United States Patent 9,518,277 (GENETICALLY ENGINEERED MICROBIAL STRAINS INCLUDING CHLORELLA PROTOTHECOIDES LIPID PATHWAY GENES) - sequence listing, part 5

SEQ ID NO: 14445 - protein, 213 aa, Chlorella protothecoides
MVAASLAALCRGGAWVEVGKRDIWSPTRIAQERPDVRASLVAIDFAPPPVLAPGMQRIAALLAAGHISPIWSCHYGLGSVAAALRTLSAARHVGKVLAAAPAPLPGKQGSAGTWLVTGGTGALGALAAAHLVTAGATHVQLSCHSRPARWEGIDAGSAACVTAVQMDVAACADGAGWLTCTPAAGLLHAAGAVSDALLPRQTLRGESVVGTVL

SEQ ID NO: 14446 - protein, 576 aa, Chlorella protothecoides
  MOD_RES (333)..(336): Any amino acid
MAASGPAVARQLARMGVALLSPAQGLGMLWEVLGDIAGPPLVLAATMRWAAAMAAVGDADRAFYRAVVASEMCDEGSTEPDASSEGPSGSEIVSDNRAPTDVAASTTHPDQAPQRQRIWTQEAVEALVLALVGEVVGSSVEATAPFMAAGLDSLASTDFLASLAKDLGLEVPVTVLYDHPTARQLAAALFRELSSKSMVGEGQASAAPKAGVPSTAAPAAEPAAPTRGQTAASKSTATAPPPNPEAPTLSAPGYFCIPPPQALARLSSAQLAALPRFVLGHRDHGEFQFLQPVDLRGARLDAMLRMDRGRARFVPLLPDGAPAPRGAALNRPXXXXVDHQELAGLAEPLFSAVPGGPPAPSGGSAYTGGEFRRAAPGGLTHAILAFEFAGGWRDVQGSVAATVLQYLLGGGGSFSAGGPGKGMHSRLYRRVLNQHGWVSNCTALSSIYNDTGLVGIFASADADRADHLVRVLADEAAALVSDLKDGEELERAKAAALSSVLMNLESRAVVAEDIGRQVLTYGSRKPAAEFAAAIQALTAKDLKASVKAALAKPPTLATLGDVARVPSLEAVRKHLA

SEQ ID NO: 14447 - protein, 170 aa, Chlorella protothecoides
MHAMRPAQGLRALQGCLAVSYPPDCLAVSYPAVRVAGAFQWDALRRRPLLPHYNEEASDPAGAISEASEPPAARSTAPKLPETKAAAPNGMQEVLDRITDLVCAVLGASVTPDAPLMAAGLDSLAAVELRSELGAAFGLELAPTVALDYPTVAALAGHIAALLREATSEE

SEQ ID NO: 14448 - protein, 423 aa, Chlorella protothecoides
  MOD_RES (316)..(319): Any amino acid
MSFTSLQSVGNIGGAQGTLLPRSFSRALPSPRRTSRVEAASASQASTDEAMGFRYDASMQRWVKDARYTGAKYNTLITPKSGTPYTIWPVMHTELVRRKVRCVEPEEAHNAVSSGKAVLLDVRLPKQFEKGHADGAVNVPLYRITAGNKLWDKIKRIVMGGMVMDATGRGEACMPLSLQNCGLPPCRSPAQRPTVPLPPPQTERDPDFSDKVVAALGRNAHRTRVIVVCGVGGTLETAVTVASTGKVAHNDPDRAFGRESRALKACYELLKAKFSKVEFLKGGHGSWRHGGFPMDYGAYSSARPPRAPGLGGVRPXXXXITNRAYSSARPPWAPGLGGVRPADVAECIPSDPFPGRAATPVRSGLGDALLRSMVLEVAHVVGGTRPHVLLRPRLHAHMPARDPCHQGIRRRLCLLSRGGEPLQ

SEQ ID NO: 14449 - protein, 265 aa, Chlorella protothecoides
  MOD_RES (83)..(86): Any amino acid
MTSPFPAPPKRSAHHNHRAPQIHRLRPWRPHAATPGRRHPGPEPRLCAEQGGGPEDLGCGGPAGRGRSFQPLGPLRALPPARXXXXVALQVEADRFNPPDPFEPFHLPAMPGVPTEKVATFTGHDPSDYLGAQAGPGRGRGPSRPRARSTLSDEQILEVMRRTLPHPGRPIAWVDLGYRNGGLTLAGKEVQLRDLWDMVQGAGGFAAVCSTRKWTSVAIALGADTSRLTNGGWLGGVRSRTFHSYLQGGGRPRVGMRALLLGAPG

SEQ ID NO: 14450 - protein, 934 aa, Chlorella protothecoides
  MOD_RES (667)..(670): Any amino acid
MSAGSRDQYALRLTIHRALTRRTLESQLCIVPTPLQACSKSDLDMNCACSDGRHVCSSFNVPNPSQRSRPEDFRWCVAHDLAFVKGHRHRDGVKAALDNYNGCRLASIESQISRNALGPQPHMADEALSLVCTDCNAQLQSVKEAQAHGLRQWSPTGEATGHSNFEESTEATTVSGVLRCRFSIPDRVCSARVGSTSKSLRQWSPTGEATGHSNFEESTEAVKRLVCTECSKPCRTIVEQELHTKRTGHTTFEDQVCGIRWVLRMAIPGVKRHGGTRAAAKAMSTEMEMAKARAVEAGEGTDKKDVELVSQFWVNGRASGSLGLHSSWRAVLSYRSATAGSDCQDEYAHVEPEVDGQALAELEAMGFARNRCGVDVRCCCDAYSKSIPGPENSLRAGALMRRGAVYELLGVRALHGSGNTGVESAVAWLADHEDDADLDSPLLLPKARLPGSPAPGEEAEKVGHTRRHPSPASRLRRPKPWQQSSSPRPGEGMGWRCVAGVAQLDLKGKPSCGSREQCLNTMAHLHSSCNRRKRELEEKELQRLREQERIRSGKELAAAARLEAELKLKRSMEARRLGKEEERKARERVREMLGGWWEGLCRTGTQRGSLCRGFWFERSCRGARAPTPLLLPCTAKVCTHHSSSASLNSSLCQAIPPLPLEQRRTSXXXXGLCRTGTQGGSLCRRSWFERSCRGAPTPLPRPCTAKVCTYHSSLCITQFQSLSDHPTPFPWSRGGQARAPCPPGPPPRAHSRGAGGGAGQGGGEGGAGGRQAAAAPACHPRCGPPAGPAGGHEAGHGRCGGGHGVLPDPAAPVRQRGQRPRQRQVPAPEPGQPGAGGAPAPRRARLPGGRGVGGRGRGGRGRAGAAGRRLACRGRAADRGGWAVALRPEQPLLRGAVKKPVTRNAVSQAGGACARHTRGASGGQEAGAGGQHRR

SEQ ID NO: 14451 - protein, 175 aa, Chlorella protothecoides
MPARLVFPWSPAGPKIRRPHRQLPAPSQRGGAPPRLPVSLGDCTPLLRISLSQPTMTALRCRAGRHCTPPNTPGVSPHGPLHTDSCRSFLKRAGGPAYGPGAGGVSGGDRLATFIMYVHAPDEGGETVFPKARTPPAAAGEARALESVDAEADDPCFRSDTLRLSPAAGDAVLFW

SEQ ID NO: 14452 - protein, 306 aa, Chlorella protothecoides
MPHLLPTTLDADLHVPLASHPLQHLVGEHLTGSAHGVAALGAIDGGAPTGHPTDGHPKIVSSVKDPQEALQSTTLPSPPPKKAKPVVVSPPDEVISGQGPSLDQATLAGGWKLTPEIFHRAASHPNAVVVSKEKPYIVQYKGFLSQAEIDHLLELSGGEPEPGSVNERAVRASLELPCAPIGWHKSSPCTPRPFNLGNVPRHPLPTDGFVRSGVVSDESVNDRRTSYGVWLSGARRDKTVLDLQHRLHSWIGIPEEFGESLYMLRYEQVGVRMEGQRVWRCWEGLSMGRKGHAQVIKVESPVQPCD

SEQ ID NO: 14453 - protein, 454 aa, Chlorella protothecoides
MQAGDWAFVDGHADCPSVSEGFKSGRNGCNKSLNCHTESACVESKPQKLVRPGPTFKRLARRNMQPTIAPVMSRMGSMGTFPCRPRALLGRCTCRDPSRLSMGSKVLVMGGMFYYTSQIICRGVVETAGGMDPGSWGARHESQERERVNVYFSLRAMSELPASTDVPLLAGSMYASRAYTSMAFRGVHTSSLPAVYSDSMGATYSKTFKPSRDSSSGVSWRVLTLLLLGVGATVYTLRSSSSSEAARVARQAAYDKLYPGSTRYGARGSMEEPSTAHAPVRKWSQRGVRRVLESEGAVQAEAAAATVRPPASGFDPERHQQYLDLPPLPAFPPSEYMGGWALTQDVYDRAARHPAATVLSFDSPRLVLFKSFLSPGEVDHLVDISKDHMARSEVLHADGDGSVSDIRTSYGHWPTPTPTTHNITDRIHRLVGIPEKFGEDLYVLRYLLGQQYEA

SEQ ID NO: 14454 - protein, 895 aa, Chlorella protothecoides
  MOD_RES (634)..(637): Any amino acid
  MOD_RES (806)..(809): Any amino acid
MTPDQELNLCITTIFCLPRGMPLTHSALVKTPHFTSIPSSCCIPGQRHSRVLIPKSLSALALLSLSLLSRPLSIMPCRAFQRSRLSSDPLGLCRAGRDRGSHVPTCESFPAHSTLPAGESGHHDDARPDPFRDLHFPGDYPSLRAAHGLQGSPGHQDAHSCHRGGQPGRRGYVGRLMGSAWPCRIVRGTLGSIDALAGGYMLVPHARYGGLLDFVPSSGCIPFLPHADHDSRESHRFVFLPFHRDNLARQGLPRQNGITHAEAGDRGAEEATFLLKTNDPAGFNIIDVSAVGCARERVWSGAAPGGEQLGTQCLRMSLRCRAWWPFLPMYVFPSAPESASPQKFSYQVLAWGALGHAAAFYLLVRLVWSYSCVARRASNSPLTWRAPSLTCIYPAAAQATTSLNSAAGPPGQFLHCPWLQASKGIGCRQESRARNENGEGRDGTVRSQCFGRSLHRMGTAENQMNASCELGQTLSQCAWGQGSLSGRPPTGGGSLAHGSRLLEESFLGPMLKPCWAGRNRSLRHVSTVSRSTSPPPAPGSRCAAPHTQAWRMGLQCRPRTTPAQSRRPAGSPCREVVSGELGVRMLRVVCGGGQLSDAHTGLRGIAPDIMQPSSEVPMKNNNRYHLLQCMKPWXXXXGIAPDIMQPISEVSMKNNNRYPLLQCMKPRHGLHSISQSLTPSPARVSHQKSRASPASGAAPRTPESLQYQESSAAWPWFLTDAWVMVASGNTVWPPLDGCLWNPGEIAAPHPGLMFLEKDSNVYVYPAPHPHHGSTKHAHSLEDEDEGRHPVPAGLAAVAGPALGTPXXXXSGDVGMQGTLERLRPLIQASCSKRKTQTWREAWMAWTWVKVMECTDLISQALPPCQQVCYSRRCDWRYGYRQLRACGRNLSSCPSP

SEQ ID NO: 14455 - protein, 90 aa, Chlorella protothecoides
MSIGEEGTRGVSSVEVYGFVGWISSFVAYVLYLVWAYTPPHLLARIGVTYFPTTYWALAIPAWGCVTVLCVILGYEACVGGLLLRLLLPG

SEQ ID NO: 14456 - protein, 150 aa, Chlorella protothecoides
MCDAAVREGVAACPFLRRVAATQGQEFAVRLAINPLKPVVDCGPSSPLFPEDAMSFQSAFAMFHGARGVMPLAPSTARTTGSCSHAQPKAQPSRGCDAPSAPQPSLSGLPVASMSISGFGKLVSGRLCSTDGVQALRHVVLCSLDQGTDV

SEQ ID NO: 14457 - protein, 189 aa, Chlorella protothecoides
MTSRLCRWPSCSGPTWQPLLPTRDWCPLAGSLLSSTRWVVCFARWGFQLERGFDVWRCELLREGHAKKSSSSGLRGQCKRAGPSKPWRQGRGGPCAVASLCSAPRWWPSESGPLTPSLPPGRREQEQQVGSADLQALADDFTELIRDSEDPVQWHLLRPRFCKKCAAWKPPRAHHCRMTQRCVLKMDHW

SEQ ID NO: 14458 - protein, 188 aa, Chlorella protothecoides
MRDLLSYLPPSNRHAAPLVPSRDPPTRSCPALNYLVPDSDAEAYDMHAVLAQVLDDGALFEIAADHAKNIVVGFGRLGGRSVGVVANQPAVLAGCLDIDASVKVLERGIGCWKGEISVLRQPDVVDRIKPCWSGAVRALLRRLQHPAGDLCGRARLPARHRPGVRWHHQVCWVGRFAAAPMALVSHAA

SEQ ID NO: 14459 - protein, 74 aa, Chlorella protothecoides
MANILRQGLGVARTALQYQQRRFAGNLPVKPNKFVEEWATRRELIEQEFKWDRKTMTQVLTFGLLVPYAIYSVT

SEQ ID NO: 14460 - protein, 97 aa, Chlorella protothecoides
MSPVGAAQHAAEAPLTGSRALQLPAPLSFRSVILLLGPTLRQFRGTAGPLSTLLLAFTAFVFAAAFSLALLAFLIMHLRLIARNQTTIEAFEKAPVK

SEQ ID NO: 14461 - protein, 59 aa, Chlorella protothecoides
MQVPDTARRQQELKASLPVLRAEIARLNAPQTFVQCAKAERKLLIMERELERLAEVEVR

SEQ ID NO: 14462 - protein, 256 aa, Chlorella protothecoides
MPHVTMAHRGLFEHLDKAEALLSKQRYLAGDRFTEADLRLFVTLIRFDEVYVVSSLGPLRMGDLAVRPDAIWGRHAGWSEGAVSMVWSSLPLAPQRSAAGVLQDEQEGHSRVPQPLQPHARCLPDPRRGLVCVQGRRVTEGQGEALHSCGGVSDDQALACMWAWLLQLVSADQQEWSFLAPCWVCAPRRMPTCLAQSLFNARAIPCGLRRGEEEREHRPPEAALLYQPPQAEHLLRHTGGRGGLVGAASRQGALLL

SEQ ID NO: 14463 - protein, 866 aa, Chlorella protothecoides
MTWSKAGILLRTPTNICAIGQGLFGCIPWGMLLTFLNDFLAQERRLSVQAATTVLLCIGIGGALGVLGGGLLGQWIYNRRKAAMPVFIGERMPRGVGCGMRGWGGWAGGGRRIPGLASGAAVRAGRSSLAPCCVWLLGPGQACRTTPLGCQAQPHRSHHLPAPPPPRSKLLEHHAGHAAHVVRAQRRRRPALHGGAGGGPGRGLRQLHHGSQRPGHAAERERAGDEGAGPGAAKHAGRPGERQQQLPAVGGVAGGMILPHVWEGVGPKVGLLLWLETLSGATEGPPAPASDDRRESISPPSCPGLKGPIHQYPPTLLSSLRCRPGTGVCCGPDLWPGSNGGAERGSCRLAALRRAHPAGRLLGGARRGGGAGQAAPVNRPHGRGRCVGVGRGAKWAKRGLNAGEGACMARRSRPWSLGAMLWDARWKLGGDGSVAVSMLMTRTCSRYMRPGRWHCGWFGRSPITKISYSIDVVHVVTPAHHLPHRDSGRAGATHCCRVSALMQGRGSPTSVLQQVETMRAQETHCLHFSCVRFPPSAPASKMSARLTGWPENLLQVEEGHEQYTTARLLIHHLKVQAVQRQGEQGGLEHGARGKVGQRAQRDGDGQRGQRRVRDREPEQRAGQPRHDSEEGRAGGQRAVHAGARHEHRRGAVMGRGAAGIRGRSLCPAAGLGGLSGSTARWERVVGRPAGRRCSTGAAAGALIPPRGPARRRPAQSRVQPGPPALRGAPWSPDYINSHHALHARPPVSPGTGTGRAGLARSGPASALRAPAASAAPPAGRAEYTRAGMGSPLSLARSTSSFRGPQGARTVRKMAIQEGQGEGRRASAPHSGVACPHAGTPDGVKCPTCRDSLSPWELCNRGCLSIP

SEQ ID NO: 14464 - protein, 126 aa, Chlorella protothecoides
MVRGKGHSLALGHADMMTSPKLMPCHVPCPPATSQWPARPTCRSPAVREHAPLVPVLPPLPSSQAPPSVGDAPLVVDMSSNFCARPVDVSKYGVIYAGECRVLRHAMWVAPSSVGCARSIVDSRTR

SEQ ID NO: 14465 - protein, 217 aa, Chlorella protothecoides
MSAWPSADECPFPRTMTTIPLPSSHIQASPITPPSPQPYKQHLELHAADGLVGAVVHVLGALGQVPGGGVGNALVVARGRGVGLQEALALADGLLGPGPRDHVVRLVALLRQVQGDGGELGGGPALQEQDLVVVRDGEQAAQVGLRLVGDGDEVLAAMAHLHHAHPCVGGMKIKGWARLHRGLMAWQAGRSRWETERAWLPPDPLSQSPFETLARMA

SEQ ID NO: 14466 - protein, 493 aa, Chlorella protothecoides
  MOD_RES (15)..(18): Any amino acid
  MOD_RES (51)..(54): Any amino acid
  MOD_RES (78)..(81): Any amino acid
  MOD_RES (214)..(216): Any amino acid
  MOD_RES (420)..(423): Any amino acid
MSVLDARWRLCQVDXXXXTMTCGAKEWGGRHDRLLTMSVLDAHWRLCQVDXXXXARHSSPAPGTRVVPGVRTSARPTXXXXPLLRTSQARHSSPAPGIRAVPGVRTSARPTTRLKQHSMAPGRTTDMTFQTASPGPPPEEGGGGEGGLWGVKSRIENVAGSALLVRCWASESHFFWALRYLARCMFTKLFDPNPPHHPPVHEWVPSPDPPNTSXXXPRQGTQPHLGGLRGGEEGRLALPRQQLHDLAHLLLKPHLQDAVGLVDDQAGQVAHQEPLGVLQVVQQAPRRGHQQAHALGQALSLGPAVAPAHHQAVGLGVAHHEVHRHVVDLQRQLARGGDDQHARAVAWHELGAVQQLQRRDQKGERLAGACAGNGCSLAPSGSGKDYPSPKSDQRSCRAACWPGRSAEKHAGESQRNFAGXXXXSDQRSCRAACRPGRSADKHAGESQRTSPGLTARQPSAVCLPGNPQEGAPRPQSHQSWRHPGHPSPGGGAG

SEQ ID NO: 14467 - protein, 340 aa, Chlorella protothecoides
MVFCSSCNAVKYYSDLLNYIDIPVNAIHGKQKQAKRTATFFEFCQVCGNLGWLGEHQWDLREEGGQLLRCDQHTQRPIAIARPPPASCCARMSRRAAWTSPPWTGSSSSTRRTTPGSTSTASDGPAEESNPHLFTLLSLPVKNLHDLHRTARGRSGKGKALLMLLPEELKFLQYLKVSQTSVTSPKSWQCRALHGVPQRSGMYSVVGYRQELLVHAASHSHDLPSTILTPPEFRPPRCRWQSTTFQCPSWPTSRRSWRTWVDSWATYAQVVSAIMHPPNTFLAETNLVHNPASSITRCRSYILAYNSHQLKEVFNVHALDLKAVARSFGFETPPKVCCGG

SEQ ID NO: 14468 - protein, 233 aa, Chlorella protothecoides
MRQESRPSHLRRTWHLEYSIRSWPAMGSKASQVRPLPSYQAHPGRVQRHPLEWMPVTICIFPPTAIQTTAGTLGTHNGAGSVMGAPSPRPANSLSQMTPGASQQHGGYSTQPTPVGRADLGYYIGHRPNTVSGTGRGSVLAPSESFAAMEDAEGDADATFIWGTNLSVSRVQSRFTSFIKTFRLPEEFDPKYLQLLQEVGCTGQAPGNWSLHRVWRGAWELSPSAAGQGRCGD

SEQ ID NO: 14469 - protein, 328 aa, Chlorella protothecoides
  MOD_RES (133)..(136): Any amino acid
MLTLQARIYNLLEIKVIRDLNPSDINRMIAVSGMVTRTSGVIPDQRCDEEGGGGGGVRELRVELCDRKRAVPIESDAYQRGCRWLVPASAAISCIHAMPGSLHHIPHPPCGAANQSPPWSYFAAWPCSAACSXXXXHAMPGSSHHIPHTPCGAANHPPPCPLLRSLALFRCMQCGHEVVEWNDRGKVNEPSTCPSPSCQVRAGVCVAWGLEWAERECPGGMGVGARLGLGPALGSTDCTQGGSGMDVVHPYTMPCHTLHMQSSHHHPSCAAGAVQHADAVQPLLLPGQAADEDAGEPQRHPGGRDAAHRHHVFTPGTLAEGGREASGT

SEQ ID NO: 14470 - protein, 364 aa, Chlorella protothecoides
  MOD_RES (46)..(49): Any amino acid
MADSPVQCLPSAGCVSSGGNLMVSSLCDITLSRSKHLNQTRFAKQXXXXPSAGCVSSGGNLMVSSLCDIALSRSKHLNQIRFAKQLEKQKTLAACPYTMMSKGWTGSLVIMACLAVAVAGPDLSNFRAVFQTDHGDIHMAFYANRPLLISLPCTPQVAPKTVDLIYSLMEAGAYNTNHFFRVDKGFVAQTADVAGGRLAAMDWRQRVGSFLRSGSKARAPGGHSRGEARQARRAFVGEAQRPRVWGLLLLNPAWPSPPPGHAVHRVWVRPGMEDEPGWAMSLFRAMGVPSTLAPLARPAKSLTPQCPNTAPVHASEVTEGWDTLTALEGVETRHEGIFVMPTSRITIHSTYTCATAEVERGKHG

SEQ ID NO: 14471 - protein, 654 aa, Chlorella protothecoides
MRGGSMIGKKLHAPPAMWLEAGWGRRTSPGVLPCSAIPSHKTAASNKSLGWYRKHGHELDIASCVDVGPSPRPVARAGLSVSSSSRTRRICVTRLNLWWHSQRLLLSVHAMADSRLCTILLVVACLLHLGNASRPHMEHALREHDDVPALTSAPWFCHDIDCPKYTVVNTSTDYEVGDGPQTVAGHFHREALPWDSRPVCRCMHPWDRLSGQQIPRPPSHNADRVGVFSTLAGPALQSIRKTLWPQVSIRAPLSDTQQPGHPLMSKPMRLPWLRPSASSHAHHLIPPAHGRHLPNAEQRLYAYIGGANEEEVKIPMTSPVRVEVEAAAGPFCKNNFTVSFFVPFSYEVNSLTPHRYRKQDTDVELMYCSPSRLGTIAASLCIPTLTHLHTGETAGTQFHGCLHSTSFPLHPQVPAFTAYVSQFGGYYMDDWSISKKAIALLEVPGVASSLRTHHAITCHSTSRPQAIQRDHGAVEGDGYTFAGYDPPFRVSVGVDAQGAADGRAGVLSPLLPLPRHGSCKTAIMRSGSEPLSKSETWAAATLCPRGAAAFCTPATLFVKSFLRSCENVGKVSWTPSKWGAKTDVDIYQALRLSQDDDEEHGAARAKVGWTLPLPFPASQRPHPHRFPETPFRSFHLVDHHNLIRGRIRNSTLYI

SEQ ID NO: 14472 - protein, 491 aa, Chlorella protothecoides
  MOD_RES (105)..(108): Any amino acid
  MOD_RES (248)..(251): Any amino acid
  MOD_RES (409)..(412): Any amino acid
MDNIRFAESGLRDNVAQVATFELLPAEEQGREREGSPVPSSPPPSPGRPASLLREEVLQQQRSWAQWQRRRRQAAGEGSGQASPRQPGSDPPGSRGEATSAAAAXXXXPGSDPTGSRGEATSAAAAAAILPFTFIVSNVHVLFNPKRGDVKLAQTRNLLHAVHGASRRAGGAPAVVCGDFNSAAYSDVHCFITSGELGLQAVDRRWASGQVRGGMCVEPEVGDEAEPARACVDCCVLCVGRCLQRGVXXXXEGEAAHASTAVCCASGDVYREAWHARHTRHRRVIALPKPRPVLSTPLPACAAIAGRGHRPRLVPHAPAPAGRAGVRGHSRLRPQGPRPLDGGGAGGGLCAPQVPAGRGGGGGRGVRRRGGGRAERRGGGRGQLGRRTAEWRLDPGRPTRHRSKEEDAXXXXPAGRGGGGGRGVRRRGGGWAEWRGGGRGQLGLRTAERRLDPGGPTRHRSKEEDAADTPADPALRVPGRDGGGAGVDHLP

SEQ ID NO: 14473 - protein, 342 aa, Chlorella protothecoides
MGPPAWSRAACCCRPWRSRCARACPMRTGPATTSAWWRTLTRAGREVCSFLLWRRLLGGWTAPPSQSPGCALPALANPQHASLLWALTHNPQAAGRLDCTSITDSRHLPPGTAHELTGDDRACSLHSPESRQAQMARGGPATHTQHSLVDLGVEDGGVVHQALGEPERQLLLRVLHSVGAVDDVAPDVDAELAADGARIGRQGVGGADDLARLLHHALALQGDGHDGAAGDVLDEASPLTQNASATPRTKFPTSEEGLGGEVGVVALGVLLGHVQELEATQGVALLGEGRLRGACTDWKPSANVSDTLQEPAPPWQPCLLAPPCSGSAPGLARPDRAGRRQA

SEQ ID NO: 14474 - protein, 491 aa, Chlorella protothecoides
MAPLISSSPPHTPPHPPHTGLIEYITSGPVVAIALEGKCVVEQARKIIGATNPLAADPGSIRGQFCIDIGRNIIHGSDTVENAQKELALWFPEGLVDNTPVLYSQIYDAGRAHPGLCDGGAVQPPSSLLHKRNEQTSRPARVKVRHQADVVAGPVRIGQARAQRLRHGRQQHAARLQAGGPIRLQAVEDVVHGAHVAVMAGGPHRLLPRHGLVRGVQGQRVCQQHLPPWIGVGWALRDPVAAPRFASRAAHARPRAIQPTRPRAAVRDPVATPRSAGRAAHARPRAVQPARPRAVELLAPLLLHARPGPEARKGHRQLLLRPGDGDLGGVAANDPGRQLVQQAPAHAVPAAADALDLRWQRRPAGTSPDAQHTAVDARTRRLRLISHLRLDTHTAPHLAGRPASIHGLQPQLARGDEAVNVAVGRRVEVAADDGRRAARAAARTMNRVQQVPGLRQLHVAALGVEQHVHIAHYEGEGEDGGGGGGGGGLAP

SEQ ID NO: 14475 - protein, 109 aa, Chlorella protothecoides
MGIHADMRVAYLALEQGGCWDGHLGPQVSPFPRQCKTSTHFPAAQQAPIAAELLKEYIAFARATCHPALSSEAAEALATSYAEMRSMGMSRKVCEIGMPGLRCLGGGGE

SEQ ID NO: 14476 - protein, 116 aa, Chlorella protothecoides
MPSDSQSSRPALQRSARAGRRMLGGPRSTEHGVVHELSKPVAGASCTRSMTRPSHVRPRAARTVSTSAVASADRPTAPKLQSHGRVFNFSAGPACLPAAVLEQAQADLLNWQGSGA

SEQ ID NO: 14477 - protein, 172 aa, Chlorella protothecoides
MTEEACGDGCMPGSAALAVPLAIARSFDMFRNLCSSTDRHGPASLPLRGAALPHQLMHSSPARAAGRYHLYVSLACPWASRCVAGLYLKGLEESIGLSVTHPTWQRTRPDSPDDTHAGWTFASPGDTPFTPVSGHGSVDCAGCVPDPHYHAKNVRQLYELAEDTFGEMWRGW

SEQ ID NO: 14478 - protein, 388 aa, Chlorella protothecoides
MCFSVFSVFFTLNGLICVELLQAFSLPFDWVSLTLLLYNTAVLGAATLFHFPAPLLLKQANLIAVGVGTAFTFTFVPEWTSWTLLVAMALYDIAAVLAPWGPLKELVDLASESGDPIPALVYSARPAGGAAEAAGARSAEAGPLLARPARPVPVPGETGGRAWRAWCELTLARQRQREGVLHGFAGTVGSARPRHWIRTHCSQDSRAPPAELAVQAGRETAPDDASPGPAVESERLLRPRSSTSGQPDGPPPFPISLWTRTDHPGLLRGTATGPESQQRPAPSPHPAASERGSEDGVWLPDGIRLGMGDFIFYSVLVARASMHSALAAGAAFLAVVAGLACTLLWLSVAHSALPALPISIALGTLAYFATRTVLEPTLLPLTLHGLYF

SEQ ID NO: 14479 - protein, 250 aa, Chlorella protothecoides
MDKKWQFAHPALHARYAEALDAGYNLLSSGQEHATLDQRKRFLRRAQSYHPAKDDRARVFLRLARLLLEHGGAAEAYDLLTSGDRLLERDSARQEVASLCGRIRHQQWTGVSVIWRGQREVVVCTRPVTLGEQHACLESLQAAASWGTCDVVSTIYLPRHPDLPGDGGCMEQGTRCVHQDPGRVGPCEERPCAGGSGRTAGKGAGDGGRGAPDGTTGNRVPGAGLCVSCGVQRPDMGWQCQACKPVRLAP

SEQ ID NO: 14480 - protein, 108 aa, Chlorella protothecoides
MAPSVLDDLGSELTAVVAPVSICIAITVWLVAVLNPDGQSNARAMSIATAAYAEDVSGERHHLEGKHVLAARHRVACRASAPNCCPVDSWFPMSRPSPSPCLLTGHRL

SEQ ID NO: 14481 - protein, 134 aa, Chlorella protothecoides
MAPTLWDVLAWHMSQPFRQLSFNAHARQQQALVNLAKQFRPPPGMVTIVGVGDWSADDRGGIMRGHPPGPWFEFVKYLREFCTVVVIHEFRTSKLCALCHRPLQPLKYPPPGAPEPRCPKPAMPPSAAPTVTVP

SEQ ID NO: 14482 - protein, 967 aa, Chlorella protothecoides
MRTCDVQAGVYPYITNALVHNRWVIAGRFEVRVGFRRFAAPQRFHLNDKSPESHRTQFHPANRRILRRCPVTSHYEPLLSSTGSVHGGDHHAVAGPDSSVTTSLAHSLVVPSSRSTTAYKRSPVEGIDRMCCAGPRLVSHIGRGLAMETGIFLGPPAPCRTLAGHVPNASQTHRVKSGGSGPPLCMWLADFLGFMVEEAVSMRMWSKQTAGRGWSSMPSGGTESGAGSRAPHAFGGVRPASHSSEQLCHQPREAQRVCTGSTWGVKYAPSFINRAHPRSIHQSGLVVPPLGELGVDDVVAARSGTPRAGRGAALRARLGPRPGRAARAAAVHGLAQGHGLLLQVLDGSLDGRRVLSRRGLLHRLHPLLQLGLDVGGRLVPELSQLLLGLVHDAVGLVLQVHQLAALAVLLRELLRVLDHAVHLLPRQRAGPRDLDVLALARALVGGGDGQDAVGVDVEAHLDLGHAARRGRDAVQPEVAQRLVVARELALALQHIDLHAGLAVGGGGEGLRLGGGQRGVARDHLGGHPAQRLQAQGQRGHVQQHDVGHLPRQHAALDGRAQGHHLVGVHRHVGLLLGQPLHQAHHRRDAGGPAHQNHLVQVGVGKLGVAQRGLQRQAAPLQQVAGQLLKLGARQAGVDVLGPIGGGGDEGQAHAGRARRAQLDLGLLRRLGQALQRLAVLAQVDALLRLEVVGQPVHDAAVEVVAAQVGVARGAQHLEHAVAHLQHRDVKGAAAQVEHQDGLVGLAVQAVGQGGGGGLVDDAQHFQAADAARVLGRLALGVVEVGGDGDHRLGNGAAQEGRRVVRQLAQDDGADLLGRKLFLRVGGCDLHVGGAVGDHTVWHLLALLPNLCHLAPDEALDGEEGVLGVHHRLALGDLARPPNDNPLANPESSTQGHKLSPDRLYTPPKALTCPTSRSPALVKATTEGVVRPPSALVMIVGLPPSMAATAELVVPRSMPTTCSWVPSH

SEQ ID NO: 14483 - protein, 627 aa, Chlorella protothecoides
MEGGKPTIITNAEGGRTTPSVVAFTKAGDRLVGQIAKRQAVVNPENTFFSVKRFIGRKMAEVGEECKQVPYRVVSDGSSNVKIASPNAKKEFAPEEISAIVLRKLADDASAFLGGAVSQAVITVPAYFNDSQRQATKDAGRIGGLEVLRIINEPTAASLAYGLDRKSNETILVFDLGGGTFDVSVLEVGDGVFEVLSTSGDTHLGGDDFDRRIVDWLADDFKAQEGIDLRKDRQALQRLTEAAEKAKIELSATSTTSVSLPFITATADGPKHIDASLSRSKFEQLASDLLERCRLPLEAALRDAKLSYSDLDEVILVGGSTRIPAVVGLVERLAQKKPNVTVNPDEVVALGAAVQGGVLAGEVSDIVLLDVTPLSLGLETLGGVATKVIPRNTTLPTSKTETFSTAADSQSSVEINVLQGEREFARDNKSLGNFRLDGIPPAPRGVPQIEVRFDIDANGILSVTASDKGTGKSQDIKITGASTLPGEEVDRMVKDAEKFAEEDRKRRELVDLKNQADSIVYQTEKQLAEFGDKAPADVKAKLEERVEAVKKAAPGEDAAAIKAAIEDLQKEAMALGQAVYGGGAGGAPGAGPEAGAQGGAAPGAGGAGAGGDDVIDAEFTEGGDNKA

SEQ ID NO: 14484 - protein, 148 aa, Chlorella protothecoides
MTCRHEGFSKAGTVRTTTLHIMGLSMSAVQVSTLEILTPRSTKMIVNVECLKAGQKPCTADSDGNIGSGNKGKNNFGTNNVGNYNIGEQGLECNLTFKMGTAAAILGETGSHGKPCCLLQGTPMWAPPTGETTIPARAIVASIRLGIA

SEQ ID NO: 14485 - protein, 227 aa, Chlorella protothecoides
MGGWARGDAGSRVLRHSAGHAPPERLLRSGMTPRKILAPQAAPPRCLHPTPCSPPFLHPLVISTPPPLPHPNTAEAVQLVKGSDTMDVWFDSGTSWASVLSEGGSAKDGTPPSPRFPADLYLEGSDQHRGWFQSSLLTAVAARGTAPYRRVLTHGFLLDEAGFKQSKSVGNTLDPRAVMLGGKDAKKEPAYGADVLRLWVASVDYTADASVGPRIMAQAGGGTGKGG

SEQ ID NO: 14486 - protein, 272 aa, Chlorella protothecoides
MLVWFGQTTQTHNYQFYIFSSRPFPFSTLKGIAIKYKSKYGALLTRTTERGFVIRKLTGPGGEIRWSAPVFLQGSAMGVGLSGGYRKSRTCIALANDQAVQSALRSQSEFGPCMHFLLDMNGTRIKRAHFDSSDQASQTAVSQDRHGGMTAKYYQVDAAMVDISVEGGSTYVDKDFNAAVYGQGVTAEGILAGEVPPPAEFQLLYTVLQQFVDETPSPVVKRELGASGHGARSIRSVRSINMKSSPEEGTALPGVALQRRTSATPSVAGIKE

SEQ ID NO: 14487 - protein, 461 aa, Chlorella protothecoides
MPHSCHPTPAPLHHTLPQGRKAIYVPGWDTHGLPIELKALQSLSEEQRRDLEPLALRRRCRKFALKTIDAQRTQFKRHVASETGGADFLVGQKPVHWSPSTGTALAEAELEYPDGHVSPSVYVSAPLLEAGPGASPDQTRALAGASLALWTTTPWTLPANRAVAVSVGMEYCVVEERAGARRRLVVATALREAVLARLGGGEDCDVGATWSTLCTLPGTALLGSRYEGPLAGDDGPRPVLDGSSFVTADSGTGLVHLAPGHGHEDFALAAAAGVAAVSPVDDAGRFTREAGHGLEGLEVLGEGGEAVAAAVAAAGRLLAREPYAHRYPYDWRSKRPVIVRTTRQWFASVSGLRSAALAALDDVRFVPGAGRRRIEAMVGGRSDWCISRQRAWGVPIPAFFYRESGEALMNEATLDHVTRIVEERGADAWWELPIEDLLPPQYRAGQPLIVLMFGGVWGGRR

SEQ ID NO: 14488 - protein, 299 aa, Chlorella protothecoides
MSSVADGSSMRGSCKIAVAQMTSVGDPDANFKTCQRLAQVCLLRAMAEAAGRAWGSAPTPLALIRHILGWSTSLSFAAPTGGQGQWLVPEGCMVQRLRHGDSACIWGSMFRGSCPPSVRRGHAPPARGHAPPQRVTCPRSSTPDPHTARPQSLAQAQPLEGPLMARYRQLAASTGLWLSLGGFQEEGPDDSHIHNTHVVLDDRGQTAAVYRKIHLFDVDVPSGPVLLESRFTAPGSQAVTCASPAGVLGLTTCYDLRFPELYQHLAFDKGADVLLVPSAFTVPTGDVVEEGGVEVGWDN

SEQ ID NO: 14489 - protein, 523 aa, Chlorella protothecoides
  MOD_RES (70)..(104): Any amino acid
  MOD_RES (394)..(397): Any amino acid
  MOD_RES (520)..(523): Any amino acid
MAPGLGLPGDVQRQGTKGQLGGFDFPLGISRVSTGGPRNPATQSPAHPPRITGGRQGGGCAASQPRPHIXXXXXXXXXXXXXXXXXXXXXXXXXXXXXXXXXXXCTRIPPPFWALADDGRRPCLLMKVPPLMCARASLFPSPVRDLSIPCMHAQADGLNPQTLTPMTRGILHCSRCCANLSLVNSSMALEVCEGAAGDLGLSTRVWGNLGAPRNDLDHFLTRRHQALGNKPLTIPYLLLAFLFCDSLHYSRSGHETHGLVTFRKLPDMAGEELNDPRLLHVLSRSRHSLEQVGAEPNTQAWVKSCASTEPGTDKLLRLLEEHVSEPSFLHSLESARAESEAAGQPDPTPPAGGVDQAPPHSHALQADWWELKPDGDFASGGLNEIWSLLLLFGXXXXGTVVVTSNLSQPERDMESSSVAVCPGQHRSSLRTASHPAPLPSSVSEDTGDYVVVEHADAVAAMSHFIAAYIVTLPEAASCDSRQLQKALAETIQARRGREWHAPSSSPHRPPAMLDLASPFXXXX

SEQ ID NO: 14490 - protein, 260 aa, Chlorella protothecoides
MFPVQKRVFEPAMAGQDLIARARTGSGKTLAFALPVAEKIMAERGGAEGRARGRAPLCVVLAPTRELATQVEREFASVAPRLATACLYGGAPAEAQRRALRAGVDVVVGTPGRVIDLVEQGALDLTQVRFAILDEADQMLAIGFAEDTERILGYAPRERQTMLFSATTPAWIKKLVASHLRAPVNIDLIGQGASGKLAESITAHAIQVAPEVRRSVLVDVLTVYGAGGKSIVFTQTKREADEVAAGVSSHLPCSVSLDFV

SEQ ID NO: 14491 - protein, 148 aa, Chlorella protothecoides
MGAELQPLQSACPPALLRSPARMPARPMDTLPCPQCTNTCSPCETPPCPPPITPLTLTTPSPTQVHGSAPDIAGQDKANPLAMVLSAALMCRHGLGIPAVAGRLEAAVAAVLASGVRTGDIAQPGKQTIGCKAMGRALLEALAAPVAA

SEQ ID NO: 14492 - protein, 322 aa, Chlorella protothecoides
MARADRDEGRQGRCGALASTEGGASPGPWRNGPSTEAHALRNGWGWPGRRFPSPHNLPLALPPRTGCMSSCHAAQPSLSEKPRHTPQGFSERDGEKVGFSTDIYSESEPLESIKRRQPPAVNIPPGPDPNPSLTPSSPKVERIAHVAFKAARTRSRRLTSVDKANVLEVSQLWREVVTRVGAEYPDVELSHMCAAGHAGLPDGCWEGGGPPQPPEDPGPLAFLTHSPPSPPPTLALARYVDNAAMQLIRNPRSFDTLVTSNLFGDILSDEAAMLTGSLGMLPSASISNDGPGVFEPVRSPGWAVPCTRVLRWLEGVPCEGPG

SEQ ID NO: 14493 - protein, 188 aa, Chlorella protothecoides
MAALAPGARLGLAAPSRRAFVARTPIPRARPAACACAAHRVTVLPGDGIGPEITAVALSVLEAAGQAEGETFTFTEALIGGAAYDATGDPYPDATYRACADSDAVLLAAIGGYKWDSLPSASKPETGLLRLRSSLNAFANLRPAKVIPELADASSLKREVLEGVDLLIVRELVGGIYFGQPRVFWRWE

SEQ ID NO: 14494 - protein, 330 aa, Chlorella protothecoides
MLLVEPLKRITIPEIRQHPWFSVHLPRYLAVMHTDPVASAAALDEEVVGEVARLGFSPSFLAASVQRREQNKATVTYYLLADNRRRMPSSAYLREEMTEGQEGGAGGARAPPAPGANPAARLVVARQWRLGWSCRARPATAVAELCRALAAAGVAWKKLAPYSYKCRVALAPAPTMVAARKEDAHACSCAPAHIGASSPPHPAPTLRMPPSLPPPPTSTLTTEGPAPSRSDSVSDGVAMEASGMMCGEEVEMEGEEESSVRPGERAPGDGEDGDGAQAMDTSIAAGGGGEGGRHVAAPRDAPTGGEREVKFEVQMYKARDGDYVLDFQVC

SEQ ID NO: 14495 - protein, 137 aa, Chlorella protothecoides
MSGSSSTTGATVRGASQCMRRRIQVVCINSVRSVKGGCNSVKRLRHCHHPCPSSSSYAAQGAPPPSEEALQEQILRAKYGGMLPKKKQGPRDHKYFDSADWALSKQGSGQPPPSQGLEPKLGPSAVPGRRVSQLGQQ

SEQ ID NO: 14496 - protein, 259 aa, Chlorella protothecoides
MYKSIVADLRLKETGGWLSEAGSNHPANYMRRNMSKLAMDNADMRRGVGLANAALPQSGPETAEHAPWHGKSPPSIVGAVIHVVALLPTASRRPSLEDISKACGVAEATIKAVYRDMYPHLVGWVLGGGIPCSPTRASSWHSRNFHAACAGEAVPEDGPGPGERGGRGQAACAGVTAGALVSDCDPPLAMLHPPPCAHALAGFALGTSVQSNFVHNKHSGKQGGTAHGQTDLKAFAAWTGLDMVLRGPVSSRPQPEWQD

SEQ ID NO: 14497 - protein, 208 aa, Chlorella protothecoides
  MOD_RES (138)..(141): Any amino acid
MASDGIWEFISPQAAVDLVRRGRVERGLLGWARTVEVAQYTDPLEAAEKLVEQAYNTWLANEPRSDDITVIIVAFDDAAASHALKHPTLKLVPSVTGRHPFLTETLSSSLHPNPPRSLGALALHQHMLTLPVAKRAQXXXXVTGRHPFLTDTLSSTLHPNPLRSLGALALHKHMLTLPVAKRAQRRCWRFPPCLAHPFNPATRAVLLS

SEQ ID NO: 14498 - protein, 211 aa, Chlorella protothecoides
MAGYNVALRMKFEQRCPECGESDFVEDHSSGDLICRDKESADPTRVGGPINPLLKDGGLSTMITGGKGVDKGLTSSLQRMQARTDSGAGDRSLVAAFREIGRLCSDMSLQDVVRHQANEYYKEAAEKSRSVRGRSQAAVYAAVVFMACRQQNIARTFKELCAYAPQASKKVGREGGRGAEEGSRRPPQAHGCWVFASAECLRIHDHTHRAA

SEQ ID NO: 14499 - protein, 233 aa, Chlorella protothecoides
MGCASSKPEIPLGPAEVVKPQPSPVQPSPAQAIPAQAGTITYSSTPPTRASTPPTYARPSPFDGPSMPKPPAPAAPSPAGKPPPSPAGMSPAASGGMTPRMSETVWMAPAMSSLSSWLSPASSGTTSLDRWGSRQSGEVLAPSLPLRCALVSKVGTYPNKPDRENEDSGACMDLTGHPGVWVFGVFDGHGPQGAECSRLALEKVSGGRLRGGLCTAISGVRPSVCGRARDWRR

SEQ ID NO: 14500 - protein, 166 aa, Chlorella protothecoides
MTLCDAPSTVTQRLPVQLHKTHSDVGKALTQALIEADSSLHRHKTRTTLSGTTALMGVVSGATLTVAHVGDSRAVLATRAAPGAAPTARQLTVDHTPRVPEEHERVTRAGAVILTVDQLEGIKDKSLQCWGPEFDGDGDPPRVWAPNADWPGTAFTRSLGDRGESV

SEQ ID NO: 14501 - protein, 118 aa, Chlorella protothecoides
MASVAGTLSKSSEVMKLVNSLTKIPQMQATMREMSKEMYKAGVLEELVADTMDSAMDEEGLEEESAEAVDKVLQEVAGETLAQMASAPSRRVAAPERAEAAGAEDEDDLASRLAAMRS

SEQ ID NO: 14502 - protein, 709 aa, Chlorella protothecoides
MIGACSLLVQPVGRPVCIQRLLCAGEAWEGRPIGGQPCALGAKKFVGRGGRGLGEGRCAFPRTPDSPRARSPKKPQAPRSVDAGLGRDVWHLIVQGLVVHGPVIHAHFVLAPVEPGHGVLHPVLVVALLEVLARVRAARLLPRLRRVHGDRRVDQAVLQLQRLHHVGVPHHAPVLHPQVGKGVDAGVDGRAALLQRGLGAEHRRVALHHALHGPPDAGRGQGTLGVPASDGLIAGALRQRGVGLAGLHRLADAQRAGAAEHHDVQQGVGAQAVGAVHRGGGGLPRGHEPRHHGVGVGGGGAHHLAVVVGGHAAHVVVHGGDDGDGLARDVHAREDGRRLRDARQALRQQLGGQVVQVQVDVVGLGPHAAPLPDLHGHGARDDVARGQVLGRRRVALHEALALRVAQHAALAARALGDEAPRAVDAGGVELHELHVLHGQARTRGHGAAVARAGVRGGAGEVGPPRAARGQDGLVRAEAVQRAVLHAQRQQAAADAVGVHDQVQRKVLHEEADVVLHGRAVQRVQHGVPRAVGGRRAAVRLPAVAKVQALPAKRALVDLALVGAGEGQAVVLQLDDGLGRLATHVLDRVLVAQPVAALDGVVRVPPPVVLWRWGGQEDHVSVRVKGCGDLISRRKRRGRSSVNGGGMGIGRGASAQDRAAAPPDAARPTQGHTFRARGILPPPPHRPTTHPPIQFWHPPVMFPRAALMPP

SEQ ID NO: 14503 - protein, 1295 aa, Chlorella protothecoides
  MOD_RES (114)..(117): Any amino acid
  MOD_RES (362)..(365): Any amino acid
  MOD_RES (634)..(637): Any amino acid
  MOD_RES (660)..(675): Any amino acid
  MOD_RES (740)..(743): Any amino acid
  MOD_RES (1148)..(1151): Any amino acid
  MOD_RES (1290)..(1293): Any amino acid
MHWVQWSCRGAGVSQSICNPDSRWAVGGRSNAGTTLATRCRRPSGKSVLSAPGVGTEKPDQQSDRCRVQLPFPAKAGNEWGGDVQGRKKRRPSSPNCHKKLRLWVWGNAWLGCXXXXLRVETVIRNSDCGSGAMLGLVAEAFPHSGGEEENLDQTPPNHALGTPFGDAHSVAIIPMPALAWTPCASGRSQAPPGIAGMATEVQGQRNICNGYHTWQPAGVRASRGRHPQPASPASMTSTRHGTRRSLLSLATAGAAPPPASREPRAAKLSYADLSPSEVRVAVLGATGYIGRFVVLELVKRGFQVLAVTRPSSGIGSKQKVSDVEKEGCGGSGPLLRIVDITVTGGPQPLVYAKALEGATVXXXXSGPLLRIVNITVTGGPPIPCPCQGAGGGHRGGGRRHRPRRPGALLLGAPRPTRRGLLPGQPDRGHRRLLGCGPRRQRECAARGACRGRRPLRPPQRHLRAAPQPGIPARKVGLRGQAAGGRDELEHRAAHRFLQVACGAGGARGHGQALHEARVNRVLPIGGPGRALTPRDQAQLLFKAFGKKEWTLGLPVGIMDGVIGILDLLAKPFPGLKVGGGPWLEIGDGGKCSRHASHDGCEVKHPGMHSFLRCHLLSIGQGAMLCDPQSVSGXXXXCEGPSPPPPDCQEAAEFGRIGRXXXXXXXXXXXXXXXXCGTRRRGGMTPTRRQSMAPTRWRPSSIGLRGRVWPARSWGTRRYSISIEGPDMLRVLPDPFVGPXXXXSTSIEGRDMLECCLIHSLVLAQVAVRLVFCEASSGGVVLSACCCPCCAETTTIRGADRWSVRVCDRVPSGPPWSTPVPRIAHMYSCECSCPGQYQAQSPRSCVPCLLHAGSASREEVFPYHQPLPPGYQGRRRGQGYHVSTPGGLATGAWDRGDRLLGACRRGGRLYSGGGFERPGSAAAHPSRRSLFEACTHSEPTMQFLSHVCPARHTHRAPPSLTPSRHPPPDQQLRPQLPLLRGGPNPPLPPGPRNGQGHAAAERVHAGECGAGRGRAGLPLRVQELRPGPGHGADRAGGGRQRAVHAPAAPGGRARAARQLRGAGGGVPGARRRAVRGRLRPDHEPGGPGGLPQHPGRHGEQRGGQRGAPRRRAQPRRAPPRSHRARGAASDAGRAPRCTAGRRLPGVRXXXXLLAVTALVALPVTLGVRRAALLAVVSQVSVTFLFFFGAATALTAAAPAAPLAELLWWRPQGAPLAFPVVVYGFTAHQILFDIYETLQSGLRGGRGVWRGVMHRAADPGRPDAPHGPLAGTRRAELAYPGAAPPHPLHRXXXXGA

SEQ ID NO: 14504 - protein, 130 aa, Chlorella protothecoides
  MOD_RES (105)..(107): Any amino acid
MTRVIHHSMALSTAMYVTVGAAGYIAYGPATAGDLLRNLGGDRASAPRRAFESALRIGFGLSILGTLPLVMLPLQAVCSRAWETVRRRAGACGPAPGVAHDPARXXXLGDGAPQGGGVRAGDRGRARPRP

SEQ ID NO: 14505 - protein, 446 aa, Chlorella protothecoides
MFWLYDNRNELPEHHRVGVVPMPCVVIWDDHGPCVGEAEQVPAGPGRTFHKPPSAWGTNGARSPTSRAVTHHSPFPSHNHNKKALEICDRVKGVLGPDTECSISLAPLDSIAEGPSLVRRKACKDAVSFSNLRSIMTRRRTAERPVPVPIPAEVSPRLAGAAAAARDAWSDRPSAVTVSVDNETSPSYTMLSLECADRKGLLYDILRALKGVDLRVAYGRLEVDEDGAGAGVTIDIFIQDNDLCRINDPVWMGGMVDRVGGYMGEELGGEEEVQYPERRGRITLETHPAGPGALPSPAPFARPALSSLPFLNCPPPPDPPLYKKGRAGGGQAPRGTGGDAAGAHHAARRLRRLLHRAGGHRTAGHGGARAAQGHVRRDPGAQRGGAGRLHGRRREQGEDGAQVRGRGASPAGRGRAGPPCNSGPCLEAPNHANTLPNPPAQSSSSR

SEQ ID NO: 14506 - protein, 466 aa, Chlorella protothecoides
  MOD_RES (59)..(101): Any amino acid
  MOD_RES (336)..(366): Any amino acid
EALAEARGVTVDGAEGAPAALALRGRCLYACGNLALAEQCLARALAADPDCPGAARPLXXXXXXXXXXXXXXXXXXXXXXXXXXXXXXXXXXXXXXXXXXXGRWQEAWDEYSAALAADPGLRAEAVAQVACNRSAAAGRLGRWAEALADAEAALGMEPGYGRARARRAAALAALGRHDEGLAELAELRSTQPEYPGLDRLLADARLAKKKAERVDYYAVLGVEEDVHPDALKKAYRRAALKSHPDKVSVGPCVCECARCPSDGFPSSPTSPHPPPATHPTPQRRRRASAQRQRSTSSWWVRRTRCSATPPSASATTRAGPAPRSRAAAPRVAAAAXXXXXXXXXXXXXXXXXXXXXXXXXXXXXXXATALGRATAAGPPSHRGPSSGRGGDRGPSTQPRRCEAPWCSGTPWMLSFRLKGGALRPLPARSFPPSVTQSLGLRRGPAPVPSADSNTVCSVCTAAVKSQ

SEQ ID NO: 14507 - protein, 488 aa, Chlorella protothecoides
  MOD_RES (37)..(40): Any amino acid
  MOD_RES (72)..(75): Any amino acid
  MOD_RES (313)..(316): Any amino acid
MGTVRVPGPTDKVYKDECGFSFATPDSQGGLYINLAXXXXSSRVASLLPPVNCLHGNILEQAPTHLPQVGRXXXXPRPAADGASTLPARTRHQGEGVGHSSRVASLLPPVHCLHGNILEQPPTHLPQVGRESGPTADAPPTQLAIGVEGGFDIGDTPKYDVVKEHALVLLPAQIRVPLPCAELPELVLQAVAAVQNWRPVLLSQDPATPPWDPPSSQQAHDSARRQDEVAAWTEERVVSKYAEGLEQLPATRSIPMDPAQVPRGRRGSGVGRGGLLALGVRCTALEGVPYTLTYTIPASTGPLPQWKCDESGXXXXGRCAVHPNLYNSCIHWTHPTVEVRRIWRHGEPVAEPVHRLHRLWPSGEPLWGVKCATTKHQHGVVGPAYWVFRPCQTSTSGPRHHTHEPHSPTPPVQNWDGTGGNGAALRHYEATGRKYPLAVKLGTIAPQGADVYSYAPEEDDMVLDPHLGRHLAHWGINMLQVAGGKGVV

SEQ ID NO: 14508 - protein, 370 aa, Chlorella protothecoides
  MOD_RES (94)..(97): Any amino acid
MRTTEAEILQASVDPAGFPITLTAETQSLARSAGGVGDLPNAWASSGRWSSCWFECKPENDDSSKQLIPALPSRLLASFQWGLEELTLVAVPSXXXXAAGQFPVGPRGTDPGCCPILGIRPQRSRTAAQPRRPQQRWYGLGALHGGTGGSPFYTADNGQGALVTKLAIDARRTFLEYQHTTGRVALHPSPLPPGIPHPPPDGVRSVTFNVKDFKAMLSLCEHLGRPLVLRMEGPGLPLMAEPGGEGGGELEAQLVLATLMEGNDGLTQATGGAPAPTQPEVHTDGEYGTEWCRRRAEGHVLSRILCNTVLHARLQCPSQETDNRISTARWDAPDADLSGAHGEEQEVGGSPLREEYVGGLPGVMTDHEWA

SEQ ID NO: 14509 - protein, 413 aa, Chlorella protothecoides
MFRILFSRCTQESEVECIRMATFPMLLSCTPAARLARSPKGPAVHGSMQRSTWATAAYRRQDRFPSIRASSVDADNESRLEALESMARGGKEQKGAVEKRPSVRPNLTQAAKADMGPSTEWGERDLFPKGWDDMPLPMKVSQLWMGKRGLLFWSNKLAWAAVIGVGRADSRDDCTDPRNLHLLDVVLGAICHSIRQANPPSPPFLSCALKTMGAAGVPSSKGPGRTRPRQHQKPAADLRLPAISHEDAEHGEVAGDPTSRVSPSIEQTWCTYIDPKSLQAWYAAFRLVAEQQAALLKGSPLLSGALPDLDDLALRTHPYTSPSQASWVTSETSFSVYSLGTSPGRLLVCDAEKNIYGSHYHIREPESSTIKLTAAEFVQCARKWKSKLLVLEVSLVHWDDSGAWLTKALLLLA

SEQ ID NO: 14510 - protein, 538 aa, Chlorella protothecoides
MPAFNYLTAFFPWPCPLQLTGRSRVFLFPPSMAFQGLYPYPVHHGYDKYSMVNLEEPDVAEWPLATRLKAVKADWGPGGFAGRDWTQGARHAITCNGGTLRLEFHRVPRRVGRCNPSSRVGRCKPSRFAHVEMLAPEDLMLTLELGQGARGLTPGAAAVHLSRALEERICEAESPKAVREWLLRIAAGMEIEGVDLATVKGYKRIVLCQGVRDDVEAVLGQGAWSTFLPSMCEGRLQPTPWLNKVRDLNQICIDLMPGQKMCPSFKYSYFSLSSPDSSRTFGSRSILRMSQSGSRMTAPRKRKSILSSSGTASELEAGRFPRTSAPSQFLDITFQHHTSLRVSKLNRSGVNKCPPHRPNCCSTMRRGGDLLRGTWNGVTSLKHKSLVGSSRLPPPSASLRCSQPDIAPLHVHHDPIHPFNHTPLSKIPSYLKDLCKGQAICRVPCPLQRAQDGPRALQQPDRDVARLGVRVGQSLADPDDLLGGVGLRARDVQCLVHRLWRPACDGFGGDDDLGRDEEGGKNDDSQKGTFFWRVILGG

SEQ ID NO: 14511 - protein, 449 aa, Chlorella protothecoides
MAASHRRIDWQNWRGTHNDGLKNNVSTSRDARYPAHPLATITSHYPNLTGDVSCDRNNKPGVVMQIVVNRTVTDHKEGEACEDTQLPRQPNEMHEGYPIFTPPFGLSIQPAITDIGPSLFLQSMGPRALPGRMRRDVIDSSFSAGPLTELSPPRPCPRPAFPVIPSPSLVRCVQWLDSRKKHPAGGGWHRHTRQAGGPSGTGRGMMGVECGVGTRPACTVAHGVAPYGNASMPMPRMQADLTDPTSLPAALVGIHSVIDCATARPEESTMAIDWESKVALIQCAQAMSIQSLSLEDTASGLCSSCQHCASFITSNMDLCTPCATLIHAGLIAAQVCLLLHRPLRPPPGSPPHEHQERHGEVSAAEWGGLHHPAPVWLHAGAGRQLRHPGAGGSRGVGDQGRHTHSLHGHPGHCPPGPGIFEVWNGVGLGIDLKDSLLFGKGIVDRGTSL

SEQ ID NO: 14512 - protein, 460 aa, Chlorella protothecoides
MSGASVPGLNREQVEKAAKALLTYAQKKGQESSNLLLDDELIYLNIALKKVPQTPRKDKPVRLNIPHPIYSLEGAEHPNECWRWSLMACTCESPPGEGHKASKKKVKEEQIAGVTKVVGLSKLRYGNSGIREGLDGGRLLWKQQPTGTYHPDLSRTKYESHEAKRKLCNSYDLFLADERVLGSLPKLIGKSFFKKKKQPVPVKLVGKDWSGHISKAVKATYFFWTGAVAPASQSGFLGPPTPKMRYRVGLARFAVCLICGYYLLFVPPTPCAFTSRATTNSDHPHSLQVVENVIAALKDALPHIPKQWNGVKVGGSAGRGELLSTWGGGGSERLFALALPFCCRKNARSPGAFPFSMRSAQSSILDTGAVHEDSRLSGSAHLSSLPGSRCSAHQGLRLSFAPASMLPLVVLLTYVLGMTASWPNCHLQPCPPSLCGSCHDGTEQLRGHRHTRIVGCPWEA

SEQ ID NO: 14513 - protein, 665 aa, Chlorella protothecoides
  MOD_RES (302)..(305): Any amino acid
  MOD_RES (491)..(493): Any amino acid
MAADGAGAGSALVVEEFPIEKRSLKALALLSLKRTYDLFHSSHWESIPLDEASQKVKISCKVSVKEGMDACIGGPALLVAGHSVRDGRVPVTSVPLHAEQMPVPCDCIFLLQISDEYASLSKYKAQAVPGEPKATGSAPKTINSTLIDSVQAQEKGAASGSRDKQLVVHGSTASITPAAKAALSTTIMVPTATGGQVRASTQRWCSMANASCTRNCNLSVMSHCCARSYQSDLFEASVTDNVSAMQRDAHSSTEGVCSQLCHCPANPQQVATARMACSLENVPCHLGAPWADETRLESNCLXXXXGHLGWVRSVAFEPGNEWFCTGSGDRTIKIWDTASGHLRLTLTGHIEQVTGLAVSERHPYMFSCALDKQVKCWDLEQNKGWGVALHNHSSQGALSSNLRSHLPLPHVLVSLRAGLGIKDLAVPSIAPWISTALTCVQVLGRFAPCPQFAGCGTFGARSRSTACRAMKTLFLPSSASPRTPRSSPLRXXXSSASPRTPSDAWLGTTYGIDLLRDMRTCQILQAVRGLTAHPTEHTFASGGADNIKKFKLPRGEFLHNTLQQQRVRCCTCSGRSLVVVRHKAIINCLAVNEDGVLVSGADNGSIWFWDWKSGNAFQQQETVAQPGSLESEQGGWAVLGLGANGHSLRSGCGSFLDEVLPATLT

SEQ ID NO: 14514 - protein, 213 aa, Chlorella protothecoides
MFHGEQVLWMPDTEQTRRRVRAPLPRVVRGKARTWARGGSVTDRWEGHCGDKEPPSSLEHFLRADGPAPPLLLQHSHLLQINIRGATAMATVDPRLDLISKSIRVVPDFPKAGIQFQDVTTILLNPEAFQATTDLLVEHYRDQHIDVVAGRHRHSGQLRMPPLHAASACGPFAAVYCMVPHNSLKVCLNIVHCKTILHKESESTSLQDLRPEV

SEQ ID NO: 14515 - protein, 255 aa, Chlorella protothecoides
  MOD_RES (31)..(34): Any amino acid
MHCNCAALMCCDAINRKPIPSSPGATVSVEXXXXVRAASHATLACCIAMWPFCCCVLHGAPQLIKSATVSVEYKTEYSVDKIEMHIGAVKEGQRVLLVDDLIATGGTLGELVLRGKSVGVASVACDGAVKTLIVVDKCQRLSCPHGPCPVAGAELVRKVGAIPVEAACVIELPELEGRRPLGWTIQCDLQRDPSHTRAKHESEEDHNTAHGWPSPLCHLLRRLRISGGGRVSNARATVRQSVANGHFTKGICRHC

SEQ ID NO: 14516 - protein, 479 aa, Chlorella protothecoides
MVSSVGERASTSSEATETDDENTSQGLKQRKRHGGVPAAEQQEPTHATLHHRPTTRARARRGAITLKYLIDKGVLEPGKDVLSLVRESVLGAARQHDYKDLRQLASLESDGRIHATVGGSTFVFEVRDAAFTPSHQADGGGDTLNDTQKPTSLRPFVPNSPHRAFRSSSRGSSCPPGRPMMAGNLFGMEHSELGLGEGAERIDGAALEQSSSAGPAGKVDYRYIDLVAHTSLFSLHCRALDCLNSTVNSLSDTDHESLSKETISEASLPPPDAHQYHLKEIIPHRSQHHRCRSNFSIPTACAYYTTDLCQRMDEQRPSMGRSVTSVLSHPYDAATRTNKKSSGVGTLADEPSHECSTLSSSSRRAFLSQTVIRKLPLPEYITEIFGLIQGQSYSARNQPNRTSANVARLAQIRLAAHKSAQQQTQGFFEHSRYGAPEGAEGMLPKAIIKADQRKESTGPTSHMDWRRQLVLLPKTPLAP

SEQ ID NO: 14517 - protein, 152 aa, Chlorella protothecoides
MSGESEAKLRGVFAEAAAAAPAILFIDEIDAIAPKRESAQREMERRIVAQMLTCMDDLAAAGSGGAPRGSAAAEAGPGMEVDEEVRREPGKHVVVIGATNRPDAIDAALRRAGRFDREIPLGIPSEEGRARILEVMKEGVGEWKARGMGALG

SEQ ID NO: 14518 - protein, 106 aa, Chlorella protothecoides
MAGLNIGETTLEATPTGQATTSAQAVQQQQGKRAGTPSRPSLCHQRLPAHHRPGSSKRARVAGGVRLASALADPRPVFYADLGGIESVLESIKELVERPLRHPEVG

SEQ ID NO: 14519 - protein, 354 aa, Chlorella protothecoides
MTPKIRNELDFAITQPIANPGIFAAMGLQQGAGVLLYGPPGCGKTLVAKAAAAASGANFISIKGPELLNKYVGESERAVRQLFARAGAAAPCVLFFDEMDALAPRRGGETSQSSERLVNQTHTHSPQPLHQLLTEMDGVDGRTGVYLIAATNRPDIIDPALLRPGRLDKMLYVPLPDAAGRASILRALTRRTPVGGALDLDALAASQRLEGFSGADLAAVVREACVAALKEGLAAAGLGGLGPNQAGPLVTQRHLEAAANRVQPSVSRRDRAMYERLRDRLCSARGHILGEVGGWVGERAWAELRMGRGYVRGRDAWCREGSWWCGGEIGYCWTPWCAKQPKRQRGLSAPSRIL

SEQ ID NO: 14520 - protein, 317 aa, Chlorella protothecoides
MAVDLLQALRSGGQALVAAKSYYFGVGGSSNAFKNAVEAKGGFSIRSLAVEGGGASIQREIIVQMPPGRVRRNKGARGTAGAECKKATLRGSTANWLWYRGKHCLERGGASQEQRDASGDVLAGYDMRLLRLATGGLHQAPHAPTGASAVGWVDMVVHPGVVHARGWCGAMPATRVPGEWRIHQLSLLLGGSLLQLTLSEGWDWGAPEVGENHATPVAEDGGAGGDGGGLLECPRPGAQGLATGGGKHDVGAPIARGHGSLLMPGFLGTSPGQAYPNGSRGVVRELRIGVGVWYMSGVSGQEPEGRWGDRTPACTRC

SEQ ID NO: 14521 - protein, 116 aa, Chlorella protothecoides
MEKTEATMTELQIAKNIDFEFERMTEAGATLEPLSGPGHVGLKNLGNSCYMNSVLQVLWSFPELDARYLAQYRSVFETAPRVVPDDLLTQVTILGVLPLCQTRDLCHGFEGRPWVL

SEQ ID NO: 14522 - protein, 247 aa, Chlorella protothecoides
MEVAVDMPARLSLEAWRSSGVQEDEELQPETQEDPGASATGDAGSNAPVPTLVDEGLIAQLVGMGFSEPGSRRAAAAVNSAGPEAAMEWLLAHMDDAGINDPLPDGGAGSQSQPSAEAVSALTGMGFTPAAASAALQACAGDVERAADWLFSRMDSLAELESAEVRDSEATPLASRVRDGPGEYELSAFISHMGANTACGHYVCHIKKVRRMPLSRCLWTVVKIFLHGDYLVVPGISMQHGPSAVKA

SEQ ID NO: 14523 - protein, 100 aa, Chlorella protothecoides
MSARTGLGRLGGSLSEDRALAERLEALLSSLEGSLDLDDLSSSLRDRYPEYRRKKTGPFKQLVVRGLETVRRKHPELFADEVREGGARKELEDWEPVDLL

SEQ ID NO: 14524 - protein, 115 aa, Chlorella protothecoides
MAEMVDAPATPQPHVSGPTAAGAGADLQEPPAASGRQAGEQDTLTRAELEGLAITMADVESAVGKVQPSVRREGFATTPDTTWEDVGSLQEVSGRVAYYVGMCVRSCALDEQHGQ

SEQ ID NO: 14525 - protein, 258 aa, Chlorella protothecoides
MLPSSAAVRETYLGPTGIFSLPPRTLRPSLLIDSSTIDPLTSRDLAAAAARTTLHPDVVEGAAGAPSTAPAMLDAPVSGGVGGAAAGTLTFMVGGPAEAVARAQGLLGTMGRATVHCGEAGAGQAAKLCNNLVLGVSMAGVAEGLALGQRLGLDARNLTKIFNGSSARCWSADTYNPVPGVMEGVPASREYTGGFAAALMSKDLGLAQEAAAQCSAALPMTAAAAELYRQLATEAGPAIDFSGVYQHVYGGQAVAANS

SEQ ID NO: 14526 - protein, 191 aa, Chlorella protothecoides
MACKGCPGRAGDTSTTTRLPSQWVKLGRALVHGLTPKEEGEGGGEATPLTSVAPSTFKTLVGRGHAEFSTNHQQDAEEYLGYLLDALEKTERAAGPDRLVCGGETPAPKELVTFELEDRIQCTVSGKVTYKRSKATSLGLRIPLDAATNRAELEARDQKRQRLENEAPEGSVDKRVGCGGDGAMVVTALGE

SEQ ID NO: 14527 - protein, 177 aa, Chlorella protothecoides
MTRSEALLILVGTDPTITSALTFAVLEQEGLHPGCTHPWSISTKYYDANISVRLLDVSDPTPSQPDACILVVDAAVGESLSRVQRWWETRAIDGSSVRVLAAYGADEEDPRLEAARAWCADQLVELVAVPLPGDGAVTHQRGRDPHPRGAAGPRVAWTASEALPSTWESGDVCGWRE

SEQ ID NO: 14528 - protein, 156 aa, Chlorella protothecoides
MKITELRLAKLVGAVPSPANVAARRTGQLQAHLDPPGESLRSPITTHVLDTARGKPASGVRIVLERAAPGSSNAWQHVGAGKTNGDGRVPDLLPPAASVAPGVYRITFDTSEYMRRCRDEHPAFFPAKPFYPRVSVFFEILESQVCWRWMSWEPGA

SEQ ID NO: 14529 - protein, 189 aa, Chlorella protothecoides
WRENDLVLLEVSINGERVEPLAAIVHRATAYNIGRALVKKLKEVIPRQQFRVPIQASIGARVLASEAIPALRKDVLAKCYGGDISRKKKLLQKQAKGKKRMKARGAWAGPGALRSSTVLVGRPPGAVPPEHDAVLPASHGLFLSRARSPTNSAHPLSPFQSSTQSLGKVDVPQDAFMAVLRINRTGGED

SEQ ID NO: 14530 - protein, 62 aa, Chlorella protothecoides
MPPPLQWWPVAEVPGRLAFDHKLILRCAFQHLARQDATPAALAAGLRDAAAHLEGPWRQEPR

SEQ ID NO: 14531 - protein, 269 aa, Chlorella protothecoides
MSGTHTYQCAGSSEMRIHVIRQCAPVCPRTPPQTHRVRLCRYPRPGLTVDAVMVTGEERPQVLLIRRKNDPFAGSWALPGRAGVHGVPSPRHTAQLCGAWARRVLGASQPSQETRHARSLPHRRVCGRRGGPGRRRRPRAEGRDGAERARGRAHPGGFVDEGEELGAAAARELEEETGLSAREAGLTQVGAFGEPGRDPRGWCVSVAYAALLPAQAEVMGADDAEEAQVAARLAVRRGHTCVHGATAPGSLFSHRACNRCTQGLAPGGS

SEQ ID NO: 14532 - protein, 741 aa, Chlorella protothecoides
MAPAGTRRPIFLPALETGWSQALAWSARDQLRGPAGELCGGGGQRGARQRLCLHAQAAAPAGHQQADGPGRGHQPGPGQPPGKAGGLRGALRPAPGDARRAGGSGLGGPAALLVLAGVRVPVEIAERTQRPLEVRGVARGGRPSGGGVQRGRMTRQAAMRAQDPSFQAGCRATGAPTAKHIHVPHGNYCTIFIWKRLQPSHGVRKQRNPCLPCGALCWTCEPEAPPGPQQTVPDAEIDLTRYLTARAWSLLCSKSLKPARCWGSPECPSGVASPQGCSSALGRSAFSFDMTASTFLIGAGMRPSVLGRGAGGNEGRWRMGSASSPAADPGPFPLIPTRRNLGCSNLNCPLCKTCQRRRCEQNFASKYLAPCDVLEAKCGAQIYVVVVDAMTGQLVHPDIDDPHLQGRPAARHRRTRRASPPVPLALLASSRPLSSTHTHMPPLPPPGTHPDLHRGRASVRAGGGAGGGAGIVHAAGHAARPEGHRLKRGAAAGARAALPPAGAPGGPAGAPLPRGQARAVGAVRSGHRARQGRGQGRHPARGRPREQDRVRGRADAAQAGGHRRGGRGGGGGGPARARELRHARGPVPGAGGAGGGEQAAARDAEAGAAPDQGLGRGARPRAALRGHRRAPARLPPRRPHRRGAGLPLRRAQRGGPQPPAGPAAPAPEPGPAQPGDGGRHLAAPGRRRLPRGGAPPAAPGLQRLVARGAPGLGAAAADHQRACAALGRGGAPRHRHRLLHL

SEQ ID NO: 14533 - protein, 441 aa, Chlorella protothecoides
  MOD_RES (402)..(405): Any amino acid
MWRGGVRCLCAVSPLPFPPPSPPTVWAPTPPPLQIDLYRDTRESIQLAARCGLALKDMQPAARERAFQREMKAENNLHPAMHSPQGHYLVGAPRALDRLVRGSLQGPWAFAWVDRHAFGGGGSASGDQGPNAVPADSAAWGTGLQGGTGLQGGGLGCRDPTKAKPPVTPPKMTTADAARRLPWDCAPAPGPQGHPHPLSQLHRDLRTAGGGGPAPAHDVLPPLGPVAEWLGPGCLVSWGRAPNQWWNPSSLPPPSTPPPPPHRQPREQGACHRPWRHPGFLLDWGLYVLLSATQPGKKTASAPPRDGQTPVLKAALPARACAIPFRLVRSAAWTGRGQGARGIEFQGTTSLDRSHPRHTLCLTAAPSTASNRSSVALEASAAHSAEGRERGSSAGAPRAAPXXXXRWRPARLTAQRAGSAARRQAPRAPRRRLAPLARARR

SEQ ID NO: 14534 - protein, 285 aa, Chlorella protothecoides
  MOD_RES (185)..(188): Any amino acid
MARSRVGTGVGGQSWAWTPLKSRPLILQGRVPPPRGTETAMRGGRGRGWPAHTLEAQTVATGVKFGIRAKDQSPIAFGSRAPDITPCRARPVPHALGSRPVISHRSSLLAFMVTACITASLPAASRCLRRPSSGLGARAPLTVRPRAPSLRCRRVVHLGLGCAPCTNPPPAIPSFPTPCRAASEXXXXSRPGYTLCALPCTNPPPAFPSCPIPCRAASDGSQQQAIAAGVTVGLGAMMAHPLVAEAAVTPSLKNLLNSVVAGGLLLGAIVGAITLVSNFDPVRRQ

SEQ ID NO: 14535 - protein, 117 aa, Chlorella protothecoides
MTSVESVGRCCRQGREHSSHLFPGVWVAADAARARGQLDHPATLCTPQIGMFSFTGLSPQQVENMTNKVWLKGGGRMAVCAGGSSTADQRPLVVGCLPTTWQPRPERCPTTHPSLAP

SEQ ID NO: 14536 - protein, 506 aa, Chlorella protothecoides
MGAVDWTPWRWPLPIQVKLVLGHDRGTAPDVAACPWTQHLGPSCKAVVGCRCPVHHPRAPSPPARSPGRVGGIQARNLNRQAEPGGASGLPWGLLRGAAAPPHVHILATPRAGAGCQPPPRPLALQVGAYRTEELQPYVLRVVGKVSTPGQPRPQPTGRRGAPHPTLAAGWPQMHTLAGTPARRAGREEDAGAGRQQGVPEHRGPARVSGRDGGAAAGGRLRRGEGGGAPGGRRGRRCLGCRKGGKWGALGGRRGGRTPVPRLSAAGADVAGAAMGVGKGGIGGGLGGRRGGRTPVHRLSAGGSNTFSSNPLPTASLPTPTPRPLDTPILLPHPVAQGRVATLQSLSGTGSLRVAAAFLAKFLPGVAVYLSRPTWGNHKNIFGDAGVEWRERAAVQCCIACPEPLERAGSSGGGGAASRDGRVTPCMLPGQGVWRLGGADPSPAPCPAPTPAAASPLTPPCRSPPHAGCAHNPTGIDPTREQWSKIADVIEERHHLAFFDVAYQVG

SEQ ID NO: 14537 - protein, 587 aa, Chlorella protothecoides
MSSAASTELAQAPAPAFHAYLDFKAIQRDPTSLVENCRRRGASADPERVAALYGQFLELQQAADRVRAERNQNSAQMKAKLGAEERAALVAVGRRLKGELEGLQGRLVSLEAALQVEGQRLPNATHPASPVGGEGAERLLRSVGTPPAFAFPLRDHVELAAHLDLVDFAAGSTVAGPKFYYLKHEAALLEQALVAHALRALVAAGFVPHATPDLVREHVFERCGFQPRAANTQVYSVEGAGLCLAGTAEIPLAGLHMDAVLEEDQLPLRLAGVGHCFRTEAGAAGVQGGCGGDRAAGIGRRGCRCDPVNALSSPHVTPAPRPSAPLRPCATRSPRLPTPPTHPTHPTLPGAAGRGLYRVHQFTKVEAFVLCTPEQSEALHEELLELEVGLFAGLGLHFKVLDMPSGDLGAPAYRKYDVEAWMPGLGRYGEISSASNCTDYQARRLNIRYRWAWGGGWEGGIASFLGSPRERGCPGSWPGTCAASEHFCRSGNALSRPSPRLHPHTRRPRLEEVGDLGTRRAQGTRFVHTLNATGCAVPRMLVAILENFQQEDGSVVIPPALRPFMMGLEVIRPRKEALREAARAGGP

SEQ ID NO: 14538 - protein, 193 aa, Chlorella protothecoides
MTHSPRASSWSGAWRSWWRRRGAGTVEGATRGQAGGHGGLPERRRGCLDRAAAPAGGIDTHTHTHTHTHTPPSVSCPWLGAAECKAAPPLLLIAPLADAPPRPHRWPLPAFPQASPSPALSAQSYSKNLGLYAERIGALNIVLASSQAADRVLSQLKRIARWGSCRAPRCGGKGCEGGKVQGSLPSWWRGWGE

SEQ ID NO: 14539 - protein, 738 aa, Chlorella protothecoides
  MOD_RES (227)..(230): Any amino acid
  MOD_RES (574)..(577): Any amino acid
MTPSQHTPLALDMTAPWHRCAAVLWFRSNGPWHYVSSALRVVFSEGPAQVLSSPRFSSAGGASRLCGVPDFWPTRRPCSPSPPCYFLCFVSDSGGGAESPMAIDEAISSGMWGAGNVIPEHTTFRVSWDFCPASPSHPSLIPIRLCIPSTRTDEPTLTGVRPHMKLVDRPAPALFQTSTETNEDDPPAKRSRRPSTLHTPKYVAMDDGGDDTDPEFSAAPLAASHVXXXXPTQSSGTEWRLLLERGNFCGGRSHCCPSSSFSRDSAPPTTCSPRTTPSSAPARRPRQGLGVRGGPSKYRGVVWHKSNSKWEARIYEGGKQKFLGYYTSEEAAAHAYDTYAGMLEGYGIAAGPVHFACSPVVSCVGRCRDLVLFSCFQDNGCPGPVHIACSPVVSCVERCRDLVLFSCFMTMAAQKLNFPELYASGAEVYHDPGTPPVRHTAPGPRAASPLARPPPSPRKAGKSRVQPVKGTSRFRGVSWNSNCAKWRAQVWKGSEVHHLGYFEGEEDAARAYDEAVLRIRCVLALFAICKAESMCVGSCRLSSRFYAMIKTAPSPHPLLNPAPSPTTRGPDAPXXXXCNDQDCALTLIPLPTPPPPPQLPGVPTPLPTSRAPSTAPSPSRATTTSRAAPPSAPPASAASAAAGQLPGRGLSRAPLRRGLPGAERRRRADQLPAAELRGGAGRGGAARHGRRAGARVPDLGQRLDSGGAGGRRGGGGEQQPAGRRRAARRAGRARGDAR

SEQ ID NO: 14540 - protein, 636 aa, Chlorella protothecoides
  MOD_RES (4)..(6): Any amino acid
  MOD_RES (149)..(152): Any amino acid
MRLXXXLEAGKASRDTIPWRSKCLMLLLTGKLQWLQIGHAAAVFAAPQCTLPARHVRCRIAGLQDRRTPGSKPAALVRLGTPLTAFDLKEDHSIFAAGTAGLLVGPCECPWGRQWQWTSMRSPGHASRGQAGDEDIGGAGVGAPLPSLXXXXRWVLVSVLGGGNGSGPQCVPLATHRAARQAMRTWVAWVWALPCPASCPTWRRTPSPMHSRLPFIHESPTISALTEGIVYLYDPRAPAGPLAALSSGSRRPITGLHWQHCYHSPPSRAGNDGRAGQETRSARPSDIASSGKAPTSTAGQSGTALGPSSRRPDALPGLPADSVAAAGVCTSHSTLANLGGAGHVGGQPTGPSDHAATSGTEASRAMDAARCREAAGARAASGAAAAGLAHPESLNVTPFVGFRHGVGPAGSTAPSAGAAALEDIRRRLPLAIGSRWGTEAGQDRAAFTPAPQVTAREWSEGPRWEAAREGGDAGSAGGAQGPRPHASEPTSSTASANANPALQRAPSGARLSSPAKSSPGTDSGKKGADMAQEGWRIPAVARDSPPRSFRPGREAAEGPGSPDGSNESVRPMEEDSLLGTAPAQGAAAGSPLRRQPPPSLASVSRDDLLALHLDMLNQFQVGWTAGLKGEVFEAVP

SEQ ID NO: 14541 - protein, 270 aa, Chlorella protothecoides
MSLSKGHRNGRCGSSLPESLPDLGIKGADASYGLLAPEDNDFSYARFSDDDPSVAGGAELGLEAGQQQGGHAVPAGHGASHGSEEFDFGEVMVHQAIHAIEFVLGSVSNTASYLRLWALSLAHSQLSAVFYDRVLMAAIKSGNPIAIVIGAGSFRCVVGGKWGGWVISGGLGSALVRAAPGACAVILSRDLAGPHPDDARTHSHRVLCLLGGHHLRADADGVAVRLLACPSSALGGVPEQALLCLGPFSRRMACLGAWHARHGEIMTSMF

SEQ ID NO: 14542 - protein, 583 aa, Chlorella protothecoides
  MOD_RES (449)..(452): Any amino acid
MNPLTQIKNTQKISKDEIELGLSDKSSWHSRFKHSAYIFAGGLPLNLTEGDLLAIFAQYGEIVDLSLSRDRKTGKLFIVGTRVDVQIRWRTIWWLRQGWCLALQSSPRPPARQSLKAKGLCLSGLRGSAVHCSSGRQPLGRQGLWSHAPSGTCGQLPEEARRGESVSEAEETAGVRGPDMEGEPDPGSGAEDTARPDPVRSRSEAGAPDAPARQPPVPADEPWAAGSSVFSMLNAPLPPNLLRPAAVSGANSDKPKKSKKEKKEKKEKKEKRRGLSPAPPSPLPRDSPDDEEGAQGRVTTPAAPAPQPLARQGCPPSQAESIKGGTAAQLLACTAQGPGLPLAREVSAMTVSACVRVEAQLFEVREPLAPTCHPVYCPGSPKASHPRHVSALHAALSRPGHCKRTENPVQMAEGLRGCGVGLNHERAPQHRLARHAWCSSGVPPQVMPXXXXTACAPASTGATRLVRLRCPSSGHAGGHAAPPQVGGAAQELVPQAAGLPTVPGLLVGEVQYHGSHAAYREVAHQALRRLRASEGEVIVQGWVMEKGVDTTGASVAGGGEVRRGSGPKPPLKSLGVHHRLSHR

SEQ ID NO: 14543 - protein, 636 aa, Chlorella protothecoides
  MOD_RES (264)..(266): Any amino acid
  MOD_RES (463)..(466): Any amino acid
MHGKKPACHTMSSPSRRPALPSRCPHDPFHAFFADRRLQPHLHGGQGRAAGRAADPAQGKHGLPGGWVGVWHARHGHESNRYCLSQDPAPSPGDRICLPEHTHTRASPSLAPCTQVQRVLDEQKREAAANKDRAVAAAVTAADAAAAVGSRFLVTRLDVGLDAKAVQEAWNAIAKAHPSLPVLLASAGEDKALVFAGVPKELAPGFPAGEWLKAALGAIGGKGGGKPTFAQGMGPEVGKLDEALAVAGKLATLKLQPWFGKMTXXXCPRTPACLSSTFKAMVGEDEPLMYCKMHGHQRAGGPTRRPLGHIESGCRWRIRARERGRAKEGGSLRHAHGSRVQQDRALHWDSHGMFLLVTGPARSTGVYCFPSHRDVVLSPPHAYMVDASQPRSRSCGGPWRGLPAWARCALRGKPMGSADVELQAAPFSWCEGLSSCVPGPSDAGVVKSALTAPYNPKSSPTPXXXXPPFPVKPYPHRRPQAPEPPPLHLQRLLAPGRALRRPLPPGAGGLQPQVPLAPCPGRLCRGVLQVRPGHDGAQPRRLPLPRLLHGPELRAQGRRSCGGSEHALLPRLPAALPAAGVHATHVQPGPGAGGAAGAGPTAQVQRAPAAQAGGHPGEDVPPGVPQHLRTQVGWWV

SEQ ID NO: 14544 - protein, 225 aa, Chlorella protothecoides
MDLFRSEEVHLMQVKDRGTKSMALLAQWSVTEYGRAGDRLCQRGRRPLPSLPPQLMIPSEVAHDTIVALGEVGMLQFKDLNPEKPAFQRTYAGQIKRCDEMARQIRFFQSELEKREIPVARRGADPPTPDLDALESQLAGLETELTQLNANTDRLDRSYNELQELQLVLETAGTFFEDAHSNALQVRDEHALTAEGEWFNSCWEFQGSCLGDKLWQGRARCFSLV

SEQ ID NO: 14545 - protein, 315 aa, Chlorella protothecoides
MGTGDYPAELLAGCSGTSLHLWRVNNVNSSPPVPNSHPGQQPLEVVAWNRNNKVVAGARADGSVSLSYSNGEAMSVLNRPAGSSAIVTPTALAWASGSKRLAVADRNGAIGVHDMTNKVGDRIACHSLVDACCGWHIGWSVGCWRRTPTGAHWGDAAPAVPSKTRPVPFPPPSAGERWGSVSLGTNAGGFSLLRLLHTPTQAFADTETLPASTLDSQWSLGHAVGQGPAACWTTDPGTWHGARHMHAPGLQLGLPDPGPRRWQPERVGPALPADCCRLPSAGPRGDLQRVLSSRRPELRVRCRQGWQRVVPGERG

SEQ ID NO: 14546 - protein, 296 aa, Chlorella protothecoides
MLNTPPNDPSTDSFTVRYGKNFVKLKAFNLTQYDAVLMVDADTVIVGDVAPLWSLPTPFAAVWDQYRWLGRHRTGLRGLNGGVLLLRPCPAVAAHMAGILESHPKLRFTHRAAEQDFLDWYFRYTGTVLPLEYNVQGDAHSSRGWLGRGVLVSERDGGSTAASSVGQAAVHAEGFNGGLGPLPRLTFPPPATESPVGFQGRFGTTAAPDLPPSCHRGPRGIHPLLHNPTLYDHLTLRRTQTAQSLVGNLTVGGVAPVVLHFTNQKPWHGREPGRLGHQFLCSAADLRRRSVAAGMT

SEQ ID NO: 14547 - protein, 573 aa, Chlorella protothecoides
  MOD_RES (310)..(313): Any amino acid
  MOD_RES (389)..(392): Any amino acid
AAAAAAAGPLTNNISAFSLRSVPWLGSRAVRPQGSGDSMEPRSGPGSAVVAPAQREMPPQHPPPSASSSMEWYVADCARTGVRYVVLQGSDTLDHWRVNLTFDPVPFEGAELGTQVHRGVYELACALYPVFLPLVREHVMAAATDSPGAPPRRLAFTGHSLGGSVGVVLSLMLVARGELAPRHLAPVYTFGAPAVLHDGTNDGLLCALGLDEGAVRGVTMHRDIVPRAFACDYAPLAEVLRRLSAAFRGHAGLAPGAGRQVSAPGRGPEGGGRCGPHGARACGREGRSAGRANGARGGSSTRRGNCSTPXXXXVGPRGARACGRERRSAGRAIGALGGSATRRGNCSTPPAGGPHEPTAAAEAPPLHGIACHVPPRGAPVRAAAAGGAXXXXPKPDPSLCPPPPPHALNDPPPKQYTQAGHVSPCGPTVRAAAAGGAALHGARGLPPAPAGRARPLPLRGARRWYAGGDRPCWPCTLVHRTQHQALHPAGLPGKRGVGLHERHPSAGHAGGPGGLRSRRQHLPLPQPGQLHPRLRRGPAQRRRQARARARAQREGGARAPCPPGRAAAPGRAG

SEQ ID NO: 14548 - protein, 658 aa, Chlorella protothecoides
  MOD_RES (72)..(75): Any amino acid
  MOD_RES (380)..(383): Any amino acid
  MOD_RES (497)..(500): Any amino acid
MNPAMTVPFVALHSACTGEWPRNAWGQPQGLISGSWWQRPSVARAAPALVALESSPGHAQRGGEQDVTNISXXXXNSRGMAAQCLGTTARPDSGSWCQGPSVARAAPALVALVSSPGHAQRRGEQRGEQDVTNISASTGVTGRDGASQERALILASGFAPYSDQAQWSWPRPGGGLVLSEHAHGQHSGKAHGPLKITDPVAFQKMLADMKAKAEEQRWVVCLGLSALDCEFIRLLRVYSMLPELLTTSPKSTPLLAAKREAERAKREGANYKPGASESIPARALVQCCSSHPHTQAADEVEAVGRKVDAQRDYYATLGIESCAAVAEIKAAYKKLALLYHPDKHKAEDAEQQVGLGKEGGAPCAGRIVAASLPSGEGRQXXXXSSIRMLAPRWRSLRWPLSGREFAEWGGKAVRPISTPCFHTQAAIADKFREAAEAFEVLSDERSRGLYDKVRDYQVGFVGPLMDVYGDVIEVYLLSPADRSSCFCSSHSKLFFTXXXXPIEGANPGRGLPLLSREEAAMMASGAAELARLRRLGTKHIKHAPSARSVALPLEQLNSGCMKTVTFSRRRVDDHGIEYNSTRSFYLVISRERLARLPPPPPHELPRSISLPCDRKGSQQGDVLTFESEGDETVDTQPGDLLVTLAAEPHPRFRRSGEG

SEQ ID NO: 14549 - protein, 400 aa, Chlorella protothecoides
MRCSRSAGCAANPEAFPMPPTPHPGPKDLETFCGLLPAAQFFAAVEVPTPSGAPRTLCARILPQLLASGGAGGTWVGTVRGQGLFDHDDPWGAPPGDLRACLRYPALRLRPGSVRVAARPGLLLLFGSASDPISGAALGGLLAAQLAHEALTQDLREGEGEGACSADVARRQTLVFWDLGRGRGLPVGAAAAAQAVRVLRPGAHLCIVQGVELLDEEMAALESADAVVLVAAVSGEGSEGGAGAMGVTTPKGRVPAPDLSASPGGARASTPSTPPPPLLLRTLLAPLLARGAAVAGMGGALPLLHSAGVLPWYCACAGEADGGWRGLHREAQRSAVPCVGVAAGAGYRVDALTGEAHAIVAPGTDALVAAASWEAGPGEPQGFEADEDRGFLLALEPGAA

SEQ ID NO: 14550 - protein, 416 aa, Chlorella protothecoides
MSLARKLRGMDAPSGTQASVPRKPRRKRGSNKNGKQASYRAGLNLQPRNAQYKRTSQQPPQQGSQQLGFFGSVPSLQDLRRENRRNTRRHYRAHGRQGDSTVWWPCYVPFTLAHSLGSGTLPGNSRGQALLPSGGNAVPLPAPLSVPPAPFNSTRQALACLVVWIILQNEMDHMWACLLPACACDDQIYCTLLSSLIPLPSLPFVATLNPLATPALEPFKGGGHGTMFDASGVNFYGSNEGLVLPMDVFPTSSGSSSDDSEVAGARHDCVSTHSPGPSGQHSIHLPGAGHEAPPPEREAYIDRLEDENLRMSTLFGGMHPQQGLEACLLIMELKERLELMAQELEELHRAAGGGKSAGDSMASPSQSGASHDNESDAGEVTGQSKSVGVPVSAGGAPTSNEEGAITEPISSNSKDD

SEQ ID NO: 14551 - protein, 331 aa, Chlorella protothecoides
  MOD_RES (157)..(160): Any amino acid
  MOD_RES (207)..(235): Any amino acid
MSSSRSSMPSQGVPAGHVGHTDFRHSTSGIADQSIGCRRNLILRDDPPTWSGPRRGHWHDFRELPCAPTDPREVPGMLSEEEPTHSFKILLVGDSSVGKSSLLVRFTTGGFEELVPTIGEHGFGPKDMGAMQRLAALHWHLLQGDVLHRLAPAPPTXXXXASPPGRCVDFKAKVVELNGEKIKLSIWDTAGQERFRTLTSCASFLAXXXXXXXXXXXXXXXXXXXXXXXXXXXXXSPSPSSPAAAAAYYRGAQGIILVYDVTRRETFESLEEVWLREVDMYATVEDAVKMVVANKTDLVGCWVGRRVLVFLNVGPGALCGVSGCLCCTQPH

SEQ ID NO: 14552 - protein, 347 aa, Chlorella protothecoides
  MOD_RES (248)..(251): Any amino acid
MMERRPRAPTPRPAASRANAAMPAGVTANPAPEAASILSEAADELGDEAVVDEVALLHGGQRGGGRRRLAPMPAGAVGALARAHVRAEADGGGGQALADLAVQAHEGAAADEQHVAGVDLHRVAARVLAPALLRDVDHAALQHAEEGLLDALPAHVTSHGHALRAPRDLVDLVDVHDAGLGGGHIVPRRLVQLVQDALHVLAHVPRLRQRRGVGHGEGHVDQPRQRPRQQRLAAARGPQDEHVGLVQXXXXTSRASVRASNVLPQPEGPRMSTLDLSSSTWSAGSGGGGGGALNAAPAAAPPRWPGSRPDRLRRSAARVGAPGGVMPCAGGPSPPGPPPCSGRRRRL

SEQ ID NO: 14553 - protein, 126 aa, Chlorella protothecoides
MAAIEINKRMTGARDAGAILDIVQTESDRFDTICLATAMHKLANMRGAPNLHSQIVTSPAFHKLKALMRARGWEGKGEKGRRGWAVRSPAGQVGVGVEAWPGMWLTVLTYEVEPCTLASRNECTPG

SEQ ID NO: 14554 - protein, 330 aa, Chlorella protothecoides
MTPPGAPTRAALLRSLSGLEPGHLGGAAAGAAFNAPPPPPPLPADHVELDKSNVLILGPSGCGKTLLARTLARLTLLARTLARLVDVPFAMADATTLTQAGYVGEDVESILHKLYQASGYDVAAAQTGIVYIDEVDKITRRAEGVTVTRDVSGEGVQQALLRMLEGSVVNVPEKGGRKNPRGDTVQIDTSDVLFICGGAFVGLDRQIGERLAAASIGFGAHVRAREGAHGAGRHGGQSAAAAAALAAVEQRDLIHYGLIPEFVGRFPVPEVDGVLVDADADQAVVHVCRGAGALAAALEARGLRAGAGGVAQPLRSEHERDPEPRAVFAS

SEQ ID NO: 14555 - protein, 198 aa, Chlorella protothecoides
MILLQEDLGIGSLGHRHAILRARDELREGALAEARPASPIGGPVQPAAASSLMRVHAQRARLARALERAVARQAHRAATAQHAQHSVELASDEVRRLEARIAALDCQLAAGSVGLSKQGSALGLAVLGPGMDLAVPPTGEVGGLSGRGSKGGLSGAELVLGGESGRQRCEVGRVLVEAHHFQSHSAGVSTRHNWTGDV

SEQ ID NO: 14556 - protein, 673 aa, Chlorella protothecoides
MNQLLSKDVLYEPLVEIGAKYPDWLVAHRDELPAEELERYGRQYEHIQRLLKQYETDPEDFGALLDLLQQARKKLDEESGQMKVPRYVASGGGATEWPSSNWVPGPEIGDAAHQSPSLSAHLSRATVTASHSHPYSSSHDAQMQACGQPPKEIVDELAPGGEGLGAEGFPLFGGGAEGSPQGPGDCCVDDVKCVGSTGRTANVVGVPLDRAVSPLSTCSRSAPSPRLLATPMKPDHHTAFGVSSVTFLLQKSSRDCLDPPRGRGHASESRTCSHPQATLGSAVLCRSRSYRCISSGKAVLKRACTAVLRSLQPGGHGCLAYICAPRNDQLRVYGTEELRLQIQACQLPPNLLTVRLPPFPCKPGWQPNLSETQRWAAELQAAARYKEFTDTASQLSNVPQHLHCDFDGGMALEKCKRHAATCTAPQSEGQAERPMPYSLLGSRPGSPCVNVPHLEECGVDGRLHLPSHPALVLVTAPASASFGPATCDTVVSTTKGRSIPLGPLPRERSSTRGTSRQPLPMLPTLPLPPMNTLIQGARIASRAAEMPPGSPPFTMLHGGHQRSRWHVTPRGCAPPGPQSGAGSRPSGPSGVSSSRWVSAASAATLPSLRGVPPSPNSKSGGRPIATPGEGEGPSRPAPNIPATGVSSAASGPAAHARSAPGAAAAGAAWGPAS

SEQ ID NO: 14557 - protein, 284 aa, Chlorella protothecoides
MLWASAGLKGPSCGSCTFMTSTPTSTPLSSNPTPGMVIPRLNGHTIPYAVGAIGAIIMPHNLYLHSGLMMSRWGVDSAGVNGDDDGDGSIPRLLRSAMMLLQGWRQVLPTLQCHAPIRPSHPLTFLNHCRSDYIAVVSVRRALRFVKWACSVVTERRVHGCRHLLACRAEMCESIFAPPVPIAPTLPLLRSVFSGAFYNSLVAPQVGLGNAGFELGKMFGTAIVSCRDPLAFWGVATGDAFQRRLLCRSMLLHLPPHPTAHLSFRLSRGLSGRWACWRLPMPPQ

SEQ ID NO: 14558 - protein, 206 aa, Chlorella protothecoides
MDPGNLASDINQGAVVGYSITWVTGPEPLSRQASLARVGPAVAAPKDRELDRGGNTPCFTPFPRSPPPTPQGFIMQMVAARLGMTTRQDLAQHVRAEYNSTTRTLLWMFVEVGILTCDMVEVIGGACALSALSGGAIPMWAGVLITGATAFMCLALESVGMRYLEFLLMLLIACMSGTFLYLFIDTHVDYIATLKGESAAGRQCWG

SEQ ID NO: 14559 - protein, 425 aa, Chlorella protothecoides
  MOD_RES (204)..(207): Any amino acid
  MOD_RES (345)..(348): Any amino acid
MGSGKTLGEGVHWTKVMPGLRAGRASWPPPKPLKDTPLCVQMLGEDSELVQELASRGLIETHGLASGATREELVKRLIVALSGDHLGSIFTRRTTGNTHKRPAASLSGATDAANGTGTAVAGGAGGAGTKSGALLVYRELASMAAALSEPELLVCAPELYVFLGGGYGKGGSDVAGPRAPARSAVGLPEGCGAKGVQDSRIAGXXXXIWFLGGDMEREEAMWQGPGRWRGRRWDCLQGVRPRRSGQQNRRAACPAALTRRGTPTAVSHLSPPAAVPLHGAGPADQCHDERPRQVRRLPRLGACLTGGLRAADPTLHRPLDTHGGPGPVRSRPTWCPPAHRSMHTXXXXIHAAGACLTGGLHAADPTPHRPLDTRGEPGPVRSRPTWYPPAHRSMHTHTRPSPRPSPRLAPSRTPHAHPPAGPRRR

SEQ ID NO: 14560 - protein, 230 aa, Chlorella protothecoides
  MOD_RES (33)..(36): Any amino acid
MQASIADSQGGLGGRRQVAVPVPVSYGGQKQRXXXXFSGWAGWSQASCRPGDCFVWRPKTTWQRRRTAPSLDLPKSTVEISRPPACLGCPGCRTSSQVARLRGCTHGVEKPAYQEPAGAKDPLVPDVQEQPRSTVRRESTQFVDEWYCDSSSKQFLSTQGNATICRDFIFGSYKDLKKANPNFPILIREASGVEAKLIARYDLGVEKTVSIDGLPAADISKQLEALVTKA

SEQ ID NO: 14561 - protein, 265 aa, Chlorella protothecoides
MNEGETFIRWAFGGQEVQGGWNQRMTAYSGVQTLRTCWLSMTAPAPALHARTPICLPSNTPSSILSPGRPLFPSDLEQLKALHEACFPIQYEKHYFQNAVHGRAGMRSWAAIHPCRTSGDAEEARSQNQVVGFVIARVNSAWDLTPEEHVGLGLAPTDGTHLLYILTFGVHEVGLACLVPALATSGGCGWGWTQRQGCHGLQGCSGNVPFRWMAWLSGHWSNRASRSHLAEVATAGFGRPAGAGSGWLFPPQWPALHLSAHTGPE

SEQ ID NO: 14562 - protein, 196 aa, Chlorella protothecoides
MWRTSWPTSPRTMVRAGSPGMMDILCQSSLMWLSILWHVGACPLVCSPCGTSGIHFTLPPHHPTPSLQITGAITIIGGGDSVAAVEKAGVADKVSHISTGGGASLELLEGKVLPGASLGGGGGGGDQLGRHGIRRRSERGGGARRVISPWCVSSWSSDLENCEVLIRYLLRAWLVRYVHAFADWWEQQIGGSSIEL

SEQ ID NO: 14563 - protein, 253 aa, Chlorella protothecoides
  MOD_RES (26)..(28): Any amino acid
MSETDVHSPFSHAGCSTHPRMRRSTXXXLNIQMVARAMSKPRNPESGCAARQAWVFHSPEDETVDLAQQALDHADLGRDLGPTHDGDKGALGLINGPCQEVELLLQQEARHLGAEVGRHACRGGMRTMRRAESIVDEDVAAGSQLLGKLRVVLLLLRMPAHILQQQHIPVLERGDLTLRRLAHAVGGQADGSAQQLRQPLRHGGQAGLLVRALWAAQVRGRHHPGTVLHQVLDGGEAGTDAGVIGDLLGLLVL

SEQ ID NO: 14564 - protein, 767 aa, Chlorella protothecoides
  MOD_RES (389)..(406): Any amino acid
  MOD_RES (700)..(703): Any amino acid
MKRAEDCPALWVAATIMPQDAACTHAAVAHASPSSTQVDNLFKRDDSLYCSNVSANADCIGLLLTAAKHPPDTSPWTPLRPQDGFVDREVSYRGVRKYLERRCGAAATEMARRDGRNDIPSMADLSDRELEAFFLGLLRALEAVSALCEGASGLFATCSLIDAHAAGTRCPRKWPARTLRDHLALASSPCPHPPLSWKNLADGRLLLSGVTLENQMEEVRQMVHAAHFISRRPALIRADLCGDADNKDVLFDASTLPKLESPLVPRKLGKSLKRGTRAWGTPAAEQGLCGSQDGRWQDWRWRSPGAAAAEWARPTHPWTAGIVDKLELLRMGPLTCPVRTLAVLIGTIDLRLLSGKDKDAAWKALQDSVAEASRLYPLDGVTEVAQLEXXXXXXXXXXXXXXXXXXAPLPPVSLATVEVAGVVYQFGAGAPPGAAQVGEASQLTTWRPVLWAQFHGPQEAQAFYDANLAPIEASGTAQIIRVKEGPHMATSAPPAEGHLAHIGQALRDRMQQPWREAGLLEAAIGDEADSVAAQPSRTAQPGSQRDGAAEQATPLVSRPTRRGDGAPHPAEARTPGVQEAGDGNGHIRMRGSPLDQSDDESDSGLEYGMDAWQTAHGSEGEGTTDGPSDSEDLGESDSEDEEVDGMEEEDEGLEGAFVMEGVEQDDTAYRNSGLITAEELWLTRSDQGSLCTLTLPGSKXXXXSHNAWIEINLVSPVVGNIILVKLIDQENMMSRYEDEHEWPNIDMTHLGVYGKCITLPSWLAPQY

SEQ ID NO: 14565 - protein, 606 aa, Chlorella protothecoides
MLLALSASYTVLANCIMPESWSLCIWTRIRIVAAMRMWVRSDRTGSHQTVSIGQAAHQVLGVTHLELQSVIGMQALEPESLTVVDEIFEHATSLAHSQYVIHGAAHAHFLEKVQAQSRGQMEESPRTLPHFRHLRALINPRWDELYRTRCAPALAVHDGLIRGAMHRAREVRDGISTFDAGGYYGEANAIALAHTGLEWGDSLHTTGRLMESAGRCPAPPNLLLRFAFLFQFFESYERAVRSKRRSWSGALPGQVGGVTVTALRNLDAWAECSAPTLGFCAAVDIIIPLQAYDRLPYTCRVHPCRILDDVGGAFGMGAVGGGLWHLFKGMKNSPSGARFRGGIDVSPLAVGIFLPGRSVLTLEGPVYMSRCFWHAGLIPGPVLWWSGWITAPILFAQQQNVCIRCCKKATGFLPYISYSSCCQAQSIRREAPKIGGSFAVWGGLFSTFDCTLLALRKKEDPWNSIGAGALTGGFLQLRTGLRSAARSAAFGGVLLGMIEGVGILLTRMTAPPPAPVPMVEMPGPAPITGKGMAAAVEAPVGLAPSSPALEMPEPVPEAGSSWLPSWFGGAKKEENRAPQAGAQVLPDDRFAPPAMPDFGASEAQYR

SEQ ID NO: 14566 - protein, 1108 aa, Chlorella protothecoides
  MOD_RES (1009)..(1012): Any amino acid
  MOD_RES (1104)..(1107): Any amino acid
MSPPRRACCASAGFVGVMGSLSVSGGYGAIHLPDEAETIGNESWLRHKCAGSHCGEEDLRMSSDDHIPEERRSPALTWDIPEIDSSETLQKGAPITAELNKIAVDHLTTLLGVQLSAVLQPERVVEWLPVIWRLADAAASSLSPSAVTAHGDLNPRNYVEVGVLVPGVLPLQGEFAPEDSEIVAGVCLLKNVAHKRMPISAQHPRIMLLSGALQYKADTLSSLDSVLQQEEDYLQKIVQHIVSFKPTILLVEKTVSRSAQDMFLEHGIALVLNVSLAALERLAMCIGAEVAEDVNTLSGRNVGFCKDFAVSTWIETSDSGGAAATPASYQPGQALVPMGKQQSLMSFDGCPRPLGVTVLLRGASIEELNKVTTILKDYIFASYWNRLEVAFLTSQFLAAVAAAPSDPQSSVGDLEEAVTLAAKACRARQQVQHGAWSPSPFISFYAPPDSMYDGAAPVSAAAVSSRAPGARPLASSQHKSSSAAPATLVDVPQSILVDVGLDAENEQRLSPEDAIATPDKFTSTEPVLGALSLTIMCKNPSKGVMCEAPHAISMPFYRDADVPLGAFMAHAAPVGQRCPHPECGEGAFVHLRNFMHGDSMVTLSCIRLGEGKQLPDDRLWIWLRPLQQASDTDTHRVALDADAACISFAHFMTLLLDVRHLELGGTDLQTDYVRYIGSRSVILCLHYTRATPYTIQMPSLPLDWQSDLELRWLQQELKDFTEVGARWLDLSVSLDVGYNYDSVSTLLQTADEHLSNLEAAVEEFWRTLQIDKQGHATWQQALKKTRRCLLSLGKNVHSHIVAVNTQLPSDTILSPLGKNVHSHIVALNTQLPSDTILSPLVWEINYAKRVSELCLKAWSERLERLQQKTALAKTTKEPPAAEIPQLGATGKSPSSENLGRSLEPSKDSPPRHQRGHSASLAEQFAQMYVRSPANIDATSKFATPFLNSDAALSEASELGERDNVIIPTGLVARYVAKFQESSQQQSPHPSINSAALEVHSNTGAGMFGXXXXPLCSSLRIRPSTRQRWRCTAIPGQVCLDSPGDPARVRELASQVSNASFTRFHRSAYVAPEVNAHQCGGDIPDCAYSSTLTILFDCHLNNRGXXXXT

SEQ ID NO: 14567 - protein, 296 aa, Chlorella protothecoides
  MOD_RES (49)..(52): Any amino acid
MFCPLQAISSRLVTDKRECSRESWMMWICPSARGQASGKIWLTVLAAVXXXXFCERTGIRPDLIINPHAFPSRMTIGMLIESLTSKAGAVCGEFVDATPFKSSEGDSSSVWEGYGKKLEAAGFTKNGGETMISGITGQAFDVDIYIGLVYYQRLRHMVSDKFQVRSTGPINPLTKQPIKGRKFGGGIRFGEMERDSLLAHGAAYLLHDRLHSCSDYSVCDVCTNCGLTFSTMAVPLAASEASGVRATADISRSSVTCRVCETSKFIERVAVPYVFRYLMAELCSMNIKCSLNVQCL

SEQ ID NO: 14568 - protein, 405 aa, Chlorella protothecoides
MHADSGGPELPHDASGPTSLVLYTCPHCEGHFPAESFVEGGPDAPMFSDRCHTCRYEEHAQMQALLAAQVVDADAAALAAGSGPQMLQYVGDGGGDGPPADAACATMRCDKCGVTRGENPGQDASSSTCLGCLGKGCGVPLIATPEPKVGGPKEQDAAPLAPHPLSGCDAHHADTKTCMHCGTTKELAAFRGSKNKTDRLQNRCKVGRPCDGRPRLRGLKRGQRIHRWGSRAQWNFWLHELLPLSFRHCVQECEVALGRGAKRDKNGPLVVRVEQKLCRRCSEVKASDLFFHSKLSLDGLCTYCKACQKELNKQARAKRPDVLRPQVGSVWAVQEHALLSAVHVVSSPGPRAVRAGMCGFSSLGSALGASPEALRLGPFCPSHKNTGAGEGVSALWPRQASRPVF

SEQ ID NO: 14569 - protein, 273 aa, Chlorella protothecoides
MIRAAAKNHAHVLVVVEPADYPSVLEALRNGKADAALRRHLAWKAFQHTATYDATVAEWFWGEIGSGPAPERCVPMKLGATLRYGENPHQTAAFYTDVSLGEHGRGGVATSLQHHGKELSYNNYLDADAAYLAVCDIVDPACVIVKHTNPCGVAAREDLLEAYRLAVRADPTSAFGGIVAFNRTVDEALAREIREFRSPADNETRMFYEIVIAPGYTPEGLAVLKGKSKALRILEAAPRAPSGDSLRQVAAGWLQQDADSLVPSQVRRVAAPA

SEQ ID NO: 14570 - protein, 224 aa, Chlorella protothecoides
MGRKRNVSDLKEADLKGKTVFLRADLNVPQDKETQKITDDTRIRASLPTIQYLVKNGARVVATSHLGRPKGADKKTSLAPVAERLSELLGTPVGLASDCVGEPAQSKIAALKDGDVLLLENVRWHAEEEKNDPEFAKQLAAGSDIFVNDAFGTAHRAHASTAGVAAYLSPKVAGFLLQKELDFLAGAIDEPKRPFVAIVGGSKVSSKIGVIESLLGKVDRLILG

SEQ ID NO: 14571 - protein, 178 aa, Chlorella protothecoides
MQIDFKVVSEAQPTPQQLEDIKFAWQCVKHVKSNAITVAKDRRLLGMGSGQPNRVKSVQIALEKAAEEVKVGPQGVMHDGLVEAWCLMLSGTLGKGSSKILSSQALPSNGRLPSAQGSVLASDAFFPFSWNDSVEIACKAGVSAIVHPGGSLRDQDAIDCCNKYGVVLLTTGVRHFKH

SEQ ID NO: 14572 - protein, 302 aa, Chlorella protothecoides
SLSPLVCSAALGPAQTGAPVNPQTLQSPSPPHSCPRFFPSHPQSGRGGHAGNGVHGVWRPVARGHAALTTRRPHLWLVGPGPQGGPGHRAGAALPALPLHRAPGPEEHSSPPKLPSSPRSKYTHTLPRSANVLLMRDGTAKIADVGFARVMSKSYMLSSTGGLGTFAWRWEVCGCGGELESGLLGGGERHCCMRRRAVGVLTPGGRLGLGWEHKGCMGATSCVSAAWRLQGCIGHIIRPGLVAGTARAMLCTRPTQSPRAPSLNARNPPPPQLHAAPPRCSLATAAAPSPTSTPSASCCGRS

SEQ ID NO: 14573 - protein, 100 aa, Chlorella protothecoides
MRPMRVPEECSQGVVDLFDACLAQDPSARPDTRSLVTRIQELLDEPVQGAAHGAELDAAGDRGGGRPAAAAAQGPRGSAAPAQVPDAARARADAPPAADA

SEQ ID NO: 14574 - protein, 446 aa, Chlorella protothecoides
SAAAAAAAQQQRRQQGSGSSSLRGSLDAAASPPTSSDAGLDAAGPGAADQAWHLAPEEVTICRRGDGTFLQIGAGAFGTVFKGVYRDRHVVAVKVLHRAADERRSREFVHEVTLLKSLSHRHVVQVGWAGLYLWRVVGLWGCGPGTGGSALGPLEASRSRPPLLVPEPAPALQGPQLVLSFPPPSPQFLGACTSGPMAMLVGREGGVVFKGRSPLGRGRGAGRGAGAGLPPRPEGGPPGPEERQHPAIAHGHGQDRRRGLRARAPKVLPLRPVGPGHAGVEVRGIYTEGLGRWGCSRMCGTGLGAVGGGPHRRSPAHASGGGVHDIPGLPCMRDPPAPTTPPSHPQRPRGPGWPAVHREGRHLLVRRAAVGDRDRRGSRAGPHAQPPHARGVPRGGGGAHRHLLRRGPLRPPHCAAARAAAVRHAGLRPPARPPPLEPSFPLQTAP

SEQ ID NO: 14575 - protein, 125 aa, Chlorella protothecoides
  MOD_RES (68)..(71): Any amino acid
MFDDVAVRRVALILLTGFTARLKYYFVWSVAEAGLIMSGQCYSGLSQKVTVGSRWSRETLSLGVEEGXXXXSGQCYSGLSQKVTVGSRWSRETSSLGGEEGAWARVQQATLFWAEPGEAPSVRVP

SEQ ID NO: 14576 - protein, 1761 aa, Chlorella protothecoides
  MOD_RES (39)..(42): Any amino acid
  MOD_RES (1419)..(1421): Any amino acid
  MOD_RES (1447)..(1450): Any amino acid
  MOD_RES (1475)..(1478): Any amino acid
  MOD_RES (1542)..(1545): Any amino acid
  MOD_RES (1575)..(1578): Any amino acid
  MOD_RES (1728)..(1731): Any amino acid
RAAHPSAPSCAVWARTRSSTPVTPPLSRRSPSWGAWTWXXXXAALNAGGRFVEISKRDIWSAGRVAQERPDVGYSLLAVDFLPAPIIQSTLARISSALASGALAPLRSIAHGLGALAGAFRQMVQATHVGKVVVGAGEAGALPGRAAGGGIAVTGGTGGLGLAMADWAAATHAARHLVLLSRSGRTGEAAPIGLLASPASMTLAAVDASVPADLQGLVCGGVLEGLPITTLLHAAGILRDSLLAQQTADSVRRVLAPKLGPLHALREAPGPLAATLLFSSVASLLGAAGQGNYAAANAALDAWAHAQMASGANATAVQWGAWASSENHLPFPASCPPWASPLGAPSISILEQRHQSIPPTPPHHPGMASQAVLKRLDRIGQGAISAEQGMLALGASLRAVHAVPQIAVNAFSWDTYLAPWTGPEQARGPVPTMYAEFEASAPPALVAPIGAAAGGRRKRGVDANKGGAGTAAPDAAALRAQVAATVAAAAAEVVGPGVGEDEPLMAAGLDSLGSVEFANMLSQRLGMSMPGTLIFDYPSLRAVGDYLSTALLKKQGAGGDGAAPMPEVDEDGDVPSDSDGEASDGEAPSRGLRARPAASPAARPIALVAMVSQGLQGDILHASPGTQAIVALQDAVHKDCGVGGWGGDAMFLRSQDSAGRGRCLSSSPQSTPSLTPPNRCANHQFGAFMSEIEVFDAAAYGMSVAEATIMDPQHRLVLSLATQALLGSQGLHGAPLPRTGVFMGISWTEYGQLAQAGGLPISAYTAQGAVLSVCPGRVAFHHGLKGPAVAVDTACSSSLVAANAAQEGLTRGAGGAIDAALAGGINMMLAPATSAMFRKAGMLAPDGRCKALDAAGDGYVRSEGWHSKHGSSISICAPIDASVLAFLVGSAVNQGGRASSLTAPNGPSQQDVIRAALAAASLLPAAVSTVQLHGTGTQLGDPIELGAVSELLGAGRAGAGAPLRLLASKSQLGHSEPASGIMGVAQLHQAMTQALALPVLHLRTPNAHVAAVVSEPGVYSMPRQPGAAPMRAPAAAAVTAGASAFAFQGTNAHVLLQAGAGAALAPVLPPAPAFEARRFWVLAEPHALLGGVLALDPRTGTVTFAADLSAPKLAALRDHAVNGRPILPAAAFLECAAAAAAAAAGGARDGVQAVLQVTIPAALELLQAGAQGARAHQHLLCCSVDAGSGRVRLSSSRAGSRLRDHAYGLLASIHLGDIGAGVSTAPATPSGTVTALLPLSVEAAGSGGPVGTITCLRPDGRVGGAGLDAAALDNAFHLGALDASALRIPAGIAAYRVAAAPSVVPAPVLAAGCAPVSQSTTSALNDYWVESAAGRSAGVQGLEARELGAAARRASGGSPQAAAASTALEYHTVWETSVVVAGGLSSARPTASAFDLAQGVSTQHAAIMALAGLQAAAAXXXAGGPRATLHGRRQRRRAACPAPHRAXXXXWKPPGHATRPSTATTRSVPSAPPRXXXXPHLIWHRGPPPSTPRSRLWQACRRRQPRRAPPRWLWSRVPAPAPGLSPAMQRPRCCAACSRPWXXXXAHAADTGPCRGAALGGIKDPCFSGICRPAXXXXDTLVFGGAAVDDGVDAHGLALRGRTQQTPGLAAGPPLAESKTRVSLASAAPRFLITGGTGSLGRLMTEAILTGSAGGATTCTLVGRAGRLGSSGDAAPLLAGLPTDATAVSSLVVTSGDAAVAADAVHLLAAEGAEPLAVLHAAGFLADXXXXGGLGGWAAAVTPRRCWPPSQPTPPPSPAWS

SEQ ID NO: 14577 - protein, 547 aa, Chlorella protothecoides
  MOD_RES (147)..(150): Any amino acid
  MOD_RES (496)..(518): Any amino acid
MHLLAAEGAEPLAVLHAAGFLADAILGNQTPSALRRVFGAKTSSAEALRAGLAFLPASQQVLFSSVAALLGSPGQVTYSAANSVLDAAAELAQAQRVTQLGKDGCAWPRLCFHIHIFSSTTAPSLPHTNPPTNSIFRRRVCPPPASXXXXPQASQLHRCPTPTPPPTPSSNAGFALHQHPVGRLGRQRHGSPGPLHRPARRAHGHGHGRPRPGAAHPGQGPGLHTGRLGGRALPPAAPGGAGAARSGHPLHLRPLAGRRASGGRSSLSPARVPRRPGELRGAGRGSSGQHGRHHDRHPGGPGGRAGPDPGARRAADGGRAGLAGGCGVPEHAAVPRAQGTHGASRAHRGSAAPPRAAPAVDIMVIRGSVAQVVGEVLGAEVEPDAPLMSAGLDSLGAVELRNSLQAAFGLGLPGTLVFDYPTVTALAGHIAGEVARAGGDAPGAAPRPASRASALLDRGSVLSTVSEVIGEVLGGGDVDVDAPLMSVGLDSLAAVXXXXXXXXXXXXXXXXXXXXXXXRRPAGDAGLRLPHRAGPGRVHCRHGGAGG

SEQ ID NO: 14578 - protein, 259 aa, Chlorella protothecoides
MLSLAEVGAVRASQDFPLVSLASRLPKKPHFTLHRIPPHLPATTTQDILNLSLAEADGSGVVPLERWDLQEQAQTLGTAPARWAADVLGLAKPDAAACGRLLGAVAGNACDGCGGSQIHLLCMVTVTFPSPSPLTSRPPKISPHPRFSSFLEDIDLFDIAAFKFNANEAISMDPQQRLLLELSAQVLAGQSAPTDTGVFIGVSSTEYRMLVSNHLPAFTPYSATGTVSLSVTAGRLSYHYGFTGPSFPIDTACSSSLVR

SEQ ID NO: 14579 - protein, 834 aa, Chlorella protothecoides
MVAQAGARAAAAQAHTPRPSVHRAAEQVLVRAGTLCAGLQQLQGGGDGHLQHGLNAVSRAAGSGCRSCGGALQEGGRGEDGAAVDGVVAQGGELGCRQVGGKGDGAGAGVQGQHPAQERVRLGQDPEAPGLESWRRRQNRCEGCAGSRLQQHVCVGALEGKGRGPRGDGGGRRRTHGRRAGLARHGVDPGLAHHRRDVRVGRAQVQHRERQRLRHRLVQLGDAHDAGGWLRVAQLGLGGQQTQRGTGAGPPCAQQLRHSAQFDGVAQLRPRAVQLHGGDGRRQQARGRQRGSDHVLLAGAVGRGEGAGAASLGLATPVRRQHARLAEHGGGGRGQHHVDAARQRGIDGAPRATRQPLLRGVGGHEGGGAGGVHRHRRALEAVVEGDAAGADGQHRALRGVGRDGKAAGLRQLAVLGPGNAHEDAGAGEGGAVKALGTQQGLGGQGEHQAVLRVHDRGLRHRHAVCRGVKYLDLAHERTKLVVCTAVGRGEGWGGLGGRRQASASASGVLRPQKHCITSPTSNTTILHPPGLGPVEVPARQRHLVNRVLQRHYGLGSRTGVQDVALQALADHRHQRDRPGRGRGSGPGAQPARWSLAVAGLPVAVGGDVAVLINLGHGRRAIPSCALLLQQRGGQVIADGAQGGVVEDERAGHAHAQALTQHVGKFHRAQRVQPGGHEGLVLPDPGADHLCGGRGHGRRDLGAQRGGVWRGRAGAALVGVHAALPAPTCSGADGGDQGRWCRRLELGIHGWHGPPCLLGPRPGRQVGVPAEGINRDLGHSVHSAQGGAQRQHALLRRDGALADAVQPLQHRLGCHAWVMGGSGGDGLVSLFKYAD

SEQ ID NO: 14580 - protein, 187 aa, Chlorella protothecoides
MVTGAALTGGPSPLRPRPVVRRSRAQGPRQRNPRTPTQCATGPDIIVVGSGITGLAISLELLRTAPGLTVTCLDGLAQLPGGATGAGQGYLWLAHRTPGSPGWTLAQRSKEMWRGWPTPGVDVGWRGAGSTLLAADAAGGVQLEHTAAALAGAGVAASVLGARELAAVEPALAHDRLAAWPAGGAAA

SEQ ID NO: 14581 - protein, 173 aa, Chlorella protothecoides
  MOD_RES (35)..(38): Any amino acid
MVRMDVLHRVIGPTLDEAYCGWGESQRGGVEAGTXXXXIGPTLDEAYCGWGESQCGGGRGWDMRRAHGQDGEPRAGPRAVPAWNAHGFKLRGSYCPGSSLQRQIVLPGDSGLAMPYSLFPLIRRQTTGLDIVWPFLLGYPKETVGIIDSVCAFHPAAQLDKVSTYGFQNPMAR

SEQ ID NO: 14582 - protein, 178 aa, Chlorella protothecoides
  MOD_RES (94)..(97): Any amino acid
MRVIATGMPAEEIAGLKALFEAIDRDRSGTITAEELREALKMKGAVLRAADLETLMSLIDVDASGTIEYEEVSDWVGLHFVVVGEGWRSEGGTXXXXSGTIEYEEVSHWVGLHFCCRGRGLEERGWHEYRRVGEWVGTGRRMECNRQRAQSREATRRECSHPHAVVAPADPASSWRPP

SEQ ID NO: 14583 - protein, 261 aa, Chlorella protothecoides
MSGARVLACQAFPTHPAQGPQRPAGHDHRMATRRTLLATTLGAGLLPTISMRSRAGALYDEYAEEYDGLESGRAAQLLGLAGLRGRLASMARGDVLEIGAGTGLNLPWLLARPLASYTALDLSGAMLAGARARLARAPPPPFPVRFVAGDAARLPFPAHSFDCVLSSYALCAMDRTDAALSEALRVLRPGGRLLLLEHARSELWPLSWYQDRTARAVAALSKGCRWDREVGALVRAAGGEVWALERHLLGTVVLLDAEPRA

SEQ ID NO: 14584 - protein, 299 aa, Chlorella protothecoides
MRLLALAALACAMAGKDAPRRMVPVTFTTGSLTFANSSGRNLILAPIGANSVRVRIRGLRRTWTAGNLAGPQPQLPPPPPPSWLDDTDSRTFDILPIYYTPQPPHPCPACIGAYHGQGPKFQLLHQVLRSQQWQAIHPRYDVVMLADDDIIMSTHTLNEAFRIFGTFNMTLAQPTLCRHPQVGVSHGVVLQNQSNFIRYPDPQVGKGDYWKRGGVQDGGRRISVADCLRCGWWSAVRLIASVPDQDHPVGSLSHRCKHKPLARQPQVHALCGDHDAHHDHGCPEQRRRAHIRGRLHWLG

SEQ ID NO: 14585 - protein, 93 aa, Chlorella protothecoides
MLGAVTHAHGAFPFPPLPLRIQAVPPAVLRDCGALRTLSLHDNPITVEELRNTEGWAAHDARRRQKHDKQLGSEVLGPGMDEGADAHPVQNWK

SEQ ID NO: 14586 - protein, 273 aa, Chlorella protothecoides
MFTSPPQHSQVWAALGQSWKTRPPPWGGTGHQAAGGEGQGEEWLVGRAPPQVCSAELLPHQQRLGDVSRPVLLPRHPDPAIRGNQPHDLRIRRNNFFISAHAPEVPPSGASPSSPGQYVSFCLQKVCHVRTQYMLVWVQDARHVSTLAVVGTDARSSGHYTYTKAPDFPGPPLTCTNRARVLNWLGQLGIHNQVQEGTCILPSLSPAALLHLAEGARTVGCAWVDCFNLCQQLHHHGPPPREEAVHLGGHLSRRFFLVNAYGGQALAATSTNG

SEQ ID NO: 14587 - protein, 62 aa, Chlorella protothecoides
MYAPTPVRTHRRDLKPENFLLASPAEDAAIKCTDFGLSVFFKAGERFTDVVGSAYYIAPEVV

SEQ ID NO: 14588 - protein, 231 aa, Chlorella protothecoides
MEVSVRFGSSAHIVSLPAEGTLGDLRAGVEAATGVLARQQKLLCRGKVLAEPGAGRDDTRLSSMGLVAGTKLMLLAATGPGPRRAVGRPAERPSQRAAQIRVWKATGIASLGAGPGAPTLDGWPPALLGAAPGLRAAPGLRVLSCHGALSPLANPFSAPLAPFCALQRLSLTGCGLPSAALDWRVLGALRALAKLSLRGNALHALPCAVGDLPALRELDVACNLLGEARGG

SEQ ID NO: 14589 - protein, 168 aa, Chlorella protothecoides
MVSAEAMQFGHATAWQPSQHSSPPLPSYSPACAVEAAGVKLSVEIWQRRLESAALYFGVLLYIDVWLLLLPIPQSSFLQELSGLDYHQMIRWHRCMLCVFSHPVSAGGPKFPKMLCKATHPHAIPHPPTLAPGTPAQVDGPHHHDCYLRARPLVLFLLGRHPPVSPRA

SEQ ID NO: 14590 - protein, 266 aa, Chlorella protothecoides
  MOD_RES (40)..(43): Any amino acid
MPGASSPHLPPCLPPPPSPPPPSPKNRHTLDALHIIGLDXXXXHSVASSPHPSGLCACMPGASSPHLPPCLHPPPSPPPPSSKNRHTLDALRIIGLDAGAVRSVLSCVAAVLHLGNVAFATEDDCDDAVLADVAAEDAVEIAARLLGVAPEALLAALTRRVLETRGERIVKALGAEAAAESRDALAKALYARLFDWLVAAVNRKIGSLGAGGAGARSIGILDIYGFESFDTNSFEQLCINLANERLQQHFNGHVFKVCRAGIQGPD

SEQ ID NO: 14591 - protein, 416 aa, Chlorella protothecoides
  MOD_RES (109)..(112): Any amino acid
MLLLPPTACMGSLWFPSPTGSPDHPLRPLPHSILHTLHVRYGLDSIYTYSGSILIAVNPHKRVRGLYGPRMMAQYRGAALGELSPHVYAIAEQALHRSQGTRPARLAHXXXXLSQALHRSQGPRPARLAPHPSSHPLPDPQAYSAMMVDEQRQAILISGESGAGKTESAKLVMQYLAHRAGGGRAANGGGEAGADARGASSGAAPVEEQVLESNPLLEAFGNAKTSRNDNSSRFGKFVQIDFDAVGRVVGASISTYLLERYVVDGKGGGGAGGSCMVLGEGWQHVECGSRDLHGVVCGGGCLAAAGQAAQGFRAAAPHAIKTLPPSSFTLQVPGGQHKVPRAQLPHLLPAGGRRLARAAPRVWPGGWRVQLPVPGAVRRGPAAARGRRRGVWVRPSVFRVDCSGGGEHAPRPRVTR

SEQ ID NO: 14592 - protein, 208 aa, Chlorella protothecoides
MPSLGRKASIPLERGLSQAGRGSGCLSAPVVSRSLHPVVFPNGWRRPDPHPAGLPPRHGSMGPTSRGFAVRCGRRQQEACHSLAGRHCAVARPGKHDCVLSCPLSAWSPTTPPGRRAERRCRRPQGSADQRRCRADHGHQRPPSGKSELPRGSRAVPGAVERGWSCPVGLTSEPVPPSAQNERDDVIDDLVKSDFLHEPGCVPESGGS

SEQ ID NO: 14593 - protein, 465 aa, Chlorella protothecoides
  MOD_RES (109)..(112): Any amino acid
  MOD_RES (205)..(208): Any amino acid
  MOD_RES (260)..(263): Any amino acid
MTAHVPPLSPAQLKAWMQAAGMDSWVDAIGNVHGRVEGSLPGPATFTGSHYDTVVDGGKYDGALGIIAGIAAVKALVLEVCVCVCCGFGGGSRGAGFLLCCLVRQAQSXXXXCVCWGLGGWSRGAGFLVCCLVRQAQSASRRLLPADAPGSEAPGDCVGGQRRRLAWSTPLTNTPSSCPIQAAVARGALTREEAARLPVDPALGXXXXQAAVARGALTREEAARLPVDPALGTTALPTTLNASALLRRSLRVVGFADEEXXXXNASALLRRSVRVVGFADEEGVRFQSTYLGSRALAGSLAASGALDARDGAGVTLREALAAEGAGDEAALRALGVVPSAARAYVEVHMEQGPVLEAANSRLAAVSGIAGQARLGVRLAGSQGHAGTVPMALRRDPLPGAAEVVLALERLCAPGGGGGAGTGLVCTVGTLALWPGASNVIPGRVLEGCVKGVGRGQRKGCLPEEA

SEQ ID NO: 14594 - protein, 64 aa, Chlorella protothecoides
MISLRPAFRPYNPLMCSASSTLESVVAKLVKNGLHRLYVCDNDLRPVGVITLTDILRRVCLSRA

SEQ ID NO: 14595 - protein, 880 aa, Chlorella protothecoides
  MOD_RES (9)..(33): Any amino acid
  MOD_RES (273)..(276): Any amino acid
  MOD_RES (685)..(688): Any amino acid
MRASISIPXXXXXXXXXXXXXXXXXXXXXXXXXSGRGLASAACCRPLSCLSNARSARNVGVCTRRKCLKDAVYPCQLQSCSPRHASHGFPAQGPLPLPAPRQVLPSTLACSCHGPWTDTGMDLTSSTLPRSVPSVRFTFPFGPCLRGKEVDAPTHAVARLAVARRTAAPACGEKEVDAPTHDVARVAVARRTAGHSPDQGSSSQHPPTCQVDSGGVTHEHTRKWLVLSDLQVRPRMCSMHAGRAWEVLGMLAAVHRLTWMLIVPPFPPATRIXXXXSHLDADRSSLPSCNQDRNETLFYKCLMDNFVEMAPAPEGHEGGRLIAITSSPPQNPADYLHPHGRLGLHELPQAVPPPTRHVLLGRRQGHDGALLLGGVTCPGMQVPGRAACVGGSGGVQGSGPSSTNPSLSRLRSQPWSTTGPTITWTPSWSPMAPGSWASVGDVTQGVDDWENTPEWRAGSQAGSQASHESALFGLMFYLKALASVFRFWVTPTPQQVWAIAPTKCLLHPPPPPLLFSHMKPTGDLGCNGLGIPIGKLDLYVAAGGFHPSRVLPCVIDVGTNNEALRCDQWYMGLKQPRLAGDAYYQLVDEFVQAVMGRWPHAVLQFEDFALEHAGPLLKRYRDHHTVFNDDIQARCGRGARGGALHPLRRSPDPSDSGQSWTNSASQLSYRHYPKPHLPGHRLRRXXXXGGRGGEKSPKGRLDKLRSPTLLSPLPHPPTYQGTACVALSGLYGALRVLGKSHADLTAQRILVVGAGSAGMGVVTMIAKGMQAHGLTPEAAAANFHVIDDRGLITTARECLPPHVVRFARSDEQSTGGVIDGGVVCVGSGGEGTEEGGGSKGAKRPEGASFLEGGAIHASAAQRESRSNRPPGGVLAPCRPR

SEQ ID NO: 14596 - protein, 606 aa, Chlorella protothecoides
  MOD_RES (187)..(190): Any amino acid
MRQHLAYPSLLIGTPTKEVPLPSTTRELDSAGGGHRSHPVGSPMPGACYLRACRLSRRLKGLQAPSQEREAEPGRAAPGTACARPPEGNLVPAGKTCDNGRGGGDRKRGPLDLVWRCRGKPMASTGCHALASVGRSQWPQQDATPLLVHTRLQCNIISRPSLPPPSVSLPQPSRLDGRGQDDCLHAXXXXSGERGDGVQPGPRGCSMMRGAGNGVTGNVAGKQCRLLVVHDGNGLEWGGVAGHSACHMVCPQSREDCAGPIAGPFIGYTASAQPLNPKPSCTHRRAERASSSAPMVSCCVQSSVLSMEVGLAGHLRVVCTSRRGTFLELTPPPPCFLRMSSWWMRHMSAAWQQTFCSGFSRYPSEECLMPIPGHAQTLWCCAGTHNQHAHSSWAASSEWHWIPGTMPRAPLLGSDAVVSHRHTCRFFRAPTAASKPRGHPLQHSEAGADQFSGNPALLSVEGRAHHVQSTRAWTWGEAWAGSQTPCLAVSPPETLPARTALLFSNRIPPLCTLPQVHYLDEPCSDYLAAAVEAALQVHRQELPGDILIFLTGQDECQAAVRLLEEESQKSGHRSGQLRLQVRGQALGDVRGERGRIPAEWGGMLEP

SEQ ID NO: 14597 - protein, 218 aa, Chlorella protothecoides
  MOD_RES (7)..(10): Any amino acid
MPLYAGXXXXRQPRRHACMPANVIHSPTPALLVPHIEPRAHTPPGDAAVCRAAGRPAAGSPEPSPTRDSCPGRPHFLPACAWMSIKWAPHTRGHGQAPPLLQAIVATNIAETSLTLEGVVYVIDSCFAKQRAYNPLTGLQSVLITPISRASSAQRAGRAGRVRPGHAFRLCTEAGWEALPAATVPEMQRCDLAGAVLQLKALVGRGCEILGQEREGPG

SEQ ID NO: 14598 - protein, 345 aa, Chlorella protothecoides
MLPTLSWSGCVGRVAALRAHRGPAGGHALGRRRGGAPHGICLPLHGRRAGQGAPGASPGQGERARLAQVMRGVGGVCSVFPVGGCGGREEGEGHGGDLRGVDGSGAPPSGCGVTRGCYIMRSPPPTEQWCQRDGTTQGGLPPAGLPSCRPEVRPNLHSHRSRSMSPRPLPIPHPQHDPELLTLPSSLPSFQSLRLACNTLGLVSYAVPHSGSRLADLGWQLRYVGGFPAGAVAHLKTSELHLEDVNAAVRGMHRRGGLAVLSFGEGKPTRVAYIKTLVVPLESAYPGYGEFFVLPSHDHISACKPTDRSDAAYAKALDFLGRCARSAARRRAEAHTADDVEAAAL

SEQ ID NO: 14599 - protein, 259 aa, Chlorella protothecoides
  MOD_RES (76)..(79): Any amino acid
MHLFVPGAEHHAVLARCGRDATGPGEPGGVSFVYFGGGACAGSLTTAPPGQGLITCAGAAHTTSPSPCTQHLPGTXXXXSRSGAHHMCLGSRTLPSPSLHATPARDAADGRGLRPRHPGRRLCHVAPGGLTAPGQGERGGSGVSPGPCNPLHTRTRPPRSPSVMTLPPPSPPLQGAAFEHHACWPAAWLSEELPEARLLTVEYAAPASGWEVRGPWGGGGRDRDAAHAELERRVGVRTTTSPGPCVARSGSVSHLDTSP

SEQ ID NO: 14600 - protein, 193 aa, Chlorella protothecoides
MLPRHSILAAADIRFQLESHLKRAGLDWRSTALGPGAQGDAASGLLTVRKACAAGLFMQAARLTEELVLDKAGGICALLCVVLCLLWGKGVCIHVSGREESGPDDVPPVPIRPDCDKRAQCQVSALSPRPDARDAGASVYRLVRSGGGEAAAAKLRIHHSSVLFRCRPSWVCFYGAEQNNTGWCAEGERGVGG

SEQ ID NO: 14601 - protein, 143 aa, Chlorella protothecoides
MLVMAPEATTKAAQCLLKFRRGAFASGHPVCPILLAYPHRAFNPAWGIVPSTPLHVYRLLAQPLNRATIQVLPTYFPSQKERADPAAYAAGVRQAMAAALRAPLVEQAMAAALRAPLVEQVGGGVGEQARGERKRFRHACLGS

SEQ ID NO: 14602 - protein, 82 aa, Chlorella protothecoides
MWQHLPAPKRVLLGQLGIVSSRAMLAQWKYVVVGATVAAAVLTPSTDPFTQTLLAVPLVGLYMAGAGAVRLIENRKAAAGPA

SEQ ID NO: 14603 - protein, 126 aa, Chlorella protothecoides
MPTVLYEIIAYVIPGLTRSERSFLAPVVFGSSALFYLGLFFSYEVLAPAALSFFVSYADGAVESLWSIDQYFSFVLVLMLSTGLAFQVRRAVREAPGPDATLSRVRRAVREAPGPDAPLSRVFCGS

SEQ ID NO: 14604 - protein, 593 aa, Chlorella protothecoides
  MOD_RES (146)..(149): Any amino acid
  MOD_RES (319)..(322): Any amino acid
  MOD_RES (404)..(407): Any amino acid
AGRRAASPRARRRPAPRRAAGQAHRRAVPPGGAGGRQGGGHGGHGLRAQRRPHRDTGVHRASRAAGGRAGAAARQPEPRRLDLEHAGRSEPPRGVMHCPWRDLIEDGCLWDEASLLRHHRKQARWESGGRALVTCSCNIGEPKQHXXXXAGWESGTRALLTCCCNIGEPKQHAFQPGKFERTQNTAGHPAAGDAYQGKAHTRLGHPRPGRPLRSRSHGVKEAHPSQSHYSGGQRVSGVDGRHCRGAQFNGVSDWPAPSPSVPSPSLPLLRHRVGKTSLMNQRASLKLLEAPPSPRLTITAVRQQEVLQSVQGHDRRGLXXXXSCMRPHPHLVSLSPQYVNKKFSSQYKATIGADFLTKEVQVDDRLVTMQVRAWERQGSGWGHGVLHMVVRVHPGRLHHVPDVXXXXCMGAPGEWVGSWGPPRGCMSAPGRLHHVPDVWKTLPCCPPRLWRCNSTPRSAPSHPLSPLQIWDTAGQERFQSLGVAFYRGADCCVLVHDVTSSKSFDNLENWRDEFLIQASPADPETFPFVVLGNKIDADGGKARQVSEKRAKQWAAAKGGIPYFETSAKEDVNVDTAFATIARNALKNETEEEM

SEQ ID NO: 14605 - protein, 169 aa, Chlorella protothecoides
MAQQPLAISDTAHGAEIGWRRGQDLITALPYVDALTAESRAAVERLVQEEVSRSERQDPRRLLGRAAPAPGLQARCKLHTSGGIHTSARLAGMALNHPPPFYAPTQEGSLVAQELERVARGEQMAEMDTVRYNLDPPSPSSRESVDAWQQALDNSHSQLEHQYTRWVLG

SEQ ID NO: 14606 - protein, 225 aa, Chlorella protothecoides
MLSSFPDASDHLNVNISISTPKVQVLLDTVIFSPLHILGYFGVMNVGERGSWADFSRKVEVDFVPTLAAELAVWPAIQAANFKFIRVDYQLLAVNLLTIFGEPCMPCWGRMMRRSPNPRDILVWSSAPGRQCIHVLVSSHRGLDVRSLPGAEESSTSSPRGGRLGAEQQRRGWAAEIKSSEAAPWVSARLAGVHTVALASVARPKEFPRTSLRSLQRRQPDFHHC

SEQ ID NO: 14607 - protein, 482 aa, Chlorella protothecoides
  MOD_RES (232)..(235): Any amino acid
MAHTWCGSFARILRSSTRDPLRPQTHASVHLLNHLNASCIGREAVWASSPCLSPRRFRAVSPIMMGRRSAKIALKKGKADGNKAKLYGKVLGVEGIVGEPLIHGSAWSWACHDGCNGVQRHAWSWLAMMGATACNASNPFPKPLLPQLGKLIAQAARAGGPDPVTNMRLREVLHQAKLASLPNDIVTRNLEKATDKSAANFSEVCWTDEGRVGGDPASRRCCHAVNTASSCXXXXPRTFRRCAGLAREGWVGIQPAVAVAVLSILLPHVSLTHPPHALWQVVYECYGPGGTGYVIESLTDNTNRSASTVRAAVTKAGGKMADPGSVLFAFARQGVILVGGREDDILEAALEAGAQDVLPGEEDGEFKWWRVAGCKAHAANAMLLWGPHNAMVPGPLNCLFIGIAVPPAIPCQPAHAQLSSSCCTDPHRACGLCSGVLPPGGGGDRGGWRGREPGLPPIRPRRCGRRGPGSKRGPDGATARRG

SEQ ID NO: 14608 - protein, 119 aa, Chlorella protothecoides
MTQANSSCIIAHPTPPHTQVDNLLEVLETRGSAALETYRVPLLSWEEVKALKGPGTVGLALGSSADAPPTPPKLHGRAAAQPLAVEAGEGGAALASEMPGDEWSPPAVGTGAPFFEELD

SEQ ID NO: 14609 - protein, 111 aa, Chlorella protothecoides
MFDPCNCRTSSTLTRPFSPGHPALRIKYEQTIRDLREAAAASFGLSLDLLQLFWRGRELTSATDGLTLLEANLHTGFSLQGYDLSEAPDYWPAVVQTPEGLAFETVAAAAS

SEQ ID NO: 14610 - protein, 130 aa, Chlorella protothecoides
MALSGLPAAQRPLCDHVALPRRRRLINLELLLKFGPDAWRVRNDTLTVQCEALKRRLAAVKKETEDLNRSRKLSQLEAGRQLSSLQAEYTQLVAKNAEIEAACLTLESQAAALGDKVGGDSDASMVEATA

SEQ ID NO: 14611 - protein, 100 aa, Chlorella protothecoides
MDDETVHWMMEEMAENRIKAVAHRKHYYHPDLVALARDPQGAGVVAAEARRRAASAGRHHDCLGTPAFLASMAGHPERVSASTLCITTVFLQGWQTLQRR

SEQ ID NO: 14612 - protein, 228 aa, Chlorella protothecoides
MNGGVKRAAVLTAALPQARHSNPSLHPPAKEAGHRVNRVLPWRRHHTHPTPHSHLLLSLVLERVPRDGGKGGVHIHILLGAGLKVGDAPLGGGPLLGPLLADLAGLAAVGVDLVAQHHKGEGLRVGGGGLDQELIPPILQVVKGLGGGDVVNQHAAVGAAVESDAQGLETLLACRVPDLKRGEGMRRCRAWGAVTSPQPRRTARERLPYIWNMMKPPRCTHTTTWRTP

SEQ ID NO: 14613 - protein, 381 aa, Chlorella protothecoides
MLTQIVVLQAPPPAPGYLSCSALCLPPPACLPQAHPLPGLPQLLGPLPAPTCPPPTSPSSAWVHIEAAQHHHKPHLHRHLPFAGRKQPGRAELSYLRGAAYLEAGDAGQALRDARCAIVFGPRAGPAAEERTPEADAGDAGEEGWGAASPWLTAARSSLWPAALGLLGAAYEATGDNVRALLLACLAAEGAGGHEREGSDEGAGGACPEVPAVGGSSAGRAVCGGPEEGQDGGGLESGQQEESVHEAARRRLLRRVPEECVAAVRARGSAGLLALLSAAHTQAKPEVLRRRPKYYYYYEWMKKRILEQARPLGWRRGEGSRVWLGDGGSLPQQPWTLPRPSPAQYPALPEPVMDKLLTLDANELDLVLQYPQATRQMVGWG

SEQ ID NO: 14614 - protein, 128 aa, Chlorella protothecoides
MVLETLERRHGLPTVASHSSQIERLALTEPVEVEFPETAGWLARQGSNLLRGLLSSGLEVSERVSDKAERAQQASTARPDRKELAEKSAEARAELRYFDRKAQDAESRKRPVPESLRRAKDRSDPRPK

SEQ ID NO: 14615 - protein, 369 aa, Chlorella protothecoides
  MOD_RES (283)..(319): Any amino acid
MVLWEEGDVRLKGLQRCRDRRIVRGGLEEGEGSAGGPPRGAGRGTHVQACGCLTSAALPPNGEATLREQLPDASRPTLIPLHSAARQASRGDDKAAPASPPTTLLASGGADGSLRLWCPATGACLGKTPAAHAGRVISLAHDASAGLLASCSQDGSLAVWRLDSSAGAPRPALALAARLTVPGAAPAPVPVRACFLHDTGQLAGSWSDGAVRVWRDLAAPPRLNLPGPGPGAPAGLTASPDGALLAAVGEARCRVWEAESGVLRADVAPESGQATLCAFLSPXXXXXXXXXXXXXXXXXXXXXXXXXXXXXXXXXXXXXHADPGDGALERGAAGGAAHGLGRGARRRRVGGRRADGAPGHARRPGRRAR

SEQ ID NO: 14616 - protein, 262 aa, Chlorella protothecoides
MFQLLTPQATPQVRGAGRRFGAGQPAGGPRDTAGGVPAAHPAGKRACCRGARGPVPAVRGGITLSRSLLLSPMRTCDIVYLHLTPSASPVFNRLCSSPLEFAWLVMPRVVSLVPRMLERAGLLADVTLLPTPLSWIPLDEDLISLELPDVFRVSFGRGPTFLPTGCHWLRRTLIFRGALPLRTVHAASPEALPSTSPNPFPSPRSGPQTATPAPCTSWPPPFPPYSSDSAPSPASRPRARLRWRWRGCWGAYGGSRAPRDPL

SEQ ID NO: 14617 - protein, 239 aa, Chlorella protothecoides
  MOD_RES (14)..(17): Any amino acid
  MOD_RES (43)..(46): Any amino acid
MGCWGWEVALYFRXXXXQTSSGTWDLECPLPGMCGPRSMPPGXXXXVWDDKSAGGQEVGYLRYVLSGAGRFWDLELECPLPGMCGPRSMPPGPLVSNFSCSQSSHENPGNQPCAWREWSIIPTPPLTGQSGIDGMILMDRSVDIVSPACTQLTYEGLLEETMGIRCGQVVLESEGGRGRCGRSGDWEGGQGGDNAVTAGLSRFYTSMPCWAATQCTPQEVPGGEAAPLSNARGWLHALS

SEQ ID NO: 14618 - protein, 481 aa, Chlorella protothecoides
  MOD_RES (87)..(90): Any amino acid
MRVALQNEDGTLPGFMRVYDCVVVEANDRVTFTGMTMEKLQGRQGLRTVMAGHYPVDRVLRAFACFNAVLSAGCSSQHLATQCHLRXXXXVWLGTTLLGGAQASLGARFPQHTLCPGNAVPDHTVPQSLPPLPPMSSPSFPPPPSPSLHWLRRSASWASTTLTWACGTSWSVTLAGAWGAWPSCGHHPFFSSCFPARSFTPATFHRVFTDVAEEQTAKSLESLRQAESSGSDPAPGSPTSSAGEPAGGTSAAAKLNAADADLPERHSHRRVKPVRGFTCSASGEMLPLGPQVEFKIIDYGVAIFDERLAESTGGTEYKGVLQRIKHVVAAKEVVFPSREGTHPGINRTVPLQTSTGAVGRASHAWHLLPTKLKNKFRVKQTPVGAFPVVSDESFTDAPAGVALGASKRIPRLNNATRRLMKESGFGEGVVWMGWLGVGLPTWSRQGRVWRLAPEGFARFVAWNCQGTQRAACHASAGITCN

SEQ ID NO: 14619 - protein, 323 aa, Chlorella protothecoides
MAAFTAARPVSVTGSRSTQQSQTSLFLKPSGFHTVAQRRNGSQGVTGPRLQDTSRGRCLCLGVRAETAGGVSTAPGSARGSVVVVDNYDSFTYNLCQVDELDRPAGQYLGDLGCDYIVLPNDAVSVETLAAMQPLGVLVSPGPGAKVGVLTGWLMHKAILFNLPCSRPIPQSRPPSQLTGRPEDSGISLDTVASLGRAGVPVFGVCMGHQCIGQVFGGSVVRAPTGVMHGKTSLVHHRGEGLFRGLPNPFRAARYHSLVVDAASLPPELEVTAWCEDGTVMGLKHRALPGVQGVQFHPESVITDNGLTIVRNFLDSLPAGVRA

SEQ ID NO: 14620 - protein, 231 aa, Chlorella protothecoides
MLAGKLGPRVLSSSRLGAFSTLLSPPTSCLCTTLVQGVTLQLTQGVVKNIIPAIASTNAIVAASCALETLKLVTLASTGLDNYLMYSGVDGVYTLTTQYERDPACPVCSAGVPMTAPPTCTLRDLLGLLTLHPALGRLLREPSLSVGSVPLYARGVFEEETRPNLDRQLRELVTGPLVELTVNDKGLVAPLKVNERERRWEGVVRGWRRARQTSCLGGKEGGAGGACAFGV

SEQ ID NO: 14621 - protein, 223 aa, Chlorella protothecoides
MYTGEGAAAVLRLLCLYCAVHGGIPRKAYDGLRRDFLNTYGHEHLLTLAALQRAGWGGWGRRRSAFPLVREAFGLLAQEDGAGADTTPDIHFTYAGYAPLSVRVVQAALSGSGWGGVEAALGALPGPTAELAQGVGPEGQPTTRTDRGPLLGGGGAAPAGVDLGTGARRPLVLVVYVGGVTAAEVAALRWLAAQRRVPCDFLVATTGVVSGRSLVQEFMPPGG

SEQ ID NO: 14622 - protein, 121 aa, Chlorella protothecoides
MPSLPSFSIDRRKLQPRNTPIGDGDVAELNDAMDKSLEPGAVLLPAGMTIREGQELWEGVKFGRLLGAGVQARVFELVRSDGTPSGKVIKVAHADLGHKILNSPVVWIGGEREWEIGIQVC

SEQ ID NO: 14623 - protein, 299 aa, Chlorella protothecoides
  MOD_RES (263)..(265): Any amino acid
MRSDSIAGPHVAHPPPPLQDLVQLPGLQPAHRARGGRGGGGRGRARRTVAGGGPAQDTESRRGDGGWQHGCPCSGQARARPELAEAGPQGSGLPSLPCGEAARMAAHGSDTSDFLDHRPATSSSPPLPPTPGPTQVLKKLQALSVSYPFWAPVRAEDAPDYGAVVKQPMDLGTISDRLKGEDYATPAQVRADVELVWRNAGAYNGRGHPITVAAAACSTAFKKAWRDVGLGHCETAQLEHKICRWEGINGQDGSSKREVQGTXXXEICRWEVISVQGGSSKREVQGTTCVHNCFYRENY

SEQ ID NO: 14624 - protein, 271 aa, Chlorella protothecoides
  MOD_RES (166)..(169): Any amino acid
MEAPAPIASQPAPNQCLDTGFLTPESLITTDMAALRACGLSQRKAEYLTGLARLFSDGVLTNEGIQGQGGWFFQGECGVGVGGMDDATLTMELTKVRGLGQWSVHMFGVEMEMADRRALAPVVLLQLDVTLLTAAQPPCAAMFHLGHPDILPVGDLGVRKGMQWLXXXXQGEWMWRVQVSERAAIFSGMRIPTQDFLPSHPRPQYTSQDLPDPETMEGVAAAWKPYRSVGSHYMWSAAASAPRSPNKKKAQSPAKRKKAAAAGELDGEKPT

SEQ ID NO: 14625 - protein, 204 aa, Chlorella protothecoides
MVVANGFVLGPNAIGLVLGLLYIFACAGLAPQRTLDAMGAVTVLFTVVLVSAGAVGTFRHLDHAALRLLWGYTSNAILLCYYAAPMSTLYHVLRERCADSLSLPLCAMNALNGALWLAYGLAIHDPFLWVPNGVGMIIALVLLAAILVFWRNRGVATPTLEPDMCAGEDGGGVCLFEKGEGGYGCFRPCSLAARQVWASSPAGS

SEQ ID NO: 14626 - protein, 273 aa, Chlorella protothecoides
  MOD_RES (186)..(189): Any amino acid
MWGCIAFFHCPYSSLCPMGGTLSYWGHSSAGFYTPQDPDTEGMGCQRGKASHLDVGICTRWRASATATQTQAPICAEMRSAASWTVEIFSAPSSSSCSSNFSSRAIMISTVSRESAPRSENLASAATCEARMVVEEGCWVGGPQHEMGGGKVWQCWCAALHEMIGERTYGRSKVCVWEMFVKKTRXXXXGGEVWQCWCAALHEMFGERTYGRNKGCIWEMFVKKTREWAHVFWRGARQQANTGVKPLHDETWNHLQADLVTNIEGKQSNLSHL

SEQ ID NO: 14627 - protein, 317 aa, Chlorella protothecoides
MSPSRSFLRAAHLLGTPPLLFPSVTRQAEGFEAAAAAAAALTLEAERLPLGVPGEAEDLAERGKLYCLCRAPYDEQRPMLGCDHCSDWYHYECVGLPGPAGEEGAGAEAVPEDFRCPSCALRAGVTYPAFHGLPPRSVEALRLAALGLGGGQGKGDGQGAAAAAEGDVAAAWQAAMAAALAGGGEADAALGPGMREMLAACPPGLAGAMFGGCWPGSVAAAGGEVDAAEPAAKRPRSDSGVQADLGALGPSSDAGGPSATVELSAGTQDPELADGCAQNAEQGSMSAIPLQEAGPAGTNTQDTTSMPVPVPEAPRKL

SEQ ID NO: 14628 - protein, 603 aa, Chlorella protothecoides
MAQVVGLHMKTLLATYTGPATRTAFATAPSCPFRYLALHRSGTMRRARASVRPMSSTGIAEVDVKAAGLAATCPRDALMARLASLERSFGAPRLSVAKRSSGKVPRSASGRALSTSPGWTPSTKPFGRRQPQRLARSRPSRSSGGSHFTSNLQLSTPGDGKEHLPRLSLEEERQLGECIQAARHLLDGSLDGQEDASPHGALLREAQLAEQVLVTRNVRLIYLVAKRLRHYSVHAEVSKGVRWGRAACYVCYTPSCYLAYAPQSARTRCTPVSFLSRLLRSSPVYLQDLYAEGMVALHRAARGFDPEKGHAFATFAIPVLHRHLERAAQSLSRSIYLPSSRLIQIKKLRSMSWALERQLGRPPTVAEVAEVMQLPEQSIVELRADAQAAASLEQAGQGEEDSWVREEVHAQGLDPSSQAVRELQGISLRSQLAHLPPAECAVVLARHGMLEEGGPGMTWQELGRWMGVSANRTHQLHTAAIEKLRRNMLDPPTSFTEYSCDAALVEKTDRLDPVYLFLPAGRCTDVNISFPVNTRQSEMVIPASVYDGCLAGDWLMKGSLKCCADISMITLHRLRPRITSTALWAALTGKTGTERTNPLSNWR

SEQ ID NO: 14629 - protein, 432 aa, Chlorella protothecoides
MSLCRTAPQPGGVCVGARRSAQNGCSPAGPHSASYGAPKPVWSNMSREMCVPRGSAGRQGAWHVQAHAAPQAGPQGLASPVQSSYCPSLRRPRLASSSQTRHSAPLSLLPPLTPLPTQTPIPPQPSRRVMLKISGEALQGPAGYGVDPAILSGIARDVAAAVAAGVQVAVVVGGGNFFRGVGRWPGLDRASADYVGMLATVMNAVCLQSALEAEGVPTRVQTAIEMREIAEPYIRRRAMRHLERGRVVIFGAGTGNPFFTTDTAAALRAAEIGAGAFLKATKVDGVYDRDPAHHAGATLHRSLTFQEVLHASLAVMDGTAITLCKENDIPGRVGRGEGREAPSPCFPSILPPTPLPTPPPFPCCSGGLQPNHTGDDAPSPAGGLERGHGHLEQQAGAGPAGTHRMRGGTQCAAGELGHGVAKVLAPAHQDFP

SEQ ID NO: 14630 - protein, 186 aa, Chlorella protothecoides
MGQLSDRGVGSPLPPAPVFHPSPEEWTDPAAYIASVVRPLTEGLVGLAKIRPPACWPRAPPIDPASLQLCSQLQAVARLQHKTTEGVARIWRDSYADFCLARGQRPGRNPVVAGHEVDLHDLFTRVTAAGGWNSVEQDCRWGEIAACLEVREGVRDAPTDAIVGAHTCPPRPLDPPDDPMVAFLIP

SEQ ID NO: 14631 - protein, 93 aa, Chlorella protothecoides
MASPVVVDLGSHAIKAGRSVGYPSDTEPSVVRGHPCMRWVLPCTVQDARVTVVEKLVHPMHAGVVTDWEGLETLLHYTLFEEVSGAEEQPRRG

SEQ ID NO: 14632 - protein, 127 aa, Chlorella protothecoides
MPAPDDSAPPILSPPIAAHRCLHPGNPNQSIPSPHPKGVLGSLFVAGGAAGVAGLGAALAREVHAALPAAQAVAALEPPDHMPRGAARSAAWAGGAVLAKVVAAQEQWVTRGEYDEAGPGAVHMRCL

SEQ ID NO: 14633 - protein, 444 aa, Chlorella protothecoides
MRLWAIVTKHARTPPQKNKIHQWAEDPALPAGACPWLARELRRCIDDDLATRLAVWAAGTTDSRRAEGEAARCALCGAHCTLSALECPRCAPGRQVCAAHVAALCECEPARLRLAFRHTTRELEGVVGRVAGRAAGEAGFAGADAAQSGEDTAAQEEGEGEEDDLVGLAGFMTELAGAAGGGREGGCPDPASASTASTPAPPPTIPTPSLAPPGAAAALQERLARLGEAHALWRERCEATLARGGRLAADLDELLEEGKQYAWGAVDDEDGVEATFVHLREAAAYLARVEAALASRPAAEELEGILGLDPPPLAAAPGLERLQELGERAREWRARAQVGGGVEGRAVRCAVLSSLRESKSVHWRWGHEPVIPAAHVVSCSPQPLIPRAAMAARGSMEMKDMEALISDGAAISGWERWMAGWEGWAGPAWSAAAMPATCNALHEG

SEQ ID NO: 14634 - protein, 123 aa, Chlorella protothecoides
MCDSCGEWFHMRCVGISQTQAKVTKKYTCPVCAAVRVSEGASGLEKSPCVERGCMFAGRATRSSASNNGWGTWEVVSLHHELLRRITLQYNGEPLQAALAKLKKTRRPTRAGLGAFLEQASGG

SEQ ID NO: 14635 - protein, 166 aa, Chlorella protothecoides
MPEVRLLRERLAAARKLGESIRTALPGLAGGPRRRKGEAETTLEGLQALRAAAVTLRCDVPFYPVLCFALDRLEAWAGRVKQLLGMRAPLADLRALIEESRELPAAMPEVETVESLIAKGLAWQSSMRALVAARAPLKRMRDALHAGLRLPVELPEVEELRGIIRR

SEQ ID NO: 14636 - protein, 180 aa, Chlorella protothecoides
MGIADDAHAGHGGHSGRGWVGSHHGLDDGSDAEDAHGVENDGGGEIDATAAAEVLGALLGTTPASGAKAVGTKKLISAGGEAVPSTLIPARGSQEAVEEPSPSPSLSADTSGGKVPQNIFTMVCEACRGGHAEDRIILCDRCDKGWHLQCLEPPLSSVPVGDWICPSCILEGDVGFLRIT

SEQ ID NO: 14637 - protein, 201 aa, Chlorella protothecoides
  MOD_RES (89)..(92): Any amino acid
  MOD_RES (179)..(182): Any amino acid
MPCRAWGWTGRRWPCTACGEGEPSAAGAVLVCGASICRTASHAACTGCRQGDLLLSLCPCLTTPYAPPHLPPNTHSLPHRRPETTWRRXXXXTRILPPIHTLSPTAGRKPHGGAAPSVRPAARCARRGGLRAAPPPARPSPRPAGRGPGRRRAHAPPRRGAPRGRAGPRPAGPGGRAAXXXXLCVRLRDVPGAAAYARRHL

SEQ ID NO: 14638 - protein, 211 aa, Chlorella protothecoides
MRACLPTSHARPSTPAHPNTPGQTPRPTTCPSARRTSPSSSPAATRVSWCGEGGMEFTIRISGRCRAGDVPGTRPWRQQHVNTRHMTERSGSDMTPTLPLSNHPPGTYWRVLADAGVTRQRLESFDRPITVDPQFFGDRRDALLADFRAYLKVLKAVHSGADLQASASAAARIVPAAAKAPLGYALAHAGTGGSALALVEAAVEARTELGA

SEQ ID NO: 14639 - protein, 183 aa, Chlorella protothecoides
MDGEELPLQRARVPVPVDADLAALAFVLRSRDGSRWWRDGGGDFRVPLPTGDGGGAGEGAPDAASGNPLLQDSVARAIVEAEATPAWTLMHRFNRASDLLEQVAAGGVEDVEGSLARIYVWLRYSSIRQLTWQRNYNTQPRILGAAQERLTHTIAKVMERGGVFCVQVGERGRGWCGVGVRSR

SEQ ID NO: 14640 - protein, 507 aa, Chlorella protothecoides
  MOD_RES (183)..(186): Any amino acid
  MOD_RES (350)..(353): Any amino acid
  MOD_RES (389)..(392): Any amino acid
DARRHPAPDARQGGTGGVGAGRRAGAGGGLAARAVLARVPAHHAAAGRHLVHQRHHVRERGVGWGMHGSGIAREERGWRTGRRKSCAQIQDSSSCGSSTPRLPHARRPPAPHCLTHNRYYGLVLLSTELQTAHKEEQCTPDGQPNLVGRDFLVGASAGMRGVHRTGHPAGTRARSDRCPGLLXXXXSSHRPPRRDWRSSAITGLLSWLPSHPHPTPSPPAEHRDHQRCRGPGPAGHRLPGGWPRQEVEPAGRPPAHRPVHPPPAGGGAGGWGPALHALPVTGGDHGGLLSAVHLHPGDLPDKGGQRVWWRVWGPDGPVVREHHWGVERPPVMPSQVFMPFPVPSPLPTSXXXXETPSDAFPSVHAIPSRAPPRTGARGRGPGWHAGRRXXXXKEKTFPTQQLRSFGLALCNAMSRVGGFAAPYATVSLVESGRQTAALCLLGGMCLLACAAAFFLEHETRGRDLQAVRLSGPEAEDEALDGTPVGASPAMSAELVHTPRPPSGAQAS

SEQ ID NO: 14641 - protein, 398 aa, Chlorella protothecoides
  MOD_RES (177)..(180): Any amino acid
  MOD_RES (270)..(273): Any amino acid
MGQSERQGSPGGSRRRSSVGVPSRLGPAAQARRTQGLPIKGWKRHGNVGIELQALLPPDRTHADMDLQPIPPPSQARSSLPCSPLGWPWDTDSSGMKDQSRNGSPGILQSVSALFISSLQGPTWCPFRAPSCWICNSSRVATQKSTSGEPTVQGITSVRMARGCSWLGALHEAPPPXXXXVQCAGIDYRSLHLQSFCLSLKHTSSPPLANHTGMRPRHPTSLVTGLMWVDFTRSDWFTSIRHEALQSDGGWVLGREPPSRARRMCRLRHXXXXEALQSDAFIRLTAAPALRHPPHLAGRAILHPSTDLGFYGWLEHDGENYGIQQLEDRRFNMTTSLVCWTRVVGVAAESSDSDDPSTGGDASGAYSVGSSVILWSMASFHGKRGAYHAPQGSPATAL

SEQ ID NO: 14642 - protein, 159 aa, Chlorella protothecoides
MHGRVRMYSHHCPCCQGHACQDPHLVFGVRRHRPLHPTATANNRVPVSPPPPPCRAAMLERLNSGTTLIVDRYAHSGVAFTAAKGLPGLDTAWCRAPDVGLPAPDTVFFLDLSPEQAAERGGYGQERYETTDLQKKVHTVEEEWGGPGSRGGVGACTLQ

SEQ ID NO: 14643 - protein, 583 aa, Chlorella protothecoides
  MOD_RES (317)..(320): Any amino acid
  MOD_RES (367)..(370): Any amino acid
  MOD_RES (437)..(440): Any amino acid
MEPCRDRRGIVSHPCNLTLMQAVTLIPGCRAVPEPCLSQRRQAGPLAFTAGPSPVERRHRLVCKSAAISHSAAPPNLPSRPGNYQWQVPSPGTERPDRHWAPGRALRQQGPPPACHLLRVWPHPLQGARGVPVAENPQQAGGCSRGPAPPSHGRFCLPFDSHGAGLPSPQTLPVSPPCLHPIPCNPAHAPSPPPRFSSEAEALLDELSSNFSVEDAAEVKEVERTTNHDVKAVEYVIKRRLGRNAELAKVLEFTHFACTSEDINNLAHALMFKEALAGELSAFCCHWRCPGGATPPGPALGPWLLSSISWSALQLTXXXXRLQGGQFKAVEAGMAVVDGMHDDLAGTHQTLRYDASGQLCCPKLKYXXXXAIAGWAVSDCRGWHGRAGWCACVLDASVHGMLWGAHRLAGRASRDSPIQTLRCDASRQLCCPKLKYXXXXVVIGHVPVARHRLRTLAPLEHLLVCTPVDLYPPIPLPHFPSGWPPSTLVCPCWRGPMVKRHRPPPWARRWRCLPTAWRASGTRWEEVLVLNSAVSHGAAQEHVAWVRIKKGGLHVMDMSGPAFVACPWISQGGTNEWLSGSSG

SEQ ID NO: 14644 - protein, 236 aa, Chlorella protothecoides
  MOD_RES (184)..(186): Any amino acid
MFTSPDTRRPSSAALSASSRLQPSRYEVSVRSLIFLGICAFWEAQDPGEWAGTGGLPLIILRRLPHPAEHFHPTEHPWSAWHGSRHWVMVAGHFPAAFSPSTAPPPLSAEQGLRAALTGSPLNICGHPIKSLTAVEDRNAYYREKHASAPCCQLERGGGAPPMSRQPHYGVSDRLFGSAHVSAXXXWGRGPSHVPPPPLRRLRRAVWQCTRSRAGGEPAGDTAAGSTARNDVDHGA

SEQ ID NO: 14645 - protein, 201 aa, Chlorella protothecoides
MTVAAPSAVPSGSIWIFGFGSLVHSPGFEFKGRVEGFIRGYRRVFWQGSTDHRGHPGAPGRVATLHEDPEAVTSSPPRSPCTAQWGVAYELAGSHEEQERTLHYLEWREKQYDIRRHVSVWAAPGDARPAVEDALVYIAGPDPGSNPDYLGPAPLATLAHTVATAEGPSGPNHVYLFRLANGLRMVGFEGGAGTSLVGCRG

SEQ ID NO: 14646 - protein, 89 aa, Chlorella protothecoides
MTLSARTMVQIGTALGLGRGGALASLQADAARLSDFGELTALHYDAAAGRFADWGLHSEDVALALDPASGKLVRQTASPPRLQWVPHHG

SEQ ID NO: 14647 - protein, 100 aa, Chlorella protothecoides
MTRSPARGALIVFEGVDRAGKSTQCELLSQHLGHLGACRPVPDDLQHCQPPHPQYNVELWRFPDRSTAIGSMINSYLTKQSEADDAAMHLLFSANRWEKR

SEQ ID NO: 14648 - protein, 260 aa, Chlorella protothecoides
MVFPPAWLPPEFWIPISTTLPNAAPQGGKEAAHSNAILHRLISEVLDARAPSVGSGLVSLVTSRDDIDALLKLDDVIDLVIPRGGNALVRLKLEIWWGLGWEGQASGLSWPLLGARGQGERVPGGGRVSHIQRSTRIPVLGHADGICHVYVDAEADPAKALAIAVDSKADYPAACNAAETILVHASLADGLARELLEALKGAGVAVHAGPRAAERYGLERAASLRHEYSSLDVGFELVDDLAAAIDHIHAHGSSHTESWG

SEQ ID NO: 14649 - protein, 88 aa, Chlorella protothecoides
MTLPTAPPFRPHLVSQALRFYARTPGPYSQHAGTAAAQLRAAVLDAGVGQFRETGFFWEQYNDTSSAGRGAHPFTGWTALLTLIAAEA

SEQ ID NO: 14650 - protein, 183 aa, Chlorella protothecoides
MILNLRRTGHLDVEKALALGVARGPGFGELKAGRAVRTAAGTTVTPDQVLGASLRGRRVLILDDAALEGPGRGLLPVLRGSAGEEDPPEPCDVMVASLRGLGAGGRALQDAARAVAATARLARAEEVIVWPRDAGTTAALVGGEGGRAVLRLAAGVPRAARVHCDLWRRCLLSPACAAFLQSA

SEQ ID NO: 14651 - protein, 297 aa, Chlorella protothecoides
MLCLPTVFPRLLIRLRHAVAPHHGLDGLRQHLPGGVQVGRQLGSVQLQLADAAQGRGVGQQRVAHADPQVAQRRGVCEGVRAGLRAVDLSVVAAGGPELCGEGNLQTPGAPGGTGNRAGTADSSRAGHPTSARLGLLQPRSCRPCFHTAGHPLSKHPPHVPHPTTLHPPTSQVALPAADRQLSGEMRQGGVGDAQVALAVLKVDGVDLVGHGRGSHLPRYRALPKVAQGDVAPHVAVKVQQDGVEARHGVKDLWLGGGGRGGPNRQTWRGCRQDGRSLGLVGTQAGCKQPPSGMQRP

SEQ ID NO: 14652 - protein, 197 aa, Chlorella protothecoides
MASNGAANARVSLGPAHVLCPYPRWKTAGSGDTPPPPPKFPQEAAIKARSASRQLQALKSEDRVALLDAIADTLVAHTDDILAANAQDVESATGKITDSLLQRLILKPAKISQLAALTTCIFNTPPDGIRSIGRQDEPLGRVISATQIAEDLELRKISVPIGVLLIIFEARPDALPQIVSLAIRSGNGLLLKASGGE

SEQ ID NO: 14653 - protein, 225 aa, Chlorella protothecoides
MEPRQGATPLPSLHQALDKGRELYEKNDRMGALRAWEAGMASKGASSEERGVMAYNAACVHAYFGDVEPAQVAMRGAHAVWGNVWRWWGAGRSRPPPAWSMHAAACVPQQPFAQVMPVHIHKLPVPPIPRGGGPRPGPAGGAGVRGQKAGAAPGLAPGAAPVGEVHPGDPGGPEEEGGGHLATQVWERERGGGREIGRELVRQGSVPAGAALRAGYSVCMDRCPD

SEQ ID NO: 14654 - protein, 963 aa, Chlorella protothecoides
  MOD_RES (323)..(345): Any amino acid
  MOD_RES (486)..(510): Any amino acid
  MOD_RES (682)..(709): Any amino acid
  MOD_RES (752)..(795): Any amino acid
GVGGRRRARGGALAPRFPARRRAHRARLRRGHGPAPPGLHGLAVSNSTGGLPRGPGAQVGAGHAGAVWLRRAVPRGSPARTGASRRQHGRAGVAGHQRGLLLLPALHPAPPRRLPPPDPGLQAHRLFRDRRHAHHPGALWQVPGGGGQGADGRGPGRAVRAGPRHCHPDRGGRRRGRAACRRGAGDEGEEHADGWVAPDGPGTRPEPADADPSPSTTEREIDCALVHVGDLLKVLPGARVPADGVVASGAGHVDESLLTGEAAPVAKSPGDAVVGGSLNLRGTLRVRATRVGADSALSQIVRLVEGAQLAKAPIQALADRVSXXXXXXXXXXXXXXXXXXXXXXXASITFGVWYAAGRGGWYPAAWLPEGHTPLLFALLFGIAVLVIACPCALGLATPTAVMVGTGVGAAHGILIKGGDALERAAGVTHVAFDKTGTLTAGRPRAVDVAVFASGVAASDAALLAAALEQESEHPLAGAVLALAAGXXXXXXXXXXXXXXXXXXXXXXXXXAAEKGGGGAGAEDRDGAKPIALACPAPPAAAAAAGAGLPHQRMQGLAGRVPVVHDFRAFPGEGVSGRVPLYRDAGGAQGDAAGCTRPWTTARGGGNALRLTSQHRSWFAAPDRLRSAAGASGASELEVAVGSARFLEQRGVEVAGDGAADAYVRAAQARGCTVILVSAGAAXXXXXXXXXXXXXXXXXXXXXXXXXXXXLAAVAVADPVRPEAHGVVAALRAAGVGCTLLTGDNWRTARAVXXXXXXXXXXXXXXXXXXXXXXXXXXXXXXXXXXXXXXXXXXXXRGAASGEGGRAARAAGRPRRGGGHGRRRRERRACAGRRRRGRRGGLRRRRRRGGGRPRARAQRPGGRAGRAGPRARHAAPHPLELRLRAGVQRAGHPRRRGRALPVLPRPAAALGGGGLHGPLLRLRRLLQPHAAATRAAAPRPARRPRRQGAGGGGLSVRLGVAPPR

SEQ ID NO: 14655 - protein, 879 aa, Chlorella protothecoides
  MOD_RES (21)..(24): Any amino acid
  MOD_RES (165)..(168): Any amino acid
  MOD_RES (502)..(505): Any amino acid
  MOD_RES (578)..(581): Any amino acid
  MOD_RES (669)..(672): Any amino acid
MVWRRGYLRADRPLGLHASPXXXXQRHAATLLLVGWGGLDRCGEAPTQWSGGAAPSVPIAPSACTRAPPRRHAPPNLRTMQTLAMERGVSCACTRCVSPLATSSDRFLEVRCVLAAGADCTALQNEGTLLVDRGQEVVALARSRACRQCAPCDRPPLRKPVCRPXXXXLAAGADCTAYQNEGTVLVNRGQEVGVWCLACRRDVLVEAANQESAAAEYEAQACERERRAAGPHAARMGRGAGKHKGRKATGGGAAAAGAAPGASAAGAGHVEEEGMPAGEETPVAGHESVPSTPPPGAADSPPAAEAEAADHSQCCGGHGDHSHHHHAPPPLTFPGKWWKCCGCGSVAPGVAEQGLGPQQLVQRADLLWQQGLMLHNMKVDWGGKGSGMQRELKVHHRPWALLPHCQWTPALNSFGHSQVTARTQSWDHSFACAGLLAVGADPAGPVRWAGGEAAPPPRQGTWLQRFYPSNPCRSSGGRLSRCSTSPSSSGRPSVRMPAWDAXXXXRKGGRDLFARCLTPNRCYSPEDAYMGCFTCTGASINQALFLSSQIVDRPTLTQLTYLGALVEAAHHKIDGATXXXXGSPPQGEVWEGAGGEHCQTGLLKAVDACLLLTQVDGATVSLRTGLPPQDDAGARGVSAGVCESGCCGEERGSLGLPPRSPQVTAWQRXXXXSVDRWGCRPDVLRLLPGKEICPTAAGSPLRTYDTEAAGASVKPMPSAIHHPTTVAAEWLGVDVITDAAAKMNSSSPTGIPKCYPKKLQGTNRPQSVLHTQKLCQWKTSYMSRGRLGTCRVLSRGVCLDEAEAEIARSVDAGGADEAGGVVHCTELDRLDALSKQLHVVAQKGGESAFGTDFLRQPFLYHGEMPLCLAVPSRAALGSQ

SEQ ID NO: 14656 - protein, 86 aa, Chlorella protothecoides
RPAPWRGALGPALRAVHAELAALAAGGKLAGYAAPGTLPELQARAAMLATNLVGTGPSTEAGLALFPGLASFSHSCMPNCIWIAAG

SEQ ID NO: 14657 - protein, 559 aa, Chlorella protothecoides
MTASAAPSPATSTPRCSRKRALPTATSSSLAPEAPAAERRRSGAANQDLCCDRVAAAARRRPGPGAAGGVALRTTSVPVQRHAAADALARESTKIVHDGHAPRQALHALVGQARTGGGGGGGRRGAGQRDWLRPHRARQRVLALLLQRGGQQGGVRGGHARREDGDVHGAWPPRGQRPRLVKGDVGDARGALQRVAPLDQDPVRRADARADHDRGGRGQSQRAGAGDDQDGDAEKEGEEQGRVPLRQPGGRGLDGRLGQLRTLHQAHDLGERGVGAHARRAHAQRSAQVQAAAHHGVAGGFGHGRRLARQQALVHVPGPARHHAVGGHAGAGQHLEQVADVHQGAVYLTLRRGGGGVGVGGLGARVGGGGLGARARGVGGNPPVCMLLALVAAPLDQDGSGGGQRAQRGQGRARLRLGPRLQVLAKEHQGDEHGGGLEKVGGLVGQGLVVGGGVVVQDGEQGVEVGRVGAQRHQHVHVGGATRQCAQGSHVEPRAAAKLHRRGQRPLEHLVRGEARQLSLIQPGHAGQVGQDHGHGEDGRGERGGAQESAAPALRLARA

SEQ ID NO: 14658 - protein, 181 aa, Chlorella protothecoides
MTSHVSEGGVLQVMKSAMRSPLGAKTRDGLGPPRFITNATTTGSYLPAEDTAWGQALGSPATERDELNTHDAAVKDVCQKDEKGQNPEGGSEEKLQACHADVGGGPEYHNSSAPRLGEPQLEHYLREDIYSGSPLDPECDPASFKLSPDAQRYIVLDTNVALHQVCEGVSNGQWSGVDVSD

SEQ ID NO: 14659 - protein, 641 aa, Chlorella protothecoides
MCCRDTYVKQDPGESPNDRNDRAIRRAAEWYSQRLPGKPILLLTDDAGNRTKAIEAGVEAMSCAVRGACRGEQWGLAWHYEDRVRCLLHWVVGCGPSYTRAAWFVCTLGRRGIRAPGPATTSSMSPFILIHNQAYARLREDVPELSDLVSAGLATQAEQREAHGLGFGPSSVLLAFPHHPPTIPPFLRTVGGGAGPKKKRRVFEDHKPLSEVTAGIKAGRYHQGTLRVSRFNPWEGYIACQSVEQEILLSGRGALNRAMDGDVVAGEVALWGGVSYPSSLPMGPPCTTSTRDSRPDHIPHSTQQHTKLPSPAVELLPEEQWRGPSAHLPTQAELDAADASEGEEEVLGEDGGAHIAQVDPGEHYPGVAGAAGGDDTSAARQPTGRVVGIIKRSWRTRGYCGSLQPPRVPGASHGPGTASVLVCPVERRYPFVRITTRQVGGVNTKLGGGEATGLGWGAWALDHADGCGKWWSAEAWTHTGVRRSEGPGPSIPSHPGVAHTTHQAATLSDKRIVVAIDAWDTDSLYPTGHYVRTLGAIGDKETETEVLLLENDINTAPFTPAVHACVPPLPWALGEAEAADPARADLRHLPVCSVDPPGCKDIDDALHVRRLAGGNLELGVHIADVTHFLKPDTAMDEEAGR

SEQ ID NO: 14660 - protein, 72 aa, Chlorella protothecoides
MSKHPTFPPPLPPTPSNHQMDFLEHAAVTDVVVPAIVLEEVRARNQSVFQRLKALTASDFKRFYVFANENHK

SEQ ID NO: 14661 - protein, 274 aa, Chlorella protothecoides
MGDTITSLSLVELRALLLEAVRQAHDGLHAVAGALPGLEDSERCAMGLVVSSHVAKVEGWNAPGSPAHGVSMMNVHADRPTRGRTLGNLEPVSGAGALPLATRPLPLCDHALHAARKRALTSQLHASRQQLQRLGVVVAWSAKARAVAECRRVMQAAAVHAAALQDAADQLAYLHSELTATAAPAYDIATAVQKPHSATTSHACTGSYNLLPSSIEEHAGVSPARPPRSTVRAALAQLDFLIRAKLLQVLFCGVAVRGVRREGIGFGGAVFGLS

SEQ ID NO: 14662 - protein, 435 aa, Chlorella protothecoides
MARRKQGAPRRQSPGRTGDRQDVSLQGSGSMQEPSDGRVTDSDDVEDASKVADGRALASVSNSVRAVVAVSPKPQPWVLGPLVLQEAPVASLAAGSSISLSALDDCIVAEVLAEDPEPCPAWKARGRVWGDWWTPAGPLDPPALESPLSLPPSQECIPLPLVGAAHAIVSLLKSGHAGLCLAGTQPGLLLCLAPKALEDPALNPLDASSRPWQSSLLLALRSFGLGPWAAQVPAAEPQEAEAGDGSEVARIYARILPSKTAPEFEGPLPPALRPTLPGYQRRALRWMLQREGAAATAAKEHGAPPCKRPRADDLHPLWARVATADGGSLFVNRCTGRLSTASFPTPSPRQVCPESGWSAVRLGILGDVGDVRLRRSSDAGGPRLNILNTTPPMQVSGGILADEMGLGKTVEVLACILAHPYGGPAPDLEAQRGMR

SEQ ID NO: 14663 - protein, 462 aa, Chlorella protothecoides
  MOD_RES (54)..(57): Any amino acid
  MOD_RES (345)..(348): Any amino acid
MALQRTGSHRLHGGHSGWVGQSEGNVGAAVFPPRTLNPMTHRRWAPVACAAWPXXXXLGRGGLECLNGGVREQCSKVMVLQRTGNHRLHGGHSGRVGTGGMRSLALHRVPMSMHDVLDVMICELQRVAGRCAFALGTWGHRFRVAAHTPRPRAFLVLGSQLSRGPSQRPPPPALSQAKNRGGGRAAPAPGGAQRPGGAAAAGGAAGGGGGHLPRRAGGRRGQRAPGRARRRPAAPARTAQSAGRAACRARRRAAHAARRRADEAGGGAAGRVRGRVGGGADGGARRARSSGARGGGGRGRGAGGSEARRSACPGGGLARRGSAADRGRRPGGGRAGRAGPPGPRXXXXSNVRFDSLNGLALVLGRELRELKDAREAALAELARLDRACDRPGPDLVRLAGSCARCRAETAVSGATCAHCRLDERFLRWEVRAFSLSVAGAAGVGGEQAALLAQRAALQRVGR

SEQ ID NO: 14664 - protein, 69 aa, Chlorella protothecoides
MSKEEVEKSPFVETLVARGYEVVYLSDPLDEYMMGHLNEYDGHDFVNVAKDDLRLPEDADAKEAEKKVK

SEQ ID NO: 14665 - protein, 588 aa, Chlorella protothecoides
MMGRMNLIIATPQVPPCPAERCWFPVPSLVDTPFRARPARCRERRKDRVPFPLSCHAGASPMARGNEPAEGLLAAARLGLTDKLKLALDQASCDVVNAKDETGGHAVQGAPPGSRWSECRGRSVVSRSPHHCYSRTGLAASGGNREPARPRDPTPPTQTHRSLPPGPGRTALHHAASCGYEDCVELLLERGADGSIQDEAGDTPLHLAAQVGCDAVLGSGGELVPCCWGAGLRRQAFYQTSALRGPQGTPLSTLTTPHQIYQVCSKFPAACLAPDASGRTPVDLAVASSRGEVLNAMLLACSGSGSEAALASMRALLARGAVCDTWAPSGSSALMLVASADSRPGVELLLAHGATMELQDALGRTALMFAAGNGARGALGALLAAGASLSVRDRRGRNVLDYAGAGTPVRAALEERLRELETKSAALQEALLAEVLGEGVRAGGVQAAAPGAGKKAKKKAKKKGKGGVPGAKAAAAGPAVDGDAEEAEEAVVEACAAREGPAETGAAGDSGAAGDAGTAGEQAGAPAGEPLVTCEPAPPILACPRSPRSPRSRSPGWCTVTKAAGPKAAQHAQQGSGAAVGGHAGARR

SEQ ID NO: 14666 - protein, 73 aa, Chlorella protothecoides
MGNPVVEHSPPPPPQLTAEEYREWRQTRDAERAARVAQHAVDREAGILSGSIPPEQLTGRELARHYPELFDGY

SEQ ID NO: 14667 - protein, 770 aa, Chlorella protothecoides
MLPAPSTRVVYSAPGSLPTFHLPTPPPTLPQTHQSASLTPPPLSPLRHLPRPLPRPAFGSSPNLQALVLEAEERMEAQASSNVHASLSAAAVFYEVTIASIDQPKLLSRLSECLGDIGLNICEAHAFNTRDHYSLDVFVVNGWFGGGSEEFEETLSQRLQELPPPLVAGARGGAAGARDAPAQRGAQEHSKPLSPLSEQRVNPEDLLGLQRVRVRRWRGGRVFGEILVWHSGGGAHVAGGLRRAACALYTPLETHASYACEIPFIHSLTNRHAQEASGAAAGSSLDSDWELDPSDVMFHEKIASGAFGDLYRGSYCGQDVAIKILRAVQGTAAQFSEFLQEIAIMRKVRHKNVVQFIGACTKKPNLCIVFEYMQRGSVYEYIRKGEYRSVHVVSKVGCQHQDGPAARIPGAQVCAGGVPRHGLPAQAAHRAPRPEGRQPAAGRDGGGEDRGLWRGPRAGPHGRHDRGDGDVPLDGAGGDRAPALRRGGRCLLLWHRALGTADGARALRRHDPAPGRGGGGAEGPAPAAAAQLPPRAGGDHARLLGARPRRAAHLRATQGAHGGAVQHVPEPGPPRGAGWRCRARATQRRPLARGHSAGRLQRRVQRLHRRGGSGALAAPGRRPAGGATPEVAADRRAAGPAAQQLQLLQVMGGEGEKARPPHRRVHGPRLGGLEDGGVRRLWTVPGMPRPPSRAQHACWAPCPTPWGTPTHTPRPSSRAAGVFCLCATTRAESPCVSRVLFFRCMASAPSSPPPMGGITHALCIASPQAD

SEQ ID NO: 14668 - protein, 175 aa, Chlorella protothecoides
MATLVTIGHSSSPSSFGSLVHPAACRGMSPDTNDTPKWAQGESFRRRGGPGALRQPAVEVRWGLNDVGGGGYESAGRLRVHHPHGCHRYAFDVNIESLDVLNHKRLLDSARAEPSAVSFQVRPVDVITGTGIAGRVPSNSFLTEGSLEVRCGRGVVLGDERFFRKTMAGSPSRSA

SEQ ID NO: 14669 - protein, 649 aa, Chlorella protothecoides
MRAGPGWAAAASQARSKGGARRRPPGLPTSDRAHAGVAAALSPPPPPSLGGVGVAAQPGQQPACQLRLLAWHRRLAGARALRGRHCPRAGGGVGRGAGAGPRSGRGRGAGAGWRGRGNANQRLGAVLVPVRVVQLLHARLELLEGGPRGGVAHPAGAHGLRQRGGAVERQRRAQALLHHPHRGLERGHVGVGHAPRQQFPEHDAKGEDIGLHAVGLVLDHLRRHPAVRPRLRGHDARVVQHAGHAKVRDLHHPRLVQQQVGGLQVAVHDAPLVQVVHAAAHLQRKLEHLGYAQRARLHGVGGDEAGDPGAGIRPLRPHARCDTRPGCTSPKAPPPPPPPLTSPQSTPPHTHLADVFVDRAALHVLEYNAQVGLLGAGADELDHVLVAHLAHDGDLLQEFGELGRSALHRAQDLDRHVLPAVRPAVQVAKRAGRDLLMEHDVAGVQLPVAVQGGARGRARCLLCCACGPPQPPGDVRATTRVPHKDLAEHPSTPPPPNPHPLQAQEVLGVHPLLRQRAQRLAVLLRAALRWGIPRACGAAAGASHQRGRQLLQALTQSLLKLLAAAAEPAVHHEDVQGVVVARVEGVRLAYVQPDVAQALAEPAEQFGLVDGGDGHLVEDGGGRQAGVHVAGGLRLHPLLRLQHQGLEVG

SEQ ID NO: 14670 - protein, 336 aa, Chlorella protothecoides
MRLLNAHGLNPQAALGEGGWGTDLFKTEVVGAITRAAYGQTSLQLNALSGAAALLAVTDPGGFSIEGGFPGLASALLDSANASLHLGAEVRSIARSPGSDRLQLAWADAAAGGGAAIAAQSGDFDGIILAAPLEGSQLDLAGVPDLAPRFPRSFVPTVTTLVRGRVRASYFGQPVAAQLQYGARSGGAEALGHTLENDGMSMGAFPLRPRHGALRSKPLGARTRHLLSGKHELAAPEIPGSHAAHSNSAGRVLVTADSPVPFSSLAKVQLAPGQPSLWRLTSPKTLSHAWLSIVFEAGWQVADATTWAAYPRWGAPGAYGMEGIAPAAGVPMDRHT

SEQ ID NO: 14671 - protein, 117 aa, Chlorella protothecoides
MGPAGATQHLGLLALLIGLQCMVCASSGPHIGVVGAGIGGAASAHWIRSLLGDQVQITVFERSTSVGGRTSTTPIGNASVDTAFDQVAHHRQAGVSLCEILHWNVEGLTLGLHLDVG

SEQ ID NO: 14672 - protein, 70 aa, Chlorella protothecoides
MPWNRRKPSSTAALCRSDPPEDFSPFLLARGLWYNNALESVAGSLEAAAMSALNTALLVKRDVKARLDGT

SEQ ID NO: 14673 - protein, 449 aa, Chlorella protothecoides
  MOD_RES (96)..(98): Any amino acid
MILNAMGSGGGEAASGAGGDLAFEGGMDLVLGGGGEFFIFGGGDLAMGGGDDLFLGGGGDRFLRGGGGERFLDGGGVEERFIVSPVTRSAGVQGRXXXSGRKIYGVPGDQISWGAGSRGASQAIADVGIALVISANVEASLILRCEHDTPRLGVCGPGSSKSPFPALKTGCGRAYPISEHPQVPAICMAAAAHHGPMFLSPLFAVPKLCHPMLPLPVFPSRSGVQAGWPLGRHSTAISAWQAGDAHVFPLTRLTAETLMFVDLRLADNRYFWSEVLNIPAALPGRGDLWAPVIIVTPASDAGELHADISPSTPHSPRRWKSEEAVWRNPVGGAATNPSLVVHCLPSSERDAIFPVEFQFSLSDSSEWFELKTASYDDVTDPTRLRTPAANQTYGSLPHPSNSFQLLPCKLWGPFIADDLKKPPEWACSDLPLSPAVPTSSVPRMLESAS

SEQ ID NO: 14674 - protein, 1067 aa, Chlorella protothecoides
  MOD_RES (64)..(66): Any amino acid
  MOD_RES (236)..(239): Any amino acid
  MOD_RES (579)..(582): Any amino acid
  MOD_RES (624)..(626): Any amino acid
MKSAARGGRALRGGRHCQGSIALFRVAPPVVQPLTTMQCTPYPHCPPLPSPPPQKITENPSTLXXXEGLEGRPTLPGSIALFRVTPPVVPTPHDHAVYPIPSLPPPFLPSPHITENPSTRTLCPQATAMTGDDMWKDSEAMGLPNWNMARHSPECAFQSRTWWSREPDATRCGRRGWKRTTQGVRLWPASERSTRLVRQQLIFTVWSPLGRGGGLRGLRPTGAEGAGPVVPPPLQXXXXADLHRVVAAGERRGVEGAEAHGSQGSWPCSPPTLTKGPSRPQDAKRAWGRGRGAVRVVGHGDGGAWCRAEGAILGRAVIHEVVLLPCRELFIQGLTRLREATWDGCLATLTLHKQVDKVALSHPALWGGAGASQGRRSKEPETLKDVCGPFWEGLPPERPHVKGHRPGTRSQSRVHLQHTDAQERGRETNMVKSYINGLGCRGGKKEPASIRNNNETKSSRPDDAASPSHPILIALSHRHPRTGDLGRGDPHPVPFTTSHRAVAQHIPGESRVFLDLTQAWLVTRRPDVGLLLHLHQEWSLAVGPVPHNRQGRARERSHSRMPAGGAHGGHHVLLHFPFXXXXLLEERTGDTTFSYTSPSGAAYNLKWALNNVRSYWQESSLEAXXXTTSFLAPHHPLTLQALGIVFVAVYQKALKLAYVDELLGKVNASFSPRFQPAKFSLPSSGARGDTGAGEECHIFLDADGNSRGWVSPIRLAHGAMLTSIAGKWLRPALLSAITGRKRLTGVLSCSIAAAMRTLSPHSSACCGRARSVPIRGRGVGRGPLGHSTIPIRHLGMQCARGRGKELRGCSVCSLKCWQGLLWASPAPLEGPIKVTHVVSGRCKPFIRRCEAARSGPACRPHRSRRGRMATRMRQTPRSGPQTWPPPRQMPQTSPGRVRRPPCPNARPLAPQDPHTQSEGHLSNGFDAALLSKRLAKRGGPGAKAAKRAELRDAPKPKGKAAAKPKVARTWNDPSGGLTQGEGSLRARIGPPPRDVLASREPRVDAAALDFTEDKPSDVESETVADFSKLSLIDVAEEVVFDDVEEEVRRARKRRRPVSLAWVVVGGV

SEQ ID NO: 14675 - protein, 97 aa, Chlorella protothecoides
MIAACDTFRSGAVEQLKTHCARLGVPLFERGYEKDPAKVAAEAAKAAARAGTDVLLVDTAGRMQDNEPLMRALSNLISLNAPDLVLFVGEALVGNDA

SEQ ID NO: 14676 - protein, 1069 aa, Chlorella protothecoides
  MOD_RES (82)..(85): Any amino acid
  MOD_RES (701)..(704): Any amino acid
  MOD_RES (966)..(979): Any amino acid
  MOD_RES (1000)..(1003): Any amino acid
  MOD_RES (1032)..(1034): Any amino acid
MLEDRQSSHHVTSSQRRTGSPGTAPPACPTCQMACLMELKGLLWACREEPCGKLRNSSTNPSPLPACWFEQPTTSSLPFLIXXXXVLPVRWQACLMELNGLLWACREEPCGKLRNSSTNPTPLPACQFEQPTPSSLPFLNPPQLQAVPAGPVCAAQGHPGEGRGGRPRGQGPRRHPVCEPQPRLEGPRRLLLLQQLWRVQHRCWGPPLHPPPTHRSHGVPAQHLGAAPWAGSVPPAHPGDHLQPDAPVAQPLARQPRRAPRSDLHRYGAAPGHLPGRLPPHLLRRAGQCPSGTRLPAPAGGAAQVRGFRVVGEHGEGECGDGWWDDVVHLQLAGRVWLLSLCRLCDGRRSAANIRRRSAPPARSAGLDPTRSTSRHTLATPPPNLTTCTHEPASFMTLTIQGLKEPVRRQSRGRLQDSCRPERPAPLPAALWRLPGGPPACSPHPSPPLRPAPPAEGHPGLAPGLPGPRGRGRGLAAQGPCRARPRPDPRPGARGGRARARAARCLPRLGPRAGHAVPGGQGGVDPGRLARRAVRPGRHALLRCRPGGAGRRDPGPLVCRPRGRVGAARSRLLLPHRLCRGGGGARHGAQAGPAGRGARWVGVLWVAGGGPGKGEGEAREPGTSLDHPSVGPATRVCAAPRLSPLAHHRRPGAAALAEAEGFFMDIMLDDDIGGDHAWNCGARHSHPGTPPHGTLPTLPPXXXXSWLLGEAKGGDHAWNCGARHFHPGTPPHGTLPTPTPLRGEAGDLHTDVERLRGSWEALIDQTDGFLGFRPVPESGMDDVMSQIRAVQSARLRPSQIPRTLFREAGAVSAASSASSSPTAARLRRVGQSLLGPAASSSAASLAGSEEGGVAGGEAPPGRGAAIQVGVEKVAAGEVDMSEAGLEEPHAVEAELSLAKMEPAREAGGAGGASSSSPGHDLPDPRTDQQRAAEGTGAAHATTSAVPCDAQVTALDANVTASTIEVXXXXXXXXXXXXXXQEARPLESQRRTPSLEAQRRXXXXAHATTSAVPCDAQVTALDANATASAIEAXXXPKKPVLWNRSKEPRLWRRSAEPIPQGQHHAAAATA

SEQ ID NO: 14677 - protein, 171 aa, Chlorella protothecoides
MEGGGSRQPGMGMAACRWVSLLADHPLEPAPALHALALGISLARFGPAPRRLCVGAAGQPAPPGPAPHHHHHTRPHPPTPQVDWRDRANWNCNNNVHPSRHGTYDGVSMHPFETVFVKASWHVGGPFVDKYAEWMTAQVGRGSEGCGGGGRAGWCASQRPPSAGRLAHAAS

SEQ ID NO: 14678 - protein, 509 aa, Chlorella protothecoides
  MOD_RES (89)..(92): Any amino acid
  MOD_RES (336)..(339): Any amino acid
  MOD_RES (477)..(480): Any amino acid
MARLPRRSGLRGLNLRVIMAIIGVALLWWSLMSVSDGYTPIRGNKGKVLVSYSYFEKDDIQGDERDGKPRYSHDHCTKKSYISPLHPSXXXXKDDIQVSVLRRTECLKMFTHGIEVPRCYPAMRSEALTPSLCKTRNFDFFITTAMGVDNVLDKPHNIDFVVVQSGDACEPCKRLLQSMKCVHSWVMGEAWAAGALRHRLPVYESVSGPGRVTLLQRKENEGMDFAAHNITLEYLLAQGRLKQYKYVILLNSSVRGPFVPSYMPEGWQWPQAYTSRLVGDVHVVSSSLVCLPEVDLGEAWGCVCRLGLLGAGHAGLEGKVLNNSLSCFVSTWRGGXXXXPEVDLGEAWGCVCRVGLLGAGHAVLEGEGAPRYSTKCLSARKSCPPPRCKVATAPSSSPGQLPSTRRDSACSWTRASLRSGPANSASVCAVAGVPCAWGFPVSECQGRPLTQRRRRQACLRLTPPLLHPPQGRHRGEXXXXPTADSAQASAGMPAPQPPTPKPSPGTASW

SEQ ID NO: 14679 - protein, 384 aa, Chlorella protothecoides
  MOD_RES (208)..(211): Any amino acid
MGVPGFTISFVGLPTNSAAERAKGKTLSPMLNARDAGGGGGRRVHGAIPSLQDSLLSNICSVFVDEVADKQAVGSLTATHCATMIAAQAPTAHACRAQACFGGPYSSAGSSMGSLQYRMPRQECFTARRVCPRQRLTPLAAGEGELGTEGRDAGVPPRPCLTHKHLHSQPLPPTQSSCPVIGIIKLALPAGKANPAPPVGPALGQKQXXXXHSPCLSWDCALSSAPKPLPNTQPPPQSTPASHPILLPSYRHHQAGLASGQGQSCSTRRPRARAEAGEHHAVLQGVQCGHPGQDGLHHPRRDHRVQARGDQDPSPTPESLNLTPAQDKTFTFVLKTPPASTLLTKAAGVAKGSGTPNGPPVGSVTAEQIKVRSSRTGEAAGRPT

SEQ ID NO: 14680 - protein, 692 aa, Chlorella protothecoides
  MOD_RES (561)..(563): Any amino acid
MACLTGWAAGVPITGRRTPAWPQTYAVAAGAELAQGALPLTPGSTLVWAGFTPEGQLAAQDSAGEVRVAGLRWGAWAPLFSAEAGAAAGVCVVDASREGGGHGVSRGTCAPPRARPMEALGVQPMLVAPGPLRPCRAPAPRPSALPFFLGPSLAAMPATPAAVFPAMHTMNTHMHTLPRTHAQLGKAASTSGWWSADCARCSAWCWRGPRSPGSAWAPPPGPPSPPCPPARACWPGAAGLRRRRNASAASGSERPRRTKRRWTPRAAPRTRPGEGRGELRGSEGVEEERVSRRCRDEAVADVMSLGQARGCHATPAPSAPAGNHPPPPPPCAACACWPSWPRRIGARGALSWRSRCTPSPPWRAPSAWPPTSSERAGTAKWEGSGKTPTLSSKGLNDPSVESSSPRKSSPFCSRHRAIALADRLSLVLEERMDTGAESQEPAPLLAEVHGCMEAALPVRCSFGCLSLSRRRDHATPCAGTPALTHRGRRAAAEESGSRPGHPKEEGSGCGRGRRSQPLLTQAQACAGMTPDHRLECVRPWAEGDTHSREGLHTWLAPAKPXXXPLITGPEGLVLLVTTRWQPALQSSLRGAAGMPQARVRQALGRRRHALEGRAAHMALACKTMDAVSAKRACSVLDGDAHVARRARHRPDGRLQAAAVEVGELDGRDLLGGGKEGEVAEVGLWEGGLVWRI

SEQ ID NO: 14681 - protein, 680 aa, Chlorella protothecoides
  MOD_RES (487)..(490): Any amino acid
  MOD_RES (661)..(664): Any amino acid
MSGITSTLKVPSGEEYEGGGESAEDSGACSAPSQTAVELMRVALMSKDCNANMKCADGLLPVQVGHHPTWLDAGVTGRAWWRAHPDSYLEGHASGTVRARGTDRLIPLWVNTAPGVSHARDGHGTAHRHALAKMMGVPTGCTPATRPVVPLRPRLLGSGGRRARPGTCLHAEYRWSAADGGPGRRRKRESIFDNFDPQEDVPGRERPLEREPAWETQPSETNEASGRANPSRPSPPRPSAGAAVELEEGWGAGAWWDPPPSRRVRGLYDESGAGVDDETEEGAPSADEPGRRPASDGPLDVVPLSDAELDRVLPVFPLASQAAYFSGGTAGAVQRWGASLAATVVLSKAALLAAASLTWPVWWPWALAARRNWALRRGRRHAGLWRTRVLDVDPGSRGGVPAPRLAVARFAFGERGGPCTRLDLPADGRFQRVRPGDPAELLVLSSSPEFDEFQAREDGGSARCGVSHAPTHTLQTPRTGRSSFPPXXXXGGGGPREEMAALLLRCGWPGAGLMHPLTYSKRPGQAAHPFHPLDPTGGEGRLPSQQRPVALVLPVPRPLRCAGTSYSERWGSYVSGSGMVVFEELLDWARLLLQVGGESGKMWQADASVGAWLRGADPPGLQGRGEREQLSGPCTAAWPRPQCSESDQSLAPTPGSSSPTXXXXGSYSARKDYRLKDLRL

SEQ ID NO: 14682 - protein, 269 aa, Chlorella protothecoides
MLAGSVCRDMSPHHAAPSPELHQLTSIRLSRPWRHAACTKVLPILNLPDTHPADPAILPPYNPHLPSSHAQFFLMAGRGSRGDATPKNPVYGVTKQALVQLSASLAASVQGSPVSVHLVSPGMVATDLLLPLADTAKSGGERGGDGVGGRGGVSLIFMREDLDGPVRGLGEGGSHHVCIQLSARERLCLRCIPPHAFPCAARLINILAEEPETVAGWLVPRLRGATGNGGYLQYLTIPGALFRFATAGRRRNRFVSESQSRVGAGFTRI

SEQ ID NO: 14683 - protein, 173 aa, Chlorella protothecoides
MSEHGRVALRLYREFLSLNKRLPAQQAQANIAQARSKFREAAAMTDGGDQAEALKELVAKISFLRIMAPRLPQDRSITAAKFIFRDGEVVEGEAETPGLRWVLACANGCTSDGWPGLGVLANNSTPHWTPWTAPSCRVASSQCSMPEFRQKHAELLKRQYFGQEPPPYDPSTF

SEQ ID NO: 14684 - protein, 510 aa, Chlorella protothecoides
  MOD_RES (188)..(191): Any amino acid
  MOD_RES (232)..(293): Any amino acid
PSGATRAASHVRRPGPGLAAAAAGGAAGGGAGADAGRAARRNPGARRGRRAVHVRGPARRRRAAAARPPARRRGAHGHRPVCAAGRHRGRGQRWDRGRQGPGGRQALPEQDAVPACGTAEPAVRLLPGHPGSRDPQRQGRRCWGGMREGWARGLWHLRTGCLNSIFTKLISAKLVTCIHSSVVCALKXXXXVLGWDEGGVGQGLVGPENRLPQVDVDKAAQRPALHMRPLLXXXXXXXXXXXXXXXXXXXXXXXXXXXXXXXXXXXXXXXXXXXXXXXXXXXXXXXXXXXXXXGRPAEHAEHDAARPQRGPRPPLCRGDCPAGAGDRRRLWLHGLQATLLRPHLLHPGAAESPHPWHLFHSPAKHGYALEWGMRVGSDMDALQMRVHALPEPTQCALVKGSRGPMAISCPVVTSQGLEGPGILHVCPLGSSSLPPKCAPGASFFDMDLDEVRAKYLPCAPEAAEAGGEQWYHQSLEVCTHGPTCKQGAACTVSKEDETRQRDFVLLGMSS

SEQ ID NO: 14685 - protein, 83 aa, Chlorella protothecoides
MSLHGIAAVQAFTLPDLSSPRLLAGGVLPLRALALSPSGATLAVAGDDPGIRLLAVGSSAGGGLHGNTAGLASDGFEAPHPRS

SEQ ID NO: 14686 - protein, 133 aa, Chlorella protothecoides
MSSSLSPSSHDRQARPSAQHPACTIATAHSAPLDSPPHPSPHLSLTFTKALPDGEEALCVASGDTFFAAATSARLLRIFSLSGLQLCVLCLAGPAVTLTAGGDSLAVVWHAQRPDADGTQHLRYSVRRGPALR

SEQ ID NO: 14687 - protein, 166 aa, Chlorella protothecoides
MQGEPAQDAAPVSLPAFYSNDTPASANEMWQRLHADPLFAIKHQEQSARRSILANPVQMQAIKAQVETGVQAGLCLDVHEHSFGRELHAPSMTSCAPMFALHHSGQAAEARARQGQEEGEEGEEEEEAQAESGVGGRGRGAAGGRGRQAPGPISRGASAVARRGSP

SEQ ID NO: 14688 - protein, 89 aa, Chlorella protothecoides
MSGIGGMLVSGMAMGTGSALGHRAVDAVLGSRHPEPAAATEAAQQLVAEKAPCSEQAKAFADCMSWASGDMGACQQYFDAMQQCRLNVA

SEQ ID NO: 14689 - protein, 150 aa, Chlorella protothecoides
MRPLAPMHEPPSLPPPPQIGRRRTPVTVLTGSIVRIWDCLERVLTRHEAELSRSDRVMRIVRVDLGDGSLPIIAQGGLGAGSFLLGQAGYGVEVGIGSRRPLPRLPPARGGHVAGGGAADGSSGEGQGGQFSHDTAPSGGRGPSRATAAQ

SEQ ID NO: 14690 - protein, 299 aa, Chlorella protothecoides
MRSAGAREGGVGVGAGGACIVDACRKPGTAVAPWLPDGCEEAGQMGHAGLPHAHRSHARAPPRSARAEATQRHLAEAARRREEEERAAAATRGQRATYRPGRLSAEEQAARLSAMAHAAEAHEDERVVRVRSQTVREAAEGEVTSGQEMGARRDSDRSAATLSRVLGTEISIEWVADFRVHPHVTHQPITFLTAIPNHPREPAEREAGLRAAGTTASFVESAQKGVYGAEGGLGASGNGSLAEAVNRRKHFNQRGSAAGGAAFRRGRLHGVSERSAHPRGFREMDVHPCAGTQCCAEPG

SEQ ID NO: 14691 - protein, 91 aa, Chlorella protothecoides
MAFLNKKTWHPGRVQNMEEVWKREQVASKEEQKVRDLQKQIAEERAREELHSMAQAAGVKAKRSTGLDVPGRRHGQERGRLAGRDSGSWPG

SEQ ID NO: 14692 - protein, 166 aa, Chlorella protothecoides
MHEPGPSAPFTARTRAHRDLPSHTSHFLHQGMLQRLLRQRQRPCQQRRQQPAPSPLPAGTPQAEAGPSSSSEEEEEQVLHISGTPAAAPAPAAAETSSSSEEESSSSSSDEEEATPVTSAAAGGAQDGEYVPRRVYVGGMPYRFTEAEVREVLLVEGWRMRQRHVE

SEQ ID NO: 14693 - protein, 194 aa, Chlorella protothecoides
MAIILLQEEAYQAALGYDGEDCEGQRVKVQRCKAPTSVRRQAAPAIAAPTAAAPAAAIPPTQAGASPAPPAADARGSAPKTPGYHVAYVGNVAYDADEATLQKLFEPFNVTLVRLHTDKETGRPKGFAHVHFRRGGHGGVPWQGRRDGSVTREVWMEGDEASLDGALQLNGTQLMGRAIKVGYAQAKKNHNGGA

SEQ ID NO: 14694 - protein, 196 aa, Chlorella protothecoides
MAPHFDLPSFGVGILAQTALLLVGRAILSSLKTSARFRADNTPHPSGLKVVITGGTRGLGLALARQFLALGDDVVICSRHAEAVERTVSALRDAFPGAVVAGVACDVSVPEDVDRLGAEAQETLGGIDIWVANAALRGLARADLVHTSPGDIQAIAIVGANLTGSLLCARTALKIMSESGCKGKVCAGWLARTGSE

SEQ ID NO: 14695 - protein, 381 aa, Chlorella protothecoides
  MOD_RES (103)..(106): Any amino acid
  MOD_RES (253)..(256): Any amino acid
  MOD_RES (345)..(348): Any amino acid
MVLTPKFTPPSPPFLVAQKVYRDPASVDDELVQMLYAPSCQPGALEAFVSIMSGPPGPQPKHLVPDIGCGGERGGVEEIKDCRVTLHRVDLSSSQGTKDLRRXXXXTGGGGGGVGDQGLLGDTAPRRSFLVARHEDFAPCPLASPPGSPPCPQLPLAGVLGHSRPFHPAGGAGGQVLPGPPLAATGHALRGRAGRRTLPPRRDAAGRAGGAAALAGNREGHDPGCGLRKVKSDCQAAWQAIQPGSGQLGPRGXXXXEGHDPGCGLSKFESYCQPAWQAIQHGSGQLGPRGEGLLDPDPWGPSLTLQPLSLCIVVEKLAEMVQGQHKEVEDGRAAQEPHACLLANXXXXPRPLGSFLDIPTTHTVHRPGKARRNGTRSAQGC

SEQ ID NO: 14696 - protein, 163 aa, Chlorella protothecoides
  MOD_RES (108)..(111): Any amino acid
MMPGGMMPGAMLPGQGGMMPGAMLPGQGGMMPGAMMPGQGGMMPGHPMMMGGFGPGPMMSTAGGEEGSFLCIAAHATCQRRMPWIHTMELFPTLNERRLRGSFLPTQXXXXCQRRMPWIHAMELFPTLTEQGLRGSFLPTQQARKRQTPAARGAGPARPPRRH

SEQ ID NO: 14697 - protein, 459 aa, Chlorella protothecoides
  MOD_RES (436)..(439): Any amino acid
MANSQGRGAVQPAVLLLSCPTPPLVHLGNGEVLVPAAVPFNPPRSHLGHLPSTCAVVLQVPPGLLPGLHGVGLHALLRIVALLHPWSACGIAPQVGGHIHSPLPPHIGLLLWGVDLLQRASTSSANVAIHSVHLDEEKDVTTLVLQHARVGLTWWRGAVAGKGGLFSWEAHPGCPLGDIHLLVPAISRWAWHPFTIAASTPAQPSAPGTLTLHVKNEGTWTKDGSSAGSRLPWEVTGSTKRGQASTSLDSASPHQLPAALTSPSPPTSIHNQPCHPAEAGGPAAGPAGRRHPRHPAPAGVPSSRALDRGRSRGCGGGRHRGHGRHALPAPDGREEGGGGAGHPPRRCPLGCPPRLGVPDPGRRGRRCCNVGAEEGRRGMGSRSAEGSRGGPGHRCSLTSAAWGSGPAPLHAARGRVSREPAGLHVALFPFLAPVNXXXXSPLLQCGCRGRTAGNGFQVG

SEQ ID NO: 14698 - protein, 238 aa, Chlorella protothecoides
MQAGLCTLQGGLPGPTARGGSLHMLRPPQLTAMAPLRSRPRPSCAACKVWLGGEVPSAPGPPPSNPLPLLALPGLLHQPVPGFPGASLAALLDRVLALAARVARACTLALALLAAACLPAQLWARPALQARLLPVAGQAATRLLGRDCDPGALQALLPTGLVGLGPLARLGPLRLGPGATEGSSAAIESLDVHLDALRTLRERRPVLGLRLRGAQVRWIGWGWRLFILLSEGVGAVGG

SEQ ID NO: 14699 - protein, 300 aa, Chlorella protothecoides
MDEASTSAEEQERHSSISSLTTEEWRKRCGRCQAGAQRPDSSVPIRNERNGYVDLWVEDEFNSGSRLVCRCPPVSSLTTPTSLPSRAAQGGRAAHLGLPAGLGSGEGPSVSKAPRHSVKIHNHYADQEVEVEVPEDRCGGGQGRMRGRPACDASGRLHRSDPTAVLHVPSPAPNRYILYEAESQGLELPYACRMGCCTACAVKVESGELYQPQSLGISQGLKDQARPGGGGAPVHSGLAGVGYALMCVGYPRSDLVLSTVPEDEVYDLQFGRAFQEQATDLDSGSILRDDFAIELALGDE

SEQ ID NO: 14700 - protein, 153 aa, Chlorella protothecoides
MPGPNQLHVARQDVVADPAALLAVPSGPRTLATLRNNVEVSIRYLAAWLGGNGCVPIHDLMEDAATAEISRAQVWQWLRWGATLENGAPLTAADVREAVDEEFAALEARLGRHAVAAGEYLDAAFLTKMMTCGRELHDFLTLPAQDILLAMGN

SEQ ID NO: 14701 - protein, 128 aa, Chlorella protothecoides
MDWCIELHGKMNKDKILKLAKGFRGRSKNCIRVARERVEKSLQYAFRDRKAKKRDMRALWIQQINAGARQYGVKYSSLISGLAAQNVGLNRKMLSELARTEPFSFKALVDQVAHMRGLSAPHAGAALK

SEQ ID NO: 14702 - protein, 175 aa, Chlorella protothecoides
MGSVEHLQRAHPPNPSISLHRNVVSYADGPRGNSTGRLLFYLTTLDATAYDAQANASAMLTVSEAQLPGSCRGLDAEDPPCAKISILGELHRVPASEEGAARLCLCGAPLDYLKKEWYPQNLCRRTFSFPGTQPCRIGLLATNFTCECDVWQTGHAMCAACDMCGGPSAPSILGS

SEQ ID NO: 14703 - protein, 445 aa, Chlorella protothecoides
  MOD_RES (73)..(76): Any amino acid
MAACFTIYQSTSILKVKLRSSSLRESHLEHTAVRCPEEPNTTLSFSQNVKWAEALPPCAREKRLQHPPPMTAXXXXQGGTTALREGEAPTAHATNDGSTQRTPPNGFSSSQEPRRRSAAEGGAASHSNFPSRSDVLSAVASTTLVLALTGQALRMVAPIASPAVWLGHADALQHYLSQGAAGERGGGGDLSSPHVSGHVLRMEQEWHCCMGKSASILQAPNEQLHSIASSGVSSPSLALDAGVVAGVSAARWCLMALVSGFKASSNASKHAQVDALGRLRKRAVTVDDTETRCPSVDIATRRPPNLLPPTKALSACSPLDVVWVGAIPGAAEEWCFRGGLLPAISPDWCEGGCTGTWGQCQLQWTCQLGQRGAAVTAIVFGLLHLLDRRRTPVSAAWATGVGAAYGALYLHTGNVADAALAHALSNVVSGLGYKLGGTQAPDTPS

SEQ ID NO: 14704 - protein, 531 aa, Chlorella protothecoides
  MOD_RES (19)..(22): Any amino acid
  MOD_RES (238)..(241): Any amino acid
  MOD_RES (387)..(390): Any amino acid
MEERRIASLEVQEGRGYVXXXXGRWGSRRLDLNGRARLDNVACMPPAGPLQHAFLHPFYPGFKQQNAVHGLPLELSPEEVTLALEKEWVRLQPVLRTSAAAADAASAALARKRAHESESDGSDEEAGPRAVEGSSEAPAWREALARGSHFCIPTRAAARDPGEAMPVLPAWTFPATPGERQRYAVFKDLLSRGDDGKLVPSRRKTSLSPQARAQGHNQPVSPGQSSGPGLGTDCGRCXXXXHPNPAPPCSFRVTGGSKFGADYLLRAVPPTRPESTCSSRRCWTAGRSATPPLDPWTVLAERQAHTGQDLIVGTPGNTVLVNGQHGQLVTLKQGHEVTWHSTPPVQRLPARVSEFCKGAVAARGHVHGQGSEAATSFESARPRVTKXXXXLPQGTGALQPSPVGPQGYCKKSAAGRAGARLLGIAEWVMGVDEIRLGPHHGREHRPLLAMVPPALRVVAVTPLPCFPAAAPSPLPALPPLPRVPAVRLCAVASLRLRVQARELVDVQAPWSRAGVERVPFQSTGGCSRHQS

SEQ ID NO: 14705 - protein, 520 aa, Chlorella protothecoides
  MOD_RES (18)..(20): Any amino acid
  MOD_RES (153)..(155): Any amino acid
  MOD_RES (188)..(191): Any amino acid
  MOD_RES (208)..(210): Any amino acid
  MOD_RES (278)..(281): Any amino acid
MLPTPAHVQLSPPRRGAXXXRGLCWRVARRIRARRSEAGASVCAVVPPRWKRTAGRPSPRIHPSPGLERLADAVGHAPHARPCPALTSPPGSGPRAALAGASVRAAPGPGCGCGCTAARRGPGGQRCVSGSASASGDVAGGRGTGPCPSCPRXXXPAPAASAVRAGARAGAGAWPAVTGRVPAPPVLXXXXDGGRVPASHPTQDQWTXXXPYGALSRESRPLHQAWAGGAARCGVHRKRGVRHDIQADQHAEEEAESPDRRPAPTHPAGEKERPALEXXXXPTLPTPRDRREWGRMRRRLRAEFSKTDVNVKVREERRREAAIPNTTLFVAGFDPRTIRTRDLERAFEPFGRVKVKLRGCRAALPAACAGGAWWQRPPRLEGNSLGSMCHPPHSLACPPPAPPPALPNKEELLLCGLAMSILVQGLQNLSSAVMRCQHLRPLSTQPNIDPHFSLARIQACSLIHSHVQWSSASRTRAQAAPSPRPGESGLAVCLVVPLLPQHVDRPGCRAPLPACDARRT

SEQ ID NO: 14706 - protein, 285 aa, Chlorella protothecoides
MSPNSPVSLPPSSPRPQVTSIAAFWLAAKLEEVVEIDRPDRLRLRDVLTTFHRLLARAAGSPVPAPLDPHSARYAELKAAVVRDERHLLRALGFVIGAEQPHRFVLNYGALVLGAGTRVQQEAWNLANDSLHTTLCLTLRPEVVACGILFLAARRLGIPLPEAPPWWQPLGATTQQVHAVAAALCQLYAKPPAQYTDVRARGSGGPARGAAAGGADAEEGLETDAGVGKGAGVEAAAAAIDAVTLEQGPGSASRDARTDTARRRQVCWGGCRMLPHCTTLSCDDQ

SEQ ID NO: 14707 - protein, 158 aa, Chlorella protothecoides
MGREGACPILTSPSLPSNPPRRDTAGQERYHSLAPMYYRGAASAVVVFDTTLASSFERAKKWVHELRQNVANPDLIIALVGNKVDLVDARAVAEADARNYAAETSLLYYESSAKTNVNVVEVFEDIADRLPRAAAAAAPAGIQLDEQPAVAPRRAGCC

SEQ ID NO: 14708 - protein, 188 aa, Chlorella protothecoides
MARLVRALVLSTLLSLAAAANPAPYYISAEVVLFDSGSSDICGTSHGASETFTTAAVGSSYYMGLYKGYTDETFTEELQRPAAEAHLGMLGLLRAAMQPGHSSHWPSPLPSTGPIISARVGDNVTIVFRNTLDFDVNLVPTGFSPIVGDDSDFLDPVPSNTTVTLTFTIPQEAGPTAYEPDTKLWLYK

SEQ ID NO: 14709 - protein, 636 aa, Chlorella protothecoides
MRGRTAESFGLSPTELLETQTHHSINGLLYCAVKNVSMVQGETVRWHAAAIGSDLDLHNVHWHGNTITVHGQRADIIKMIPGSTYSLAMEARSPGTWMFHCHINDHFNGGMIVLYEVAPNATTQALLTAQLDGATREYYVQAEQDIWDYAPHGAYMCGGSAENFTADQLTYVGNFSDRIGSRYVKGLYRLYTDDTYTQRVPRAAADEYLGLLGPIMKAEVGDILRVHFKNTLPFPVSMHPHGVWYDKSNEGTPYNDGTSAEEKRDDAVETGQTFTYTWNVPDIAGPGPADLSTKAWLYHSHTVEDADTYAGLVGALIIGERGAFGPDMVPLDVDAEVVLYFSVMNEQGSLFLDANMQLFLADADWTVLLNDTQVTEQAEGGESSPAGAFAESNLMHSINGFMYCNGPHIPIARDGVTRVHIISIGTEPDVHAPNFQRQNLLADGRAAPSVTAMPGTMQSLDVVAHGSGSSLLTCRTVDHINAGMMALYDVVGDVADPPAAEAAKTYYVQAETLVWNYVPLGLDGCTGEAFDENAKQYVAHTNVSIGPEAIKAVYRQYTGPDFATRVEAPATAGLLGPTLFAEVGQTFAVVFRNALDMDVNLAFDAGLIPLSNASDPASTPVAPNATHLYTFLVPST

SEQ ID NO: 14710 - protein, 81 aa, Chlorella protothecoides
MIYTSLDNFYLTPEEVEASPSRADGVDAATEDQLRRFGCGMLQRAVVLLGLPQGVAVTAQVLLHRFYCRRSLKKFDVKVGF

SEQ ID NO: 14711 - protein, 522 aa, Chlorella protothecoides
  MOD_RES (116)..(118): Any amino acid
  MOD_RES (144)..(147): Any amino acid
  MOD_RES (176)..(179): Any amino acid
MLLEAHPKHTALLEQEATAQSLINQYDDLDLVSPDTIQALKASIDAVMSQSRQAMRDLELVSEEGSGQRVRGARSMNTLPSQESGHSARGMSSMRFSASTLASCRVWVCTGPPDVXXXASTLASCRVWSCTVPPDTLHPFTWNXXXXHKATHEALQNALTAAAQRRRAALAASGAXXXXPSTCRIPTPREAEAQSNAGLITRHKATHEALQNALTAAAQRRRAALAASGAAQRRELLGAASAQGLSAAAAAQRAAAASPRLATSQNVTQGLKRARQVLAEELQHTSATLAALDSSHGQLRGARDEYVGQAPLLKRSRRLLRTINWQSNLVRDILLTWRGTGSCDNRRKGATHDAAHVRAFQQCKPPSQQTSHQDNILLWTGVIIFGAVALYIVQKRVSYFVPGSLKPGNVLALLRHRAGAGRPGPGAQPLTQARLAEDPGPGMPTGLTDVNSIGRPAQQVIFSDGSAPLVKQAREQIQEPGLPAASPAVAREEVRRATQVGPAVQNPSLDRQAPTWQEHAEL

SEQ ID NO: 14712 - protein, 175 aa, Chlorella protothecoides
  MOD_RES (12)..(15): Any amino acid
MPSLHRSPTMAXXXXVTYHGLQTIFQHLHLTRGLPAADAAAPAGAAGGYGAAAGPLPGANAVAGLTPVLNDVLGLFHAVGGQNENGASISDVSIGVARGYDARLGLIEEFPPNGTLLIFAATSAFWSHLSFIQVVARSGGRYTVQQIQDAVEALQNDGQLYSTKDDQHYKPCNAL

SEQ ID NO: 14713 - protein, 248 aa, Chlorella protothecoides
  MOD_RES (187)..(189): Any amino acid
MKVGFSGGLVVDFPHSTRAKKYFLVLLVGQVPGAEAFCRCQLVLMPTWGGTSRRQCPYSPLVPSHVQVGGHAALPASRGMDGEDPSDEEEAYGAVQVGQRRTKRRKGGKAGKGVEWIVKKKAQQRGRGHENIKPDTKYTGRKRKACANRCAWPLGAIPSLLLCQLLGPDLAITVMLSCKLACCYPVXXXACANRCAWPLLAIPSLLLCQLLGPDLAITIMLSCKLAYCYPVTPQRQHPMEGVCTLVTV

SEQ ID NO: 14714 - protein, 145 aa, Chlorella protothecoides
MSRLARSISRLLVPPLSWRDRAWCPTLLLGALHSKAAFHLHECTFSFLHTQGMDISPSMLGIAREREVEGDICLQDLGHGLPLRPGMFDGAISISAVQWLCNARRKWASLPCTIEHPCLLGAACSAHPSPSSPHRIAAPMTLASG

SEQ ID NO: 14715 - protein, 90 aa, Chlorella protothecoides
MGRSDRPELTAPPDVFYNEEEARKYTDNTRMVNIQTQLTQRALELLALPDDGRPKYLLDLGCGSGLSGETLTDAGHVWLVRGCWSTSLWI

SEQ ID NO: 14716 - protein, 125 aa, Chlorella protothecoides
MTTFYGAGNGGFDASASQFAGGGFMPRWGCELGLRLDLNAGRSTYDSKNQTLRAFTIKQLYDAASATADDQLSVDGRDVTNVTLVGKITAVEEQNLVSIYTLDDGTGTMLTKYWIPEQDDALVRF

SEQ ID NO: 14717 - protein, 256 aa, Chlorella protothecoides
MTWHAITASGYQQTLPLYSATHALAGLGQPGAPAPGRHATPGRDGAPAGRPHRARPPPLDRSAEPFSFLVVLTERDSFLGRVSTGRIATGSVAVGDAIKVIKHTGGQGVMDQWARGEGEEHMGFKVTKLFKRSGQRTLELQRAVAGDIVSIAGAPIAGVADTIGDVGLADALPPGQVDPPTLSMIISPNTSPLAGREGTQLTGSKIGERLRQEAETNVSLRWEGQGVGGQRERSEVVQPGQAGFRVPRARGCVCAG

SEQ ID NO: 14718 - protein, 296 aa, Chlorella protothecoides
MVYNHVESARHTMICLPSLPADSVRDYCSGGEPTARHAPHVWACNSKITHAVVLQQSAQFADFKVQINILHVDYTRNGHAEGSAATVACSNPAHGPADRLADGAPLSSRMRTLPRSSHVDHGKTTLVDKLLTSGGGTLSSERAMDSNDLEKERGITISSKYTSFQHKGYTLNVVDTPGHADFGGEVERWGAWLSLDVPAVSPSGGCPPSHHIKYQHRPCHPPLTQCARHGRRSGAARGCHGGTPEPDQVRGREGPPAGSAPPGGPEQGGSPGGDARAVWRGGVGRVRYLCPAGRRR

SEQ ID NO: 14719 - protein, 101 aa, Chlorella protothecoides
MLTVIPANMCYFSGYELGKRITPPGLGVLSDVATAAIAQGVAGIVYCPIDIVKQRVQTAAVMEAGATHRQFGVLDAARQIWAGQGVKGMAQGLGWRLVWEE

SEQ ID NO: 14720 - protein, 239 aa, Chlorella protothecoides
MPVYNFKSMGVVPTAKDLVDIVLSKTQRQTPTVVHNGRDGGVAVVPRGAGWAIQRIRQFYMRKVKHTQTTWHEKLSTILEDFPKVDDIHPFYSDLLNVLYDKVTFSLATAYVLRAEGSSTHFQSSSPPNHCDHYKLALGQLNAARGMIDKVSQVRSSRGNVFWGGLLRTPSPHEEALSYKLGHDSQVLSPLPPFPAGLRAPLEVRRLPLSVQGAEACCAGARACCGSCTLSARPFSARP

SEQ ID NO: 14721 - protein, 120 aa, Chlorella protothecoides
MRFFEYYDDPSRAVKKRNFSTLHCRGADGPVVELDLACGLFDLNNQAAEQAAERSLTHGQATPNSEDDSSDDDEEESSSDEEGGAPERQEAEHAAAAGRSDGARRRKTVQRPKAGIEELS

SEQ ID NO: 14722 - protein, 167 aa, Chlorella protothecoides
MASKEWDGQRRRGAVHTSSLQKQVPAAQRNQLEDSAPFRTLEEVTPRRQGQTGMPELGLAPLMEEWREGQYSIDIAIPTELIAVEVDGPTHFPWASRRVLGKTALKRRLLTAMGWRVLPVPFYDWPEAGLEAQAAYMRSRLAGLGLPGACVAGAGPHPAGRPAGRED

SEQ ID NO: 14723 - protein, 87 aa, Chlorella protothecoides
MPPDSGPPFPPQGRMCTIMKRQGPSLAYLEQVRQHMGRLPSIDPNTRSLLVCGYPNVGKSSFMNKGELALGFGDTPGPLERGTPAEG

SEQ ID NO: 14724 - protein, 288 aa, Chlorella protothecoides
MVLASHPPSPDDGPAWAMSARDAACLLRSLSLHHAAVAGPGAACHTHLQRALDALLLHLSRLVPGAGTHEVTTVAWALATLQHRRPNVLTTITDRACQLVQEGDWDVQAVSKLCWACARLSFDAPAFFDAVARLAPSRLFSRRQPEARTLALLLGAYATLGRCSGEREQELFRLAVPACTAEYAHASSSPYQLHAHGHPALPYQPLSHIQAVHGMTCEHLINLAWSYCVAGLYPPEFFSAWRLALALQAHRLSHQDLQKLFLVEAALQLEAASASGMLLACRMEEVDV

SEQ ID NO: 14725 - protein, 243 aa, Chlorella protothecoides
MRREGFELSVSPPRVVFREEAGRRLEPIEEVGCEVADEHAGEVIEAMSNRKGEVRRGAGGVFGPLGSPPRHMRGSKSPPATLTDSPPYSPPQQMTEMVPLEVDGKQRLTFDVPSRGLIGFRSAFATITRGSGLLHRAFSRYDEYRGPLDRVRKGVLVSTATGRTTLYALGMLEARGDLFVGDGGDVYEGMIIGESSRWAWVGERGGLAGLMAGMLALQNTARWAGTWEWSETAWHTGACWQWE

SEQ ID NO: 14726 - protein, 160 aa, Chlorella protothecoides
MDISKYNYELSKAAKDAKKKQRENITETKELKFRPGTDVHDYQTKLRAAQRFVSKSNKVKVSLQFRGREMDLIDQGHEMCKDWHSEQPGGIGVVHPVPLAYHNYSAGVLRVPLQILYHVLSTPIPMQRIIEDLGSAIVVESPPSMQGRTMNMILGPRKDV

SEQ ID NO: 14727 - protein, 221 aa, Chlorella protothecoides
DRRSPAAERRSARAAKRARHAAVYQASALAATFGIVALAVGATALRITRHLDAGDPLPLGELAGTLVLMAGSAVAMEMYARWAHRVLWHDAAWGWALHASHHAPREGAFEANDLFALANALPAMGLCLYGFLRPDALGGALFGAGLGVTLFGISYMFVHDGLVHRRFPVGPIADVPVLRRIAAAHKLHHSDKYGGVPFGMFLGPQVSMRGCFRTEGEGRGI

SEQ ID NO: 14728 - protein, 60 aa, Chlorella protothecoides
MSQRAYNVWTAKEVEALKRGVEAHGVGFWEQIRSDPQFEVLSMGAITVPFVGAGAGRVCS

SEQ ID NO: 14729 - protein, 214 aa, Chlorella protothecoides
MRCAVGGGATRCEARCPTGCPCPHTMGVGGQPMHETSLPIPPPQAIEAMYARQSRWQRERAAAFFSSELGGIVTDPALMLLHADEHGFHRGHAVYETLRLEDGHIYLLKRHLQRIKSDESCPSPPSTNPRPPLRHPRLFLSMVKADIPLAPDLGVDQMARTVLETAAASTKLSGEEPLHAWAMACPGSWVAHAGEVWGIGSWSIAHEHPRSPVR

SEQ ID NO: 14730 - protein, 120 aa, Chlorella protothecoides
MVCRVPCPQITQASRFHVIPPSPLPAPQLKSVLMAIYFGGDNIVWASQAGILQNKTLILRAQKASLYGWAGGSIIGVITELHELQGRPDALDGIPVMAARDWQDRIVQGVSVEYLTDGMH

SEQ ID NO: 14731 - protein, 280 aa, Chlorella protothecoides
  MOD_RES (247)..(250): Any amino acid
  MOD_RES (275)..(277): Any amino acid
MSSVSASSPFQMKHWPLASSICRRLRGLPVLHSCRARHHPISHGSTHRPDCRPGHEDHMVLRIESGDSDVCSECWDKAVLFAAGTDPYVLMEEAVIVAAECSGTAKPLRAKTLPPTLDSFGWCSWDSFYSTVSAQGGEPGGGRERIQCMCVVGCWLSSSTSPCTCSQRLPAFKQPFPCPIPSQASTMLSEACGLRARHHAGWSLMTAGSAHRWTPPTATTRSRPSDEATGKSIGRSMVSIGDKALSXXXXCSQRLPASKQAFPYPIPSQASTMLXXXCYE

SEQ ID NO: 14732 - protein, 167 aa, Chlorella protothecoides
MSFLWGRPKAAAQPATPSGTEPQAAKQSGKAQSLELVKYDAQTGKFESGKAQSLELVKYHAQTGKFEVGTEALRILRATAGPVGVVSVCGRARQGKSYILNQLLGRAGGFTVGPTHRPCTKGLWVWSAPVPRTAADGSPYHLVLLDTEGIDAYDQVRAWDRAGSVWV

SEQ ID NO: 14733 - protein, 493 aa, Chlorella protothecoides
MARYAPRLVYGAPTPGVAEVEPSAAWNPAVLGGVGWVGDMGALFEDMHAYLAAAGVAGVKVDAQAGVGFVGHASGGGAAAAARAHAALEASIAVHFPANLAVNCMCHSTENIYAWEGTALARVSDDFYPTDASTHRPHVAACAFNSLFFSGVAHPDWDMFQSEHRAAALHAAARTHIWRPPDSLIGRRWTQSGGPQSSTSLPSTLDPTPDPSFDRPTPSKPPANPRRSAVSGGPVYVSDSPGRHCVPLLKRLVLPDGGVLRALRPGRPTRDSLFLDVCCDARSCLKVWNVNPRGGVLAAFNLQGSAWDWGRRRYRTHEAAPPPLPARAAVRDVEPYRGAPSGDRFAMHVDGAEGVLVVDADGGVDLQVPSESVDLFVGSVFQGGGQRGSDGARAEGAGDGQHKVAGSGHHQGAQESVTRCCSRGSDGARAEGAGDGQQKGAGNGHHQGAHESVTPCCTVLSFPSTLFHHLSRCTHLSPHLPSHPLLHRQAAAP

SEQ ID NO: 14734 - protein, 814 aa, Chlorella protothecoides
  MOD_RES (46)..(51): Any amino acid
  MOD_RES (362)..(365): Any amino acid
  MOD_RES (804)..(807): Any amino acid
MHTRCSMVRLPAPPLCLTTIHWCAMQQGQEGAGVQPARRRLQDPGXXXXXXMWGKVPAGRTVEEAIAPFLLIQRETAGLWCICTHMTHWCSYEGSCLSSGRVPLTTPGPEQHQHAITDVAPPSLYPPAQAGVGDPDFDAAYSAYVQSTMQTSSRRRSRGTKEWGENADVCLYGLRVPGAVQGPAEDRPLAGLWMAEGYGPHMWAITYRDHARVLRLEEVVRCDEELSHLPRVHEYRVTPGPALADAGAGHEADVEHFLRHGLVPEGVLPALGSQGWLRLVAEDHMRQVVPNYVPGRLYRLPMEACGMRVRMNPARRACPPGQMSNPCCFTSLWTCTSTTVRSDVSRARPENTKRASPDGATXXXXCRARAPRIRNEQVPVQCDLISHHLDGATEGLRGHQQRQPRAPWAGCRDGRGAGDADPGRLRIRPKPCKAGQARSGRERIIQPDPASYHPSTFPLTHQTSQTLLRGILREPAVQRGGVEQLSRLRVLALRQLAALLAGRDGGGPAALDCLCQACDLGPPDAVLLSRLTTLAGREGRWPLARWAAEAGLELDPAHPTLAAKAAAIASHVGDGAWAEELGRSVGGRRWDAAAPTAFRAALPAAYQAERPLPEPSVRSVALPRDWTPVLLEVAAFLGAGSALCEEGPDRLILLERERTEGHTAGEQSPRGMGAPGAVPGEPGQEGDAEVDAGGGDATQPAGEGGTEAAPAKLTRSRARGLGDDPTQSQPGGDEGAEDEGRARLGALWCLFPGPTRVDALRDDGEAATARDGALEEDERAAGPGAPPAPMPASTQGLEGLLWPXXXXGWSPGRR

SEQ ID NO: 14735 - protein, 760 aa, Chlorella protothecoides
  MOD_RES (173)..(176): Any amino acid
  MOD_RES (230)..(233): Any amino acid
  MOD_RES (271)..(297): Any amino acid
MPNASLLHAGRVPGARSLFAGTGSASGLVCACSAGLPSQAGEGPGRLGRDAPDVTPNYTFFKLTVCQQQHQIATSISCKPSMVAIINLLRCHISNLKAIERHHDDCGGSEAPHMRPVRGHVCRGPCERHRWWHQHQGGGRPGHGALWCAEGAHAAGGHVRAGPEGDGWGWCSXXXXPLPVGKGEVDSLSVQIESHVVVEMAGGGALAGFRSVIRLSVMVCMACPLCKRSXXXXSFAFRSWCAWCVGSASNPGSLPSPTQAYDLAGAGAVLXXXXXXXXXXXXXXXXXXXXXXXXXXXCACASLGVSTLTSAHSHTGSAACRKHLILAVSRSDPSGLMPQRAGIEGHGFFDTLVVPIIENTARECELTERLQAAIRAYPRTRAVLVRRHGVYVWGRDWIQAKTQAECYEYLFEAAVRLRQLGLDASRPAVGVEDAGRPGAAPLDVSAPGPKRAARGVPRAVVLDIEGTVAPISYVTATLFPYARVRLRSHLEASWGTPATEAVVQQLRQQVRLAVWDVLFGGPGLRVPAHVLLGMAGGSACGHAGSWVVERGRRSTCRNSLGNVSPGPPSPPAQVNGSAIPGLAPAAREGDAAEEVAAVAAWAAAEMDADRKTPALKTLQGHIWTEGFATGELTCPLFPDVAPALRRWAGAGIKLYIYSSGSRWVQGGEDGPSAGGWRLQEGDRLPEDTCCRCGMCRKGAWRREQACISRFTQSFPLPGKPSETCSGTPLMVTCAPSSPASSTPPAAPRWGGAGPGSGSCG

SEQ ID NO: 14736 - protein, 952 aa, Chlorella protothecoides
  MOD_RES (379)..(382): Any amino acid
  MOD_RES (740)..(743): Any amino acid
MTPSTPRDIAPFPWSSVHPPVHTQRLAQDLESQWRMQGLRDPPARREVWKRKVEAVVDEAASLGLALRRCCEASQARQAEATQRAELFQGASSSGQVLADMDTAARRHLASSKRVLEEAYATGAGVLGSMSSQRETLKPQRCAWVQYYRNRFPSPPWTPFPHLDGPAPAPGRHQQRGPVRFTAPNGRPAAPHGQAAGLRRHGGHATDGGPALLVPEDVEDLASGKVQGCAAVMRHTWRLQPGAGVGTLRPPADTGRVCSAVSDSLTSSRCAVANDHLGCTQCPCSVEASVALPTLPRRGAPGVRRPCCCRCSDVLGFPLAPAFPPPPTSLECTYPLAPSCAVVLLFLQTDDRAADRQGVHRGRRHILRRGEGLPGHCRXXXXASYNLVQGLRAGRGCTGAGATYCVGARDFLVTAGLPVAAASRPALPSAASSSSACRLASTARTPTMTEDDTWLPSRSRARCAPCGVCEGKGGVKAHAVAPDTGQRWDAQPIPIAIDPAVHNPAPHRELHVEPVHALPVAVGAPVQQVPAPPQLSEHVRAPASASARPGEQVSMGAGPVPASPPPGLSSIRLLVGGGGGVSRARPLLEGVRERRRVWAGVASHRGPRLACCPNRDPDARGERRPPRRSGVLDPSPVFREVGVNSRLTGPVGPLCAPAIPCWCRPPLRCARSMAPGSLERRRVWPVRRFLKCYSTVADKLCRAARTPLSGCYQPPYMHHFDIPSHSVREAQVSLLPLLHXXXXTHFTDLVHLHLWYTRRYGIIYKSYHPHTCTTTTSHHTPSAKHKSAYYHCCTHPHPPSAMAGYGMGGYVGNTHDKARITRQEKEREEAKQKFEEAKRKAEEGAGLRKFGAGTTEACCRLRTLTPSHPPQTLETAFKNETVGLFTRQEFVEKRATIGDRLQEEKKRQRAAEEEAEWQVCWRDHVLCLLHGQEVSKTSSMNWRLRPEAHHQK

SEQ ID NO: 14737 - protein, 550 aa, Chlorella protothecoides
MFGHSSTVPPSSRQEPPPSPWPQQKENELILFGGEWYDSEKDKTHVYADLFVLDVEKVAWRRIVSPKGPLPRSSHQSVMTKYHMYVFGGEFTSLNQEKFRHYKWVHWGGWRDLGGGRVMVGFIELSSWGVLGVSARHTALPAVEGIVFWALNLACNSVYSSQCFMPHRTATDPPPTTCLPRSQRSLAPQPGRLVLGAAARQGRPQPPERAPHGAAAEPPAALWRVLGRGEGAQVLQRPLGLPPHRPAVGVPGSHHADRLQLAQPARGLPAGSPRRAPFRLRRLLGAYEHHSTTLLSQDCSVSGAAPTPALQPPRGCDANKDPAAKAAKRKSAGDDDDEGGKGVVHDDVWCYDTKSGAWERVRKAGMAPSARTGFGMARHGRRAVYFGGVVDQAGGRDRVYSELFNEAYQFDLETRRWFPLAVRAPRGKRAGAAAGGADGAPALADGSALQVTPAQRARLEAAATCIQASFRGYAVRKAYTAYKLGGAVSELLYSPALYGVDVGASADTVKPRARAAPLMAVARNTLWLLGGMVEVRAQPWAGGDGGAAPM

SEQ ID NO: 14738 - protein, 73 aa, Chlorella protothecoides
MQVEAASYENIALSLGVDSADEVLFATDSLAEARAAGAAGWRVALTLRPGNAPVSKEDSACLLRIASLADLEF

SEQ ID NO: 14739 - protein, 151 aa, Chlorella protothecoides
MEAAREGRAPSRNAGGHRDQSANSRALHSVFSGGVLYVHLDHGTDLASEGLEGYTKNMRCRLTVGSHSRETECSRSKLLNRRNPVFDQKLELILDGDEAAEQDAVVRGHVAVPLQEVVSRRRVTGTWPLQGVSSGQLSMNLTWVNTLEQGP

SEQ ID NO: 14740 - protein, 89 aa, Chlorella protothecoides
MYVKEDIILPHTTSFYDLILNKVRGKSGPLFQFDLVEHAVAAFDPRVKSQDSHAGKVVDRHWYTKNKHIFPASRWEVFDLDKLTQERDT

SEQ ID NO: 14741 - protein, 396 aa, Chlorella protothecoides
MDIQVLPENARLPIIGQLAAFITRRSIVRDLVVSGTLRTQLRPLLNEIPVVGAAKVSFLGTPVFSYKGQRTSSSAQDPGVSLSSPPDDHQVHTHSQVSSYGVNPLFIPGLEHFINGFVSGTVLQPFTYPDGFVVKLDPGADDSVAELPEGLLTVVIKEATGVPRMDLIGGADPFVKLWVAEGTKLNTSVKARTRHPRWNETFRMTVHDVAHQSLRLILLDADALRADDEVGRVELALADLDLSQPRDLVVTARVAATPGVGGESGRGLDLDGHATRTGPAGPARPADEGRGESEGSNGDRGEEAREEEGKKAGAVRHDAAEAGEGVPLWREEEPETAPGQTSARQRVGRLAEQSLEIFNLRKACELHIRAYRPNPVRLGFEGGSLAAALGERASRC

SEQ ID NO: 14742 - protein, 252 aa, Chlorella protothecoides
MAGAHSGPTGPVSLLFTPTSLKTGDGSRTPDLRGGLRSPRASGSLFGQQASRGPRWDATPAQTRRRSLTPSSSGLARETPPPPPTSSLMDESPGGGEAGTGPAPMDTCSPGRADADAGALRPAPQPAPYAGCWVTTFGFGPEDLPDVLRELGRCGDLLHWGTYGDGQGVNWLHMKFAVRCWVVDGGIDGNGNGLCVPPLSCIWGHSMSLHPTFPLADAARRTAGPAAGRQPGVVLRHRRGPGRGCQPAGRAG

SEQ ID NO: 14743 - protein, 722 aa, Chlorella protothecoides
  MOD_RES (57)..(60): Any amino acid
  MOD_RES (686)..(688): Any amino acid
MLQHRVLEKVKQAVEQAAESEWPGPGTLGVRVGWEYRSWGLGGAVDDVQQCAHHTLXXXXEQAAESEWPGAGTLGVRHDTFLVTARTHRLEAGDEVMASVSLLPWVGLPSLERPSDRPRELVAPLERAQGLGGGSARKPLPRTGSPAPPSPYPERPVCGAKEARQRSGPRSPYQTPLASGKSPLRRSQVGATFDYAPGFGVLKKAVCPLALGFRVHGERCRSLLHHDSCTNQIQAMWMSKGSLVSTQPSLSSMVSGCRAGWMPPSRTPPCSRARRACARPASPAPRHPSTPCTPPAVARRGRCIPGTWDRARPAPGWMPRTSGTLSTPAPRCSTMRTRKTRGRRTTTRLATASTAPPPSGTTSAWWVGGWRTSCVCLYAGAKEPWVEGAVGVDTTTGRAAFNQQALPFSCARPSFFLGHPQDCGHDDAHTPSLFDPTPLSRRATNSAGPCLANSVDTCLPNVSAVAYTAADARPRPRRRDAVTVVAYDDAMLLHQESEACPSSGGGAHPERPDRLRAVWARLQAAELAGQRGVGGRRSGGHGLLASPFTPRSPAFLQTHAPARPNTERCVRLPSRPATDAELEAVHSRRLVRGLEALSEGIRRAEECEEEGEETAGFADAHQLSAVGPRGFPAPPPTLGASCDGGPASGVVPEPLLGVPPALTPPPLRLPPDTYACAATAAAARLXXXGGGGGDGGLCRRPAARRRGSWGVSCTAPDAGRLV

SEQ ID NO: 14744 - protein, 792 aa, Chlorella protothecoides
  MOD_RES (2)..(5): Any amino acid
  MOD_RES (163)..(166): Any amino acid
  MOD_RES (634)..(637): Any amino acid
  MOD_RES (775)..(778): Any amino acid
MXXXXRAWLTPNAYDVDGRPSWLVLTSRANMSATGSTPDLRQWITCNGGDVHADIDLFGTTEGGYRGIIATREIAEGELLLRIPTPLCMHVPSSPSEPIAWSLPAVRPPHHSPVMQHALCPGTCHASTAVPTQLLSGIHDAAPGGKRKGNRGFGVAVCVGRNXXXXAQRQSWFWRGGVCGGEFSLDPGHVAGTADRRHCRHVPFSHTVSCPTPSDDMPLRLITGSCIAVPCPHYKHAIQPRLPLCLECSSTSMHPHQGPWWLASFAPLGMPYIPPSSLTPFPAADIDPGLREAGLELYEEAARELASRYPQAWPEFTYERFAWAAGMVQSRTFHLQATNWVTGGTSDDLPEPARFLSRRSTALTAWGCAGQPRLAQEGCTPPGLSMLAIFFHTGCELYLLPGIDMVNHSSQAEQRSTELRFTPDRTAGGERIPGEFTMLASAVCSPSAWRRQPLPVAPCNPLPALSLSSAIMCPPPYTIIALYTRLPTSSPTTHHPHSLATHLDSARAISPGEEILFTYGDLSDTELLHTYGFVEGLDVPRSQGQACVQLADVLIGCGGARAQRGASGSDRCACEAIRAYLAPADAFQGLAGDILHAWAITCAGVAPRHPGPPFRKGQQSPVQLISHVGRTPSXXXXKGQQSPVQLISHVGSTPPQMLLGGKKDLQTICDRFEAWDPQGAQVAVRGFLLSRPPVVLAPAGMQQCWLSLQEPASEASDRSLNTSSDADTEQPKPLAVKKEHLAAVGAALESACARVSAAIKGLQPDAAPRARAAWXXXXGGKERAPGCRWGGP

SEQ ID NO: 14745 - protein, 154 aa, Chlorella protothecoides
MMDMHTFVPDMTSTYASSNRLPAAGTCGSSGQASDDSDQDSKQGESGSRQATEPPEFFDPEADDKSEAWVSKLRGGRRSDAILSCPQCFTTLCLECQQHAYQHNQFRAMFVMNCRCSQPVPSHVCHELQVLATPVVSGHAAEQGRRDCWRCVHS

SEQ ID NO: 14746 - protein, 312 aa, Chlorella protothecoides
MPGPTSCMFLRQGAGRWRHMLKSCRAFKCANSSSHSKYCHTFVIRVSCIVFYDCVVHVHGRLAIVDSAMDYRDQQSPTPRRSETLRLLQWNIERGYKLPGIIEELKQIDADVIALQEVDIGCERSGSLDTGNLWVWRGCVLGLPCQGGLVSKFPINLHPKTGNEIAKALGLNYAFFWWIVIQFSINLHLKTGDEIAKALGLNYAFFCEFEELRSPLRTPELQVLVRVRVGKDELVCTGSSLRSGIPSAILSQCLSQVRSWEDAGCSEGHVVSFLGWVPGHSSAMEAQRESSLTILTIYWQCAPGGLEQCRET

SEQ ID NO: 14747 - protein, 175 aa, Chlorella protothecoides
MEWPACRHPTAAIACGSGLWSDPCWHVFCLALLGVCTTGCSTTGNGKLMITPPPSTRFLGSTEGEVWQDKILSVPDPRYSEPYAADALAPNPHILAWGLPPQVALGALNPGFSDPFDARNTVTLDNPKYRWGPWSLMAGKLDWMMLRQLTVHSTSLGNQGYGLSDHAWLCADVSV

SEQ ID NO: 14748 - protein, 445 aa, Chlorella protothecoides
MSHFVKVNPVTHRLELNGQPFRIMGANCYHVQRFFTCPLSLASFVCTLPQSHGADSPQGLEERRKNPDSGFPTDCGRANIQRLIKSAAAKHINVLRIWAHNDGNGWQEIQKNGAKEVPGSSPEAPWYEPVIEEGGADGLDWVVDQAAKSKIKLIMSLTNFWPAYGGLTQYAEWAGVGGGDPWKGEPQNRFFNSGPAQSRFKAYIQKLLNRTNQYRNLQYKNDPTILAWSIANEPRVKGEKDSNTLDRWIRDTSDFVRSQDSNHLITVDTEGFFTSDISGFRVGDLNPGLLMEGCNFLTNAAHPNIDFACCHIYHDLWNIESQNKKGLNPWTTMWLDAHLKACQDVLRKPLVLSEFSHTEVGTGDEKYDARRQYLQHVYGWLEKHMKNDNWVAGSCVWMICEKYYRERYDSEKRFIAIDGDGKDGLQEIISHVQAFNDSRSLHAEQ

SEQ ID NO: 14749 - protein, 473 aa, Chlorella protothecoides
  MOD_RES (20)..(23): Any amino acid
  MOD_RES (123)..(125): Any amino acid
MQTHQLVGGQHSGIIVTSIXXXXEITMTLWGLETRLLDPGTILNRMQGTISSQRLCQGVCLLAKTTLGCAKGPTCRNGQIWLFQSVIRVCQFPPLLQEAPYGLYAEQLSGTAFTAPRTAPALXXXVTHEPFHPLNFPVETLSANFTTGTITPNQLRAPAPVDGGPSPFLRIRWTLCEASLQCVVPEELTITAAFPILSLSQLNSAAAKDGYAIHMYAASADMGDSCLANADGDFLIVPQLGTLCITTEFGKLRVAPGEITVIQRGMRFSVDVEGGRARGYVLEVFAGHFVLPDLGPIGANGLANPRDFQTPVAWFEDRQCHYTVITKFEGQLFSGGRGRALCQWAGQSPRLPDAGGLVRGQAMPLHCDHKVRGPAVLRWAREGTVWWCTWEDNGPEHRLDPGAYMYFLEALDDGEVALACSVVVLRHVSITSLNILSTSCSRSELLTLQCRRLAWELCALQGGRGQEGVVSWV

SEQ ID NO: 14750 - protein, 233 aa, Chlorella protothecoides
  MOD_RES (8)..(11): Any amino acid
MQDVALVXXXXLNLGRSLSCGRDNGHRAFQFRALCRKGTCPMQRGEREGLPTSLMQDVALVVLDEVHYLGDPWRGSVWEEVLINLPPHILVLGMSATVKNPGDLAGWIRQVDGEGGVVGPRRVQRGEQHVPSRPADLALLPRGRRAGARAAQAPAGARRAPAAPLPRSPQRARKAGRGRRGGRGRAARPPRAGRAGVGGGKDGGGRLAERAPGTTCALHGPRQVYDGRGWVDR

SEQ ID NO: 14751 - protein, 232 aa, Chlorella protothecoides
  MOD_RES (194)..(212): Any amino acid
MALSLLATRSLPDARAFLHKSFLRYMGGAATRQRLAEVAALERAAEDLRRELGAADGVGSEPELWQRFRAAQEAARSAKAAGRRLRAAVRTAHGGAMAERVAEARRETPCPAVALDLEGRLLDPGAGPDSLALLPAWLLGPSEVDGKDDGWEAAADAAPGPPRYVCLGADNRLYDVPAHALAGVHPSVPGGPPXXXXXXXXXXXXXXXXXXXWRGGAASPARGGRRPGRRPP

SEQ ID NO: 14752 - protein, 83 aa, Chlorella protothecoides
MSRLLCIGDRPLPAHRVEVVGLQTGDASVNIAAPLVIMTTEILRNQLYRSRTIAPDGVEGAEAATDAAGDDDFEVGGDRGVDN

SEQ ID NO: 14753 - protein, 92 aa, Chlorella protothecoides
MCMTPHGPDTISYEKAILPVAEEPAHLPRDTLAFMFETYYTPRLTAQALGSSSMERGYYQCWSGLKSHFTGSKSPAPSQAEEARPLAESAAA

SEQ ID NO: 14754 - protein, 349 aa, Chlorella protothecoides
  MOD_RES (160)..(163): Any amino acid
  MOD_RES (202)..(204): Any amino acid
  MOD_RES (281)..(284): Any amino acid
MQGVTFRILFRSAFVVLLGVLGMCLPFFGDIVGLVGAIGTQRGRNNLFSSVKSWFVELRVSDQVNTLADLPNYPSSPPSAPGFWPATVYYPIECWIRVYKPSERRKFWLRVGGGGSSPGREVGACPHMDIPLTMSQRNPFHHHPLSQVLNIACFVVTLAXXXXPRETPSHHHPLSQEAPVPRDARKPTPTEGRHGSSPRVPXXXVQYRVTPESRRRPGGATVPVPESPSSSTDRGPLRSLYTHVVLGGKPASDRYNRTTPPKIASLRSSRRCLAPQYQVQXXXXSPPNNLTAQLARMSRTPVPGPGGNPLGSAGRVPADFRADSFEGDDAAFKEGIDEIEDTDGVERTG

SEQ ID NO: 14755 - protein, 645 aa, Chlorella protothecoides
  MOD_RES (418)..(420): Any amino acid
  MOD_RES (510)..(513): Any amino acid
MLVIHMVPVPWLPHRALASQEGTLLAACPALTDRHALGGVQLGHQVVGGVGHHGAEHARDVACGKGHAQLLALAAFLARLGHHVLVQALDHILEGRELHDGVGDLPAPEGDHALPQPAHAALGHELGQAVAEAARPAGHGLHLDLDGLKGAQRDVGDELGRGGARHVDQVLVARRVLGAGQVGVVLLEELVEAELAGALRGVAEGGGNPALEQAAGALLGDDGAEALEDARVLGGGGLHVALHHVQGGDRSVREAAGQDAAHAAGQVVVLRGDRNGKRNDYLSVPCRGARRAPGFSSARGPAGVGRARAYPGVEGDLLLRGGMCHEAGHAAGKQIVLGGRRPLQGLLLLNGGSHGRVQGRGEWHCRQGCAQLFSQMLLTSIDPGARSSIISPYSQNSLCIGIARAVKQAHCKISAELXXXCAKRTPHLSLHILPNPAWVFYFELLGDVECHTPECECSRAVRQAHCKISAELAPKSLHYAPSLHPDSHKSEIVGIPSPKARSGGLTLVAXXXXPDSHKGEIVGIPSQKSRSGGLTLVAWPSGGDAHRGVRCGRVPCEYTPVTENPHRTELGCRPTARGLQALARLGAGAERAGHPGVVGPPAPPSPAGRGRALDPARPLPGSSPGLTARKESLHPWTFPRWRTIL

SEQ ID NO: 14756 - protein, 200 aa, Chlorella protothecoides
MPTPRRHPSPALSPNLLLPPPTSPHSTAYQLVVDKFGHRLYAAVREAEAEYLRGVAERLDLLPSPSFLPGLKYEWERHMKSMGVIRAFLLYMERMYIPNQPQLAPLNQLGLDLWRDGVVRAPRIAPRARALLLEAVARDRGGELVDASLLKAITSMYMDLGPVVYRDDFETPFLEQTSLFYAVSGEHAGGGWWGQLEFSG

SEQ ID NO: 14757 - protein, 305 aa, Chlorella protothecoides
MGKPDGRVWVGCCDSCSIPLRTPPLAPDPTCLTRPPSNVPGKDSIRYENTVDVDPKVFQNLQLFSREDANGKGEHGADRVPPKLPGDQLFECFDAQDLNVRLKELMDGLSVKVISLLEFCVCGRGGASSRRAFGVGSQFLCASLGAQVILTPSPAWLESMGGGCRPAPCTLMSPLPACPLPWLVILQRLVLGKPSTHPPPPHSLLPTHLQVFRTYNASIVLDRLLTGEVDSESVEAKKAAYDTANKEVAVLCNHQRAVPKGHVGQMEKLTAKMEALHAELAVRWRGGARGAGRRVVNPGPEGWDA

SEQ ID NO: 14758 - protein, 189 aa, Chlorella protothecoides
MGGGGSRGEGQRRHHRGGWQQDGSGREAAGFEGRSTDPTHRPNTIRQAPQGTPLQCHLPPTLYSHRQASIHRGGRHQGQGAGHPVHRDQRQSWLQHQGEPRAVFLSTARGRHACAVPPTGPWSSLREPALSLEATHPLATQALFRKIAAALPGMESLGGSKQEDLVDINLAPSSAAKAGGAGAASGCAC

SEQ ID NO: 14759 - protein, 69 aa, Chlorella protothecoides
MCIVHRLLRGCPNPCPLPATACRLENRVSKKQQQIEKAEINFKVKEDLKTVALGTSKINYLDPRITVAW

SEQ ID NO: 14760 - protein, 581 aa, Chlorella protothecoides
MSPCPTTAVGVASRLAPTGNLFPFRGVLVPLRRSKQSYRCIRCHTTLESQAEPANRREPEASEAPTAPVTLKPPPSRRPAPIYRAPPSYTPGDDSRPGERRGPEGAPRGQPGTRPDRRPNNRGPPGGARPLPSGTRPPGSPQQPSNGSSGQPYQRSASQTASRGRQARGAYNTRPPSRNPPVPITPAATESPQAASNGAVFAMLQGLLESGAAQNGRGKGGPGPSIPQEKEKKQEWVDLDSRRRARLNRRSERREERLANVAVREEIFEVGPEGMAVGDLAAMLAIPAVDVVKYLFLNGVMAAINATLDPDTVKAVGKEYGVEVLDRDVADVASGAVKSLDLSLDEDEVAVPRPPVVAVMGHVDHGKTSLLDHIRSTRVAAGEAGGITQSIGAYTCAVDSGGERRAITFLDTPGHEAFGAMRARGARVTDVAVLVVAADDGVRPQTREAAAHARAAGVPIVVAINKVDKPGADVPRVMQELAAEDLVPEAWGGKTPVVEISAKRGTGIDGLLEVVLLVAELEELVACPDRPALGTVLEARMDRRQGACATLLVQTGTLRLGDMVAAGQAYGREGSEGRWAW

SEQ ID NO: 14761 - protein, 130 aa, Chlorella protothecoides
MWRVRAFPALPTHTRIHTPLPTPRGYNIGQRLIDEYLARSKTTSCSDFKEVAERIAHVGFRMFLNTSARVAAWAPDGRSCSLILEDNPLTDFVELPEQLRGLSYSNILCGVIRGALEMVRSVGGEAHAGW

SEQ ID NO: 14762 - protein, 87 aa, Chlorella protothecoides
MQARDRAWAKMSPPGRQQFFQLAPGHARTQEDLTEDSEATVDSDVPPDTFDLVFLEVEAVDYVDLVGNTRRQWHVMEGEWMSGEVNP

SEQ ID NO: 14763 - protein, 246 aa, Chlorella protothecoides
MVTLSSLASSDSGDEEGPGGPGDGGAGAGQALMHMNLVLKADASGSVEAVRGALAALPQGAVVLRYLLAAPGEVSESDVALASASGGVVLAFQTRAGEAAALAAKQAGVELRAYSVIYDLVDDVRAAMEGRLTSVQESVPLGEAVVKATFGGGARRVAGCEVTEGALRKGASLRVWRGATLVHEGTLTSLRRVKEDVASVAAGTECGVSVPDFHGWEAGDRLEAFKLVQKKQKLEQAQAAVASFGD

SEQ ID NO: 14764 - protein, 172 aa, Chlorella protothecoides
MASLGACIGMQGHVSPTSRTSFTPPPHRAFGARRPSAPRPLPPCNAIGVPRVPYRVPKQNQWLWVDIWNCLYRERIIFLSKAVDDELGNQLVATMLYLDSENKKDLNLYINCSGGEVMPCLALADTMRHIKSDVGTVGFGGAMGMPGFLLAVGKKVRRAGKGVYAEGKGRDS

SEQ ID NO: 14765 - protein, 165 aa, Chlorella protothecoides
MEPLSSAGSLRRPSQALTAEPVEPLPERWQAALRNLDTASTCADSLASALDEALYLDTMEWQRAVPASQQHQAKQSLLNRVRALETLLTDCRGNLAASEKLRREGEARVQELEGELENNAKVFRLHYEALLDKDQTISDLQAVISALSLGSIDQQVEGGPGRAQR

SEQ ID NO: 14766 - protein, 218 aa, Chlorella protothecoides
MPDPDLASHATFLHAPHLWPLTYAWPSLIPPSLPPPKKHQGNRLPPRIHDRLSLSQTVGRRVVVIGDVHGCASELDRLLAALARPDDLLVVVGDLVNKGPASPQVLRLVQERGVRSVRGNHDDQALAAWRAWDAGLPIPKPAKHGWVQGLHADLACELEALPFTLDLPAYGVTIVHAGLLPGADLRDQPLSDLFTVGAGVWEGDWGGGLGAGQAGGGQ

SEQ ID NO: 14767 - protein, 141 aa, Chlorella protothecoides
MRCAAINAAFLALADAGVPMRDSVAACAAGYLDGTALLDLNYTEDGGGGPEVAVALQTGLDQSPRPDDVVQSVPLSCAHVQPPAHQSSLPTTAPRLSMEVFEEVVELASNGCRAVAEFLRTTLLAHVGRLSLATSIAKSEA

SEQ ID NO: 14768 - protein, 470 aa, Chlorella protothecoides
MGVSVNAWTAGPANSARTVPFRAGPCRVYRSQRPQRACVTTFPEIERRLKQRACATVSTDADVASTSEKSLDQLPDDIHLYKDLRDSIATLDLHEDDVDAADNLEGVWRFLPGPVRTFVRGLSPRLRGLLLCNLLVLVVATNWVVVKDVGESFDPFTFALLRFSVAAAAFSPFLSTALKDRTILRAGCELGVFMAAGYLAQSQGLASTDASRASFLSTFTVLVVPFLAGLSGSRVRPVTWAAAALSLVGVGLLEQSGRPPSVGDIWSFVSAVAFGIQVEKGGLGGWGGVEEEERAGVRMDVSCSDGWPGGETHPSLPPHIRHRQIFRTEHWSRRLGADSSLPLMSVVLTTTMAASAGAVAILHPEYLSSLLHHPLLTSLQSWGSITLPWREALYTGLFTTDAVLLMEVFALKDVSSTDAAIVYTLEPVLGAALAFAFLGERWTPRGWVGAALIVGSSVFSQVANSKGKEE

SEQ ID NO: 14769 - protein, 136 aa, Chlorella protothecoides
MPADLRLRENKKADNSLLISGLQLDGVGLEKGSITGAYELEDDGVLRTGQVGGTTFTAVGHTITSVIGAGILNLPYAVSILGWVAGPVCLLIFSFITQYTSQLLADCGVIRGVRQRTYTDVVEATFGRRDYVIIAW

SEQ ID NO: 14770 - protein, 760 aa, Chlorella protothecoides
  MOD_RES (163)..(178): Any amino acid
  MOD_RES (230)..(282): Any amino acid
  MOD_RES (314)..(317): Any amino acid
MEPTHSTTATLACRRRPHRGRHPSRRPADLGQRAAGAAGAGGRAPVGPRAGGHAADPGPRPAQAPALGARGGGRRGGGDLRHLCAAGRRRRAGRRAEQLRPAGAGERGAAGLRADARRRAGRTQRAWCARRAAPHAGAGGAGGGAGGQRRRRGGFGGRRALGXXXXXXXXXXXXXXXXRAAAQLRPADLRPAGPGGGGGGLRRRRAGATRGGRLGGRGAGGGRGGAGGVXXXXXXXXXXXXXXXXXXXXXXXXXXXXXXXXXXXXXXXXXXXXXXXXXXXXXGGGGLVDVGGVERSRGRLWKGVRGVWGACMGXXXXAPSARRATPGCGGLAPATSWARATTTKPRRVPIWVCCAAAYSALHSTANAVFQQSSLPPTQTSSRRGSSPEAGCHQEARRSEGDRARVWGAACRAAVRPPPRTDAGGQPAMTRFSAGRHTCLLGSQGCTMCGQAHMPSRLTGMHHGFGALLQTPCPSATYCAAAKQEARAKARVTEELAIHGGHKGSTMATYINKLYHSITRELYPYPGQSRPELGRRVISLGRAAINKLHHSITRKLYPYPGRSRPELVRGVISLGRAAVCRVIHACARHGLGIQIRCHCVGDGSGGVPACSVSGFQVAECSSGLCGKVLPISSAAATSGKTVLQLDAQDFYGGRWATLSIDDFLAALRPGQAAGATGLEVAGSTDPACIGESRAFLVDLAPRLVYGGGPMVDALLASGAHHYTEFKLLQGRWEGGCGTAIAGHLCSIRADEASDIQLHLLA

SEQ ID NO: 14771 - protein, 672 aa, Chlorella protothecoides
  MOD_RES (381)..(384): Any amino acid
  MOD_RES (560)..(563): Any amino acid
MTNAGLSRPDLRATIAHGALLLPDPALLSTGVALDRLALLQRSAGRYGAGSGALLCPMHGAGELAQAFCRSAAVGGAVQMLRSPIVALRLESAEGSRIGGGAATVSDSAGPKVGASRPVCTGIYLGTGDDRQEVAAGVVIGGVAEIASALHLGEQMADAAQSHPDGGAGGVVHGAGQPCGEVSDGTAGGAGQPCGDASSCPSSEPERPRAPTLLRCVAVLDAPALLPGQDRVTGACFDADACGWAGCEAFPRQETDWTTAWRPGWDPGPAARNTPDPLRTPCLAPHSLLQTPALLRTLVYLWTEAAAERGARSVLEPALQAVLRAASGTALFAAQGAAEGGGGGGVSAGPASLLTAVYYTEAPSDLRPDALPSNVTACPDXXXXGGVGAGPASLLSAVYYTEAPSGLRPDSVPSNVTACPDPGSEVAVDSCIASARQLFHRQGCDPDVQEGCTAHKPSVKWRCPMLRGALTALMQHQPPQDVWTFGEEGRFPLDPDPPAPDAEDVASDEEALDALRTALRTVDGTEEAAKENPDLGESECPGTEFDSIGYGKGPDQNGAXXXXRAPCPLFAVRPRRALSRGSSYTTGTIKLFSAHCPLHAHACNIKNVPELSSIALVMARALTRMGPGRMAECAENLPRPEDYLTINGFRFVSVGSIVQSIGDSASHAIALL

SEQ ID NO: 14772 - protein, 206 aa, Chlorella protothecoides
  MOD_RES (140)..(143): Any amino acid
  MOD_RES (197)..(199): Any amino acid
MAAGLRDALAAYKALLGPAADPQTPEEAERDRGAYFQQLRDSLSPGPSLANEVQAWPRSPAADLPRSRHLSISTGMRLRYLEWGRGGDETVLMLHDAGSGAEAWSPVAGPLAARGMRVLAVDMRGGNNRGLMKWKSCINXXXXVLAVDMRGGNYRGLMKWNSCINGTGNRCKHGITRFLCRLNQTLHPPPSLSEPPXXXSLGFCAG

SEQ ID NO: 14773 - protein, 615 aa, Chlorella protothecoides
  MOD_RES (34)..(36): Any amino acid
  MOD_RES (362)..(364): Any amino acid
  MOD_RES (433)..(436): Any amino acid
  MOD_RES (519)..(522): Any amino acid
  MOD_RES (545)..(548): Any amino acid
  MOD_RES (569)..(572): Any amino acid
MAVLRIADQPRVPIIPMPPATSLIADHCDTADAXXXLDMAVLRIADQPQVPIIPMPPATSSIADHCDTADALVCAAPQGKPPLPDQAWGGGMAYNAGTTAGEREVRLPRATAVKNRQAASKQITAEQILRESKALQADDFKAPVVKISDPEELAERACALRFAPANQPVLTADPPLPPPPFHAEYRLAKRKEMEDDVRRVGRWNPTVWVKYAQWEEQQKDFRRARSVWERALDTDHRNVSLWLKYVEMEMRHRFVNHARNVWDRAVSLLPRIDQLWYKYIHMEEMLGNVAGARQIFERWMKWEPDHHGWTAYIKLCPFPDGLWPAAPCMALLTIPWATASCLDGRRGACIAAFHITVAPPPXXXQMELRYNEAGRARDIYERYVRCLPDVKSWVRYAKFEMKQGELRVMLFLTWVSPCRALRLLDVQGKCLCXXXXVPDIGLSLSCAEFAGCPREVSVSPARDVAAARRCYERAVEELGEDSQSEELYIRFAEFEEKVKEPERARAIFRYGLDTLPRSXXXXLRMHLGPQLLVATCFPFHSPRPXXXXQARKGGGKGISCFPGCPSRPXXXXQPTAQAISRLREQAASIRHKPGRGGYGYLVLSRVPVAPTWLPP

SEQ ID NO: 14774 - protein, 260 aa, Chlorella protothecoides
MHACYSGRAVAGPSLHTFQRTTHPTTRSRGLKLRLYAQSAVLLDVRDLEARITNTQQGVLKGVSLTVREGEVHAIMGKNGSGKSTFSKGKDARDGLTQDGNHAFLPCRELLLVGGPRRSALPFPEQVLVGHPEYEVTSGSVDYKGESLLGLEPDERSHMGLFMRWAVWSEIEVSKLRCMVLDHITACLRRVSTPVQPICLRPKDGDPPACPPQFPEPRGDPRRFQHRLPAHRHKRSEERPGPEGPGSPRVLRFCHAQGVV

SEQ ID NO: 14775 - protein, 168 aa, Chlorella protothecoides
MDAAFLNRNVNEGFSGGEKKRNEILQLACLEADCSILDEIDSGLDIDALRDVATAVNGFRKQRPAAGLIMVTHYKVERGRCGQCEREGKLVWEAGGELNHGVRLVERCVSRRSLGHGGTHCLSFNIMSRGHHSVGERPMDGKIVKTGGMDLVDQLELEGYKVLSGAGR

SEQ ID NO: 14776 - protein, 310 aa, Chlorella protothecoides
MAAQFEVRQLRLDAARRILGMALGMAPKDKLFRSYIDMELALGAVDRCRTLYEKYVEWNPASAGAWARWAELERGLGEDERARGLYEMAVSQPALDGPELLWKAFIDYEIASGRRDAARALYERLLARTRHVKVWLSYARFEATPLALLAQRDEEGEEEGRATPLALLAPREEEGEEEGRGSEGERRAEAERAEGGAAGVAAREAAARRVYERGFRALREGQAEAKEEALLLLEAWRAMEAASTCRPAEETEAAVAAVAAKMPRRVKRKRAIVSSALLQPNVVEPGVVGQGVGAYLGVVLLPPLGNDHLL

SEQ ID NO: 14777 - protein, 190 aa, Chlorella protothecoides
MPAVTAHIAVMVGARSGWVSGGEGAALARAATAAAAAGVVTLPGMGHRALPDGARALTAALQDFLEGPAMAALQRGSAVSRRPEVLGLKTLPRFDTLQDAQKLSRARRRCAEQTMHHRKRRRPGEAPPPARLIPWTPPQALGPRPLPRPEAVEEALRKLDLENGEEPGSVGDAHQTALANNPSDYFGMVG

SEQ ID NO: 14778 - protein, 294 aa, Chlorella protothecoides
MSNEGWCLALQVPLQGICRVHGVALPVHNHVHTLAWLCTPWQLRPFLPRPDPVGRGRGGPTRSGPRTGRTHQIRVHLQHVGHPIANDAQYGGRYAGPLASRVMAAALGVAWDQMRAAAGIPAWQPDGGPAGPGTVSGGEAGPEPASRGVRGSDASNDGWAAPEASSGDAAATASKRPRVAAGNLGAADARGADAFPIREPPRPQAVFGSARNADAYAQNQAFRQGEDYRAPEGSLDDSCPHCPYLAPMDYPLDLRPLWLHARSYACAEWEFEAPLPDWAAAGYCPDAHRQGAGT

SEQ ID NO: 14779 - protein, 181 aa, Chlorella protothecoides
MDLQTPQPHPKYLDVGRPAVVVGLPLHPALKDLAGPRHVPKHLLHVDVLVPELVDAGEQGHCPVPHVARVVDEAVPHLHLHVLEPERDVPVVGVQGAFPHGARAPEVLLLLLPLRVFDPDRGVPAPHPPHIVLHLLALRQPVLCVEWWWGEGGISGEDRLVGWSKPECTSSLCGCMHSGRI

SEQ ID NO: 14780 - protein, 77 aa, Chlorella protothecoides
MGSRGGLVATFERHTVLVWGPKHGPRGALSLFHTKPFTCVALSPDDDTLAAGDRSGRILVWRGIRAAVESAAEAVAA

SEQ ID NO: 14781 - protein, 235 aa, Chlorella protothecoides
MQLRGGGQFTARPHLLTLDGQTVLVCHGNFVRAHSAVTGEPLYRLTGHTAEVTAVLADPDNAKRVRCCLVSGGGDGGGPACDVGALGEPLGWGVPAVLGGVLCLKHPPKTPPVILPKLPLCEPASPPPHPPGVHLLSGRHAAALGPPQRPGPAHLARPGARGELCAGPAGPRLAFLPGQRRLRPPLPLRPDHRHPRTPAPQDCERQPPVGAWDWEWGPWQAGDSNSIHAPADAVL

SEQ ID NO: 14782 - protein, 451 aa, Chlorella protothecoides
MVAETGVLAPGLAAQDGTGAGPGPSDGGAQEATPPSMHSAEGAEGLRGRRRHVWGPIPGQENTSTGDASTKKRKRRSRWGEKEETNDEKAIMLMPNEIVLSNGMKELGVRVQEAPGNQSLPAPASHMLAVYLPPSVTGRSPTGDPEVLVFHQQLNALNKKISEGEIDIPPEGERSPSPPPTYDAMGIRLNTREVRTLVQFQSSDRGRSGCASNAPAHSLARPPAHRYREKMQRKRNELIETLIARDPTYRPPSDYRPEKKWCKLSIPHRQYPGYNFIGLIIGPRGNTQQRMQAETNTKIAIRRDWCHDWDHLHWSNLSNARCPSLCPLSIALFIILLSTQQGCLHVITKCRGRGSIKDGTARDSKGAAGEDEDLHVMITGDRQEDVSWVEAAMGEWVEGKGWIIRGQLQCNGKGEASRACPGGIGRSGRNVWPGKAKMALADCSACQNGTG

SEQ ID NO: 14783 - protein, 663 aa, Chlorella protothecoides
  MOD_RES (306)..(309): Any amino acid
  MOD_RES (570)..(580): Any amino acid
  MOD_RES (621)..(624): Any amino acid
MACGLLPPLVTPVSRASPGCVLKWLTFSHNTAFLSPRQDRKASPLLRGGTLQGEAAAGKDASDKFKAMAAGESTASLQPQVVDGKFTEPRWKEGRWVLESFRDSKGNMDWDAVITAEMTRRRMLEGNPIPSGVWMIAEHVPGGGLITKDCSTPALSTLLHPTPSNTVNEDPVRFDTSEIPWWAWVRRFHLPEVGKGAFLDIIAPLKLAHTTPCGMKSPQAEKLNGRAAMLGYFLALGVDKLTGVGLLDQQESFLGKVVLHVAVFGGMLIYADGSGGNDLGWIPLDGEESQVVMHPRKAPSLAHLIXXXXIVKSRPCPIAVLLFRTTGDFNKYKNLFDEATFYDKQGHRWSCILAKPLPLHISFAVEGVLGGPGSAIREGVRHHRGANVPPEVHPLDRVRNKACQMVRERKREVAKVATRGDSTCHKYWHGIHVKQPRGPVSAVHASGKNVYRPAMQLCSENAAGQELAINGRGQGEAACIAHGTVSSPPPTPKDGTPCSLYPNPTPNTPSHRLDADGEGRDDLYVIAVVAPSLQPDVRHAQEEAEVHQATAALDHHQVELAVAQVAIPAXXXXXXXXXXXQFPVPAAVGAEPESMLPLDSNSANEARVLHGIRGDQPLNTXXXXPGDEARVLHGIRGVQPLTPSSSIPSPSCGGCRARVDAAA

SEQ ID NO: 14784 - protein, 218 aa, Chlorella protothecoides
  MOD_RES (33)..(35): Any amino acid
  MOD_RES (74)..(77): Any amino acid
MTACPHTPLRSYDDARPPQSDAVPALLRSCPVXXXITMMSTLHNLMACLHCSDHALSGEHVCHPVPPPPPPPPXXXXEPGAGRQAGCRRSQESGGDHRPGTRFRVRKRRGHLLRLLAGGKERRGHHYQVQGCAELCVRAGVVEGWDWYGRWQAVGDNHDPTPPSSASSASPRFDITEFPTKFAGQIKSFDVEGLVDKKNARRYDDALSYAMVASKKVG

SEQ ID NO: 14785 - protein, 228 aa, Chlorella protothecoides
  MOD_RES (207)..(210): Any amino acid
MYGQVKVEDESYQLKPMNCPCHVAIFKARQTSYRDLPLRWAELGTVYRYERSGTMHGLFRVRGFTQDDAHIFCLPDQIAGEIRGVLDLVQSVFTAFGFDRYEVNLSTRPAESVGSDADWAQAEAALVSALEDKASCSFLGGGKGKEGGAREGMTGSSIECGRAGKGVSRAWLGPLEWRSRSPLTGAGREPTAADVALPCVACLARPXXXXRESRGPGLGPGSGAVGHH

SEQ ID NO: 14786 - protein, 311 aa, Chlorella protothecoides
MCAEEQGLPSLAPRQPRTPTHSAAGSCLLVGPEGDGGVVPAEAKGVGDADADVMPRLDIGHDVDALHLRDGVVVVDGGVHPPRADGLDGGDGLQPARRAQAMPDHGLGGVHLGATHVAKHAAHGLDLRLVAHQRGGGVRVDVVDLVPVHARVGQGQADAGAHAQALRVGVGHVVRVAGEGAAQVLGQDGGAACLGVLQGLQHQHARALAHDKAVATRVPRSAGAPGLKVARGQRAAGHKAAQAHGHDGGLGAARHHHVRVAVADVVGRVHECIVCRGACGGDGVVGAHEALVDAHQRAACLRERGRGSGGL

SEQ ID NO: 14787 - protein, 310 aa, Chlorella protothecoides
MAAQNDVWCGRSFATVICTWAWAAGKGSPVERFPNRCGDQFPCSCSWGGRTAHPTSDDHCPSPTTGLARGFGFITFPDDATAAAARRAMDGHLVDDLPLIVRMKGEPSSGPAFPMRRGVLVCVLLVGRGPHQLPAAAAFSSHRGACLFASRWWAGILTSSLPRPPAPRIAGSPTICPPTPHPPPTPQHISGGGPSRPDDDLPPENKLYVGSLPPSIDDAALQREFERFGPIASCRVIYDRDTNRPRGYAFVNFVDTEAARAALFNMNGFTGFEGGRPINVKISGQSGGPGGEEGGRGGTRMHGISVGNCC

SEQ ID NO: 14788 - protein, 264 aa, Chlorella protothecoides
MSAPILRSACFRQSGMLMFARAMSALDVVPTAVCPRPFSVGASRPRARAPSHGPVRGLSSSSPSLPPRVVCGSSKRGLHSDQMRTCAAAPAAAMEVAPSETTPAPEASLTLDDLPTSSESPGLLAVRHSAAHVMAMAVQRVHKGARCTIGPWIDRGFYYDFDMPQLRDCSACPPLQGPMSLACLVTFSLLLHAQQPITEKDLPKIQKEMKRLIKRNLAIRREEVGQGYGAWLSLGDRVLGVEGSRDVCHAPCPGCVPGPPADIV

SEQ ID NO: 14789 - protein, 164 aa, Chlorella protothecoides
MLEPGRHQGGLGLGPVGVRPHRLRGAGGQVDLVAVKAKGGEHRLDQIQHPPDLARNLVGQAEDVGVVLGETAHTEEAVHGAGALVAVHRAKLRPAQGQVAVAGLPRLEDGHVAGAVHGLELVRLVLHLDLAIHGVAVEVQVPACLPQLTLCGVKGVGRESCKRS

SEQ ID NO: 14790 - protein, 168 aa, Chlorella protothecoides
  MOD_RES (74)..(76): Any amino acid
MLHLPPPQLDTPLPKPLPGDPELPDEEEEEEKKKNPKKDPDEEDPEKEKPEPSQPDDMGRIWGVGAGASEGRGXXXPAWAEFGKWGRVPRKGEKRSVRGAAARILGRGVIEPAPATARGRLSSRHVLLNIEWTVEIRTWTECGTRVIGASDVGRYLCALATIPLEQCA

SEQ ID NO: 14791 - protein, 284 aa, Chlorella protothecoides
MWHIADACLGSGKVMCMMLFHLSMSLAFHQVLQLEIWSGNHPFYRGVNSTMVTDEGRVSRFRKRFAGLEALNKISGGETVIGGKGGARPATLDDDSDDEGVAVAAKPVVKPKQKKKKRAVDRGRQSGTWGVSTKQEWVVQGTVRHRMEGPERLWMYLARLFRDGNGDPLPPQPSPECPGGPFLGSRGLAGRRHCRRGNLVQPKGQGAPQTSKAARRVPRREVTLALGEARPFTGVAAPLEVPGRPLLTPDTPGDTTVGSLSPVVGRSTPSAGSALPGAEGGVGG

SEQ ID NO: 14792 - protein, 233 aa, Chlorella protothecoides
LAAWAKLSAVQCNCGIEATLDACIHQVATWERAAARQRAEAAGGGGEAGEEEGAKGPAAFEANAAEALAGSGARAEHRPAGGADPPVPESLHANGKNPSTPRSAPRSRSVSFVALESAAVPQRSPSLRLPEAAGAPPPPCADELYDAAEDCLPLLEERTAPGGAEAAGLAAASAHACTDDSANVLAGLTPLARRRRVAARMSRQGSGSGGSRARQLARRGALPSSLGLDVVAP

SEQ ID NO: 14793 - protein, 544 aa, Chlorella protothecoides
  MOD_RES (486)..(489): Any amino acid
MSDAEDPGTSGAAPPPNDEGSNARSRLLELAKRKRQEQEEAENAAAAKKGHSVAIDFGDNSEDEGDVAGLPEPPKEQGGPARRTSGAVDEHGHAVQDQVHPVPLDLAVNIADLFGDDEDEQELAAPTEADRAFIDDTGVAEDQQIDFGDDDEQQFNKDDEAVESDLEDELDKLFTKRKRRESNTDYENKALVDSFLAQMEVAVEEDMKDYEQGEWHQPAYSEQSLQAQRCKVTLDLFFQRIAMQSASGLGSLAQGSRSMRAGRPATHKLRMLSRVQDLLSTQKLHNELLDGGLLGVLKAWIDPMPDGTLPNTTIRSSILKLLDILPVDCAMEDRKAQLKRSGLGRSIMFLAKVSDETAANKRLARGLVEKWSRPILVSRSTRGADTAEEQQILQSRQLRLAAKKPQADKELDQNGRPVKLRPGDPGFRRHAAIPEAASLDYVKRPESMTVLPVGRNAGREKPSELVQGQGGSVWSMQPGCSPPAGXXXXSPSACWEYVQPPTRSALIPPGEHKLSKKLKVMGKKNQFGRAANVSVEGRNVTIQH

SEQ ID NO: 14794 - protein, 253 aa, Chlorella protothecoides
  MOD_RES (14)..(17): Any amino acid
MQQTGLPVLKTGGXXXXPNFQCSNRLACLEDGRTGVDFLRKTFIRIDPDAIPLNHLGGTWDKAEYEDKAQEREVQEKDAEESALDARKRRRLGDLWPQHPSAHSCDPCPPYSPPTTAERDPLHQGLIVQRGNLKARDYQLDLAANLNKTQIVSVGMPLNQQGGYYCSVCDCKLMDSMSMLDHINGKWHQRALGMTMRVEASTKEQVWDGGGGLDARPLDSGFSFVKEFFMRSERLFRWLQFSEYAPARAWQAT

SEQ ID NO: 14795 - protein, 479 aa, Chlorella protothecoides
  MOD_RES (12)..(15): Any amino acid
  MOD_RES (384)..(386): Any amino acid
MVLLNAMPSVTXXXXREGCALSHCVTSCAHIAGAWYCLTQCQASHHPCSRAVERFLEVIWSWVMEPMLFVTIGASINFQTLSSGTIPKSLVIICTGKGLWLGESRRQCHPPHDRDLLCHVTRWVHHQREDLLCPGLDAQGHLISISHFLSSSATATPLAMIQAAKAGQPDYAQWEQWGYDILTTGIFAIIICATLGVLAIHLTAHRFLEMPGSWGDHSGQSGPELQSPPCTIEYLPLTFMCRCPSRSSQPEESDEGRPQPSHPSGAASNVALHRSLSTMTKRRGTEGGLNQSASAEGRQVGYEDDHTLLHHNIALEDYEVVALYIDAISELSTLVASGKPDEEELQRLSHHVAMMKRVRDAICGRCKPVPTITISSLLLTALTXXXDLLVCMIGMPVVVDANLYPTITIPSLPLTALISMQRVEQEVGQREVTVRELFRSASLLAANKPVVYRNASRAPHPPSLPASPGKGSHDGDAAV

SEQ ID NO: 14796 - protein, 310 aa, Chlorella protothecoides
MAGADREQSGNLCVHALHLHSELDHVVLFLPRVTPSLNPPGVKHAAPALFGMPILLGFTMGFILKAVGPGLVVPAMFKLQKTGLGKDQGIPPTGCSWGLGVPRIGSVHIKGIPSTIVISASFDDIVAITGFAIFSHIAITGGPESGNLGWEIAQGPVQVVFGILGGLLGGFIIGCTRIFYSRLIRLVAIYGGGELKRSGQILLCLAVASGTRKGVPAPTANILHPTVSCCPRCPTALLIMFFLEYYGMLSGGALGSLTIGLATANFWERGLPRCGSLGPSFTFSTEGTMGAVWASALGGSVPLRDVRAVP

SEQ ID NO: 14797 - protein, 810 aa, Chlorella protothecoides
  MOD_RES (74)..(77): Any amino acid
  MOD_RES (188)..(191): Any amino acid
  MOD_RES (757)..(760): Any amino acid
MYAGLWCAGRDRQLVCRAPTSIDDRREDDHSSIDPCLLWRRGGSRGQRGTPSGERSHPMGHRGPEPLDAHLPGXXXXGNGHILWVIGVLNLWTHTFLGPCKVVVGGGDLPREGRTLLLVGSLNAIDIGALHGFSNRRRICCTRIWASGHCADRRWLSGGLASPACPTLDCPRDCHVLEKGARPVISFXXXXRTCSSCLPDTLLPPRLPRAVKGRSSSDHVAVVGRLQHGNSGAASPLRADTRHAPPPQYNTLQEESLRSQLQGLTKLLADNAPGCMKEQKFENYFGRKIAVDASMHIYAFMVVVGRTGDQTLTDEAGNVTRPAPSPPPMPVNLTLRSTCALLIDECAQVIRSCQSCAIYMMCDAHVGLILPRGAPACGQMALPFLLRHRRFVFDGKAPTLKSDELAKRYSKRQTATTDLETAKETGTKEDVEKYSKRTVRVTREHNAECRRLLQLLGVPIIDAPSEAEAQCASLCSQGLVYGIATEDMDALTFATPRLIRHLIRWERRAGVEGREGDGKWTSGKAHALKLLDLAHETELEQPAASPFRVDPTSNRFLDPPPAPRKVLAELDLTADQFVDLCILCGCDYTEKIGNIGPFRALQTRCALNGANVLTIALQLIKKHGSLEATLAALDPEKYNEYGRPQLRCHPLLHPHAQIPEPFPYKEAKELFLNPEVLKPENIPPMKWTSPDLDGLLEFLVKEKSFNEERVRSAIQRVTAAKSKSNQGVSCQGMGKAEVRREEHGRKHRTDRFALSNXXXXAEVRREEHGRLDSFFGPSKTPPSQAPKRKEAGKVVPPPKKGKLGGFGKKK

SEQ ID NO: 14798 - protein, 971 aa, Chlorella protothecoides
  MOD_RES (469)..(472): Any amino acid
  MOD_RES (553)..(555): Any amino acid
  MOD_RES (625)..(628): Any amino acid
  MOD_RES (654)..(657): Any amino acid
  MOD_RES (757)..(760): Any amino acid
MSGTSVASLEEIVGAKTWYNQTAKLPMEKIQGFRAPYLAFSPEQRAILSNNGFRCAPGWLCSGAGRSEFWDPVEHRVHPTEAASCVIYSAPCFAFGDHRMSFNAPSCRYDSSISESFPSTTSPSATNLLWPYTMDYGIPQAYRDVSTTQVTSRSHTLASPQVCTTGVCSSDEVYAGLWEFPVWDTQNSDASLAGTMNPQGDLYSLYKLALDNRRSGNRAPLGVYVTAAWLEAEPERLTQLNAFFDYAAALPYTWLVTISQVLDWINDPTVATKYAPTCLSPDQLLAELPGVKICTQPNVGCSYVRGHGGTWDSDQCLCICQGAESTTGGYCRDAVGSCTVSSGQWGGGARLGPCLALSCSYGGGRSAPRVWLFSDSKPEEVAKGYDFASKEYICPIGTSPPSPPPSPPPAVASPVSGPSWGPAESIAPVPAPTQVSPSIQLSDGLCGTLPPSPPPSPPTAVASPVSGPXXXXLPPCPAPGHDLLSFAGLTISGYESLNDGYAVAIKALDGSCETCAMAPVTGTISYISIDMVCVHTIASPAGAGGHGAHVAVXXXGCASRRERRPQMPAGMGRMWQCTLLGCPQSLQHADHHVHLSRAHPAHQPVWSRLVDQATRAPPPPPTPTXXXXQGYSVTLSSVSIRSSYDVLVNIYVGXXXXGYSVTLSSVSIRSSYDVLVNIYVGESAANNGMNNALCAQSPVCPRHLPACPLPRRRASSTIPSAPPAPPRAPHRVRASLSFPFLRPPPPSELPGEGWRRXXXXPAPPRAPHQVRASLSFPFLRPPPRQSYQVRAGGASEVPCAATGTYVTVQTKGTLTLCDIYPVVASSAPPPPSPVARSPVIVDMDVTGLSTAVVTAAGAPAICGVLVSLTNDVSATCSVTSVAGVPAGRRRLLDDSSVHVTAVVQTADSTGLVASLSNTAQAAARILAAGAVPVTASSIIVSGGWCFSMEGGRGYDGGVCGRGGLSWRRLLY

SEQ ID NO: 14799 - protein, 98 aa, Chlorella protothecoides
MQTAWRASHGRRAFLKARRAALVLQAHVRGWLERARLARRRSAAILIQAAARGWAVRRHEQTRARAAQIIQVCLCMGGGGKWWEGARLRDTTCAHQDD

SEQ ID NO: 14800 - protein, 73 aa, Chlorella protothecoides
MTRSATPECPTTCLPTANCKCGTSGIPGGLDASVVPQFIVLTTDDAVTLKTKASLLQITDNHVNDNGCAMPAT

SEQ ID NO: 14801 - protein, 200 aa, Chlorella protothecoides
MLALKAQNHMATLNKLERAKGSDVSARQATKALVTANRQLLALNRVLSLLGLPAAGAGPQSANHPQDPMHGPPAGSPGVLQRLGKNTIVRGGSPCEPRHDGLPLGGISIQRQEKVGPARHGIALAPALIGFHRQPHQAPPHAQHTVLGRLSMERDRCKCQSMRMRCSTTCEGKGSACSMPLHPSIAWSPRPSPAAAPPLV

SEQ ID NO: 14802 - protein, 140 aa, Chlorella protothecoides
MRVQRSEIPSPPLLHAPSQLEDQQSNRAGWLFAKGAFDKGDLLHLRDEEERGRHLEKEVRDAEQREFARQRAELERRAESGQGAGAAPSAGGAGAAPSKRPPGAEIPSGRCVLLRSCALHDMHVQQGEGGSQSLVSLMDP

SEQ ID NO: 14803 - protein, 487 aa, Chlorella protothecoides
  MOD_RES (165)..(168): Any amino acid
MRGGALRVRHGVADCGSAEGVLAPPHPSPFPLIAFNPPLHLGQVVDEQALGQDVGQAHHAQQVVHVALDGLRHARVLHLDGHRAAVVQGAAVHLPDGGGGHGGGVEGGQARAPAGPQLRCQRGIQLAARHDVGAGAHALQRGLEAGRQQVLVLDAQHLAQLQGRXXXXKGGIECYERTGGGGWHSARVRAMRVKECGDHLISCTQKFKQPGAPSVAKKELALECDYEYEAASQARYAALVAADPELAPLFFVPPIVPDLSSRGVLTSVWVEGVHIDRVAELGQEARDRVATSLLTLTLRELFDWRFMQTDPNWGNFLYDEATGRINLVDFGASRDFPITFVREYLHMVAACARRDREAIIRHSINMGFLTGAQAVRRGNGGGSLRGGASHAGCARGGGLGGGHPLWHPGAVRLCHALDGDQARDGAGGGDAAAPADAAAGRQLLLAPQAQRRLPGLHQAEGAGAMPPAVRGGVRSLPGQGGDGRGGA

SEQ ID NO: 14804 - protein, 479 aa, Chlorella protothecoides
MVVGCCACWTPPAHMRSISPYHGGPPPNLTSNSLPVLLPPGATRPKKGLSILEWTGGVIPQGVLVSGVKAAWKAAWLTFMRELAPQDAEGAYVRPTYSFEGVLGSPDFPLETGRYRLYLGNPCPWCHRVGLALAARGLSDHVEVVHLLDDAERASRGGWVLRAPDPVSGARDLRGVYDSLSPRYRGRCTAPLLVDVAARRIVCNESSLIVRSLNALRLPGDSGVDLAPQHLLPEIERWNDRSEANTVRRREWERGSPDSNGEGFPVSCTGCGCLQQTTADINNGVYRCGFATTQAAYEAAEFSLHQALETVESALAASPFLCGAAATEADLRLLPTVQRFDAVYATLFRCGRRRIAHDYPAVDAWKARLLAAHVPGQALQLQDGLSMECAATHRCLGRLLWPPGTLPIQTCPHQTQDCYDQADAARSYYTQLFPLNPSGIVPVLEDPGKSLERQGAEERPAPVPITSIFQVHPQKALAA

SEQ ID NO: 14805 - protein, 81 aa, Chlorella protothecoides
MATLALHQHGKSRVRVGRVWREGSVHTFAEFKVATTLESAMEHAFLTESNEGMTATDTQKNTVYYVAKQVWLHGVQLDDRV

SEQ ID NO: 14806 - protein, 138 aa, Chlorella protothecoides
MLSIQDEDLLPPGFQAALERVRAGADVMPRRQLDAALAAELGPSWRARLAAFDPAPVAAASIGQVHRGTLHDGRAVAIKVQYPGVAQSIESDVDNLLRVVRLTNILPKSLFVNNLTKVKGGIECYERKGGGVRWGQNP

SEQ ID NO: 14807 - protein, 141 aa, Chlorella protothecoides
MRTKREGSTNIAGIIPQIAYVLHRVRGCESHVVLVAGANVDHYNGRLTGYVISVAIMAACGGLLFGKQADLIPTNRDAMLADVAKHKGCVRLYGITGGVTAMASFQMKFFPDVYARTVEGGRELHQGAVSSSHWSYTHPPT

SEQ ID NO: 14808 - protein, 129 aa, Chlorella protothecoides
MGWLVPSEIHSLMTRPAGMSIAAAANCLFSFVIGQSFLSMLCAMKWGVFLFFAAWVVVMILFVYFLIPETKGVSVERVPILFARHPLWSRIMGPASLEIIKWDATRAASHQAAADQRAATIGDLKKAAQ

SEQ ID NO: 14809 - protein, 457 aa, Chlorella protothecoides
  MOD_RES (100)..(102): Any amino acid
MARTFALLLCLAGLVLHGHAAASPPIDPFASSSTVSTGTNGAAAFSPKVQMLMGRLPVRGCPRRGGGFRATHFGRSALSLGIECGIMVICILAHIRACAXXXEGRGCSGDTFWEISSQLRHRLRDHGDLHTCPHTGMCVPSKHAVHSHGWGCSMPCPGPPQGPVLLTPGPPSLPDPYASIPTGDLYSHPPPTPHIYPTQSPAASPTAAAPAAVDGLALAAEYAAAPGAQPAEQRLTYKGVATTGYTSTPLTTYGATNLGCALGYVGDNFTSDYVAMGPSFFNQGYSCGLCIRLECDDARCEQPGRTRVAQVLDYCGNCYDADLTIAQPLFVALTGRQPSPNPSALISWEFVDCAPYSNGTIKMLVKQGGSAYYQAFSFANSIYTITAAQLNGDRLVHGTDNYWSWNPVSTIDPAGPFTLDILGSNGQVLQVVLPALVSTDLGLQFTPPAPVPAPSAE

SEQ ID NO: 14810 - protein, 422 aa, Chlorella protothecoides
  MOD_RES (283)..(285): Any amino acid
  MOD_RES (344)..(361): Any amino acid
MEMFVVKDCRVPAGARGEGQEYRHRAELPPSPIPLLLVRPRAPPGWSQLPGHHSAPPMNTVRACSKDPNPSQRLQRPITRSKEARGSRTAGLDRDRRSKLHARRWREGGSNPYRPLAGTTSRAGMRANSFIVVILAACLAGMAAAQIPDIVPITVQEALGPLPEVPALEDSAPAVEVPPAVVGALPGTGPESEPVAEPVAEPESEPAVEPAAEPESEPVVEPESETPLEPVTETTAPGAAVIPVIPLPSPVPVAEVPNLTAPSLADVGRWGHKAGAEGEQGGXXXLLSGESRGLSHRERAALTHLLPPLMPLSPTEDLAGIVPEVIAPGLESALGPDTEFPLVXXXXXXXXXXXXXXXXXXSRGHGAWTGTVPSTDTGPWGCWPVSIAERGIMRALGDQDAPCLAHGPQTQPPLMHRRGAGG

SEQ ID NO: 14811 - protein, 214 aa, Chlorella protothecoides
  MOD_RES (91)..(94): Any amino acid
MCLCEHAGPVARPCPAGINFHTPLPSLSHPLLRSGSDPLSAFLDSGEGGGSQFPASPFPLPQQYFETWEAKMAAAGEVRAAVKEGPACIPXXXXGQRAPRATGVTWANNWTHTTAARGLSSGPSVYPRQSHTAAGVKGGNHPFPAPHSSVSLLIITTPCPTMQAALEEGRRRELMAAIQASFKDWLQSTGSMRHVYDIARMERAEAGTGSGGRG

SEQ ID NO: 14812 - protein, 506 aa, Chlorella protothecoides
  MOD_RES (152)..(155): Any amino acid
  MOD_RES (261)..(264): Any amino acid
  MOD_RES (496)..(499): Any amino acid
MFMLEPGTRAVVFDLDGTITVGDGQVVTQFTLDALGASTALNAKLSHKYDLRPRRHALHAVRAWAAKGYQPIYLSGRQGSYYNLTLAWLIKHRYPPGPIHLTRTHLPTLPVYFSVGLFKVKWVWGSGQGGRRGRLFVGPPRVQRIDRVGKHXXXXFKVKWVWGSCQGGRRRGRLFVGPPWIQRIDRVGKHVEVPSARSTRPRGVCSARSGGGCCAAPDGVGLAMRASRPPPSPSFPPCARYIEGLRAKGIDVYAAYGNTMXXXXSARSTRPGCVCSARSGCGSCAAPDGIGLAMRASRPLPTPCLPPCARYIEGLRAKGIDVYAAYGNTMTDIKAYEAAGVAKVGKARGAMPGQTCVSRGYAGESGTASPQPGSSRWNDWPTMCPQHCTVPAPRGRDTHKDTHMRTVLQSLTPAPLHLLLFYACRRGPTSSGPLRGRTARRRLQTGPTTCPRSWHTPTQRSPSPTPNCSSLRCRDMSSKSGQKWGQEGSLRRSRMXXXXEMPGYVK

SEQ ID NO: 14813 - protein, 218 aa, Chlorella protothecoides
  MOD_RES (102)..(105): Any amino acid
MTALVDAYQSSAIPEFERILRTHRAAIMADPFIAQYVEDLLRNVRIQASMEWGEGGRGACLGPGVRLPRTASVGMDVEGMDGHHDRLPAPSPFQTRKHPSQXXXXSTGITTGFQRHHPSATQTPLPSPPQAVSRLVQSYSRIRLSAIGEELNIPPPEVESLLVSMLLDGKFAGAIDQVQGVLTLDRADPNDARHAALERWGCQLAALQGTLAARLNAV

SEQ ID NO: 14814 - protein, 166 aa, Chlorella protothecoides
  MOD_RES (82)..(85): Any amino acid
MDVYLAPSCKHQKPVHTLTRPPPAQVDVENQYYNSKGLLETEDGLDEALAGFQQVLEMECEDREKWCAGWLRVGWGGGMFIXXXXGPREVVRWVASGLGGVEGWVLWSCSIHGPCKGIRHKIVAGCIAGDVASPGARCSSYALAGHPAVSRSGRAPHPCPKILPPL

SEQ ID NO: 14815 - protein, 107 aa, Chlorella protothecoides
MTLITAGWSRIPTPAIPRTRSPPTQASGSLDVLSNAYRANPAPFREQRIGYLLQRGPECFDFEYYLAQNSDLRCRQGKRGWEGRGMGSCLVAWRFAGWMCSAPGILA

SEQ ID NO: 14816 - protein, 500 aa, Chlorella protothecoides
MARPYADLRWPVCIRTGSRNPRGQTSHPYDPPHTSPEPQHRAHLPSVRQHLSEHLAIHEALVKGFRGFVCAHLALLLEAVGVRGLQGATPGPDAMDSEGGEGAAAGRVSAAQLDRLGFLIAQGPPSQEEVWGRGEASPTRGSPMDICATPTLFQGGFVLLAWVLSGGVIVDGGWEVGEQARLLGASAPGADLDSGTLGALCLPIAAHAFVDSVGLRGACSASHPHSPPGAGVVDTHWSLGRMHAYQYAARPWQSPSCNSPSPLIPPPHPADAPPRLSSLSPFFHDPSQPDPPALAVAGWLAESLGAEDLGPGAGYGDPGGAASPPPPPSAFNQLVSLASPSDLQSLHKATVVRGEDDFPGGAARVLDCHDCIVYALAPLRHALISCCTDCLVVVGAVGCMLRVERCERVQVVAAARAATVNTCHDCILHLGVNREPLLAGDNRFVQLAPYNAGYERLEAHAALAGCRSCPRPSWCPSWCPSAARAGRWQAGRPCNETPGV

SEQ ID NO: 14817 - protein, 63 aa, Chlorella protothecoides
MLGFGLGLASIAFWMVAQIPQLVANYRRQRADALSPWFLAEWLLVGRGFHGARKGKGGVVWTV

SEQ ID NO: 14818 - protein, 304 aa, Chlorella protothecoides
MAPRSGKAVVTGGGGYFGNRGVSLQTITAPGVLLTHRLAKRLAALGYDVVALDVQVEPAAGVEAVVGDVRDAKLLQGIFQGADVVFHTASYGMSMREQLHTAIIHAPTSSTPNPLPTFHPGTDNVVAACIACGVPSLVYTSTYNTVFGGVEIVAGDESLPLFPLDAHCDAYSRTKALAEQAVLAANGARHVGKDGDPGRGRLHTTALRPAAIYGAGERRHLPRTVENARRGWYKCTFGKPSSLTDMVHVSRRQDEENSGAGWELLWGRVDNLVEAHVLAARSLAHANGGEAAGQAYFISGGKHG

SEQ ID NO: 14819 - protein, 196 aa, Chlorella protothecoides
MYVFSNTDPEYITNLRFFVQFAISKDDRCDYVIVVQTDADKAERSGPFLPIPPSHPHPSPSSQTPDLPDLPPNARYLHHANECYDWGTIGWAINVAGVDTRPYSFFIFMNSSVRGPFIPPYAKDMIKWQDVLIGRIDARVKLVGPTISCEGSPPGGRVREKWRVNPHVQSYVLATDQGAQGDSALADLQCAGHAPL

SEQ ID NO: 14820 - protein, 127 aa, Chlorella protothecoides
MFRFFEPLLVGLGFPTPHLRLPLLVVYCLAWLTELIWRVVHPVWDFEPLLVRAEVLKVGVTHYFSIDKARTELGYAPISTDLVQCGALEWFLERMPEERPRGRGGSVLFVLAALIGVFLVLHALLRA

SEQ ID NO: 14821 - protein, 177 aa, Chlorella protothecoides
  MOD_RES (32)..(34): Any amino acid
MRCAGPGPFRPRVQLRRDAWVGSLTPLDIMSXXXLCRGGGRKVCGGGDAMRRGRALSTPCAAETGRVGRFPHPTRHHVLEGSLCSEPRAGRSRGSDPASLGRLSHRQPAVPCSHSPPPTLALRPAPHRRRRGRCPHPRRGTGAPRPGPRRWTCTWGPQNPPPPRPTSGWRPRRPARG

SEQ ID NO: 14822 - protein, 490 aa, Chlorella protothecoides
MHFEHGLPHTDSQRTRKPLRGLDHEYYYQLHIEHTARRWCTHVKITTEHNHGMLTWKLSIHIQDVLWLLDEELLLSGGPIEPCTESSRRSSTIVRTKLERCKSKLQPYKKHVGTLSILWAEMFWLTLARARSGTERRVREIIAIGSSRWVGEHQDRRCARACAGWSCSECTTVLSGPFDLSQGASCFAGSPPHPRGKWRASTVPDKALHSESAVSGPDAQPTRSLSLLRPSLQPWRLAQQRATHAPGLEPGSFSSACATPCPTLLIQAAVPPAPHRCAAGGPRRQPGIHALPLAPWFRTRGGGLLARQGVPETPRLAPPAWPVPSLPVHGLYMDAYPHDDTPVEASTTTPPPPFSPDVCCVTSGGRVHSRWKPENQDSFMLQAIPAVHDAALASRGAVVVGVFDGHGPRGGEVSRGARDSFAKSMLASATGGEGGPDPSAVGAGDPAAGALVQGLQLAATELNARGRDYSRSGSTAVVCMAEPGRFVVGG

SEQ ID NO: 14823 - protein, 358 aa, Chlorella protothecoides
MAADMVKLDDGKGLQVTEVHSSPMDTVFTNFKAGMEGVDKEKVKAIVHDMSKVGCEDWMLLRIGPGAHMYEFWCGEPSKPPAGSDHFKNEQRKAAATDVRIHRMKQAAARLTADQLAGFERCLMFVLFLNLDVKEFAGLVGTVDAQVCELNATRDLSRTWLHVDMDAFFAAVEERDRPDLVGVGVYERAESCVLQVAQHLALSLRILVQKAKPFAVGGIGMISTANYVARRYGVRSAMPATEGFNILGSTPEARLSISVSCPASRHEQTPRPSQASAQTRCSGEHVLSGGGRCVAHGSSRTEARGAGQWSAGSCPPLDPASAQLPLKGAAPGQGLLSLATRSSHPILQGGVQGLRPGV

SEQ ID NO: 14824 - protein, 339 aa, Chlorella protothecoides
MASSVSRPPVTVEKVDNFQPPAASKTNGDVHGNPSSTAGNAGSSGPDSTQIAPSPSKAQQDPNKWLADLIAHLWPYASNAIEALANDMIPDILAASRPSFVHDLKLKKFELGKARPKLTNLRQAAGHISPCLTTPPTAAHVPDRMAPCAARLDPLHRPVPPPSSHLCTPAQALELYISVPKLPLLVSEVVPDPLEDTLALLMSLTVMCTDLWLKGTARVTLRPLLEEMPVVGGVRISLINPPDFGYDLKLGYDSRCEGGVVGQSEWVGGGDYSAATTAHGCTKGKRVHPTPCHSPHVFAWAPQARPPPLFPSDRFVLETMEPLIKSWVDGVVKESVLQP

SEQ ID NO: 14825 - protein, 97 aa, Chlorella protothecoides
MRVKESEKSSPLTLANRRGQAAFPAPLSVHVGLDAVEDESTMVEIIIQEKGWVGTSTVGKLEFPLATVIKRMKTKGEFHLQEGSGTAKLDLRWTRYL

SEQ ID NO: 14826 - protein, 284 aa, Chlorella protothecoides
MLAKVCSDRNKPNGQVAVILYREGGCTGHEAYLTTALGEYYDSAFCQMRGHTYCPLIKQWNPEPNYLPCPSAPLQYELPSTLAAVRQFVAALEIRKVPGVGKSPPGGPVQPRLARLLHAHSPGPGLHATLGPGPRRQCGEEGHELREDVQGCLTMPKRLGWPAVTFSLASPLPYGKGHAKAHCARAPGGPALPARNMSEPRDLEAKLGELAEHLAADMASEDLKGRTLTLKLKCSNFEVGGRGTICWLVEASYLAIHASVSGSREGCQSRLLHRLCGLLTPFCC

SEQ ID NO: 14827 - protein, 233 aa, Chlorella protothecoides
  MOD_RES (135)..(158): Any amino acid
MCTVGVRVTYADACQQTTWCSRADAYATLESKLVYHESLSNVDYLHGGAESFLTVTNLLLGKRTRTAPFLLDLCMLGQCHWAGAPQAPAQNPVETILGPSHLQCWAQSKGWIGIMPRQRTLPTRKMRRRQQILPXXXXXXXXXXXXXXXXXXXXXXXXPLPPLLVAVCVSEQHPASACGLHEPPELVGGLKAGHLRGQVEEPHIRLFRIRDRARNAVGIVEPPADLGYVGVQA

SEQ ID NO: 14828 - protein, 521 aa, Chlorella protothecoides
  MOD_RES (191)..(194): Any amino acid
  MOD_RES (334)..(336): Any amino acid
MEFDNLYLDMNGIIHPCFHPEDKPAPTTENEVSGLGLRSIPGCASPHHDLPSCAQACLSSCIWALVRLNQARWFDRPGGVPLCLGRNTASTPTPQVFLAIFDYIDRIFAIIRPRKLLYMAIGAIGGMPSKGTHWIGCWALCPAPSTRRGHPNSQGIGFSSVPSRFPALSAYPIPHFLFALLPDGVAPRAKXXXXPLYPAGAPRLSRDWVQQRPIPVPGPVHKPHSPLSFRPASRRRRPPCQDEPAALAALSGRPGRGGEGAGGGEAALVAATLVACGRAWPPATQPWVLRIVQGAWKGIMLWQFPPTCPAPVYPFHPPPPSPSPNSLRSALSGXXXAHPRHSGRLRACLASCYAALGSKECPGRVERHHVMAHTPPACPAPVYPFHPPPPSPTPNSLRSALSGHQHPRPRRVVGVRQQHHHPRHPLHAPPVGGAAVLCAPAPELRPGLARGQSAAVGRQRAGGGRAQGDDLHPGAACHARPRPQHPPLHVRPGRGPHHAGAGHPRAALRAAAGGGLHPRPA

SEQ ID NO: 14829 - protein, 219 aa, Chlorella protothecoides
MRLNGESLVGSSTTSNTSCPFLARCQLMLSRAAPPAPLQIMTNPSNTSGPGGKLKQAIEASFGSVDALKEKFNAAATTRFGSGWAWLVVTPEGKLVVTSTPNQDNPLQAGLVDQAGTPVLGLDVWEHAYVSGVAFWAGDVPEDGACEQGAGRGESPGCWVELFLGARAMRPEVAHDASVLSSGGGCRTSHPPDTQWVLPSGSHHRAPSPALFLAPPCST

SEQ ID NO: 14830 - protein, 234 aa, Chlorella protothecoides
MNTGDVFDEHLGVIAALRDNYARHDDTDTIRELLGIQEELEGLLSSREDTVKQAIQGVLSSRRERSDTGQYAGMDYLWKQGPASLLHCSLTALSSRVEEARIKAVYPEEEGAHDARLRELEARVAASKQHVAQLTTELEALGKQRQQLGSSMKEVSVKKAQVDHMLLEDEPRIRHQLSLYAHVSKISWRFDNPDRIAGTVSDPEKADVRLFDLAPQMPRFEATNQLWRLMEAAS

SEQ ID NO: 14831 - protein, 149 aa, Chlorella protothecoides
MLRFAAAQLARRGQNLPAVTTTVGTRMRCPVCESSLSRAPAQAFMAAPSPTPQGLRCFSEASAAELSIPPQFSIPGRYASALYMAAVKADKLDAVTNELSQMAGLLKQSDDFREFVSDPTVGQKVKVEGMSSVMDGLGASSTTKNFFGV

SEQ ID NO: 14832 - protein, 112 aa, Chlorella protothecoides
MNQGALGLLLMAAPGHSHALQSPVELTEGGVEAPSQPGSLLDFELATPPLRVGYQGDWLDVSPAMLATWDISPLEPMGEPKHLRAYALCQTGCKEATHAFCKVHTVAVCVWM

SEQ ID NO: 14833 - protein, 68 aa, Chlorella protothecoides
MADFQNRVQRCVQRCQDAAQESLPIKPSEKDIARAQDKLANCAADCAQEYERQIPKLEKSIVEQLARA

SEQ ID NO: 14834 - protein, 143 aa, Chlorella protothecoides
MEAHRDSPPLELAGTMPWAFPYNYTFNAPSRNRQVGGVVHHAMEEQVVVSLAADVSERRCPLSCSDDRPRRESTANEDGYNWRKYGEKHVKGSSCPRSYYKCSFPGCQVKKIIERNLKTGFVSVCLSKVSGQGLDWPGELDSA

SEQ ID NO: 14835 - protein, 317 aa, Chlorella protothecoides
MSRSHRRAAKTPPWLGVLVDTDERWSNYLYILGTAYPRFLWLFFEYSGDGIVWLAIALAAFFQPRATLTQQTLVLNFLAGWALDLVLVGTLKFLIRRRRPVYNVAEDFLVVVAVDAHSFPSGHAARYVGVRVSAGGRMLMDQAGIWVSDPLPGQSLSSALFPRHVLGCVHGTVEGRHGSPLPRRRGGGPAGGRGHRAPGVQGWLLQGHAAREPGADKGTAAVGPVLATWKGHSKSRVAADQDLTILCNELTVCLPVLEDLGRRCARTCSVQLCCSGPCSMLVRVQPMCSRKEPGIGTLYGIASKGLHGGKQRTFRAL

SEQ ID NO: 14836 - protein, 323 aa, Chlorella protothecoides
MLLPALAAREVGTLRGPRLESKAVGDPGLALRLCDVADLNLEDRGGVGALAWNGPTADTLAVGHADGRLVLWQPEADTRSEIDTVSMWLWVGCSPSHPPSGTLYTSWVSRPWLLTSHLEASSLPPSDQGHTGPMHGLSFLPDGTVLSAAGDGQVRMHSLRRGATRPFHLHSAAATCVLAVEAGEAGTGLLWPGRRALVRCASFGAHPSAEWPWQAADRPASLSQHPMPAASFLSGSSDGTVRLTDTRVPPQPLREPDSPARGSCLVGELQGGARSGWGCRAVGHGVCRSWDVGQALWSARALHRACMPFLWWPLLAPSMSRLA

SEQ ID NO: 14837 - protein, 298 aa, Chlorella protothecoides
MRDLVGSAYYVAPEVRRLLGSHGTGRGWRGKGTMEQGFQSAQRAGDQWWDQAPPRHASFIARRSEAAGSLPLPPPSSHAPHSHPLPLNPHPNPSLQTQVLHRHYGRECDLWSLGVVLYILLCGLPPFWGSTEAEIFKSVLEEELDFQTAPWPAVSEGAKALVKGLLDRDPGARLGLADLARDPWLRERGGSRAAPLPPMVIQRMKAFARMTKLKKVRRRGGPAEDGRGVSRRGGGRLNEEADAVPTWIWGCSGGRADCTCTLASQATHKATLAGSGAECRQVPDQGPDSGASGAVQVL

SEQ ID NO: 14838 - protein, 125 aa, Chlorella protothecoides
MVKKVAKRGTKRAASQPEADNSDSEGHATVIEQAIAGDASQPSPAGPAPGTEPYPPPNPPPTDRPVRVYADGRMPGRGFEVRAVKSRVFIRPPGPPVPIAGIFDLFHFGHARALEQAKKRCAGLD

SEQ ID NO: 14839 - protein, 721 aa, Chlorella protothecoides
  MOD_RES (314)..(317): Any amino acid
  MOD_RES (670)..(672): Any amino acid
MRGGNPITGFDLGKGGARLRGRHVCLLQQVQSEPRVWESHATARVYCCMGTTAAAVPGSSPGTAAHPVSATRAHAASGLLAAESRSRGGALHAYTRTRRRSSARCGGGEFRACEVLQGLVGAERHDGLYERSARKKGATRLFAAYETYPMINEYGWTSRQSADATPARLTSIYPFAPSISRITGPHASLTCKGRGGTTHFIGPAANEPLTQQGGWSPRPRRRRSPEPRQAGGGDLARPCSAAIRNSPDVTHPVHLSRCGQGARSHLDGVEDPGLSPVCRLQGVAAPLGGRPVPPRVHCGPPTPRWHDDQGARVXXXXCPQACTAVPRLRGGMMIKVKTLTGKEIEIDIEPNDSIARIKERVEEREGIPPVQQRLIFAGKQMNDDKLAKEYNIEGGSVLHLPVHAPAGKGRPSPSSSARFRSSDGSVTEPCVYNMQPLWALPALPSPARPRSGILLASANQSEFHKGSDCELHRILGMARDEEAEALPVEDEEYEEYIPVKKRRQLEVQSRLSRLGRPSLVAPLNGEPLRNKDGGSSDGAGAAPRDQQPAVQQRGKESLLILKAKALQEVGGPWDHCMRRERLGRDRAGARAEGGSRADAQHHPEGGAEDLCGTGEGHQIHASDEDGVEAAPQVPPDLRGRAPGSCLFVFSFWQWRGKESCKRTCSGSPAXXXLTSEDEHQVRFCLSFLFGCGGERSLAKGHALAVQCALLLAPAIPEHPTL

SEQ ID NO: 14840 - protein, 280 aa, Chlorella protothecoides
  MOD_RES (222)..(225): Any amino acid
MPDPLPHHSVYEHAAVLAPGSPAQQPPAAELMARSKISSLSWDPGSEHRVAASDYDGAMSLWDVEGLALVHEFEAHVRRVWAVHYCAAAQGLLATGSDDGLVKLWSTSLATMVGQGQPPSPPIIPSPADRRGRQRVLRAVAPGVQPPCGPGLLGPPRVPVRHAPCGAAAGDAVRPQVRRGLWSRRRVLVVVVDEGAPGQAGWSGICALTALPVPIIVVRGAXXXXSVPSRLCLFLSSCFGVRVHVHPVPKIPHTTWLSPTPPPHLAASQCRTCAGWTLAA

SEQ ID NO: 14841 - protein, 549 aa, Chlorella protothecoides
  MOD_RES (47)..(49): Any amino acid
  MOD_RES (138)..(141): Any amino acid
  MOD_RES (440)..(460): Any amino acid
MHGRDLHLDAPNSQLSRWIWSLHPAPRTPQHHGRRAVCMALAPVPTXXXPRTPQHHGRRPARMALAPVPLGRSNQPADRPAPSSRQRTGLQHHVMDMPAVHASSAGPGEDVASHADFSCPVCRERQRDPAPHLLLHFXXXXPAPRPAGQHLPLLPVLPHGGPGLAQPPAGRGVQGAGGARRAHAPVPNRPPQAPAGGGWPRHAARGAGRRAAPALDAAAARPCTPPAPPLPPEDEARGWMIWGEGGGRSLRPVVLEGLPYHDDYWLARRPHHAFPGQALPAWPEARLFRSSPDQVTSPATPTPPLPLVSLPIVPSSPPQSWRPLPSPHRQSKEAELDRVQDRLDCLETDIRAVARRVDPGCLPGTELEDTGSSREEGEDSSNASGSGVSPRDPAPGPDPTQDLAGAPLFVPGGKRARLSQHLDGLLAAYEARRGAGAGAXXXXXXXXXXXXXXXXXXXXXGGLGALAGALDLVHRAAALETVAVIPRPPGARPNSIVSGLEYNSRGNLFACAGVSRRIRWGAGGGRVPGRMPDPRCTPPGQGFDTTAPY

SEQ ID NO: 14842 - protein, 451 aa, Chlorella protothecoides
  MOD_RES (73)..(76): Any amino acid
  MOD_RES (100)..(102): Any amino acid
  MOD_RES (162)..(165): Any amino acid
MGNRDYGNGDHLGASSKLQDPRRIHKANVIECRAEPRLHPSSGVRWCPYHEARQSPVAALGGPPADHCSLLCXXXXNPWMGTMMESAEEGQVGGLGREGXXXPAAACSPTRLPAPRSLLSPGRPPPSPWAPTAQWTWPMPTPLSSRVGWRPWHQSRVHWEPXXXXNPCPDPQASGPGPLGAFVPNTLRPSSPPHLHPPLNLQLTRGEVRAIVGREVPLPVDARYGVQSSESVPGVQDVHAELAALMAASLAGMTPVEGTAVRRQHRTTTAEMGVAARDALNDTSSVPARIAFLNALAEEAAPYATTRVAVVTTSGVDLRGVRREVLPWLQYHTEMGVSRFYIVYNGHDAAAVQALETIRHVRLIHVHEPWAKGVDSALVELYSGLSRQWKGRPGNYALMVTQGEASCGWGGWGAWEWGGTGTWEGGTDHACGTARVGCAPPPRGSAAFPVA

SEQ ID NO: 14843 - protein, 462 aa, Chlorella protothecoides
  MOD_RES (335)..(338): Any amino acid
  MOD_RES (404)..(407): Any amino acid
MQVLSKTKMTQNLADVDLRKRELAPSPHRETQDLPLANLIGEGMRKSRNKQDGADNELRSVSVGRGGDGPTQQRGVCAGRRVVEGAEVGQRPQGERGECRRVATRHSRSAPPSYSSARLTLHQVGVLTTDPRCRAPNSSYSVVSLAQGFISSEEFLSIPELSINPLAQRLSFFVESINFKEFVTFLSGFSAKAGREEKLKVMFDVYDVDGKRPRVGWEGSGRVISGVWAVAAKLCWAGDISRLRATCANLSSSHLFTHAGDGFISEDDMAQTLRYLIGSTLAEAELRSVIERTMVAAGADAKGLTFAQYKEALGDTQLALNLEHEELMVIWSNAXXXXHNTAMRPDSTRSSWSFGFWSQVSCLGRSGHCKEVPMSWLRLIAALVFAKSRRNVTKSSCHITMLLXXXXCFSFNTSLNMGLGVLCLYIPVLVPSVLPRTLWALQGGPHVLAETHHGACLRQVPK

SEQ ID NO: 14844 - protein, 311 aa, Chlorella protothecoides
  MOD_RES (106)..(109): Any amino acid
  MOD_RES (290)..(293): Any amino acid
MVLPTDDLCPCSTKDDHSILVAFCWHVTALFTEDDHSILVEFCWHVTALLCWGESQNSLLRKYYKPSSTRAKQKLQVIFDQCYDFPSIGHSIWVSDVRAAEHSVSXXXXAPAYSRSMLRFPFNRTFHLGFKRSSSRAFGFGSTRAMPGRPNLGRLTAEDLTALRAEPRATAVLNFWFGEKWETEGLPNPTERLGVWYGKSDALDSSIRESFGGDLDRLLEGRLDGWRSSLLPAVAGIILGDQFTRNARRGTASMYDADAKTLEWTHALIADGSIARLPYALRHFAAMPLXXXXHVRCRCQDAGVDARSDSG

SEQ ID NO: 14845 - protein, 1858 aa, Chlorella protothecoides
  MOD_RES (100)..(103): Any amino acid
  MOD_RES (161)..(164): Any amino acid
  MOD_RES (310)..(312): Any amino acid
  MOD_RES (470)..(473): Any amino acid
  MOD_RES (626)..(629): Any amino acid
  MOD_RES (886)..(916): Any amino acid
  MOD_RES (1052)..(1055): Any amino acid
  MOD_RES (1218)..(1221): Any amino acid
  MOD_RES (1381)..(1384): Any amino acid
  MOD_RES (1617)..(1619): Any amino acid
  MOD_RES (1754)..(1756): Any amino acid
MASNVLRIMHASAYAHPLPTASRHEGFSKAGSVRTSTLDAIGLSMTAIRVSTLEILESRSTNILLAVECLKMGQKACTADSNENIGSGNKGKNNFGTSNXXXXPWSASRWARRRARQTAMKTSAPAKKARTTLARATSVLPVAGNANVSTANWGNNNNGTXXXXRRCSPGWRLISAMEVLPVAGNSNVGTGNWGNNNNGTGNRCFNKHGKRKVQNDCSLLEFRRHAWVLALPPPPAKKSPPPPAKKSPPDPSSKPPPPLARKLPPPPAKKSPPPHPRNSPPPPAKKSPPSPSKQPLPPPAKKVPPPPTTXXXPPPAKKSPPDPSSKSPPPLARKVPPPPAKKSPPSPSEQPLSPPAEKVPPPPTRRSPPPPSERSPPPPLRPPSPPPSGSRAPPPPRPSPSASPPLSPPPTPPPSPSPPSPPPRASATLQFSALTDGKVNATCVVTTVGYIPYMVACNLYSSLLGRIGFXXXXPPRASATLQLSAPTDGKFNATCVFTTVGDISYMTACNLYSSLLARIGFMEEYSPTSTVTTIVGESLPQTVMRNFVTGSALVYKDSLALSEVMALTLLNPSPPPPPGPSPPPPAFGFISGSVTRADQTFTFSVTLGSVVPDALFYAFFTTDGIXXXXEASSQTLSSMLSSRQMGLSGPQVLRRELKRPDPEIVNLMAIKLPTRNKVFQNHLPRILNADIPGSKRLQNRVLLPRSVRGSQDSESLLAPISLPLSSPLLVKLYLASSAEESSAVDVSPFPQQQGQRRETYGVITWWPLQPVFAKFLGDSDRFDTCIGILHVRSVPHDLTHCGGSSGCGDAVLEATLRGVRSCNRHRVPDGSLRNAATSISAVFPDTLTNINDESNKPNSRQVNPGGGTVTAPQGAGCHRPPGTQSXXXXXXXXXXXXXXXXXXXXXXXXXXXXXXXISHPRQPDCGRPFYNHFLSIPAHRRPHAAPLSSRFPVQCEPCAIFMREGARGSPAASVTFLFSRSCRAHASGRAPHIRVPTQHFWGPGKLLLPPRAHASGRAPNIRVPTQHFWGSGKLLLRSGTHITHCARVGLLXXXXSAPDAPPTCRFYSIPYSLGAHLYLTTVDSADATCNLGAHLYLTTGDSADAVCKHMGFSKAGSVRTSTLDIMGLSLSAVRLTPLGIVTPRSTKILVAVECLKPGQKACPADSNGNIGSGNKGKNNFGTENVGNDNIGNANVGTANWGNNNKGTSNRCFNKTGNXXXXTLGMTILVSKGSNVGTANWGYNNEGTSHHCFNMSGNRKNLQGCSLLEFRKYAWVLALPPPPAKKSPPPPAKKSPPPPAKKSPPPPVKKPPPPPAKKPPPPPTRKSPPSPPTMKPPPPPAKLSPPPPAEKLPPPPAKKSPPPPVRMSPPPSSPSPPPPNAXXXXLLRPAPLPRPLHHLHPAPLLHPGPLPHRAPLPRHHHPQDQQLPHFSSVLLQMGSPPPSPPPPPSVPATATLQFGLPANGKVTAACLVTTTGYKPYSVNCQLFTSMFQTLTTMEEGSPRSSITYIMMALDATYMTDYSLGSAFVNTDKTTLHEVVPLKLLNTSPPPPGAAPPPPEFGSISGTATRSDNTFTFSLTLGSLVPDGFYYAFFKEDGALVQSFAGYYSGPPAKVSTTXXXYYAFFKEDGAIVQSFAGYLFWPPGQSMYNVGLCHCTICVLCPTSGLQNCRWKHKCPDSELDLLQDGSEVAPHATKCQKPTYREVPCEVHRVTSFRDGQRPEHKQEGQSWHNLWRPQDVDQQTAATPLLGCFHPGXXXCKPADGSHAATGLFSPWPWTQGFTRQPPYCKPDFKHRPRMIMDCKFNQSDKGVHRELKCGGGVGLGAWGSTPPHLILWELLDGINAAHAPAWYLWGIPGAPF

SEQ ID NO: 14846 - protein, 534 aa, Chlorella protothecoides
  MOD_RES (128)..(131): Any amino acid
  MOD_RES (239)..(242): Any amino acid
MRWLAQLEGGTTPRLLVLDKSGTWMTTHPPLDHLTLSADEDGVGSLGRLGAQCNLGHVHDLVALHVSIHGRDDLHLLAWYGQRGGRWAGAETTSPRGRLLCLRAITPPTTPVGMRADGRLPYVMQPQXXXXGTGNGEAGGREQRPHRREAGRCASRQSPPQQHPSACVLTAAYHALCSPNNTCRNLHAEESAHGLHHGPLRWVVWWVRYRLQCVYLSRAGLLGDETSICKFNDIRQDRXXXXVGKIPTAMCVVLPCRTAWRRNLYMQFNDIRQDRSFMDWDAGAGPSVPMRIKGAQCAARGNYYHRALARCHRPTLAGPTSPIPSLVEDTIKFTIFLRVRDRAKVSRPLRQAGARCRRVEGLQLDGEAQLRGLQAFSSRQEMCNIVYHDNYKVVYRRYASLFFLVGVDNEEVGTAGPGCLEIESACVSAGGNELGILEFIHCVVETLDKWFSNVCELDIMYSLETARPIVMWLECETPCCIQRGCIANPHLTLLSSTRDQAHYILDEMCMNGCIVETNRSNVLAPVHLLEKATT

SEQ ID NO: 14847 - protein, 242 aa, Chlorella protothecoides
MHIRNSLPDEVVVQRIDERLSALGNVIACNDYVGLIHPDIDRETEEIVADVLGLEVFRQTVAGNTLVGSYAAFTNQGGVVAPGTTVEDLDELSSLLQVPLVAGTVNRGSDVVGAGELALCRFGGGPKYRHPDNQGGGSRPGKGEGEAQGPALDAWASSVDTQRGTLKHGIGCGGGLHPGTRFLTLLAPLPFQGLVCNDWSAFCGLDTTTTELSVIESVLKLRTSNPSQIVNEMRASLIDSMV

SEQ ID NO: 14848 - protein, 125 aa, Chlorella protothecoides
MSGGGGWNPRGGLASQPVHWPRPPWSTGAVGTPHHFPPRIPRAMNVPSPLHPTTTVRGLGGFYTYGFTHGGPVSVIWGWPLAVTMTLTVALPMAEVCSALPTSGGVYFWAGTLGGRHGPLYSWVR

SEQ ID NO: 14849 - protein, 291 aa, Chlorella protothecoides
MTCPVSSPLLAQEEVRMRLEGGEGPIGMVICPSRELARQTYDIVVAYSEALRAGSLRGSLSDPELLPVDPCPHRLTFPETLHPTNSAADGAPELRTLLTIGGVDMKSQGDAIRAGVHMVVATPGRLKDLLAKRRMTLDACRYVCLDEADRMVDLGFEEDIREILSFFTGQRQMLMFSATMPMKIKAFAESALVDPVTVNVGRAGATNLDIIQEVEYVKEEAKLAYLLECLQKTPPPVLVFAEGKKDVDTIHQFLLLKGVEAVASHGSKDQEDREWAIQSFKTGQKVGRRGV

SEQ ID NO: 14850 - protein, 207 aa, Chlorella protothecoides
MYLQQVISISEGRYYEFTRAQQYGLYCGFIILHGVANAISVKLLGWLSVVSVYWHVLGTLGVVIGLLVIAPVHQSADWVFGTFIPNPDTGVSNPFYLFLLGLLMSQWAMTGYDTSAHIAEETKNAAIAGPVGLIMAIVGSFICGWMFLLSLTFSIQDPANITNPDTISGGESWRCCLGGGKGEGVGRPHRGGGCLGTAAGRGRLMAL

SEQ ID NO: 14851 - protein, 166 aa, Chlorella protothecoides
MAPLSPWPLASDTRHRAPATHAPPPLLLRPLLSVHKAELLDFGAAMGIPHVTDPTNATPAYQRNRLRALLGGAGPEVHGALQALQRACSRVAREARERGDAALDAASRASHGRFPPPSAAVDALAARLGREGKLVGSWTGGGCIVRPVPGSKGRLIDCAPQGPAQA

SEQ ID NO: 14852 - protein, 127 aa, Chlorella protothecoides
MAGRPVLRGLVTEGLRFRVVDAKGQVVGRLASQIAKVLTGKDKPTYLPHVDGGDAVVVVNAAQVDFTGRKWDQKLYRWHTGYPGGLKERTARDQLAREPEAVLQKAVMGMLPKNNMRRVGICDGGAK

SEQ ID NO: 14853 - protein, 206 aa, Chlorella protothecoides
MAGSSDEDSEDFDSEDQDAPAGVPLRPRPAGTLESSDEERLGEGSDGDDSDLGSLLDEDDEEEEEEDDDDDDEEDDRRPRAPRVGQAGARPPRGAGGRPRVGEEGQGGRRRHAGPRLGEEGEDRSNAGRRRACARGGVTALALAGCMAEYVAALKAVLQAQGPQRVSALGALVKRPPQVPKLKSTVGANPAIFLHDLVTDIVSLVE

SEQ ID NO: 14854 - protein, 137 aa, Chlorella protothecoides
MPAPLSPPRSAQRNAGLENGHHPPGDAPAAPPQAQTQLLAVAPQDTYLDSRAGALRQVESTITELGSIFQQLAHLVAEQGEVALRIDENVDDTLANVDAGQAQLLKYYDTISSNRWLILKVFGVLMLFLAFFVTFIA

SEQ ID NO: 14855 - protein, 278 aa, Chlorella protothecoides
MQWLLHLDPDELVQPGDASGSLAEVLGRVPPHVASLRFMNFEGQSEAGDVVNRYEQVTLFRVHKHFITPEAHWYRSRFKLGASTSFLLLYANGKAAVRVDAPGAAVRVDAPGVRHLGPHFWTGDPSPRWQSADNPGGEFTNLVSDDSVILHYPYSYVSDVVDKAHRSCPDSYLAAARAGDRAKVRECFVIEADQDAYMAAAAGPTAVTDFFYSRFVLSEGVSVRCTDPETKLKVSRLPYLGKGGGELLKATFRGSLGGLESMGGRKSRGGAAEGAACQ

SEQ ID NO: 14856 - protein, 184 aa, Chlorella protothecoides
LTGEDPAPVPATDPERLKGLSSPPEEDEDEGSDPGLSGVWRAIPFLPSLVEAIVGTPYEEEEEEEAAHEDSRSRRRADEQRAAEAAAAHASAAALGAEQNEPVPLRVDPRARDPLAEPSSLLRPGEAAALATLCPTRHRLARWQLAYSTLRDGISMQTMLRMGHGRAPTVLVVRDMDRCRRVEC

SEQ ID NO: 14857 - protein, 118 aa, Chlorella protothecoides
MANGPSAGLVGDITPTCGVSDEEKHALESAGIQKLKAMLGGGPAADEMEELWREYEAGESTEAALVKDFDKAQEYEAGQGMVLQEFFDSTAGKWRTGLGRAWAAEIASRRPGAAAQED

SEQ ID NO: 14858 - protein, 116 aa, Chlorella protothecoides
MSTASDVPEASGALDNGEPSTSGPEQRHALGGKKYTRLELPTPEQMAGQEAMNNCAVRTVLSAVMGAGLGAMFGLFMGTMDGAGLGIDGRLATENQKQNVRQIMKDMVRNTSSKSW

SEQ ID NO: 14859 - protein, 167 aa, Chlorella protothecoides
MDVINAVVNNIKTVGGRLRPGVRSPDVDSGSGRVCQCCEASHGDLQDHMPPHKVNLSAPQKTILINVLKTTCGFAVVEDFKQLLKYNIRLLATPPEEEEAKEGEGKAKAEDAEGADEEQPAPVESAAEVSEEKVEQEVEEKVEQEVEAGKDEPAAGGSEAPETKAHV

SEQ ID NO: 14860 - protein, 217 aa, Chlorella protothecoides
MPRADLALDGGRAAASSEGLQISGFPPLPVPPSVLHVLPYLPPCTHILPPHPQQDVLAAGHGGGVSALLVPGAGEPNYDSLVADPFQRRKAAREAEVAFLLDKLQPGMIVLDPDSIGGLAREPKEVQKERAEAAAAANAAALAAQRAKADAKTPMKGKNKPTRKRRKKQQNVIDDKAPAMRARMAEQGVLGGGHARKESEPIPESVPRALHRFVVRK

SEQ ID NO: 14861 - protein, 155 aa, Chlorella protothecoides
MAQASDVDDMEPLLLTAKLDPASRALFTGLRTKYFPAERNYLDAHLTLFHKLDRRQEAAVRRDVAFACSTSSPMPLDSLRARLAGQWKPWLTPQDRQGHRAHITIQNKVSPEEAQGLFDELRGTWQPHTLTVQGLELHIYKGGPWELLEAYDFGA

SEQ ID NO: 14862 - protein, 262 aa, Chlorella protothecoides
MTDAVDAAAPARANKSRKRSDGPKTGVAKYRRGEEVSTKTVKDKKLKGQLLYTERCVPRALGCVASCGAVVNAQQTVLADTRQHALNLLPPCSSHPSPFTFRVFKDAQKAAARVDDWLLPAAAGGLEAEGMEQTWRFHQEDIVQARLCDFGGWRQGTMPLTWPAVEVGAGPKAFDLSLPSLGPYALATTRAGRYLALGGHRGHLALMDRLQSRVLCEVQVKESVHDVSVLHSEAFFAAAQRKYVYIYDKRGIEVHCLKVSAG

SEQ ID NO: 14863 - protein, 282 aa, Chlorella protothecoides
MSKNGARGVATTVAPAPHDRVPKDDFEECLASTASQGACLHCKHGCYRRAVVHPPCFLKTPIWPRTATGDQARLSAVILRKDSAAMDRSVAMALLCLSLVGSALAAQSIEVKSWFPENPTNEFLPGKEVKAVLGLHNAGSSALNVSYGAGLLASPYDANQVLLNFTTQARRAGRGGRVGLGLPCGRLPPTHLALQARPSPLQAYPPTVQYLNNIPLAPQQEASVDYTLHFPAQIPPHEFLLKLVLYTTVDEQLEGHLVYNQVGPVLLNPGQHAASTLGHRGF

SEQ ID NO: 14864 - protein, 145 aa, Chlorella protothecoides
MQQGATLGSASGLLTTPLGSTTTQQPCAGSAILNAYIRETAYQAHKFVGGTRPIRPLVRVAGAAGAAVTGPFCGLSRPKRRGFARDLSRGIRGLATAILDEALGAAGAAAGTAAGRLDGQAGVAAGALQRTLKGARRKLDAQPRN

SEQ ID NO: 14865 - protein, 261 aa, Chlorella protothecoides
  MOD_RES (206)..(209): Any amino acid
MSLLRECCSTCCTALAQERREHRREDRDDRRDHRRSRDSESRRSRFEDLKPHGRLAGPETGARMIGVTMTETGPGRGGAVGDPGVYCNSWKIVICPLSMGRPAVPCSPPAVPNPVAPSSTMTLSPAMQITPAPSQQVAVISDTSIPIMPAGSVFGGAASQQATRHARRIYVGGLPPSATEDGVASFFRGVASARKSLAQPGWGRAXXXXWLPFSGEGERYETGVPQTQVDVARVVCSLQRGCQCRRIACATWLGPRLTPDS

SEQ ID NO: 14866 - protein, 489 aa, Chlorella protothecoides
MTEPSLSQTGQSFLVVRDACCKVWGQHRSAQGHASVKTWLSIAAMSAWVNCHPSAAWPVAVSGEWPEPRVLVLLFRSMRYACTVPSELLADRPVSVRAWPERSDFGHMQLACMPSLSHIGMARSSLILNTTRAFSSCRPRAYAAAFPQVLRAGEESVGLETRDVPIDQQRLLQVGILGVPNAGKSTLTNALVGSKVGRSGWWDVRCTRCWHCRPALFCSTAYQPQLQHMQVSAVSPKTNTTHHCRLGAYTQGPSQVVLYDTPGIVGKEQIKGAGHETRVMSAWGTASSCDLVLFILDAHRQIQVPDPRVIRLISNLGSSAGTTDLPPAILVLNKCEMVPPEQRPDLLSLAGSLRDLHDFQDTFWVSALKGGVKEGVKGEGGCLAGACWLARICGSWSGFANMRVEDRRTQRRLLSGSDGDWQWQGAVRNVSSSPSHDTFRERRSRPEGVPPESGYSWPLDSGGRNVHGSQRRRPRPRDREGEDFPEILR

SEQ ID NO: 14867 - protein, 326 aa, Chlorella protothecoides
MSSARTVVLLILAVALPACLAMPRFIKDDLSVQGIQTQPDFCGWAHCLMGGVDQVARDHARLLQGMWNLPQLQILASLYTFSSINEFKQRGDGQIHAGDTYITYCRDSECPPFKLVKETDNYEVRTYDEEKWVITNVTDSFYTVAYPKATTVLLPHNSNPPPCPLQRLLKYFKGQNDKGTHLNITTPTVSYLELDDDRKGTKKAYTFGWFISRHIEEIPKPTDPELEIVTYPETTRYVRVFGGYASEGEGILALDRFGDGTVTIIPSKHGSGCNYQIPAANYLTGNIVEQAVALQDVLSKEGKSFEPKARNGKGSLVALLGSFGYD

SEQ ID NO: 14868 - protein, 199 aa, Chlorella protothecoides
  MOD_RES (84)..(87): Any amino acid
EGGRAAAQASRRNGWVGVLLSLHIDTWTRHVAFPHVLTYALQNPTALYLSTPLQLRAVPGVRIYGPGPEEGMGRAALASFNVEXXXXICTPESHRSASVHPLQLQAVPGVRIYGPGPEEGVGRAALASFNVDGIHPTDISTILDQSGVAVRSGHMCTQPLHRELGISASVRAAPYLYNTKHEVDVFVEALKEAISFFTM

SEQ ID NO: 14869 - protein, 130 aa, Chlorella protothecoides
MRRGERAVLDIQPGYAYQHRTWVLDIPPGLRKGDTIHAEVEVSMGGGGEGLEVELVEVVPGRTVRAVLAAEDTFKVTEQAGRDFETPRAPYKGFHSLQRRQTSGCQSNLLHDAKWDAPGGYARLWAASPR

SEQ ID NO: 14870 - protein, 161 aa, Chlorella protothecoides
MALDGIMYEGVTVRIRRPADYQAAAALSLGPSQPNPNLNLMAIGLDKKAQEAAAAAVAAAAAPPSALPAQPLPPVSWGCGCQQTLEWEGQWVAAEEHAHEGPPSWRMTVPHPFLPPATHPTSGEPGIGQDLCRRAALLPHRGAHPGAALLLWRYPAAGHRP

SEQ ID NO: 14871 - protein, 173 aa, Chlorella protothecoides
MAEMAMAGLHGMKMGDRALTVKPANDNSRNNDGGGGSVTMVAPPRVVRLLEAGFAGSLVTLLEHQIAVTPDELANDEEYADIMEDMREECGKYGTVLQVRNRGEGYGAGTVHIPRPGPPDAPAVPGLGKVLIEFAEPSAAIAARNAMHGRRFSGRTVVATLLTDDDYKLMKWD

SEQ ID NO: 14872 - protein, 358 aa, Chlorella protothecoides
MFAATTWALKRLLKFVLKRNLKQWIATEIDLDQVEVQLGQGSLELREVLLNVDYINQQLDHTHWEVVTAFVGCIRAYIPLASLYQDSCSIQLVDVFLTVQPRAQPGPASHAPGAAPGTPRPPPPAPTDGVSDGIRIIAGGLESLVQRLQVQASNIVGRVLLPSQHSSTPPALLVLTLEQLSYTGAEPEASSLTSAPRSTRSVDFRGLALGAKVDAGAGGAAEPLLAGADGEGCGGTMSGCGTPYPTASLGLTLGGLAADLNPGGLATLDRLATVLRGMLGAGGQAPGTKGAGPEPCREQHDPPGAWASRSLLESLMLPDCEDLVLEAFAGAESELEVPVSCLGGGEADCQRLGGLLGG

SEQ ID NO: 14873 - protein, 87 aa, Chlorella protothecoides
MAVRLMLEGEVALVTSSWRYAYQGRADAPQGVTEGDTLEFEVELVHFERDQIREDTTTAGRLTVASKWKDQGNMLFRRVGRMLTAGG

SEQ ID NO: 14874 - protein, 1176 aa, Chlorella protothecoides
  MOD_RES (544)..(546): Any amino acid
  MOD_RES (854)..(857): Any amino acid
LLIKTRPSNPGSRALSQRLDLAQAGNCPLRGGACPTLCRESCCCHLPKEVCKELGSLAFPLFVTRRCGYKIIIQWCILSACLSMSTAVRGLLGSESLVHGTIRSYNSARFVSHWHRSDFEIHFTSKYGLIVRLEVFWVLIGHTSQFHSTFDYLLWSPVHVEGDEDLGLYPVYIFLSKHRPQFKARPCVYPPGYSCPRLSLLGREEEAGRMVTAAASATKSRCLRAACFSFSGAFLSVNATLQADKWVSWECTHDNGAVLFVPTAPSYLNLGQEGSRLDVTITNHYDCRSPFNPGTDDPEKEPVSPTNVTLCLYTDAQCDNHSTPMMSIVKFKYSSFIKCTESLCRSQARFQYRLSPYPAEGVSFLVSIFVFERLEVVVLSEHLPCVFTSSSKKASHAIKELGKNDETILLLGDRFFSRKKRVVAMDTVLLYCLMGQPQHRDLVHMWRLMAFLLSIPSSSRSHSQPPSCTHFEARADRCAPGFKGKLWSGSLDNLLTGPLLRCCGHHYRQDPDEESLLCNYLLCTLGIACKHAFRCFSNVINKVXXXAPNHQVALMSKLVQLGPLLRCCGHHYRQDPDEENLLCSYLLCTLTAFRVVLRLDLLLDCTTWLRAGPPFDSTLSSVVSERLDSQHGQRDAAPGVEPCFQCNVITRIFDEDGAAYRLPVVAVAREQLRMRAGQVSAGFRGQTAIREGADVPHISRKSLNINSFFCNLCQGLHNQNLVEVSYSPAGSGVYLGSPSLLVLHESGRILCSHDTFPDGETTYVLESKDGGATWQNLSSVAAQYWSNLFMVQGGSRMSTTPRADTIYLMGTTHSTFGAGIALSESSDGGSSWRHAVLFEPPSGCSYSTGAVPVXXXXTHLNVVPVKMFTSVYLKITPDIVSSQELCLSWTMVGSCIEALRCGVGAGWCGPRPIRPLWCMPTGRPPSWILRRGHGLRLSLSQGDSDMIPAWMPSPVVSGGFLEGNTVLRPDGRVSLLMRCRVYNGQSEMYSVQEACLFDLTASTSDMDIREARLSLRWQGHVFMPGGGNKFTVRYDVHSRMYLSLTNPSIDRYGVNPDARNVLVLVFSQNLVDWRIATTVLVPNDGLDWEASLWFTGYQYVDWQTDGPDIVMAVRTAYQGAHNFHDSNRRVAWGRRTMGSCAAHLGTGDPPPLNPLPTSIATESHSSASRTTCATSL

SEQ ID NO: 14875 - protein, 281 aa, Chlorella protothecoides
MMCESTTLHTPSLEPHLAPPYTLQPKMISQADGKGGKEIPIPGVKTIPSYERDYLPTWKDQNTYIRDRGTAEQEFELVEYDLDSEDERWLQDLNNGQLHARHLQERLPKARLEMMLWKLEIHNAAATDRALAFAGATAAERMSVAACSTTDHMPREEALQMLEESCTGRDVLRATVYDYWLEKRRRLGRPMLRRLQALTPPNDNNPYNVFRCEACSGLACEPEWCRGLLWITGDSPSLHGLLLLRTPPHPHLQTEGKGAPSPDAAQKGEQRGLPGQVADGP

SEQ ID NO: 14876 - protein, 309 aa, Chlorella protothecoides
  MOD_RES (150)..(153): Any amino acid
MANFDLKVVLLGAQSSGECGIRYSVPVGRAGKRASYDANICSAHNVRPGKSCLLQTYVAKEWRSTLRPTYGAAFAARRYQLPNGHSVSIGAWDTSGSPAFQNVSKRFIQGADVAVAVCDLTSRPSWEKLKLWWTLHTCRTKNWPVAWHSXXXXCISMPDCTPVHAAKQEQPGILIFVACSKADLVTDFAPPRPSPEAAKPSEGKGADAQGNVPRVSTHAGGDSERMRSGFQEATSQAPTVRFEDEVDGVVPETRGDPHSDGQTPDPRVVAGVSPAALDFVEVDAYCKMTGASLYVVSAKTGVVGGVSGL

SEQ ID NO: 14877 - protein, 113 aa, Chlorella protothecoides
MSLPEDHRYNYVVTAQKPSSVRHSVVGCFTAPGAVNLIVSKCTRLEISVITADGLQGVMDVPIYGRISALRLFAVAGEETERLFLLTEKNRFAVLKCDPATGALIAAATHDPP

SEQ ID NO: 14878 - protein, 415 aa, Chlorella protothecoides
  MOD_RES (212)..(215): Any amino acid
MTAAWRTGGAGQVGLLAAARFHGTLNPASKPACAFLQASCRPAPMATPRTASVARSSRDRCASSAPSGTPLSCTWALRVAPDCVVLVPPTASTLPNATHPLPNFLLPLQIIPVSPSGVLSEAYNVRIDELNLVDLVFLDAEDFEGLPTIAVLYDDGGGHRHAKTYSLSLPSRLCTKRGCYGLVSQGPVALVRLLLPVLGPGSTFRHDRRSAXXXXLVPVLGPGATFRHDRRSATPRCAGLTLTGHMPSALTLSPSVRTSCRNCCSSAGRRRTWMPWRTCSSPSPAPTASWWSARAPSASWRTTRWCQPPFPPPSSRRGSLGDDVLAATCRAPHPRTDGMYENVTSFPPPLDVSQAYGAVDREGTRFLLGDFRGELLLLVLEQNGPSKRCVLSWLGPLLCRAGDVFSQHVALAGSF

SEQ ID NO: 14879 - protein, 370 aa, Chlorella protothecoides
  MOD_RES (154)..(157): Any amino acid
MGRPRGLPCCCPLSLLDCWWKLPAQGHGWGSTAPAQCPLQPLPFTVEHALTVALPPLAPAASLDSTLSGSAAPPSPAPSPTWMPASCTSAAHAATPSSSGGWRRVCGMMDCTLCGVEGSEALREARPSRRWAQGRAEVCPSSPLTYFPCSCLKXXXXGRRDGGPRGGRRLHAHPPDPSQPDSFLEVLDTTTNLGPIVDFCVVDLDRQGQGQVVTCSGGAGDGSLRIVRSGIGVLPQATVELPSLKGVWNLRRVGHVGWACETLLGRIRLQAAGSTKGHWVVQGNGFPTAHLSFHCWWHSTWGLAATHTMIIMTLSHPPRSFEDEHDAFLVLGFVESTSVLGMNAAEEIEEVGVPGFDDRAQARQERNGLL

SEQ ID NO: 14880 - protein, 133 aa, Chlorella protothecoides
MIEQVLLPFYPGLHMGVGTACHNCIAITRLLALLSPSDAARKLVNGDADIAINWAGGLHHAKKGEASGFCYVNDCVLGILELLKAHARVLYVDIDIHHGDGVEEAFYTTDRQGKGASGCAKGAPCGREGLAGS

SEQ ID NO: 14881 - protein, 158 aa, Chlorella protothecoides
MPSSHESIPALAVDAKSDSLRLIDDQTFETLDRYQMPESDMACSLLSTTLGETGAGPYYIVGTATTNLAEREPTEGRIMVFEAVEGKLHLVYTHETRGAVYVLHPFLHNDETMLVAGINSRVQMYRWVGAVAVNCFWLWVRAGVHEALFLCCIWQVGI

SEQ ID NO: 14882 - protein, 91 aa, Chlorella protothecoides
MKPQRIAMTHHLILGYGLHEHMDVYRPRRAQHDELTAFHNNDYVGMLQTTTPEEARSDPRAFLKYGIELDCPIFHGLFDFCRLYAGASIGE

SEQ ID NO: 14883 - protein, 80 aa, Chlorella protothecoides
MTVSFHLKREGFFPGTGALEDKGELLGRGYSLNVPLDEGIDDEQYLGLFRPTLDAVMRSFQPGAIVLQCGASLGSVAVAG

SEQ ID NO: 14884 - protein, 114 aa, Chlorella protothecoides
MTIRTRAATLAAAQGVVLHRDYGNGTETRADKLARYRAKRARRSFAKTIRYETRRVYAEVRPRIKGRFVTPEELACHEAGGAPMQDPPAEGLEVAEPEELLHMVPTCFHGLEYA

SEQ ID NO: 14885 - protein, 226 aa, Chlorella protothecoides
  MOD_RES (83)..(86): Any amino acid
  MOD_RES (135)..(138): Any amino acid
  MOD_RES (167)..(169): Any amino acid
MGVHQARAHFLKTLGRIVDEPEVGAALTRVYWQVTASAQGCVCWGLECFALSEAECGPFPGSIFQNRVDPGPGVKASVHDSCXXXXTASAQRGVCWGLKCFALSQAECGPSSGSILQNRVDPGSGVKASVHDSSXXXXGWMYRGLGAALLLPGCPHGTSARATAPGXXXCASPFLQPGNSVPFLDLVERLTEAPLTADAWVKELQVPVEVKVGGWMYRGLGAALTL

SEQ ID NO: 14886 - protein, 298 aa, Chlorella protothecoides
  MOD_RES (63)..(66): Any amino acid
  MOD_RES (227)..(230): Any amino acid
MLCWLFPPNHACISPCTLHWLIPCAQSAPASLSSAASSPLRKHPMHIHPLPPTPSTSTNPRWXXXXACFPLLSGELSPAHAPDAHPSLAPHSLDLHNPQVDGAWVPAQTNFTSLATPGSVGSGKTALVTLLHEGGHAAHFANVDQASPLCSQERAPTSVAYAENQSMLLDSLAGDAAWLARYARDAAGQPVPWSLVREAIEAGHPYAAFTVRSMLAVPYFEKALYDXXXXQSRPGTPTPPSPCGQCSPSPTLKRRCTICPTTRWVGGEWGGRDCDGGGGWSSNWRGSRDGPWLLADYE

SEQ ID NO: 14887 - protein, 388 aa, Chlorella protothecoides
  MOD_RES (14)..(17): Any amino acid
MSGCGVISYAPYAXXXXSVCGDVACRVISYAPCARSNPSMTSGTLTAYSKGKHISILDPCLPARRRRMLRSRAHSVGFPGLRLHISALRARPPTPRPSIVMAATALPGNPDVSTFIQGINDKYLEVHRAYEDNFWATKMALSGASTSALSSTKNALDEFLSSQDRLRAVCDAEARPDLSPEQRRVLAVLRRTFATYVSEEESVATLRARLNDLEAELAGVRNRMRLGTTDPATGEFRPASSVQLRNAMKMSGEESARRAAYDALRSIGPAIAGPFAAIVRLRNELARRAGFPNYYDMKVQAAEGFTQARLFQMLDGLESATRQLATDARARLAAAKGKDSLKAMGLCHSSEDVGAVARCREAKPWHGDAAPEWGRAHALESLTSQPCT

SEQ ID NO: 14888 - protein, 84 aa, Chlorella protothecoides
MGCTGPRSTAQRWPSPSSRLPSRRHATHQRPPSTTPLPAQGGSNGGLLVAACAEQRPDLFAAVLGQVGVMDLLRFHKFTIGAVL

SEQ ID NO: 14889 - protein, 633 aa, Chlorella protothecoides
  MOD_RES (52)..(54): Any amino acid
  MOD_RES (107)..(110): Any amino acid
  MOD_RES (258)..(261): Any amino acid
  MOD_RES (512)..(514): Any amino acid
  MOD_RES (555)..(558): Any amino acid
MSTIKPAVLQWGPCKPLYLGYPASGPSRPCQPNPTMHSTQHTSGPAALAPSXXXPANPTPQCTPSNAFQGQPPWPLAACMSAGPAQPGVHPPGGGWEGADAVPSCDXXXXQPGVHPPGGEREGADAVLPHAARNRGGTGVPARQRHPSWRPDRRQCAPGCQQQGRPRLHRQVGVVAFSSLLATPPATSSNSAGRGFWAEPPDWQRVVPADADPGLRRVHVRSLPGLYFVWAIQGTKVSALWQDAPARLINSLPRCPLXXXXRPRLHRQVCVVAFSSLLVTPPATSSNSAGRGFRAEPPDWQRVVPADADPGLRRVHVRGLPGLSFVWATQGSKGSALWQDIILASVHGLASPTLAGVSRITMKLQRHPGPSSSHQQSTSLPSYNLPALHSRPPELIIDGLLTKAGDVYAFGVVLWELYMGTRAWEGLKTSEVLNHVASKRSLVFPPSTPHRLKVVWCTGRRKGGWVPVQSVLGTRCLAFNPDDRPTFSDILVEVDSVLKDTQYILRKFLARXXXGAVGAVHGDARLGRAEDLRGAQPCGLQAQPAWASPMPGSAXXXXCRYQLATPTMHISIPPLPPFQTNSGAGHKFSDPRYPLYSIRLSAPQGSMGIPSAGVCGGGCPAPRDRRHASPPCG

SEQ ID NO: 14890 - protein, 948 aa, Chlorella protothecoides
  MOD_RES (25)..(27): Any amino acid
  MOD_RES (335)..(384): Any amino acid
  MOD_RES (796)..(799): Any amino acid
MPVPACCNHAGLHADFTLRIFNPPXXXPRQHASPRLLQSRWSACRLYTQNPQPLPPAAAGVCAGMVSAHDDYITSLACSVSAGVLVSAGLRGGLVRWDLERLTASSLSQVRERVGAVYLTPARMCGLSSMEISIARAFSPPSAPARPHSPPSCSPLSSPPCSLRPTTPCHAPACPRPASTLWPWTPAPAWRRPARPTAAFACWTPAPARPRCARCAGTPTSCAACCSHATAGDWSAPPRTARCASGTWPAAGGAAAPGRRMRGRCGAWPPVTPTWAACTAAGGTAACTAPTPSAARPGASARWAPPSRRSRLASGAPSGRLPLFYPERRGGREGXXXXXXXXXXXXXXXXXXXXXXXXXXXXXXXXXXXXXXXXXXXXXXXXXXFDPDVPATILSEGRDAGGDGRGDCSHPPALCDAALAWTAGVAPLTAAAVTTDRLRVLTRDAEGAVELWDVGRGRVTRHWEASGAEGAGNGSAPPGAAAFQAARRELFDPTHSVGAWFSADLRLGSLGGVLDPGAAFGVEAYARELGAHAAPADAKASCGALMLSALFGAWAAAGGGGGEAGAETSVEDAPQGGEASPGSVGEGSDPASAAEPGPSASETVSTAPGPQSTPLTGQGRQAVAALGQGVAPSATSASFSLDAEAAEVLLLGDAPWRGSLAELAARGGEAEALSPVPAWVRSVVLDGQVPVSRDLKLVFTLLPLEVSWGVEAGLWRGGACKKALLETSVTRQVRMPQRTNRCCREAQAGRRHRLGVNKLGYKFAPQDHPSPPPPPHLHKGLRAAVAAAEPAACTQXXXXTFTKGSGLPSLLQSRLHAPRVLTVDKVVEYVGRRLRDAGLSPGEAPLFYNTRAAAAWEAGRAAQTPAGAAPRPNGRASPVEGRPPPAGAPAGPDLVLTCGGTAVPWDFSLAAVRQWIWKRSDDLVVHYALQPRGTELVLPSIPLPPIDT

SEQ ID NO: 14891 - protein, 72 aa, Chlorella protothecoides
MPHQELPLDSPDSTKCRTGDLNPSQRNPLLTRVEVRAGHGAGKPTAKVIAEVSDMLAFAAGVIGAPWVHSSA

SEQ ID NO: 14892 - protein, 128 aa, Chlorella protothecoides
MHDREAGNPGKPSAEAAPAAGAGRYGLCPRHAVLAASRRRGTLFMHRPSAGHAWITDYGNPDTAEDFNWLLPLSPLHNVARSKDNGQYPAFLLTTGDHDDRVVPLHTLKLVATLQHTLAGGTFGSISV

SEQ ID NO: 14893 - protein, 258 aa, Chlorella protothecoides
MDYEKFGTPFKKGQRYYYTHNTGLQAQSVVYSQSSLDGEPVVLIDPNTLSADGTVALSSWAFSEDGSTLAYALSSGGSDWQTVHVLGVDPGMGATTQHPDTLRHVKFSCLAWTHDGRGFFYNRFPPPPEGGGEAGTETARADNQELAYHVLGDDQARDVTILALPEHPDWMIGCEVSDDGGRAILSISSGCEPVNRVWILDLDAVGRRADGALDFSPFAHGAAGSRELPLNKLVDDFKVREIWGWEEKGLKQGSTLGR

SEQ ID NO: 14894 - protein, 74 aa, Chlorella protothecoides
MPHALQVLLPHPSSPAASPVDSILDKDNYTLEELLDEDELIQECKSLNNRLIIFLKQRSSVEALVGWLAGTGEV

SEQ ID NO: 14895 - protein, 166 aa, Chlorella protothecoides
MDLLFSLLASPPPLNCMLAGYFSRVVGCLLARHVEEVGAYLQAHPATLNALCAHCGTTSVAEVVVRLVGAGEVGGGGAPPPPALDWLGESQLLPLLLRALGPEAPPDAAANVAEILAAVAQSPGSPLVAPLAEPEVLARLVSGALSSGTPGAASHALDVCLALLEP

SEQ ID NO: 14896 - protein, 806 aa, Chlorella protothecoides
  MOD_RES (52)..(54): Any amino acid
  MOD_RES (229)..(232): Any amino acid
  MOD_RES (455)..(458): Any amino acid
MIGSETTIISNSAHLGIGGPGSYGEEAGVRVLGDGNQGSRRARFSQEMPARXXXMDLQREKKRGTDTSTVGGGSGYKSGRENSMHIILASEPDTRQLNFDVGFGIFRVCIGRSYYHIVSPSLPPFSMSNLEQVIREATSKRHPAVPASELREIKQTFTGECVLGVPAPAYEVAGAKPPGVVLIVMRGYDTRLQASCTEDNCLKPTIMADGVQEVSGDPFSCLVWGAVKXXXXMRDYDTRLQASCTEDNCLKPCTPCHTKVLELCIGYSAGKPPSPAPAGVASELVSRALELLFQWTTKYATKHVQVRPQVAWVLVIAGAPLLSSLQAGVVLLHPTIGWHACRSIPPVRPYSHFVLPTHLHDAQLLLSYMYLKNKLKLPLQDLPVQPAASASPPSQLSPAALRHQSENWDEIVYSAKSTVHELAAPNAWSDPQASIVCSNAHAHWFARQTSHLAAXXXXLILLQSWQAAPKAWSDPQARIVCSNAHAHCFARQTSHLAALSAACGLDAPGEDDAGQDWEDVEEAGPSSAVATEGTSTFKTAWPRFDPGRVDLAIAGPLLDQAAAARQLVVQELVPVLRAELARGGAHGAEAGPLLCGLEEASRQLDLPGIAALAERWRALKGAAAEAGTERAEGSPPTGSRAALGAAPGDKEAAGRGQAPTTKGLGGRMPRVPPSQLPDADPYAGIVDPAAPRPGPHSIAKAVVEPAAVAARAPSAKQSSLPEEVRRRLAEQAPTLPTGLHTQFWDSSQAVSLTSGTAEVYNHWGAVDVAKGAGGKGSGRWDALLRNTHLFTQERTARLLNACGKRS

SEQ ID NO: 14897 - protein, 909 aa, Chlorella protothecoides
  MOD_RES (432)..(435): Any amino acid
MSLCALCRVIFLELIPGFALYRGFYEMGAYAFRATFSPGVSCLGQSVCCLIEMGRLLLLCRKETQPGNIVTRLQHQHARFLTPASFAEHQGPPVVDPERPRQRLYRCAHHLCSGVGGLPPACMVPGTGHSLGHWGDQASVVFLGRKVFQACRPAALKSRARCSRGDAGIPVVQLRSRRTASSVWARPLSRPTLKRSQSPSPQVIVEPEDVQAERARVENGGADEACIQIKSLVKIFPAVGGNNPPSTHTHTHLLPTQRRLAAVKGLTMAVERGECFGLLGPNGAGKSTTINILTGFLTATHGNHAGAGCHVSACCSKLCDRGRPRHPERHEAHSLHHGSVSTGKEGVKFLGKQSLKPSMFLVWTLVHHDPAGPFQDNLLWEQLTARQHLSFYGRLKGLKLHASIFLIRGESGRACKHITSFSRGAWLPHPPXXXXRKCPALIYPCLHITGRGPGDCHHQVLGFCEPVTRPSGREAGARVAGHANTYPASPGELGFNTHQPYHPQVLSYSGGMKRRLSVAISFIGSPAVVYLDEPSTGLDPASRHNLWDVVKEGKEGRGIVLTTHSMEEANILCDRLGIFVDGQLVCLGTPKDLTTRFGGYYVSWYGVVGACGDGSGDPGVLWRPPAFSAWQEPAWPSPVSLLKPTQVFTIMTPAEEGESAHRLVLSMSPNARQTYSLAGTRKYELPMSDVTLAGVFEAMTTAAAHLTILDWGIANATLEEVFIKVSGGGRMKGISPNISAWRAATDLTFPLTPSSLLRFPMQEAGLAHSPLFLSVAYMLARWAPVAPGVAATGAQRWAPVAPGEATTGPQRCVELEYDFQQPISEQLKCRCDACSPAAAEPRFRRPEPDSVPSSCLARSSSLEPDWMTGKVHGCRDAEVRSRRATRCWDGTRETPQPTAQPSLPSTAAL

SEQ ID NO: 14898 - protein, 628 aa, Chlorella protothecoides
  MOD_RES (237)..(239): Any amino acid
  MOD_RES (392)..(395): Any amino acid
  MOD_RES (585)..(595): Any amino acid
  MOD_RES (613)..(616): Any amino acid
MASGPFKKARYEGIRSQTCLACLPPPTGSYLCVWPIPTGAHPGVRSEQILSHLLCGAIPHLHQICESVSGCRPGEAGQGGCCAVILFWFRVKLLADPPLTCSILQHQSQYNASLTAVVRNASSPSVSLFLDQLGTSLDALSNAVGLGLAVPSISPVTGEPAWQANASAINRFLYCGYPQVSGAGILEVRAPLLPGQEARCIRLVSSLPHTMHSAPPVLSLESLVSTTWAGRTGSLTXXXQTGWSYGKPNLSSASHTLHPAQIRCGGRVQEDYEVSQAWDFQNTSVETGQYNVRMWFNGTGRVDVYNSFPSLLRVNQGPISPQLPAGHQLGCKLLPAKSTGTRVPIPPPRVPGDAQGNTPSRAGQGHLQDMLVPPLFTHHPLPCAQDVTRLTXXXXPSRAGQGHLRHILVPPLFTHHPLPCAQDVTRLTVSISTLLGPLFFVWLSQLLLPTMLLTLVYEKEKSTASSLQQAEDHDEDAWTRGWCLLVGGLGRALASVLQDGCARSLGCLAACSVIYPCYARAPKLPLLDLLNRKGITTLSTIPPSPKTPQADPVHMVLYHELPLLHDPRGHGLGRGPSHLQAHIIXXXXXXXXXXXTVTIQDMSMLPLRKCYVXXXXKVCWALMSRIQN

SEQ ID NO: 14899 - protein, 523 aa, Chlorella protothecoides
  MOD_RES (124)..(127): Any amino acid
MTPPEQGEAAHKLVLSMSPNARQTYALAGTRKYELPVADVTLAEVFNEMTAASNHLTILDWGIANATLEEVFIKIAGHYIKYLTSPSFSTAVRQGPRRQGRKLDPWHWLLTPCPCACLCHRPLXXXXETRPLALAPLTSCPYLAFESLFATSACRRDLAGSWISRHAQLALLAMVARSPWTLISQELPRASTSSWNIQKQHEGSLQREVSAAGGPPRNPRLSCGPGFTMADAIRATGRQIACPSLTCATHYPRADDIPNPSHCLVPEERSPAAKTEAQQCLAHHISCGFALFTLSIPTSCCLGLPGRLHDDILPDIQVLFVGSGAGTINIEAHRAFLAHVYPHQQLTSSSPPRMDLPKLSHLQCGCYCLRCCSTNGSRQYTCRNNTEGAACRFYEDCEEYDESRCGLGYSTAAQAMYCPVPQPSTWPALMQIPRTARRAEPWRPAAAMLYTGDERGASEQLANELFIDPAPSPAEEGAAAATFQEGLAVVSQPFWWKRGEVGGWGEAALAAHSCWSSKPDQPR

SEQ ID NO: 14900 - protein, 539 aa, Chlorella protothecoides
  MOD_RES (47)..(68): Any amino acid
  MOD_RES (134)..(137): Any amino acid
MACSAARPGPLHRRLAAVKGLTLAVERGECFGLLGPNGAGKSTTINXXXXXXXXXXXXXXXXXXXXXXTANGGGCCMRWAQGGGLRCLHEPAETNAMVAGLGSMNAPRHAGTVKLLLGCNGVHLDQLLTGDSPXXXXAVPKPTRTMGVGCDARTSLPRPMLWLPAWGVMNALRHAGTIKFLLGGNDMHLDQFLTGDSPGMCPSFCGRQRRGGGQRPTGWNEAHPRPHGRLPPAHSPPAPRLLWPPEGPEGGAPCVGDAPSVRLRSCRAVSQRDARGCCLGTLSSGYQQLHHPLYPTQGTELKEAVDAALKSVNLYNSGVGDKQASSRECSRPDCWARPPNLLQVQAYSGGMKRRLSVAISFMGSPAVVYLDEPSTGMLMCLEVFFLLLCNPRDAPSPATTPMHRDWTRPRARTSGMWSRKERREGASCSPPTGMYNVAVPAHSALSSTSQHSMEEATVLCDRLGIFVDGQLVCLGSPQELTSRYADFYIGVASEMAGPFILNLRFCTAGAPSKPLSSASDASSACLLCQQVPSPPVDPP

SEQ ID NO: 14901 - protein, 528 aa, Chlorella protothecoides
  MOD_RES (10)..(13): Any amino acid
  MOD_RES (313)..(316): Any amino acid
MRAGGLDWDXXXXGWLGMGSVEMRRPWWLTQEQPGLGRLVCLVGLRTSVTNGQSPATPQPLTIPFPGLVQRHLCLQRDFPGLGLPGHLHHLGHLQHSHVVQCDGSVWSVPDTAHPGPREPGAGPRDFLLSQGVVVRSGWGGAQMTGKALGDPALHGGRVSLGHHPSGSAHQTIGGRARCLGSPHRSSSQTLFHVCHLSAVGTRPAASTTKKLSLSSLPFIQGINLATNAFLQAALGPDYQAQLLGLMEMPKPCQRPLPPRACHHSLQGATILSLNFSALLGPLFFVWLAQLLLPTMLASLVYEKEMRPDNPLXXXXPSLAWKERLGLDCRARALLLEWGSGCRWLNPSGCVSHVHDRTLVRSLSTQAEDHDEDAWAGGRRILLAPPLSCLCLRLELSELTHRSTPSSSQLDLCRALNLPPPGSSRVASNARIIQTPSTTPHRCRTGVLLPVGQLPDILCVLAFHLLPLVTDSRGGGLPLHLCDGADWLPAPHPVHPVGSLVVRWALLLVGEGWETVLLSVRMVHRIRN

SEQ ID NO: 14902 - protein, 376 aa, Chlorella protothecoides
  MOD_RES (121)..(124): Any amino acid
MPLQPAQSCRGGVSPPLLLLYTDVMYSSVPFGDPCGVLKLSGQVAGAHAANVDTSTDALNNHHPDHLQTRFGTQARALFIKNAAQQRRQRRTNIILILYPVIFCILLYVLQRGSAAASWVXXXXWRLEAQVCAWVVLPALWVTGERSGKQGEEDASISPSLAGAGVYSVLDTQRTEPPVTPPTSQISTTQCGCYCLSCCRTDVAGTTTCRTNSAADPCQQSDDCQAYDDSRCGVEYSVNGQAGYCAVPYPPTWPALMQVPLTRRRAEPWRPAAAMLYTGQDAAAAAQLAGGLFGDGAPSAAERAAAQATLAAGEAAGTIYASGLSQLGLTLGTWRPVTDFMTYYLEPGFLQGENAEDVGGRGGHRGLGGERWGDGT

SEQ ID NO: 14903 - protein, 280 aa, Chlorella protothecoides
MIVAYRNLRATLLRIIAPLVRRARDPGLSSGLPARILWLGSLGVGHSLPFPQPDRRHLLHYYTTFPTIPQFFMFLLWLINIAVRNDNPYLEYFVDNPDPAVVTVGAIPACATDMYIESPCWDFLYQPNNNSAVELARPSRKLGMTVEVVGMGVLSGTVPSHRLLPIGAFLGWLCLGFWSHTYSTQQAWFSLEAAASVSCPPIPQLSYPCLSTLQAIVTGIRENNPGRPIPASAVLGFPSMDDVNSWLQNNKEQTLGAYHFTPNGSTGMDFLLQINSTVGC

SEQ ID NO: 14904 - protein, 758 aa, Chlorella protothecoides
  MOD_RES (37)..(40): Any amino acid
  MOD_RES (71)..(73): Any amino acid
  MOD_RES (275)..(278): Any amino acid
MVEIDWVLPETGGTALLQTQRSLGSGLLQCSPADPAXXXXETWGTALLQTQSSMLADSWVPFFHDTTPSTXXXVAAEEQRMRNLLELRTAHVCPFPALTPPGHDLATSPVPPAAVEVFGLKQVFTPGILTRFGHSLNRALSVSAHLPPTPAQILLRLGAEAEAEEEQAPRQAGLPAPEALLGDQGLLVLHRAGQAVLPPGPQWRGEDHHHQLPHRCGRTHRVWVLGRGPLFLTGQSLEGRVTTTRGILSSPLTMQRPLLPPAPSPPTVQPPPPAXXXXTTPWGTLSFPPDHAKGHSSSLHQALPLFNPPHPPAGVLPPTGGEVLVYGERLGSSGGADRIRSIMGVCQQFDVLWPELSGAEHMHIYGRVKGLPRSALREQAAALLESVRLQGAARVRTGAYSGGMRRRLSVAIALLGDPLIVYLDEPTTGMDPISRRHVWDVIEAAKAGRAIVLTTHSMEEADILGDTVGIMARGQLRALGTPLRLKQRFGSGYQLSVSVVPRVTGADGAAAARAQAARADEVRAYFSAALGVAPAEENRAYMHFLVPKAREAELPGVLGTLRERGSELGITDVQIALTSLEEVFLTIARKRPGACPTLAAQLPPADTSACHPSFSTPQPAPTPGRDGGRRGRGTRVGGGAPGRRHHRPRAPGRRVRGKRERQPLRGQVGAGRGGEPAGAALRAAERQRGRPVGRPADRDPLLHRLRRAAGRVVQAAPERAALSVPGWAAAGLGTPPSGGDWPGAGEEKDPPQGHTCFH

SEQ ID NO: 14905 - protein, 408 aa, Chlorella protothecoides
MDCRILVGIYSVDRQSWPAARASRRPPGFPEEGNSTIVPKQPWAPSVSVVVEPGCRPGRNEDSTSAWALQECALSRAVRGPECSQEAAPLRIVYCAVGGHRTSYVPSAFLPPLSPEIGPQHARYLAEAPALDELNQRLRMSLVHAAARGMPIGSCTLITCTAQRSIGCHQRNLRFPPAVQTYVGSMSKAQTVTVSRRLSCNAFFGFGKQNDTCEEVDCWLGYMLLELHHNPPMSLIMRSEVEDYYNYMGMLAAEGNYDKLEELFDSELGWIEQGWLMLCATLASMHDSIILVWRGTCGSPGSPCQHRERPAQAGGAGGGGGRSERQGDQGSGVFAGGHEHGESRLSNQDNTKHVHGEIVLWNVMCLSQCTGVATLESRKAIEDHTMCMAVAIRVPRRFRCRMTSVTTA

SEQ ID NO: 14906 - protein, 735 aa, Chlorella protothecoides
MCWSLDMLGGVAGGNPAVHCERQRGSHDVFSPKAAQHGRQHSTVYLPPLDTPAASEGASKRPSEPPRTPSARPSRPQMAPPSGKTHGRGRAAAAASRVSCKTGTCGRRRGSTLRGEIHAAHLGLSCSLVTGAHEGGANVEVLCKSSAPGKRHPPNSIPHTGFAHTFLRGGHQLGDAPPQPPCPHHALQLPVGLLVDVQACSPHGSVGGLLGSQAWLHVHPASPSHIPPPFPPPPTATSYFETEEWNGIPAQWWFGGGTDITPNYVVPEDMAHFHGTLKGVCDRHDPEYYPRFKKWCDEYFLIKHRGETRGLGGIFFDDLNDRPAEDILAFSTDAMNAVVEAYVPIVTAHKDDAFDPKQREWQQVRRGRYVEFNLVYDRGTTFGLKTGGRIESILMSLPVTGCSKQRGLWSCLLQDRRHTCEASRQGPAPVPDPSARALHPVCPLCFLAVRLRPGRGLPRGRFPGCDQEGPGVGVSMTPCRPVCCVSLVTASLLWHPVGEGYAVRLASRSTTSTSAPSCWGLLPKCFSTPCGPHACCLSIVFELGTGAARLTAQSECPARSWVVARGHHGPEGWRAVPPSWGARNASPLSAAKRGSWSARRVMAASSWIRSTSACPWVHASWVSHRRERLANSSAAGACTCADQEPDLLAVKVLVELVQQPGLANPLLVFEHGVEACREGAAGSAGAGAAWTTAQPLRQHLARSAERRPPPLSSHPPTLMHMGYTSGDRPTDAQPA

SEQ ID NO: 14907 - protein, 240 aa, Chlorella protothecoides
METCIDLRSRAACHTGPLAPTPATYPTPCPGPLPLRQVKLFRGLYQDPTFFSQVPLQVAAEREIARYLWQLAGRDAANFSWTTSLSEFAHPTVDSINIVGQAIGPFVFAANLFGFVLLVGGPDLEGARHDLGWRRPGLAGSAAEGAGRKPAWVELSQDSHAPTQLSSVVMEREQGLRQALKNMGMLDSAFWLSWGFTELLAGILFSLLIIGFGAAFQFDFFLNNSFGVVRQWEGGGWVGC

SEQ ID NO: 14908 - protein, 124 aa, Chlorella protothecoides
MHFVANREDGGYELSISDACGRQMWGPRSLRAVPFAAALPAGGVAGTVLSTGVSQFLSLYNAALIGRILLTWFPQAPEAISRPLATVCDPYLNLFRGIIPPLGGTLDLSPILAFVALDVRSRRG

SEQ ID NO: 14909 - protein, 382 aa, Chlorella protothecoides
MSQATPLLCPEFLAEALAQYAVPAAGPPPSFPRRHINIVDALLPGNNLGRSVSKASASRFASAFALGLRTLRGAVDRSPSGAIEGVDAFFKNAWQAPMRAAAEAAACLAGLASLGPLGWEGLVGNGAGTGQGPRAGPGLSPPPINMPPPPPPPRSQGQWGGGIPEGALPRALAPRPAWVSQRAQRAQQATAPWSPQPPSDGLQADLLRSDLAALLANMEAACRTRSPREGDDWPRGTASPARAEPLEPTAALADLSLRDGDGARMDPRGRDAGQPAAAGRPGEAMEAPSSPQAGSSDSTPTLPATRDAGNGASPGAENGALPGAGNGASPGAAGSGPRPPGATPAPLVSWSAVAMGLRRATIAETQRDPNSKTTSPKLRTTA

SEQ ID NO: 14910 - protein, 463 aa, Chlorella protothecoides
  MOD_RES (72)..(86): Any amino acid
  MOD_RES (421)..(424): Any amino acid
MSHEEDQLIPNLFRYIQSWEAEFIDSQRVWAEYALKRQEALAQNRRLTLEDLEDSWDRGIPRINTLFQKDRXXXXXXXXXXXXXXXTRAGGCARTSSSTSYSPHHPLPPPPLSQPDAADEPLLVDPPAPRRQAVEPEQLSHRCYPGAGRRGGHPGAHAVQGHLLPHLGGPVLGEGQWLRGEHEVQEADQRAALGAEPDPQPPLHAVVEPYHQPCQRVRRLPGAAGPDRHLHAWQGEQDASGGFVVSVLVGPDNGPVGGRWLHTQWPGLGRAIRSSSCIWFPFWSQAARQRAELQPPTHAHTLLWTHTGMNVPSRAYTRKPTLPPSRPQIPTLKISLIQIFRAHLWQKVHESLVMDLCQVFDQELDALEIETVQKETIHPRKSYKMNSSCAGALRGGCWVCGWGVPAGSASNECCKCQQCIXXXXVLCRCLERGPLGGWGGGCRLGVPAINAGNVSNALLFGHP

SEQ ID NO: 14911 - protein, 1124 aa, Chlorella protothecoides
  MOD_RES (101)..(104): Any amino acid
  MOD_RES (341)..(344): Any amino acid
  MOD_RES (969)..(972): Any amino acid
MLRVGCDQLPVPPAVDVACVLRDAGLFGAAPEDAAYLAGCLAGAGLEEPLAFAAVGEAGAVVCDHVSRLAERLGAMLERDARGYPLWRLVSRDGALERALXXXXATTCRAWPSVWVPCWSAMRADTRSGGSYPATAPWSALLASSPDPAWRVTCSRRRRPCAAPRWQACWTATQRRTAAPTLLRKRWALPRSPAAAATRRGSCWRRTWRAAWAWPATCTAVRARPATPRRPRSSRRAARAGFDYACPARGWSCCRARSQMLWQLWAPTQPTPGWCASPSRAWMRTVSTSGLSWRARPSSSWTPGSWRTTAGRPTSPGRTMHLPPECEDSLCYMSQPWSLAXXXXYLLSVRTACVTCLSRGHLPLFVSMAHHMSIIHPLCVLGGLHPRSAAAICPSLTLSTQFHTVTQVPGLPAPIENMILRYVKMKADWWTNVAHYNRERIRRGATVDKTVCRKNLGRLTRLYLKAEQERQHNYLKDGPYVSPEEAVAIYTTTVHWLESRRFAPIPFPPLSYKHDTKLLILALERLKEQYTVATRLNQLQREELGLVEQAYDNPHEALSRIKRHLLTQRAFKEVAIEFFDLYSHLIPCYEIEPLEKITDAYLDQVGVRGGWRCWEEGGGVWVGRWVARTTGNGAAWQVEGLCLDTNASENCAGPLHIRPRCAAGSPPLAHTFQIAHYPPRQPCTHDPTLHVHNTQYLWYESDKRHLFPNWVKPGDSEPPPLLVYKWCQGINNLADVWETENGECVVLMQATLEKLFEKVDLTLLNRLLRLIVDHNIADYMTAKNNVVIAYKDMAHTNSYGLVRGLQFASFVIQYYGLVLDLLLLGLTRASELAGAPAAPNEFLSFRDVRVETRHPIRLYQRYVNKVHMLFRFSADEARDLIQRYLTEHPDPNNENIVGYNNKKCWPRDARMRLMKHDVNLGRAVFWDMKVGGCPLVCWERVSDCRGVVDGEGASLGCQKTLLCSARVPXXXXRWAVVLWCVGRGCRTAEEWLMEWVPALDAGNTAVQREGHFFALPDSHPFDNPPRISPLQNRLPRSLTTFDWDNAFVSVYSRDNPNLLFSMAGFEVRILPRVRAAAEGFAHKDGVWALQNEITKERTAQVGGLGKEMMHGWFVIGAWMPHWLS

SEQ ID NO: 14912 - protein, 101 aa, Chlorella protothecoides
MPSMQASRDGPQCGWEDLRRHENDLTLRLPGQYGSWAVTGHAATVPYRCFRICIMQMQKGNENPWHASLAQIELYGNLYVDGKEEDADVWELAGVAANGLG

SEQ ID NO: 14913 - protein, 327 aa, Chlorella protothecoides
  MOD_RES (294)..(297): Any amino acid
MTMTCAPSPLPFEQCVQQHPLWETCSMLRQLVREAREADTAMGSPEKLVSSLQAAGPPRLPSRQEAALSARFLSRTTPGCVELLFVCPGDKNGVTYWLATQGGQQQWVNPMLSGRVKVRIPLKQSDWLAESLDEGICTWSQTLSSAPMGLWRPQCHDFMVAAAPLLPLACVACLFKSLPNVFSPLPPLQVQASSPACRSTNPASCVALGPPRLNFAAPRSEAGRLVSWWSLDLGPRHQLACSAYTLRHDKSHDPLRSWTLQVKTLRGTLRLKVSGNQRTTVPRLWNILGANFLXXXXMLRGTLRLKVSGNQCTTVPRLSSILGADYL

SEQ ID NO: 14914 - protein, 1083 aa, Chlorella protothecoides
  MOD_RES (154)..(157): Any amino acid
  MOD_RES (499)..(502): Any amino acid
  MOD_RES (540)..(543): Any amino acid
  MOD_RES (708)..(711): Any amino acid
  MOD_RES (865)..(867): Any amino acid
  MOD_RES (960)..(963): Any amino acid
MSFALRVLKGPSGSKKSMTPLKYFYNAPCDGWGTGGIRLSTCYWSTASSPPGIGTSSRWEKKTFQVFKGVADDLPEVAVQVVTRRDRRDSLAFSKPCAEFRTRSLPPSPIKISVRHQGVFRGVVCEGVFDEHGVFVTSGLVGMPRHPLSSLMFXXXXNYHPAVTEDHLVSLSVVFGKLLPKALRTLDTGGVFCFQGEPSGRSVYHVREGHSFTSDCKGELLCNLTLGHVGQRPTPMLAQIQGQSGSEPYLVYPEHFCECHAFQFDVLTKQDSVLVSAFAALCSGPMADPRCGMWDRAWFASCMLNSAPTKPGPHAVQAPTCCSPGVLTWHAAHFDSQRPCHSRSLAPTTWGRLVSQVLHTFAFQASASSETPLFTMPLRWLLSRVDTAFVDAHSRTSGGLAKTRAVVLDDTAALHEHLHAHHMHMQAQGQRRVAPFVIWLLIFLHVAFVGGLLWTWYSQKLGKAVIGAAKRESLPQKVSWSLVRWSGRFASFCEVREPXXXXKRSVVPCWGWVNADMVNCVYEFAMPNLRTAPDIKAKSXXXXSVVPCWGWVTADMVSIEHGSSAPSRHDVPGVSKSQPLLPDDEGPTTVYNHQNLHGPRDELLSPMPAPMPAQCTFEAGEDGLGLMLRKRNFRSSLPRHRPSFHPLDTTAKQCSVLLTSESATRKQLIQLVWGCLTFEVRGAYMEIEDTFGDQVPPVSKSGRHASKXXXXERCVHGDRGCLCRSGSIRDNDVTVLLKQQPGSRRWQHLSAAAGSNLESNYTVILGSHRNSCLKIEKDGVLCCSVSFGRYCCAHCSRHACVGFNLMFHHWTLTHSLPTDPPGAASLWVWEILGRTSVTPGGTQIPSRASHTRVCGAERGEPSAVXXXPSRASHTRVCCAERGELSAAQCSQGGPLLSRHDPADRAGLSAWDTHIVYRAIRVLPVLNMQQGTDLKVGPILCMHSLDAWQLALVNCYMQLFXXXXCTHLTHGSWLSSTPICSSSHVHHEFPHLCRTQSTQLPSLLDLACNTLRDCLRPSSVSAVLVVVDALEPTLPVLRQAALSFAAEHLQEALAQDPEGVAGLPAPMLSEVLRSQAMVSKFQAR

SEQ ID NO: 14915 - protein, 167 aa, Chlorella protothecoides
MQILDAGLRRDFGFQHILYVYSGRRGVHAWVCDDRARCLSDEQRTAVANYFAVYRGQEGGLARLALGLEEHPAVTRAAAILEPVFVEGLLSDDKRQEALLAYIPSERVRERARQRWAQGEAGDDVARWHALEEEVAKEQAVGPGSKEGRAEGGGGGEAQALGCCLGA

SEQ ID NO: 14916 - protein, 124 aa, Chlorella protothecoides
MRSVVFAHAYPRLDLEVSKKMNHLLKAPFCVHPKTGKVCVPIDPDRAHEFDPETVVTVGRLLDQLNKARDGVKGSDAGEEWRSTDLVPAIQTFRACFLDGLQGACRESLAARARESAAQPTLVW

SEQ ID NO: 14917 - protein, 82 aa, Chlorella protothecoides
MEGHGPGAEHPFAGGMPPVDEAMLEDKRKVATMSWLASPIPLLPLLQARKWQQLNSKRYSDKRKFGYVQAQKEDMPPGIRGQ

SEQ ID NO: 14918 - protein, 486 aa, Chlorella protothecoides
MQTQGRDLGASVEENLDGRARDRIAKSIQVGGGDGAHAPVGFAAERSLLVGAGGGDDEVVAMHVGGLGGERGGAAALPRLLLDLRDLLALGGGRRDLRAQDDVADLALRQRAHIHVVLLGVRDLHLDPLLVGQAGPDVVWLRHHALVRLQHHARLVHVHVQGAQDEHQAREGGVGGDGAQPVVVQVEQQHLRLRGLQDQVAKLLDLQRGLLELRPCDDNVGEVEEVDLQRVQHALAAYDDALGLLLHRLRADERRHLLRRLPLGQLAEALLPRPHRGVDDLEEELARARVEDEDGAVDGLGGQVPLKRLVDGDAVDVGVVHKPDDLVAEQLAIVLAAQVRLGGLAGVELQRLAHSLAQHVHGRVGLHDLGQGLDHQGLGPREPVAKGGVQVVGQVHAHHHPRGRGVDAHVVGGVVQELGARIPLHVVRVVIAPAQLHVHPIFVGGLLVEYVVGVPHQAGLGHRPFVGRKQQDVWCVGKEGRGVACG

SEQ ID NO: 14919 - protein, 195 aa, Chlorella protothecoides
MYGSSPPDNPAVKEIRCIVMPPQWGSHAAVNLPAGLPEHEMLSDLEPLGWLHSAPSESPQMAPVDVAAHAKALETHKSWDGERCIVVTASFTPGSVSLTAYKLTPAGYEWGRTHRDALSNPGSSGIVYAPPLATLLTLRILDTMQGVKFSSAMKYGLKLDNPKEFYAEVHRPTHFLEFSGLEDAGPVADVENPFA

SEQ ID NO: 14920 - protein, 1148 aa, Chlorella protothecoides
  MOD_RES (1107)..(1109): Any amino acid
MSSRKFRHDKRVYLGALKFVPHAVYKLLENMPMPWEQVRHVKVLYHVTGAITFVNEVPWVIEPVYLAQWGTMWIMMRREKRDRRHFKRMRFPPFDDEEPPLDYADNILDVDPLEAIELELDEAEDGAVARWLYDSRPLQHTRAVNGPSYRRWKLPLPVMANLYRLAGQLLSDLVDANYFYLFDLNSFITAKSLNMAIPGGPKFEPLHRDSDARDEDWNEFNDINKLIIRTPIRTEYKVAFPYLYNNRPRGVRLSAYHHPMVMYIKAEDPDLPAFYYDPLIHPIAGYKSGAGVALEDDYGEEDEAWVLPEGGAPLLADTPLSSDTTTAGISLLWAPRPFNLRSGRTRRACDVPLVAGWFFEHCPGNYPVKVRVSYQKLLKNYVLNKLHARPPKNMKKRSLFKSLAATKFFQSTELDWVEAGLQVCRQGYNMLNLLIHRKHLAYLHLDYNFNLKPVKTLTTKERKKSRFGNAFHLCREILRLTKLVVDANVQFRLGNVDAFQLADGLQYTFSHVGQLTGMYRYKYKLMRQVRMCKDLKHLIYYRFNCFPTDHQVLTEHGFLSLDDVQRHFRSNATLRVACFVDGALEYHAINSGDVTVAEGRHRLIAMQGGDATARGVSLTPTDNHRMYVRTDGGEAGGEPGGFRIATADEVHGLGERDNQARVTFQASCALGARPDVGAPPCLGALGLQVGEELDAFLRIYGLWLGAGALDPAAQAVVLEVESGAAQELAEGALAALRRVLPAGDEAGACAAAEGGKRRYAILAPAWWAYFSEECLPAKQGRAVGGAVSGADGKSASMITTPKALWPWVLRCLDLGRAREVLRGLCAVAGAMGPGSNGGHVVVASPGLRDELVRLCLHAGYTAHFEAAGGAGGYRLEFGAAAQAQPSLRVASDCEARPYEGTVWCVTVPTAQQLIVVRRVLAGGVESSSAGGASTAVTAASRPVVVGNTGPVGKGPGVGFWAPTWRVWLFFLRGIVPLLERWLGNLLARQFEGRQSKGVAKTVTKQRIESHFDLELRAAVMHDILDMMPEGVKQNKAKTILQHLSEAWRCFAPDTPVRMADGRVRPAAEVRVGDRVLGAGGEALAVRRTIRGRDAMFAVGVLPGNARXXXRAGRGRRGAGRPAHHARPRHHVRRGRAAGECARGQGACW

SEQ ID NO: 14921 - protein, 99 aa, Chlorella protothecoides
MVGGGVSGSVTPECPWYFLSIAHCGPLPPVTLPGLLPHPPNRALRPHPPLAVGSWARVDNKAVIGEDVVIRDEIYMNGAIVLPHKEIKESVLDPGTIIM

SEQ ID NO: 14922 - protein, 98 aa, Chlorella protothecoides
MVGHWSDLYGRRPFMAAPQLASLGSLGVVLLHLRIGLPLYWYYVVQVCMSGFSALAVNLAFLADTLSPVNRPPAFGLVLAVFSAAVILGPTLGSHLGA

SEQ ID NO: 14923 - protein, 334 aa, Chlorella protothecoides
MRWALSHHSEERLPEMPLLARLPALPLRPLIPQQATGTATSGVVTAPRWHLRCVRSASHPPPRGRAPARIKLGAGSSCNHHSLSPPHMRTVIQRVKSASVSVDGEVVSSIGPGLLCYIGLGKDDSEEDAAYIIRKILGIRLWPSQDGKKPWHRNVQDVDGSVLCVSQFTLFGRLSGNKPDYSRAQVPSTARDQYHAVLEALGKAYRPERVRDGVFGAMMDVASVNDGPVTWYLDSKERGAPPGWPKGPDAVRVAAIPGPDSRSIGAKRSRRSGIRLDLGIPRPLQAGVDSILRKRAGLPPRLFSLSRNHSGVMSNANNGVPSFHNNHGPFHIGS

SEQ ID NO: 14924 - protein, 540 aa, Chlorella protothecoides
MHGTMLQGVWRCSPFPHDACGLIGIDAYSSRPHFAQPRHAIPRPGFLMCIAFIDPGNLEADLQTGARTGYILLWVVLASTCMVSSMAGWHNLVSSSTAKIQGACRLCLLSESHFPHIGPPCPPLLQGMLLQARACKLGVTTGKHLATHCRCVWVGQNDVHDFPCSLGGYWIVGASSRPSSLLRTSRANKYHLPHSSVRCLTHASTVQCTQSQLLPLFAFPKLRAQYSPLVRTVLWLMAELAIVGSDIQEVIGTALALSLLSRGHIPVWAGEVHPWAPAPGAAVDEPLPASSAMPTTLAPTSRLDPGRNLVSLPLLNPPPCTALAAQASSWPPSSPLPSLSSRRPACTGWSAPSRASWRSPWWPWAASSSWQTSPTPRWQKVRACVEFRSGAGARQDVSCVVAGHEMRSVGPCCGGPASAFPAPFGYTQTDPCHFSPTPPSLQPKGLFIPRLPRSTIAIACGLLGAIIMPHNLFLHSALVHSRQAPGPGEAGCCQGLRALGALAPECMLLGKRCAPKTPRLRSNLCVRTPPGSHHAPTLPH

SEQ ID NO: 14925 - protein, 84 aa, Chlorella protothecoides
DSAQTARTGAFLNAWGGIADEEGTIRSAGPRPTDKQPTILPCLQEMTADEIAWVDAYHAKVLAALTPRLSGRELEWLKEATLPL

SEQ ID NO: 14926 - protein, 81 aa, Chlorella protothecoides
MNPLGLNLRNFSVAETDSGVVGFAQLKPLTASSVELASLVILEKHRPLVLTALAGTVVARAAAQDRLVVMKRLGKEDSIRS

SEQ ID NO: 14927 - protein, 153 aa, Chlorella protothecoides
MGAQSAAHAVESMHWWNLGHDAPAAAQCDQRLSILMQVEIKLRLKDEEAHARLAAALKASYRTTHEQENYFFDGSSAELSSARVILRLRFYNFDKKALLTVKVGREGKQVLVDGVGRCPETEVEVPPVQARGYLSNPNKLLEAGLPLVDGLKQ

SEQ ID NO: 14928 - protein, 209 aa, Chlorella protothecoides
MDSQYMFIDVMRGNTTAYLSYLQVKEGIGKLLDGVDFGARGLRLLGSDTVSAFKLIGRAAAGGTLKPREVQALRRTFRDVLTFIPFTIILILPLTPVGHVLIFGFIQEQLQAAQQLAEQEGDELEFQRAAAAAAAELGKRWTGEAGAAGMALQPGAAGAGAQDRPSWKVAEEEEGEEGPAAAAVRSLKERLERAAKLSYTDPGEAGGGN

SEQ ID NO: 14929 - protein, 66 aa, Chlorella protothecoides
MHMSQFKVLDEELAPLAAALEEDELVYIEAAELARLADDIIDLRTSMGLGDTQVERAGHRVPGCRF

SEQ ID NO: 14930 - protein, 137 aa, Chlorella protothecoides
  MOD_RES (88)..(91): Any amino acid
MGKAARTVMIANVSPCSSSCEHTLNTLRYADRVKGGLLVVWHVHWGGMRKGAPVSWRVRGVLEPRNEPQCRAKQCTHCPPHTNLPAEXXXXAPVSWRVRGGLEPRNEPRCRAKQCTHCPPHTTLPAEIRKPQPGVPA

SEQ ID NO: 14931 - protein, 771 aa, Chlorella protothecoides
  MOD_RES (489)..(492): Any amino acid
  MOD_RES (620)..(623): Any amino acid
MRHRVLPECVATRSSLPHRLRGGSKRLSTWIRRHLNRCEAGRGLPGSQYLKGRPDRPSRSRHHAGSRVEDEGEGSPSRLRARGTKSARGTARGCADDRHASRCTRLGVEVSKSLFELQTSGSRSGAHSARWFLSSVIQHGGGHGGEIGPSPRSACVYVFRSDPSHVTPVPSRQPYNTAKRDFLVKIQESSQKKWEEAKLFEVDAPSEGETVEKFFGNFPYPYMNGLLHLGHAFSLSKLEFASAYHRLSGKRVLFPQAFHLTGMPIKVSGGRSNSCSAVRLEEHRVGHDNCHRREGKRPFHAVQRPDWRSTEWGLRSAIGACADKLKGEIERAQAPEEAKPVVAVVAKVHWRKDACRMRQEGSSLHDGFLLSTDAVIVMTMEISGALLSRTPLSPFNLQAPTERDDPSKFTGKKSKAAAKTGPGNTQWEIMRMSGIPEEDIPKVVLGSSLRSRAGGAGTQGRRPLLEAWCPSVPRCAKQYSSARSSRVHXXXXSAHHWRPGARVRLNAPSNARVHAAQECITSLPTLLQFADAKHWLQYFPPLAVRDIKAMGCGVDWRRRYGFIPRGGDGAGVQFKVAAQNDKVAWQVLRGMASDCAQAKSSSNPRSFVTTDLNKYYDSFXXXXAAQNDKVTWQVLREMASDCAHAKSSPNPRSFVTTDLNKYYDSFIQWQFWTLYSKVLRAMCALRCRHPLQHPAPVPAWLEGKIVKDKRYSVYSPKDGQPCADHDRATGEGVGPQEYTLVKMKVLELRGKLAALEGAFNAVGGEWSGVMR

SEQ ID NO: 14932 - protein, 376 aa, Chlorella protothecoides
  MOD_RES (108)..(111): Any amino acid
  MOD_RES (280)..(283): Any amino acid
MTKVLNRGVPIHRHSWRPVMYKTYRNSGPLCSARSVCSEGAWAILTVVWTADSKHVRHALAPPHLYCSGFEIKRWIKRIASRCLDHNEGISIRTRVKADSCKRLALWXXXXSTDHREQNIRCDAVFAWARALHRPPTNVPLQPVVRKQHNSGYKHKANVKSYFTQFEETMQQRQLEAQIRARMVGAGTTGTACWPLQASFLAQARRSPRPSATPARWPPRAATPPAGPARTCTAPGAAASWCTTPTRCAAWESTRADPDLVMVLSSRAGVGREVGMPVQXXXXTTPTRCHLSLHTGLAPPTLAASPPAVAAQPPGESLEKPCFGGVEVQVRARDYCLSQLPDLLTPSILNGQNCRCTARMSVRCEHPGGAYYLLTP

SEQ ID NO: 14933 - protein, 529 aa, Chlorella protothecoides
  MOD_RES (424)..(427): Any amino acid
MCTTLHCPGPGENVYELLLPMKTRHRSNQTLAHGEQAGHYNIQPAGKKLASWKEFDPRIVSSRHGWQRGEAQVGRAARPCLPGCQHSQGTRWLAGRRPSSCPTPPGSGRHQPPGRYTLPPSLCAPASVGVPLLVHALGRLLGLVGRVILTPLRGGVGGGALDQRLLRGLEVGLLPLPGAQHGVLQRARVGEADMPGVGRLVHGVQVERGLQLGLAAREEHDARDGGGHPAAQQAQRVVGHHLGRGGVAGVGARGHHGGLEQDSLEQHVVVRQVLEGFRPHSAGHLQRAVDVVLAVQQDLGLHNGHQARALRQRGVPRQAVGAVAHRQGGGAGGDGHHATPLGEARACAVVLPAPHVQAVQACAPAGFEYLRSGSGCRRRGAWEAALEGAEEGTGGCEPQSSGCLGSWVPTQTGRMEQPAATQLXXXXEEGTGGCEQQSSGCLGSRGPDPDRLDGTAGSHPAAHQLSELEPGRGCSPLSTLMPGTMPCFFNSSVILVPLRVSWNRVSSNMMAPEGVGWQRVQEHIHAPKP

SEQ ID NO: 14934 - protein, 249 aa, Chlorella protothecoides
  MOD_RES (95)..(108): Any amino acid
MSQLLCSKAAVFPAFVAGRPHRAQRRSALAVRAGKYDDELMQTAGFALLPSRRTRGPPHHHWAQHGGPGRHACPHASPPSSSELRLRPGVRIWRXXXXXXXXXXXXXXPPTPLPLLQKTIASPGKGILAMDESNATCGKRLEGIGLENTVENRQTYRELLVTTPGLGEYISGGWYGPRQRMGGGEGTGRVSRCGVDEVEMVLFHAAALAWAACVGGDGTGRVSRCGVDEVETVLFHAAALAWVCSWGSI

SEQ ID NO: 14935 - protein, 253 aa, Chlorella protothecoides
  MOD_RES (88)..(91): Any amino acid
MIGGMRMDLEKSRYETYDELYDYCYRVAGTVGLMSAPVMGIDTQYKGPLDPVYRAALSLGTANQLTNILRARDGTERELRQHGPQPGXXXXFARQSQGRHGTGTETAWPSARHLPIDAPRMGVTVESASPSPAAASLRGPQSSCQTLKALSTNSAQGRGRGRTAAQPGVPATGRAGTLWHQPRGGAGGHAGARARPGGPALGGLHALPDRAHARRLLRGGGRHPPAVARRALAGVERAHPVPPDPGRHRGQWV

SEQ ID NO: 14936 - protein, 119 aa, Chlorella protothecoides
MQPLPLRAAVDVLSVLSTPDFHGVGLHVSCYEIYGGKLFDLLNARNKLEVREDGKRRVSRSQGQRFCDVQGAEVQARATRVGQVMGDLLHRGCDGVSTLDHCRCQGTHVGHAWVPGIQS

SEQ ID NO: 14937 - protein, 106 aa, Chlorella protothecoides
MVFALRNGNEPKRPVVGKLTFIDLAGSERGAGGSEKGSGDVGLGNGRAASWGGCHLEPRAPCADTYDNDKQTRLEGAEINKSLLALKECIRALDSDARCAEWGDGG

SEQ ID NO: 14938 - protein, 83 aa, Chlorella protothecoides
MAYYTVAHLLHEGDMYAVRSGPVDVRDLTNEVWNYIFLGGELPRDTPIPRDLLARARREFEFWYPFDLRVSGKDLIQAMQPGL

SEQ ID NO: 14939 - protein, 204 aa, Chlorella protothecoides
MRLTPSGPCLPHPTQTPPPHTPNSPCHPLSPAQNHLTFALYTHVALWGPDKWPRSFRCNGHLQLNNAKMSKSTGNFKTMEQAILEYGADAMRIGLANAGDTMDDANFEHDTANQAILKLYRQVEWAVYYTEWRDRPARGASREKVRSPVHIREARRSCGAKGMRDGPPATFWDRVFENEINAAVHRTKAAYDDMNFRDVVLAGW

SEQ ID NO: 14940 - protein, 239 aa, Chlorella protothecoides
MAATLRPETMYGQTNAWVRPSDPKNPDSEVGKYAAFRAKNGEIFVLTARAARNMCFQDLTPENGVAEKLLDLTGEDLLGLPLRSPRATHERIYVLPLLTIKMDKDLVKKPKLRELYSITDEMVLPYQVPRHAPAGVALVASAHRPSGAMTTHNPHRCRTHCPRLQVIPIIDIPGLGDLAAVKLCTDLKVQSQVPQLPQHCDPHSQNDTEKLAKAKAECYRRGFDSGVMLVGTYAGKPVC

SEQ ID NO: 14941 - protein, 243 aa, Chlorella protothecoides
MKKPIKDGFEKAAGGSAGKKGQPAVPASPVAHAHIHVVDRFGGWKARALQVLAGLYDASLPDCFPAKPNETVLSAVASEPELTALPPKQLRPTVFPFVAYKTKQAKEGGKEVLSVKLPFDEAQVLEASTGYILSGDERGETGLAVRRQAYATLKAKALLAQHVFEKATNLAAPSAPASAAAACCRSRAKTLTPAFPLPHRALQELKGLQSITIHKLAFDELATAGDERVRAALPGEPVIVFTS

SEQ ID NO: 14942 - protein, 224 aa, Chlorella protothecoides
MKLVQGGSVTVVEAARAVLASRGVGGFFAGNTIDVLRTVPSKALELAAFDSYKRTLRATPWVPDRAIGAVAGGLAGITSTVAIYPLETVRTRMAVNGHTFVQTLQRVGSHGGLPGLYRVSRQGEDEGGSEGPRGVGVQVGMPKSAPGRGILRRTCAAAALPGHPCACARKLMQGSPPHPLSPTVDCTAGFGCESDWHGALHGHPTGTVRRPQVLLEAGDREGAP

SEQ ID NO: 14943 - protein, 235 aa, Chlorella protothecoides
MGLCVSTLPCRPSQCSPSAVEGTKRALLPHPPPESQPAGVCMPAPLPPSPPAEPGKPDVSKAPGDISYAQTVKEGETKTTDTSSTTGSKPSGGAARKNKAGEPLSNEPNFNYAQKHAEKAGDKAGEAAQKGKESLHEAGKAAKSAAGESVEAGKQAAGEAAQAAKHKAREVDEAAGEALGHAREAAGEAADAAREYAAAARDKVAEAGDAVYEQAARGVEYIKEHLPTVHVEHDE

SEQ ID NO: 14944 - protein, 385 aa, Chlorella protothecoides
  MOD_RES (297)..(300): Any amino acid
MSKNDRLKSHPIHVEEVQLVVESSHQSAQATPPAQKGRRGILVAAAAKAKHTTSEPGVTSGGRRKHSGAEPDSSKTTAVPPKAQQTLPACAKSKGQGLGSGSKQHHAKKAAGKKSQAAAVAAQVQQGVSKSEPKVLSLPRPPTLPPPRAPSIKKYSPADLQQGLKRGTLFRAVIRYNASDTSQAFATLPGLSHDILIKGAIAQGHSMEGDEVALLILPFQDWYVRSEPARGAGRAGGPASAGATREGTPAKAAGQPGAKTLAAPSGSGAVVPVPQPGASSPHGSKKHPEAEGPKQAXXXXHRPRMAPRIIQRQRAPSKQPCHPLRLALTAYTSWHPSLTSPWSWNQVGGGICFGCISGIAMGCATYPQHHVFGSCIEVWMSGPAR

SEQ ID NO: 14945 - protein, 134 aa, Chlorella protothecoides
MCLLTEHASHPAAPALAGILTVLFAGLDMKACLGGRQHYLLYALVPALHPRMLMTLDEEGKQLSVPVRVGAAVDVVAAAGRPKTVTGFQTHTTPVLLSAGERAELGTTKYLPLTSVLEGVVVLRPNPDWVEEAE

SEQ ID NO: 14946 - protein, 89 aa, Chlorella protothecoides
MACLPQTPWRIGEEECVGRRDLRSARTFSIDPPTARDLDDALSIQELGGGSYRVGVHIADVSHFVSLNAGVDRLAFSIVWDMGADGSIR

SEQ ID NO: 14947 - protein, 356 aa, Chlorella protothecoides
MNVVENRNDSDNSIPRGLLTATVAPWGEYSLGATVPFAGDGLLELWIKGSVMFGAAIQFRDRRTLRSSRPASLNSRFNPTTFVVLGPDDSGWFRALVRAPGLTRLHYAIPAPATPGTPFPLSTSQVGRWEAAWFYSRPSGLPWQTTGSQLPPALRTLAASSPTTLYYLQRQSRPIAKQPTPPPPHLCFAGQGFALAIAEANLFPEEQEVQTESATTGIPASPSDVAINSASDLVPLYGPSGELVINTGAFPDSYDFLLALKPTATSGDVARICNTLAGTASGNVAEFRGSCNAGLQAQILNAEIDSDSPLSWPFTSVTLNSEVGGGERLERRVKGAHVVVGDRKAVCPGIRGHIAV

SEQ ID NO: 14948 - protein, 94 aa, Chlorella protothecoides
MGTLRALFEPRGIRVPAPLQAGVTRWGSDPMCRGSYSSLSVGALGGADYDILAENLGGRVRLGQWAVGGEGEGKAGAELVWSSDGGRGGCTAAC

SEQ ID NO: 14949 - protein, 490 aa, Chlorella protothecoides
  MOD_RES (448)..(450): Any amino acid
MEWTWTVTSAFVSIHAWGPTALEHGRWRGVPPCYLPTEGEPPSSACLQGPGGVAAVGELGASIITGVDGNPAAIIATQLGIPMATIRTHTPIYLEGGVEANKTLDEKVSGDSQRLSSDGDSPLPGMPGTILEAGLVMGLCSSRGQAGGKTALHAFHACDVGHAFPLPPSLGPPYLVNPQGGGPPQLPAGRVPPDPGAAGRRRRRPAPGPDPGGPVDRAPAPPGTGLGRRPGPGAAAVRVAPGQPGVCQLGAAGQPVPAPLGPGRPERAARGAHLCPRRQRALGAHAAEHLPGGCRRGHRAPGLPEGRGCGVQAGADAAQAGRGGAHQLWDAEQGGPPLPPRVLGRGAGHVWPRHALPRPPRRLLPLLLRRRAVRRRRPGRPRGRCIDGATQGRWPHLHGALADHQEGAQGSKYQALPDVARHPSTPALFSRLTSPLQIPPPQAPPQPXXXKYQALPDVARNPSTPALFSRLKSPLQIPPPQVPPQLSTRR

SEQ ID NO: 14950 - protein, 152 aa, Chlorella protothecoides
  MOD_RES (56)..(59): Any amino acid
  MOD_RES (143)..(146): Any amino acid
MPSVTFPTVIAVKGYINFGVSPAVSARMRATTDARGSVVVIGAGCAGLAAARQLRXXXXTDARGSVVVIGAGCAGLAAARQLRTFGYRVVVLEGRNRPGGRVHTLRLEVSGVVGAGGWAPEWHVPGVHAESAKASEWSRPGLXXXXILCAWR

SEQ ID NO: 14951 - protein, 268 aa, Chlorella protothecoides
AGGEGAWALGPAPEPIPRPLAERAARPTLAFLGAPDAERYIAGLEWVINMYARGRVQDYRFTYDLAAPTLLGLVASLAHDQPAVEDGEEGAGEGEGAERGVAGGESCGPEGAQPALGAGRLARNGLKRDQAAARPDGAARQPGGADAELAEKAHGSRNNRAPAMDVPSAVAPRTPPPPKSPAAPSKRSRDEDLAPALPRPPPPASPQSSSMQPLIPAACALATLPLSGRQFAASALQHLMDDGQGAALRHVYALCPTCQRIGAEIAAG

SEQ ID NO: 14952 - protein, 318 aa, Chlorella protothecoides
  MOD_RES (133)..(136): Any amino acid
  MOD_RES (245)..(248): Any amino acid
MIMEGVQKSSECCVYTRRGGVLLHVLCSTSPAVGQSLEQAHHPIPPAPPPTWIPPRTHRSARAGTHGEAERRPGGIRAPGRSGPRALLQHPPPAPPDGAGRRAGCRGGGRGGRAGRAGATPAPAPGPGAAAGXXXXGGPGVAEEGAEAGPGAPARSRRRRLDQEPLLAARIMIEDCMSLILDVQDIDQIFVAAAGWTAGEGCGEHFSHAAVQWHESWVGWIHPMHMGGVTAPLSAIAAPTGARLXXXXGGMSVRRGLIARDGWGRVWRAFQSSSGATARERGRLDPPHARGRSHGASVSRRRTDRRPSSHSHSKHSHS

SEQ ID NO: 14953 - protein, 329 aa, Chlorella protothecoides
KNKNPTKPTHQIGGDQDALGTLLELLVHGQARGLVHTRVDGGGGEVALAEELVQLARARDGLDEDDHLVEVQRVQQVIQLPVLGVLVQHDVVLHQAMQGQLGLVVHVDLHGVAHEALAHGPHLGRQRGAEHHDLLVVGRALEDGLHVCPHVHRLQALVALVHHKVAHAGQVQAALVSQGLDAARGADEDVRRLLAVLEQVAVGLDGQAPEEVGQPHRLEVGGEALKLVRDLEGQLARVAQHQHRHLPVHGLQLLQRGDDKHRGLAHAGLGLADDVHAQDGLGDALVLDCVDGTRGGWDGGGGLGVWGKEEAQVTSCRGPCASGGGGPTK

SEQ ID NO: 14954 - protein, 945 aa, Chlorella protothecoides
  MOD_RES (86)..(88): Any amino acid
  MOD_RES (157)..(162): Any amino acid
MCQAPCFSKLINTEGCHERVRSGCEGQQSQQHKVCCRDRKFSKIIKFTSSSSTNQVQRPSIPFCWSQGVPPTCLPTRHSPSPLGGXXXPQHPVLLITGNTSNLPANTAFTQSFGRYLNARKRLKRTTEPIRGNLAASCTNMAWGDGVGATQAVCSAXXXXXXHPGSPSPAHPLCHGVLWRAVLDGSPAADVNGGRGSGHDVEVHRHRQENRGHRQASQDGMANWTGHLQRSFLTSSHVVQGGALRVLASGWAGTCRDHHRLGQDLQSTRWITVSGTPRHRGGEGVVILHQNVAQIPCADLSGKGGIQSSAMTPCESWKKNTPYPSGLDLVTSWYKACWPPDYFGVSSSHRDKNSLQETCRSVSEPTLHALGPLLSRTQSPSRRDKKLRAGQATRLAVAVLRALPPTGRTKNRCNSNHSTRAPFIGWMQCIRQATCRSGGEGILFPGSPVMVTRPVLHAPRLCIQYSNPGGPYAPHQCAVNIAALPRASQVAAQCRARPPRRFLGSSTPSLHPSRSRSSGMATLATPTGGSIRQELTSLFGASISSTFPDAGVQPSVAQTNDPKFGDYQCNNAMALFAKCKGKVSSAASLWAPIRPAASSAAPTSFPPRTDAPLQTHTHQSLPSPLSAVQEGAPKNPRAVAEAIVAGLPASDLVESTTLAGPGFINVRLSHAWLGRHVGDMLVSGIGSWAPRGQAGKRVVVDFSSPNVAKEMHVGHLRSTILGDCLCRTLEYCGADVLRLNHIGDWGTQFGMLIQYIADKRPGGLSAAEDEDVADLQVLYRAAKARFDADEGFKVAAREAVTQLQGGRPEYLEVWRRICAASRAEFQRIYDRLGVELQERGESFYNPRLQATVDALVEQGVAVESDGARCVFFEGRDVPLIVQKRDGGFGYASTDMAALHQRLTEERADWIVYLTDAGQAGHFEMVSACFKGVCVGVFWGGKGGGG

SEQ ID NO: 14955 - protein, 60 aa, Chlorella protothecoides
MAIVSHDDLLPLGGVFNQYYTECQVIGTEEEDSRLLLCEATAVVMRQCFHLLGITPLYRI

SEQ ID NO: 14956 - protein, 233 aa, Chlorella protothecoides
MHLLEQGSLCTPAAKSFAAPGCHVPSARHTCSLDPRPDISEEELEEATSAMGYGAVKYADLKNNRLTNYRFSYNEMLSMQGDTAVYLLYAHARIAAILRKSGKDVAELANSTKITLGNDLEVALALHVSRFSGAFSGGEGWHGGMRCCGDRQALPCGRGAGRRGCDFHLQKMAIVSHDDLLLPGGEHSRCALELPLIRAEAVEEMLTDLYPNRLTSYLYDLSGETQGERWWVC

SEQ ID NO: 14957 - protein, 169 aa, Chlorella protothecoides
MPCPGTGCTAGHGPGWREAQDVDDTRSRCSLPAGGAGRPGTGTGGLLRASCWPLLRVLRAFDRGDNASHAVALDASTRTPPPWLKGFGNHLARPILREKHRPDMSEEEARALLRECLTVCYYRDKNSINRFQIARVSAEGVDLGEPFALPTNWDHALFRDPAAHAVGTW

SEQ ID NO: 14958 - protein, 144 aa, Chlorella protothecoides
MAGSEEGPLKVPCPIGHAVLAGLAVAPIFLPVPVNFNIVATAAATVYVGSRRSVKDSPPQDSMTKREGLEFSFSPLEIVLSASAALFSAWYLKQRHWFASNVLGLAFSLQGIEHLSLGSVAVGVILLAGRCRVLGWGWAERERM

SEQ ID NO: 14959 - protein, 126 aa, Chlorella protothecoides
MEVDEVTLSPADEDEEAFNEVPYQGPRFEELDEGLQAELLHYLDERGVNADLAVYITALNFDKEQREYTQWLERMQAFVAQKADGPGAGSRVQELCAGARGQHRPCSMTNGKGARHPARCGPGGCA

SEQ ID NO: 14960 - protein, 133 aa, Chlorella protothecoides
MGEVRQNEGVVLGPSWSPLVLSRQQHPKGGWRRVSHEFNAILPPPNPSLCIPPLTSSLPQIFAAGRRAGYFPKDREVRIDHVGFGLVMGEDGKKFKSRSGDVRGDGGEEGCDASGMLLPVGPIYDLVIRSAVV

SEQ ID NO: 14961 - protein, 267 aa, Chlorella protothecoides
  MOD_RES (185)..(188): Any amino acid
MKASYHDVATRLRGTLLHWEAHGTALESPLVPQAVIPPSRPLSCGNVHKRLQGNLTPIHANPKSLTSMATGVSCLCLLDHKFGPWTVHASEIFATSSLSFAFVNLKPIVRGHVLISPRRVVNRFAELTSEEVADIWCVHGSCTSGRADRAGTGPLLARASCVCWAGTPGVHTQADSAPPRLRPTXXXXCWPVLLACAGPELPASTHRLTLRHRGSAQLQAPRPEGQQPAGSPPGCELPDPYHPGRSPGRTDRATRPHPHPPQAGWGL

SEQ ID NO: 14962 - protein, 435 aa, Chlorella protothecoides
  MOD_RES (354)..(357): Any amino acid
MEKGSWGDGVVIELGTGPVAEFPTGLLSYQGNAATRSPASRPECLPHRKPVPCIEYTLRSHHHSPPCLDGRGIDRPTAPRHERVGLCLPHLPQPALQTRRESGVRACILLLLPLQGHVPLRGLPLPAVPACIRAPARGELAEGGCGVLRLPLSQPRAPPPRTPAPPPPSWPTGLRGPGRGTPTELPLQLRRPCGRGGGPGVRPGLQHPRRRARRPPCPPPRLPALLPPWLPSSAGPPPRPGLRPRPLRSARCTRRLEGRLGLPALRCAHPPPRGTVRGLGPRGGRPVPPAARRCRGHGAGRMRASRHDDCDAGVGTPGPGPLSDADSGAPGHRTGGRAGWCGGSGPGDAGPPGXXXXQAGARAGAEGQGPAAQAPLVGARTAEAFVHYGAGCDACGQHPIVGRRWRCRDCPAAIGFDLCARCHASCGAGVAVLGR

SEQ ID NO: 14963 - protein, 94 aa, Chlorella protothecoides
MRILPSAPSCFAQAAMTNASFTEMQPMVSTPLAFSLSALLMKPGTCLDEHVGVKAPGTATKTTWGEGREGGLGIEHRVFVQGEAPGEAPWAAGA

SEQ ID NO: 14964 - protein, 140 aa, Chlorella protothecoides
  MOD_RES (15)..(18): Any amino acid
MPFATLRSGAPPPRXXXXISMATAATTGTVGASLASAGKAMAAGGAAADLPGAQKAAQQFARESFAMDMAADVMDSALETDDLEEETDDVVNQVLDEIGVDLSAAMAPAGKARVASDAKATTITPGQEEDDILARLTALK

SEQ ID NO: 14965 - protein, 437 aa, Chlorella protothecoides
  MOD_RES (332)..(369): Any amino acid
MFPPKRALTWKFTPFSSFAPLRASNRSEWSKHGRVRHAAAAAAIFSGLAAAGIGAPINPFYDGSQAKKEFEAEKSGRRRKSDRLWAPLPTDDRPPDPGECGSFRHAAPHQAGSHGVGCQEVSWRDIGPYLCAVPFLHLQCIPHPLPSVRSATHLLHPAISAGEPVDCGRSVLAAHHTRLPARQPRTLGHQLCLPECPGGHPGGTVWAGEAGLCLHGGCGHGQPGQLLGQPFGLAGGLRCGSRLGSGGALGWSSQSTCSFRMIIPAFTPLCTLSSWHPFIPLLPGAIFGLGGALAIFFYQNRNLYGQRSDFVLRQLGQTLALNVVYGFVSPRXXXXXXXXXXXXXXXXXXXXXXXXXXXXXXXXXXXXXXLNRLAHTPRGHLGGLVGGVLAGYLLGPRLSLAETVDGRKAIVDEPPLRLFARDPVILPLPGGGRGRRG

SEQ ID NO: 14966 - protein, 393 aa, Chlorella protothecoides
  MOD_RES (222)..(225): Any amino acid
MTKAATAGDEPIGWCYLDASSQSQGPFPLDYLQRLQQAGYFHAETLFWREGQAEWKHLQDIPDLHASLEAATLAAAPPPAAQGAAVDGSTGDGPAAPQDDLSTFMAEISALDAEQADDGPSTPPPEEQTFTDDDGTVYSWDPATRKFLPQGQGGPGGAAVQYNPEDMVFEGEELDIPDFVRPGDEVRTWSRAWVVRGLHSGARRNMPREDLVVVNLGSEMHXXXXGPGWCRGWHSGPAHSHVESSSPPQSSASDGEEESKKKKAKPDAKTGKPASEAAKDPVKEEQPSSREALLAEAKEKAAQKKQARAAASAEWFELKRNTSVYVTGLPEDVTLAEMVETFSKCGIIKEDDQVRCVLNWDTKRMDGSMDGWMDGWMGSVCIECARPGTAHSW

SEQ ID NO: 14967 - protein, 129 aa, Chlorella protothecoides
  MOD_RES (111)..(113): Any amino acid
MVKRRTVHQFDNHVWSLLTMKIVGLSGGIATGKSTFAAELRTLGFPVIDSDDIAKLVVKKGRWAHRRIVKAFGSGVLTPDGRAYCRRRSGAYGIYRNLDVSIMEEHTCTAXXXRPPADRDLGHMAYTET

SEQ ID NO: 14968 - protein, 192 aa, Chlorella protothecoides
MALSRSPFGGHVLGVTWAGVSHTCRCLPRVSTSLYTQAMLHALHHTPDIPIQIVDMPLLFETGFYHFTSPRLLVAAGEDMQRRRLMARDGLSEEAADVRISSQMPLSAKRRLADIVVENDGDMEELRQSARTVGGLLQRHRWLHICDSVRVPAWLPCTHRLLCIFDLDARYFAVFLSIRIVRGSGPEWVSIP

SEQ ID NO: 14969 - protein, 216 aa, Chlorella protothecoides
  MOD_RES (133)..(135): Any amino acid
  MOD_RES (173)..(176): Any amino acid
MGTPGVAGLATRSNHVAEVVATLGIEAARATVMEEIAYTMGQHGMAIDARHTMLLADCMTARGEVLGITRFGIAKMKDSVLMLASFEKTTDHLFDAALHGRVDDITGEETLGRGGHLGGSGASRGSWEVPRSXXXHGEEVRSRRGRPAPPTTTGVLLHTESSLCWVRPRACTXXXXAGAADHYWSSPPHREQPVLGTALSLHVGAASNRPAAPPQA

SEQ ID NO: 14970 - protein, 864 aa, Chlorella protothecoides
  MOD_RES (376)..(379): Any amino acid
  MOD_RES (603)..(606): Any amino acid
  MOD_RES (844)..(847): Any amino acid
MAARGMHVTKPHMAPDGASRSAPYSSGTQGSLPLPPPQPPLDQPLDHPLDQPLNQPLNQPLDQPLNPTFEVPLHNVPDLELGGDAPPVPEPEEDLVAIGEDDEGGPRPVRRPRQHPLLQLLHVVRCHALRVGQGQGHEARHAHLADSQVGVRGDDGASGEVDALARQVPPEPPLLALQPLDQAPRWLGPPGLVHCAEAGEVAVDHRGAEELEVVPVLHQVGGGGAGGQVLAQRGVGLHDVGQAHGDVVLVGPCPGVHLHGGADADGGHGNRGDEQVLGAAGHVQQLQILCVGSVLNPQAPHPHPHIPLPKPPKTTHGLWNISEELAHAQGVEVVHDSGKVATQLVVVLAGHGQVVLDAVGGMGGRVTTLLRKAGPXXXXFPMAHMFTQGCQSTLAGRPAPFQTKRYFVKQQHPDKHTRCTSPPPTLEQPARHSHVSPPLVPGERVMDDLERPRDLLHHAVFRAAVGAELGALASVQDAFEDGLALHALRAQRAEAAQEGAALPRRQQHAGAGLADALQDLHRVLQVPDVEHGQLQLDVAWEFPSTQGGHHRHPDPPACCNDPEPGGQAGMRSAASAGQAPGPKTPARLTKMPCAVAQVLAARXXXXHRHPDPSACCNNPDPGGQAGMRSAASAVQVPGPQPPARLTKVPRAVAQVLAARLADGALVAHAQPPIQHPIGLRPALRHLQDGWAWRGPEHAGEAAGYHSRPGIHSRARHLSPFPLHPHSNPSIAAACCTVEGGWMGGLGHGSGRVPSRLHHVPVIPGTHILRGTLGSSYDSLEEHSLERSAGPGGAGRAPAIPHGGGAEPCAGNSLGGGVRLTRAGVLGRELFVRILISRAVHNQQXXXXFRLTRAGVLGRELFARR

SEQ ID NO: 14971 - protein, 112 aa, Chlorella protothecoides
MFTIDEILENPLYSEEIERDVLAEAGRLGRVEKVKVYKGNPDGVVSIKFATGEAADKCVKLMEGRFFAGRRLAAFMWDGYTNYNMKLQETEEQQAARLEAFGRELEEGGKEQ

SEQ ID NO: 14972 - protein, 129 aa, Chlorella protothecoides
MTLKTFHFAGVASMNVTLGVPRLKEIINAAKNISTPLMQVRAPGWAGGARAAGRRAHGSASGNDQGVTLGVQRLTPCAMHVSEILPQLPRASKPPLSPTQTRSGRWAELGWQEQQAGVLMNQPVGMIKM

SEQ ID NO: 14973 - protein, 168 aa, Chlorella protothecoides
MVPQHDDVPAGSQGPGGAGQGCGPAAERPAGSGVAAEYHDADFDWSEAAAEAAALVASGGGVCAAGCAPACAPGAQGGACHAGDAGEEGAATATGQQPGSEPWERFHAQHASARFFKPRRYLLHTFPALRAEGLRLLELGCGAGASLIPILLANPSARCPPGGCAGWE

SEQ ID NO: 14974 - protein, 263 aa, Chlorella protothecoides
MPPVRGGPASPEPSLHTSETDTSSLSRTQKKKRRLKLARAQAALLLEAGIMPEDAPAGKRQRAALGEQAVLASSELSTQASLTMTPGGTTDHTSPRTDAAALTGSRATPLPARPARAPQPFLPRALAAQRPLRADLSSQAAVTHAALAHRPLAEGTGEAASPRRADGAQGPGQAGVALPGPPRSRLAPHGNYHRYYGYRLGQAFDHDPRLAVMERSWFARRRCMDVGCNEGLVTLALAGSLACKSMSMVGVDIDPHLIKRACT

SEQ ID NO: 14975 - protein, 81 aa, Chlorella protothecoides
MSALKGLFKKPDPRAQLRTSQREVTHNVRDIEREVLALRREEAKTLKVQLGCCREVNMDVEFEWAPGSVQRWQEGMRTLGK

SEQ ID NO: 14976 - protein, 163 aa, Chlorella protothecoides
MPAWPPGSGSLQQAGGSGCRWCPPWVDGLPVRSPAHARVLVQHLSQPPLASPLLQFPGYIKLELPVFHIGYLKNTVQILQCVCKTCSRVLLPAGERSAFLRRFRSLRTERVQREAVFKRVLDRCKRTKLCPHCGAENGVVKKVTGTLKIIHDPFTRNKGRADV

SEQ ID NO: 14977 - protein, 662 aa, Chlorella protothecoides
MGVVNNLCTPKNGEILVAATQDFLTSAYLLTSKDKFFTRPKLAQALAYLTGEAGPLDCRRLFVSLETAEKIYTKQGQHMCPADGYVCFHNSHLICGRLGKVTLGGGNKAGLFQVLMADYSAAVAAEAMSRLAKLSARFIGDQGFSIGIDDVTPAPELQRAKAATLAAGYGQCDDFIAAYGRGKLALQPGCNAEESLEASVTGVLNNIREQAAKVGALGACGLGGGIHFPCLSPVASPPPPQHPPAPCHDPLPNAPPGVYGVAAPPELPPHHEPGSPINIAQMVACVGQQSVGGKRTPNGFTDRSLPHFPRGDCTPAGKGFVANSFYSGLTPTEFFFHTMAGREGLVDTAVKTAETGYMSRRLMKALEDLYAHYDGTVRNAAGGVVQLQYGEDGMDPVGMEGKDGEPVAFQRVLALVKATGAGAAGRAGGAGMMASSAASGGVASVATGASAAGRAGGARTTASSATGGGVASVAPASSGGAHDAAQRDASEAATGGPERDASAAAQGTGHGATHDATGSPRRPREGGEGAAKEEIAAPGARLSTQACPLPAELEAAVAQVLGQGTFGEGSPFSSAAFRDRLATFLAEQVAALRAARARLGLPADARGAGHLEHLVRVQALTREALAGFVAQCAARYERKRIEPGATVGAFGAQSIGARTGDE

SEQ ID NO: 14978 - protein, 62 aa, Chlorella protothecoides
MACQYNDQLRGNLARVMDDLNPLRVRQLFTNIPQAVSRLGGFGERNVWVWVWRLGVEDGPLQ

SEQ ID NO: 14979 - protein, 167 aa, Chlorella protothecoides
MENIHKLQLGLNASTVKLALMEAPKLKLKAEHILRPPHPVPPTRLHDLRFSTLGEDQLEVRPPLEPARVPVLFQLQTLENALPGVIVRGIPTVERAVINKKQGGGFNLLVEGTNLAVRRRMGWCFGPEEGGNGRSTTPPGGACCQPLWESSSPVCVSRIRWTLDSTP

SEQ ID NO: 14980 - protein, 88 aa, Chlorella protothecoides
MAPLTTYFKDEEDCLGFPIWVAELELIVGSARGSSRPDSIACLALLHKLVATLARAGREEVRAHQRRCEDAVLHVLLKGAPPSVRSSG

SEQ ID NO: 14981 - protein, 59 aa, Chlorella protothecoides
MTVSPAKFELKGEGFKPKQSAGNKKRKKKVLESLEKQALTWDGFDDKLAPTQVWLCGGI

SEQ ID NO: 14982 - protein, 223 aa, Chlorella protothecoides
MATVVKDAAEAVRSRLNAVLAGVGEAPSTLISSSPEWKALEAHAVAVQKLCVRVFGVWGQRNQGALPPEGVFPTPTTPIRHLKDLLSDDARTTALTREAEGLYLDLARQNATPETLQVGGGALDALMQGHAQSRQQRNVKMIHVDIAEPASVSSIGAQSIINSSNVRAPMQLLLALAEKAGVKTKIDAMFAGQHINTTEDRAVLHVALRAKRNQVGGCGMSLL

SEQ ID NO: 14983 - protein, 311 aa, Chlorella protothecoides
MHHPPRHLAELDAPLVEGVDAPDETGGGHAVLVERQQLAQGAGGEVGEEQAQAGAIAGEGLVGDESLGNPLARQGRGILAQGQRVGLGEEVAHQLLVARHLLALWEKRTGARVGRAPRKRGAAAWRCARHDGNELGGDDPPLVDQLVEGVLAVGPRLPEINLARTERHALAVGLHGQLLHVGCKVRQRLLVGQDGGGGVAQEGGVPHVEQALEQGQVAGGRRGAVVLVHGLHAVQEGAHDPEAVLQAEWQHADGGGDRVAAAHPVPEAKGVGGVDAKGTDGRQVGGHGHHVLGHRLLTKRGRQPGPLERGG

SEQ ID NO: 14984 - protein, 111 aa, Chlorella protothecoides
MEACRPSQHVIWQHFHFKRLPNQVITDAGKNVVPEVWEVLDKIKAFSERVRSGEWKGVTGKPIDTVVSIGIGGSALGPLFVHTALATAPEAAAQVGKTLAFNATAALLCMP

SEQ ID NO: 14985 - protein, 1339 aa, Chlorella protothecoides
  MOD_RES (325)..(327): Any amino acid
  MOD_RES (528)..(531): Any amino acid
  MOD_RES (902)..(905): Any amino acid
  MOD_RES (1148)..(1151): Any amino acid
  MOD_RES (1174)..(1177): Any amino acid
  MOD_RES (1330)..(1333): Any amino acid
MRPLLGKGISFFGRYPSLRPAFPTTPGHHSAAAQRAYLSGKPPVHGKLASNFSMSAASKSFSTVVLGGGVASGYFAREWIKEGGKGSDLAIISDDTVSNTEFVVKWSRCHQGPEVDAPCAPCNLQVVAYERPALSKAYLFPEGELVLHACNRSCVESEFLNSGAQNIFGWIPTCLPALLGTYQPTPDLAMLQVLLGSLDSTPLWVWAGSVKIRPGTPATVGGLLMGIEYLTETAIKSTDLKNKTLTTEDGTAISFEKLVIGTGARVTRLEDFKTPGADLEGVYYLRKVADADALLEGIAEAKKKGPDVNVRAVGAGRVWETGHAXXXKMLTCVRLELGGFGGLGSLLLGLKAGLSIGVWKPVSACVSLSLLAIVDQACWGWTGHTPPVAHGLEAGCLSVHAVHSVALALGLAGLCTSLVACPDAEVCPSLRGAAWLAALSLLAYKVHHHIMYSANTHHLRLMERLLTPELAGFYEKYYEGKGVKLIKKDLVTALEGTDGKALGSSDCLYLCPSEGGLRGCCTRQHTVXXXXWGHSCAILEGTGIRLQRLPVLVSQRGGTARMLHTPTHRLGCMSESSPCRRALPPSPSPVVAHRSTPSDSLPNPFPLHPSGHHRRAEEREAPAGGPGGGGDGRPAQRGAVQGRRGPAGGPPWWHQGGRQVANLGARRVCRGRRGGLQAGLHGGAHTPGACDQCKGGDGALTDPGWGARARRDWGLTTLVVAAPKPPARSTGLTGAYVAREILTPGTQPEYDYLPFFYSREFDLSWQAKAALAVRQLSVLCNSVCHGGDTLRVGPGGKRAKGGVGVQELRLHWDAMDCARPWYEAKAALAVRQLSVLCNSVCHGGDALRGDPVHFGDQSSGKFGAYWVKDGTVVGAFLESGSEGAGMGRRSYMSCAGSGVAGXXXXRGKAHLLSHAQREAAKARPCAWRSLGALALVWMTFLMAAFSSAGGRGEGPMNRSSTREKALQRCLFPGAQSVPYPSACASPQPHQSQHRTRPGRTAPLAAIQHHTSSPMYPHVDWLFCYTRSIIFSERWRPQGTESTGIHGTRQDQGLVRAVSASARLLCEDVDGQRCAVGREAAGNAGYGIWQQPPGKESPLHPLVVPWVANVLKQVGDGALAGGLGLGDKAQEGQLQGARRGGGGNGTGEXXXXTRGSTHPARQHPFTHLLCHGSPXXXXASPPLTPPRAPTIARRPFLISLSLSSLRFASEVLQGWEAFAIRPADVSNILGACHAHVQPLSPCTTTEHTGPLQPSPGNHLLGEAQGVEDVAGVPRDASPLELTLESWAGCHVGAQGMNQAQSAMTLGSVPSVPDSGGHQAHNPFPQQPPHPXXXXTPVPLN

SEQ ID NO: 14986 - protein, 1352 aa, Chlorella protothecoides
  MOD_RES (201)..(204): Any amino acid
  MOD_RES (391)..(393): Any amino acid
  MOD_RES (999)..(1002): Any amino acid
  MOD_RES (1064)..(1067): Any amino acid
  MOD_RES (1118)..(1121): Any amino acid
  MOD_RES (1287)..(1290): Any amino acid
  MOD_RES (1339)..(1341): Any amino acid
MQASWDCCPTPVLQFQPLISRSLSRARRCLSLSAPPSLHAQVPPGESHLPAWGHGGRAGEAGMGGRQAGPETAWLLVQPGECARRDPRLHHRAPPARGTLTPARFVPVSLERACIPSPPFARFLALKGSHNPTPAAAPGPSSPPPALHPAPTRHHAAQDDVRAVRQARHCPGGGALGGPAPPHHRAGVQQSQACRGRRDAXXXXARAVERLGGLHHLTTALGYSTPRPAGAGATQWQAHVSKVAAVTKLSGKQVRGRGGFLAAMHVLAVPPPGSGRGERAPGPTALTLPPPTGAVSRGSMHIRQGAQGRRAGPGGERGVVAGRSRRSAPGRWGPQRAGFPRSRFADPCAMNLGTVPTCSPDEARAGCLGENRAGRGEARGHLHHTLPIRVXXXWCRFADPCAMNLGTVPTCSPDEARAGCWGENRAGPGEARVHLHHTLPIRVWVQTCKERESAGAHVPAHCCALAALLFAAGTHAPCARPRLGNERGRDWVATSAGVAARCTPNLVQNCIPRVPLIPTDPRPGSHTTALKMYMAMPVLPGITRGGVSPSMPSHFVILPQGNLLHPVLSLLPGQPLVFRATAAFVSAAQRSLLSSHPARVLGVQGHRDHRAAVQEGLAQRPLPRLLPPHRAAIALATHEDGVPLRDVPQHEVQMLVKGCEPPWSGRKGKGVWKGGRVSCWEREICLGHGLRWLAFGPSSSACRLPGSSDHALANHLTCASPTHTMGMACDDQQGRTACHGPLQEQEGASRHAVGDGIQRVAPGEQGIGTIPTPDPPTPHFVSPCSREKPTSLIGGLADAGTSACSRGPPTHCSRIVPARRCGPTQRSSHTGCMQPDARQSTHGCRGKIVFVISGQQPPVRVQIVQWLGAWDGRQASIGGKRGERIEVPRRKVQAAAMHALRVPLGVFHTKVVPSRVDCVIRPVQMVFLLLPRCLLHQARDGKALTQCCAHLLQAHSLGGENEKHAWQTMQNVLLVAGINGVMKRRRPSEPTLIHPPDVXXXXWTAKLLSNPELLCSKIREEAGELCATWEEDEGEVVPEAGRGRRAGGSEWALMGACPTCAECXXXXSLSFWWPLVCSSQSAQGNVYAPRTWHDARAIAMPVRVSSITMVSQPDTPQXXXXSLSFGGRWSAHLNQREEIRIRRSPLTLDCGLRPPIGDDALQRKEGGQRRLRAGGVGACLAHFPVLLPLQGREVAGGGIGVTGRADGVAHIDQGVTIAVQVDTQHLRRALCGGGGEQDTFESVVERRQASTMATKGANMWHETPLSPKYTRSLDFIPHLDEVSRGLXXXXSPKYTRSLYFIPHLDEVSRGLALTPPALARPAVEGSELGGGERNTASAXXXAQSTWDDTTFV

SEQ ID NO: 14987 - protein, 161 aa, Chlorella protothecoides
  MOD_RES (138)..(141): Any amino acid
MALVAPLSRPCPSYSSAGHACMAPSPLLNVHRPPPTASNARRVSVRACAAQGRNGTAHQPSVLPSLKWDSKGLVTAIVQHVETGEVLMQAFADEAAVLETLETGQVWQAMGAGVEAQACHKPANSSGSMFLSRSIPAXXXXGGLVGPVGTRASDSAHACRG

SEQ ID NO: 14988 - protein, 270 aa, Chlorella protothecoides
  MOD_RES (159)..(162): Any amino acid
MASSRALSLSGGVRVARLVHPATHPVLLPARTTWPPAFGRRSCMRSMATATPALESEQRDVASHAGDAPAVHRPTMEPGAFQRLPIVASAKELVRTSVRRASRVGNNNKLKNEAAKARNRCAAGRAQRTELRRGISTPWKCLHRILRALLDSPSRLLLXXXXNRASRAMDTLMKEMCGPLGQYRSGFPSRERLHPFDAALLDLTVGAERYRRTLAQLEAFKKTAVQVSVWPGRVTGLKVVRCGARCEPGGTELSPTQVDRPLGTLPHPPW

SEQ ID NO: 14989 - protein, 289 aa, Chlorella protothecoides
  MOD_RES (54)..(78): Any amino acid
MGLRARDARLRIPTPMSSGPAKFGADSASREMFRQSDLLIAKSRRICRCRREEXXXXXXXXXXXXXXXXXXXXXXXXXLCTCDPRHQELLILMVQASEPLNEIKIFGGAISVPLPSRLQDVSDFRPVPDHQEVRAVVSGLDGLIDSIPLGEMHSPQPHTPPTEQIFTDAARDQSLIVEVVVRASGSGMVGVHQAGHHSPPTAHAHCPAQEFQDQPDEDAAGFFFKDLADVGQAVSSRLDSVQGLGSRDVPPLPPSLYVSLAAGQHTVAKSGAASEALAIQVRAAWTVVW

SEQ ID NO: 14990 - protein, 148 aa, Chlorella protothecoides
MLGVAGILIPGLLTKIGILNVPEWYDAGLVSQQNSPIPFSEQVSWWEEVHPSRASSQGMMPVCNLLPPSPQPTEPLLLIELFAFNFVELKRLKDIQKPGSQGEPGSFLGEAAAVGRGSVLDGHRSQGCLAHFPASSHSAPCFIPCAPT

SEQ ID NO: 14991 - protein, 162 aa, Chlorella protothecoides
MPDGNKTGGGPGVGGGDMHRGKGYAPDEELAWAATAEGSREESRGAVWDVLLDFERLPSFLPNLTACQVVARPHVGRLQVLQRGSAHSFLWHLQAQALLDLVLWQDGVGVRKAKFRMVEGDFKVGWRCRGVGLSWRGGAGIWCQGPAPGAELAPGLHRPGVG

SEQ ID NO: 14992 - protein, 142 aa, Chlorella protothecoides
MLPVCPGARAAIPIGQTTKPSFSADIPPPTPLHLLLGHRLIPQGAPQGVQVHLRRLDELSSLHRRVVASVAVHAPRSVIWEALTGYSDLPGIIPSLETSEVLPRRPGPAHGLLRLRQVGAGALHAVAPAHPHPSRIGAGTEA

SEQ ID NO: 14993 - protein, 146 aa, Chlorella protothecoides
MERLTLATLLHLPTSVVFVADLTGQCGTSVGKQWAIRPICTDSRAPNRHRQELKARFPNKPWLDVCSKADLLEAEFRVADAHRAGQGTTQPPEALTTAVEWAVHVPEALRVSATTEQGLDGLKVSLSDTVRAALESLDAWVDAAEV

SEQ ID NO: 14994 - protein, 93 aa, Chlorella protothecoides
MPQANLSLPARNAPTFPHTFPLPAGPGRLAAFDKHLNLVLRDVSERYTVLMRGKRDGRTVRWQEARQRTLRQAFLHGSAVVSVSLHPQHASGV

SEQ ID NO: 14995 - protein, 885 aa, Chlorella protothecoides
  MOD_RES (265)..(268): Any amino acid
  MOD_RES (345)..(348): Any amino acid
  MOD_RES (509)..(512): Any amino acid
  MOD_RES (679)..(682): Any amino acid
  MOD_RES (877)..(880): Any amino acid
MPEVMAEYESGGGPPERGACCSCRPESLARWVNAARFACVASLGLVAAASPWALATAEAVTMTLLYALTLPRKARDAPYAFAASAEDVLALSLLRAGLVLVCHFCGTGGLHQRPYLYAATVLGCISLPLAMFKTAALEQGPLPPAKHPAFFLFFLLHAGFALAHMVAARQVSIWARRRHRLGLTGLGYPWEEGEETWLLAGELSARAELDALQLSAEDGGALLQASDSLFMTDCLGVTVHYRLVHPQVGGWEGVGEYGGEREGDXXXXTTAWCTRRWVGGRGWVCVEGRGRGGAGGTARRGLDVLVDCGYRLDSKDHHLAGSSGCTASPIPAPPPPKKKKIFNPXXXXCVTNPRPSPLPPKNTIFNPQGQPRATSTVILLLHGFGGGVFAWRHVMRPLADASGLSVLAFDRPGFGLTSRPPRPPDAPGGNRHNPYAQRFQARMTLELCRRLHIASLVLMDWSWMEDRVARGMAVTGHMTFCGTAPDAAPNATAVQAPGFPAGTLIIHPXXXXGMAVTGHMTLCGAAPDAAPNATAVQPRIPSWDTDRPSVRHPAVSPAGYGDGALLALRVASSCTAHRVAAPPGDDAGARPSTRDGSAHSQREGPALASSGTTGSPGTPPPPPWHAPAPLGHPPPGPRRGGPTSPDWAGSAPEQQALLASLLRGEFVPGAHWPLGTGAXXXXQQALLASLLRGEFVPGAHWPLGTGAGVRAARGVVERDAPVKTAPGSWGSPASDAGAAVPSPTEPPKPAAMPRAAEPSPFLQAALEAKPAMQGSTGVANAAPSSEPAPAPELERAPSILPPGPPLVRGVALLHPDISGVPAPLYARVLAQSRCGPWTRGGVCARSAGRASVHTFEGAWDLPTWRRAAVPAGDEGGXXXXQCAHL

SEQ ID NO: 14996 - protein, 329 aa, Chlorella protothecoides
  MOD_RES (99)..(102): Any amino acid
MTGIARLAAEIAWASKIGAGHRSPERNTSSGSGIPHLVLHTLKDVQYVSMPRSHQGALPLPDAECPIAYRSLSKIAWASKVGAGHRSPERNTSSGSGIXXXXRVHPLYPMLNALSLTGACPSSGPPAMARRAAGLLLCLFTLGACSVHAFYLPGVAPEDFKKVGEGPGLAPVLSSSCPLPPRSTPSHRMQGDPVTLKVNKIMSVKNLPYDYYSLPYCRPEKIISSAENLGEVLRGDRILNSPYTVCDSVGRRGESDPVSPSERAAYRRSLSRKAFWTPTRTPPPPPTAPEPLDRPSFVCPSPARSCAASQSWTRSRPARSRTESMTSTA

SEQ ID NO: 14997 - protein, 148 aa, Chlorella protothecoides
MDRQGPGGIYRRCPGEASRGAGRVPAIQIDTPLPEHPYPTCDMSLPWDLDYPQTKSGKTYSGILSSISSDKGALVAHLSMTTLVRDAKVQGELPVVRPTPTLALPWLDIVSITAKGVALGAEDVSTASTHNGIEGLGTDADISRGRGG

SEQ ID NO: 14998 - protein, 127 aa, Chlorella protothecoides
MVEILETRLKALLHISELAATRVRAVEDELALNQTVQVLCLGRDEAGNVVISRKALLAREAGSGEGAAGAGEPKAAGSDGEASPARSPGREAHRSASREGTRPSGREGSSPSRSRTLPRDSGPRRRG

SEQ ID NO: 14999 - protein, 70 aa, Chlorella protothecoides
MVGHVKVHPRMLGRIIGPSGSNLRGIEEATGARVQDDGRVHVFGPSAAAYESAAARVLDTAGDSMEVSGE

SEQ ID NO: 15000 - protein, 117 aa, Chlorella protothecoides
MTSPVLHFVIVGQNDHPIFEADLSSKAGDASHREERPQYLYHFVLHAALDAVEEQEWASPSMHLGVVDRFNNFQVSAYSTAAHIRFMLLHDGRSDDAIKSFFKDVHELYLKVGAVGM

SEQ ID NO: 15001 - protein, 247 aa, Chlorella protothecoides
MSPGASHPVTSLPSRLLIHRRADRELQRWVPTADEADLGSLEGLEGARGGGRGGGRPSASHGSRGGSGSNSGWDQFALNEAKFGVRTDYAEELYTTALDPRASTISAAEADRIAREIEGGGAHGKAGGLASRHVLEERGLAVLDDSGLDEEDLYGAVLRTDGPGGAAAGRPAASGERNGAGSGGSARPGASAAVPVPKPATSRSAPIDIDARRETNKLRAQMMEGKKTSPYGTPKSLKSPLASPLIK

SEQ ID NO: 15002 - protein, 183 aa, Chlorella protothecoides
MSAALAWLPAAPPHTDQLIPWEHHGVPIHLPARNPSVPFRVRADGSVILNNHLSFTILYHSDPASGTARIVGFEVVPQSVHHKYEGKWQGADTKLTTCSSTKGSSVAAGAEAQLVKQGQEVVFTYDVNYRVRGCACYWEGGRGEQGCCRWRVSLCGSGDCSLKEGRVAGADSWRSVGAGAWRP

SEQ ID NO: 15003 - protein, 272 aa, Chlorella protothecoides
  MOD_RES (69)..(72): Any amino acid
MFTSCTERRCPSEREWQCGGDVACGGVDFCGAWHMRVTAARMPPWDGCAQMPALARRRWLRGLPVLALXXXXHMRVTAARMPPWDDCAQKPAQARRRWWRGLPVLALARAEHHSFPLPGRFDDECRSAVAENLELRGIHVHSECNPTSIEKEGEGRYVLHYRDGSGQEHSLRCGKVMMATGRRANTRSIGLEVRQVARGCGGARGRVAAAAPSMRPPTLLRRAPTGSVGGGRGRSPWSSGASIDAASLRLFWWLGLPDTRMPVPSPHPPPSP

SEQ ID NO: 15004 - protein, 1133 aa, Chlorella protothecoides
  MOD_RES (53)..(56): Any amino acid
  MOD_RES (101)..(104): Any amino acid
  MOD_RES (203)..(206): Any amino acid
  MOD_RES (321)..(324): Any amino acid
  MOD_RES (674)..(677): Any amino acid
MIGALSAMGLIQCVREPVVPPFPLFPTAQSLPPTPLRRIATSSPAPRQPWGLXXXXREGACGPALPDFPTAQSLAPTPLRRIATSNPAPRQPWGLLLSPNXXXXLLRKGYIGLRCWVSYGLNPAAVWFREQAQSESGYPLAPFSIPDQVRNGRMLENESLGDAMARLADVLDRWMRCPHIADVLHLDRGMPIYWLERMARRMXXXXCPHIAGVLHLDRDMPINWLERMARRMNMAVLDDEPTRLQYYAINLRGPVYGWASSLLRGNAFTPAVTMCAEFERKFLDFFRPIYCHRRGRVDLYQLQQRGSVAEYAREHQSIVSXXXXDQLQQWGSGAESAREHQSIVSSIEDLTPDECLATFTSGLKPELQRENSVHFASSYEEALVKAQWQEQNTRRRRQRNHTLPAQKGQRAAYGPCLLNGAVAGSPPQRGPQWTAAQPKRTCSVTGQEKTWTCDSSFTPAAPASTRFALEPHAGPLQPLPTLIRSPAANAPEMQHCESATKKITARALVKMFLDCVCNLPGSPGIMVGNCDPYFTIGFWAQLSGVMHLHDSSWWWSSIWGSVNPSRPFVSETLTRSISKSCPISFGSLGSGILTAGLKRDALRRLSLRASHARASLPSTGEGLTAWHHTVPSACLPVLGIMIVYMAHGGAPRGSCGLRWLNDRSRHEAHPGRIXXXXHSTGEGVTVWHHTVPSAYLPVLGIMTVYMAHGGAPRGSCGLRWLNDGSRHEAHPGRIQFLIGVKESATGEGGNEILLAVLRADDHHAGDSSHSESLGDKSRSVPCPHRSRQGPCGEVYPVLPNITCLDCPMPPMQTAFGQVAPSRVCGLSGAARRASVIARAENNKIQKVSEEGVDSFSRRLSRTSDGEPYGACLNCCPCQLLGVQCLRLVLASLNPPQQSCLSRRHLTSLAQAFLISLPSPPPAPSYEQVDRIQKNGPLYLNFASDQSLTYLDGTLPADFGFDPLGLSDPEGAGGFVTPEWLAYGEVYNGRWAMLGAAGVLIPDVLSHAGLIPQTPEEIKWWKTGVIPPAGQYDKLWLDPYSLFWIEAILMNFVELRRYQDYRNPGSMGRQYFLGLEGGFKGSGEPAYPGGPFFNPLGFGTKSADDLKVWKTKELRNGRLAMIAMLGFAGQVGRG

SEQ ID NO: 15005 - protein, 120 aa, Chlorella protothecoides
  MOD_RES (3)..(6): Any amino acid
MQXXXXSTVIEGMDVVYKIEALGSQSGQPSKKVTIAKSGEVTGDENNSTLASELPSAEPGRVLQRLGTKASCGMRMLRPQVPWDVQWPGRARVLTWRCKRERCPLHSQKRGHWRFSEEYP

SEQ ID NO: 15006 - protein, 235 aa, Chlorella protothecoides
  MOD_RES (68)..(70): Any amino acid
MMPALPPCPCSSTLTLPHQVLLCTGSIRSWTPGPSLVREWLPQPQPVPRPTRSPSLRSPLPKTTWRPXXXRVAGGELENHATCPSTMPLQQHSDASTSCATLHRLNSLMDSRPITRQEVAAPTPARPLAYTIPFPALTPAEDDMAAVQPRGLHGGDEELGAVGVAPRVCHGEDTRPGVLELEVLIRKLGTVDGLAAGAVSPGEVAALQHELGDDPARWDGVCGAVRGGALGGAAE

SEQ ID NO: 15007 - protein, 84 aa, Chlorella protothecoides
MHSHCFAAYTRYAYTCPLCFKSLGNLEMYWRMIDRLLEAEQLPAEDAGRRQSILCNDCGARSEVAFHFVYHRCASCKGYNTRIV

SEQ ID NO: 15008 - protein, 126 aa, Chlorella protothecoides
MAFLGHGPCHTRNFFRTGVACPSIHPRARARTVLQSLARSDAVDASPFDDVAAASPGDAAREESRNPSPPRRTLSVTFTCNKTERAVNPVAWTRGLVIAQCGECDAWHKLADAANLVDEIRYSDEV

SEQ ID NO: 15009 - protein, 193 aa, Chlorella protothecoides
  MOD_RES (63)..(66): Any amino acid
MAGENTDAQVSAILADADAFLAQVRRGGSECSERSRVRGGWGCGLLTSLVAGNLAAGLIGESXXXXGACGPLTSLVVGDLAAGLIGESRTAPSQVQGRPRRPPQHSAPPPSAQLPDVYEYVQVCFPPSYSVFEVVSAEYCTHLASMLDFIGLCAEQLANEDILRVVGWVGGAGDALCALGLPPDRASFPGEGI

SEQ ID NO: 15010 - protein, 202 aa, Chlorella protothecoides
MLATLEDYLVDFSAMIQPALLPRVAEGMLEETVAHYSGAVLAGLTLAGDDEVAALRRDHGRILEFFGRHVKPAKVRAGVGRTVWGRAAPCNQPLCIHQHTRTHTKALSPLPGGCGVPADRGADRVPGCRLPGRLRAFLRLHCVPGPGHHPNPARGVAGRACCCGDRVQQGRRQGGEEMMVEPWVDGWVDGWVGGRSADLSPV

SEQ ID NO: 15011 - protein, 130 aa, Chlorella protothecoides
MGWLRRADGAWACRVLCARPCLWGQKVVDVSPDQDAGLVPIHSFTTFLHARSLLPRQHLDVWGADAKFSRRGAGDPLFHVSVHPAGAAPSLQEMVVLEAAAGDIPVKFAVVEKGDIGFYGFSHVRLQDIL

SEQ ID NO: 15012 - protein, 798 aa, Chlorella protothecoides
  MOD_RES (148)..(151): Any amino acid
MTHSHLPGCHPGRGARAHRGHRRAAGPAEGRGGGQARGRPAPGGHVGHPGHPEADGLLPGLPGGIHRTPITTSSLPLHPSAGEAVPSAGHVHPRAGGELRGRRHHHRPADPLRGGPRRRPGLPHRPGGARVGFCIATPAACRRALCLXXXXPHRPGGARVGFSIATLAAWCRALCLFLQRGASSVLLFLPNSHSDVLVRHPYCPSNPSDKSPSPPPLPSPKDEIEACERLLTDRAASLPPDPARLSLCVLPLYAALPPEAQLRVFERAAPGSRRVVLATNIAETSVTVPGVRFVVDSGMVKARAYSPRLGADCLQVVPVSQAQARQRSGRAGGTGWAWVCACVCQGEWTRVRPNGRDGSRGWSDRAYDAAGGCLAPCAAACPCIVSPPADGSPCPLAPTTHSLSPRRLPPTRLLFPPLTPRPRGPGQGLPTLHRGRLRQVGAQHGAGDPAHQPVQRRAAAQGTWRAGRAGLRLPGPAACARARALPGAPAGAGGADAGGGPGAPHRVAPWGAEGWGEGWGGGESGEREGVELRYLPVITSGDSSTQILSPFLSLPVGTSLARLPVDPMFGRVLMASAELGCSEEALAVIAMASTDPVFQFPRWVWVCCISRSGREVKGAGVWVQSCPVRPLLLSKTLDSAGCTHPLPPTALPQPPFQGKAGGGGGRPRPLRLQGGRPSHRPGGLPALRGPAAQAGGRLVPGGLPERAVAGQGARHPRPASRPLSGPGPEAGLLRRRRHAAAPGPGHGPVFPRRAPAAGRWVGDWCWAGEWALLHGSQLSNSDQTTSAWNTEPPTDPCV

SEQ ID NO: 15013 - protein, 131 aa, Chlorella protothecoides
MVVEPPPTQPFLPQTDYSEPPKVTAEGRVWTPGPVDFFRILNEQLGVAAGVDDGPLLAATARAAMEAMASYQASQRAAVASGRLGLDLLCAAVNNNMRCYDESLQFAERLQKSLERRRRGGWFWEEGDLPG

SEQ ID NO: 15014 - protein, 287 aa, Chlorella protothecoides
  MOD_RES (35)..(38): Any amino acid
  MOD_RES (207)..(210): Any amino acid
RAGAARGLSLRRPGGPGRHRRRRRRGGQGRGEEPXXXXGGGGAQAGTGAAGAGVGRGVGRSPAAARGARAQPAQAPAAPAPDLLGDLLGEDPVDLGSQQPSGNGHANETDLFFGGGVVGLESVAHQPEREQQQTPLNAPSDPFAMLEGLQTSGQSAPVQDYDPFGGAFLGPTPVASAADGARPPPGLASPSPATSSPNWNLGGVGMXXXXPTAAGAGLPTAGHLVTQLEPGGRGHAGDGGRCHAESAVAPACQEGCRPLCRSAGVAPACLLPVNALLSALMLGPNFQ

SEQ ID NO: 15015 - protein, 504 aa, Chlorella protothecoides
MGARSEVGRPVWGAGPAPTPMMVQGEARVPRTSVPVYSIAHFTTFAHRFHPRFEVRIGSDTLILGLNTMDDDLEFLMDTVSEEEESDGVSLPGQLTCFRQCMKFHPSSRIACRMLPSCGGTRDCSPFRNPPSDRSVACQYIGIGSCPTRPLSLPASQEPAGQPVQRTQANRLPLHQFLRLIAGGRMVDHGTAASNDDLVAALKRGGVIQRLLPCVSIARTPSCAPCSDLVARAMRACPRDAFVPEEYRYEALADSPIRLESMEFNVSAPHMHATCIEALDIKPGHRVSLGHHSADGQPASALTLPCARDPSSHPPHPDLVDPAPLTLGPGCRVRVRHPGRLRRLHGGQGWLRGGHRRPAPSGAPEPRQRAAAGGGRHRIRGHGLRGRLPSARRLPALRASARPLRPRARRRVLSAGAAGAPAGPVGAGGGPHRGARGAQRPACHHPRARRRRHPARVEPGAIQRAGGAGGRAHAAGHAEGGSQGAHHARGPAQHLPGRPGGHAG

SEQ ID NO: 15016 - protein, 299 aa, Chlorella protothecoides
MMLDLLWLLRHGDYYGAGVAAAALSQADAAMRVGEDVRHLLATLGALPAARLLHATDVYAQHSAARFLSIMRGLLGGELAAHVAGAGALSALCRQLQPGFPYVRCSAAVAIVGIMEHQPNRTELRRVGGVQALRRMVVEVYEAGLRMGAGPQEPHKTVPPLMPPRKIISRHPSRITLWPAEDAGPTKQMHARYDCRDAAHALIAACATDEELAGQVPDSFVDHEGVLELTADMLRVFRSCGQAWIEGRVPRPGQGLDPQEEEELTSSDEEAAEAGEEAEEEEAHARADESEWETDEEGA

SEQ ID NO: 15017 - protein, 179 aa, Chlorella protothecoides
MSVHEQVGWLSLAAAAGFGAAGWWWLVQHRPPREIILLSLDGHAVAHPIPTDGTQLPVSYLLTGPAALARVQAAPPAQAPQVAPRLVEDPPAAPQAEEEPEVPEAFLDPISLGIAHDPVVLVGTGAIYSRESLFQWLATGSRVCPKTNILLKDIEVGMQRMCGGGGAEDWEGERLLRVI

SEQ ID NO: 15018 - protein, 403 aa, Chlorella protothecoides
  MOD_RES (87)..(139): Any amino acid
  MOD_RES (247)..(250): Any amino acid
METSRWCRFLELEWLVANPDPHPLALPCCTHLTAVSLPPIPLQYAAYMLKVSSRGAMRWCLDAVLRDEHEVVKVGNSMVCAPWSRGXXXXXXXXXXXXXXXXXXXXXXXXXXXXXXXXXXXXXXXXXXXXXXXXXXXXXDPRLRQDEGGGDPLGRGRRGHRLRVHRRLHRRGQGRRAPEGRRQARGHLCSLPRRAHVRDGRQPHRVRRGQRHRGVQRLLHHQLPGPPGQGHPRQVWHQGGADDHGAXXXXTTATQKTVDGPSKKDWRGGRAVGNNIIPSSTGAAKAVGKVLPALNGKLTGMAFRVPTLDVSVVDLTVVLEKPAKYADILAALKAASEGELKGILGYTEDAVVSSDFIGNPLSSIVDAQAGIQLNDTFVKIVSWYDNEWGYSNRLVDLVAHIGA

SEQ ID NO: 15019 - protein, 617 aa, Chlorella protothecoides
  MOD_RES (89)..(92): Any amino acid
  MOD_RES (152)..(155): Any amino acid
  MOD_RES (317)..(320): Any amino acid
  MOD_RES (591)..(593): Any amino acid
MMRLASRCWSRVGERGLSTGQLQVALEPLDGSIFMLTLNRPDARNAIGRQFLRELKESLDNLVLERSTRCVIIKSSVSRVFCAGADLKXXXXSLDNLVQERSTRCVIIKSSVSRVFCAGADLKVGMCAGGPGEPRAFPGNWFAGEGKHDQAXXXXVLGGRGSPGVWELGCPAGAGAKNSKWRPPHSCVTCAALSLPWRPSPCPPSPVLMGECLDHRCEGFKWASVCWRVCSWLHMFNDKRCLAAGRGIFGKGGCTHHHSPQSQFCRYALGGGAELALACDFRVCGESLGFKATTCFLRQGIPVEAQRSGGATSSAIXXXXLGFKATTCFPRQGIPAKAQSSGGATSSAIAAVAALMGFMLAVCVADALSPPSTEWLVNVPTACVLLSIPGTGAQFAFPETRLGIIPGSVEDWRRGFGRSMDSTAAVTGSHGHSGPLPMSPPSTLSLQGGGHAEAAACGRDSQGQGAHLHGAQDICAGGPGHRWGPARGSWLRIGWRGDLGAGSFPPCAPACDSGCPFSPLSPLRYQIQPSLLPGLADHLADSVSAEDRALRLARDIAQVRGGAGGAVPEATVWKAGSFMLQSTGEGQGSGXXXLLPPLSFRISNPTSPSPRPGRPPG

SEQ ID NO: 15020 - protein, 249 aa, Chlorella protothecoides
MRQSTGEGQGSGATGPPCLAGVSRLTMYRTRARPFSVSNPSLHTSAPTSQPGARGTCGPPHGQAGHRPRHGGGPGQRAAGGGGVLRPGHPNPGPTGRPEGLCREAATRVQGGVIGHLQGGLSVSVLQPLPNRIPHPLSMWQGSVRVEHGSLPDPGATLLSPPRLFNISHNSTDPECPVYIYNSNDARRPWAPHPWPGPHQAPSFPPAPPAHQGGGRALQRRADPRPPPPAARPCPLGTGTPMWRTPPGA

SEQ ID NO: 15021 - protein, 97 aa, Chlorella protothecoides
MPWEDIMVAALLRGSGARVHHHDGFKAAWNDCGPGTVLKHLDNDAPLLQAGLHAQEASGLWARRGVTCATGDFTPNDYDGWRAWRNSLPDNQLNGFM

SEQ ID NO: 15022 - protein, 439 aa, Chlorella protothecoides
MHTITAPPPHPDAPPLVAIPGYAAGSGHAFRIVDGLASAFHFHAVDLLGTGLSGRPRFPARSTEEAVAFFVESLEAWRAAAGLDRMLLMGHSMGGYLSTCYAARYPERVQHLLLVSPVGVGRQPPDWRPPAALAGRWTLRGQLARAAIAAWDHDLTPGRVIRGLGPFGPGLVARYARGRFQQGLAFNDDEVARFESYFYHILAARGSGEFALRHILAPYAWPRSALEERCADLSVPVTFFYGACVWDRARHLLLRCVCLGRGRGGGAGGDGWRWERPLLRPWPSKLVGAPAWHPSSRPCTPTHAPCKPMHDPGDKDWMDPAGAKRMVAALAQQRSPACESDLQILTTPSAGHYLFIDNPSEFMRQVAYATSAYLSPEGRGALLAAADAGPHAAAEPFHPPDELEEQVERKAPGEGQAMGVGPKDAAVREGKSVAAEGSG

SEQ ID NO: 15023 - protein, 674 aa, Chlorella protothecoides
  MOD_RES (87)..(90): Any amino acid
  MOD_RES (275)..(278): Any amino acid
MTLSNGQVTNCTFQLPLLSHSGIKKAVEEVRPKILFLTSPNNPDGSIVSDEDLLVGGGLWKGCTEGGYLYMGPRVTGEGLRTPDCTXXXXSRWEHCVRRGYFGRLRTVEGLHKRRIPVHGSTCDRGGTQNPRLHKQPRACCPPPCPNPQELLELPVLVVFDEAYIEFSDEPSKMGWVQQYENLIVLRTFSKCAALAGMRLGYGAFPLSLIEVLWRAKQPYNVTVATQVAGLAAMRNVPYIEGQGSCCPSSLPTHQHRTSSSMPPPPFVPARARPXXXXAHPHPCPRPPFVPARARPAGGGEGAAERSPAGAGALPAPLPQPRQLLAVPRDRRARRGGAEGAPGAGVRRHDPPLQHPGPAGLRAHQRGETGAHGQADRCVGGAAMTARGRGVAWHTCPFSGSLRGHRSACVKRPVLGALHGPSPPGPLCTRDKPCGHQDLPLGLASLCQWCHMNCHSTENLHLRRGHTDRQGGGRIWVNVVHGKRLDRKLECSQAADTACGEDHRSRPARGASPQAWHANNATLIIVEDADAVAAVVHGDHPILPHGEDLEVWEGALQLGLGFVLVHAHLWGELACQNSEGPHQVRPRLRLLGAGHPAEERRESWQGEGGGAEQNWLEGGWWDYITQTIQRHDPCTLSHTLVAIEGLDCYLRASVGNSKEGTQHKKKTQSARGNQ

SEQ ID NO: 15024 - protein, 562 aa, Chlorella protothecoides
MHVEDRGEGWHCLSHSTLLQRSSCTPRIPEPSSTTPLANTPTHNSAGRNVVLEQSYGTPQVINDGVSIARAIELEDPVENAGAQLIKEVAGKTNDTAGDGTTTATVLAREMIHLGLQSVTAGANPVSIKRGIDKACAHLVAELARRSRPVKGSDDIRAVAAISAGNDESIGHMIAEALDKVGADGVLSIESSASMETTVEVQEGMGIDRGYVSPQFVNVPERQLVQFDNALVLVTDAKLEAIKDIIPLLEQVSRLSRPLLIVAEDVTGEALATLVVNKLRGVIQVVAIKAPGFGERRKALLQDIAIVTGAEFVAKDLGMKVESVTAEQLGTARKLTVAATSTTLIADAANRDEIAARVAQVKRELAETDSTYDSQKLAERIAKLAGGVAVIKVGAATEAELEDRKLRVEDAKNATFAAVEEGIVPGGGAALLHLSELVPDFVATLEHPEERQGAAILGQALRAPCRIIAQNAGVEGEVIVQRLLGKDFGVGYNAMHDRVEDLLDAGILDPAKVTRSGLINACSIAGIMLTTQAVMTERPRKGGKAPPPGGMSAAGMPAGMTM

SEQ ID NO: 15025 - protein, 685 aa, Chlorella protothecoides
  MOD_RES (266)..(269): Any amino acid
MSVIVGRALPDVRDGLKPVHRRILFAMHELGMTQGKPFRKCARVVGEVLGKFHPHGDTAVYDALVRMSQPFAMQSPLVDGHGNFGSLDDDPPAAMRYLGDQKGVAACFYGGCVRMWVCGEGTMKWLGRVAVHRVPAAGVHRRSAACGPGGRDRGLRAKLRRVGAGADRAAGAAAQPSGQRLLGHRGGHRHQDPLSQHARGGRDGWDGPRKICVEGRAVKCRVAFVGLSLHHRVRAVQSRSAFVRPLLPARPPLPQPSLCAALSPRXXXXCPCSAVTLSISSTPPPCAPTLASTQLVCSPLSTLETPPSLPRPGGEILLSPAMADTYATGRGTFTVRAKLRIEDAAKAPAAGRRAGARHAGSGRAAVVLEELPYQTNKAALVEQIARLVDAGTLIGVSDVRDESDRDGMRVVVEVKRGLGLALPERACATTRRPPKWPHPTVQNLHCRLRAGAGGEPAVQAHGGAGPVQLQHGGPGGVHAPHAGPARLPAGVAGLPGDGGGGARARGAGPCPPPPAPGGRLPAGPARHRGRGAQRARCGRRPRRRRGAGGAPWAQPRAGRRRAGPGAAPPDLAGKREPGGGGGQPEGQACVCAGGGVGIGRGFDCSRALRTRGMYTFKCCLKQPPTLRVAELEALLASQDKVLDVVVAEAEEIAEKFGRPRRTALVSEDPGEWGFVGRVWVEMQSV

SEQ ID NO: 15026 - protein, 194 aa, Chlorella protothecoides
MRCRHFTPCQAAETRLAHPPPARPSVKDARVFIRPHLRNLAPYKPIVPLDVISARLGFAEKDIVKLDANENPYGPPPEVTAALASLEYPNIYPDPESRALCEGLSRWHGIPVEHLMVGLRAGAMHAALPCRRTQVGAGADELLDFIMRCVLEPGEYIVDCPPTFTMYAYDAAVNAARVCTVPRLDGFRLDIKGA

SEQ ID NO: 15027 - protein, 208 aa, Chlorella protothecoides
MKDRSVGTSTGPALLALGQSCEAQGCYCAAARCYAAIPGTTQTAPVYAQAALHLARLLLARFENVPEALSALHTATLHLRASNEETTTISCQLHDCLADCHRAQGEPELELKALRAGLEACARASPKADRPTIARWRSYFLFRALECAAAGEDEPALTQALGELQGTRADLTAVEQASVVAMQMGLERHEQASVVPIQGGACFPHGFL

SEQ ID NO: 15028 - protein, 207 aa, Chlorella protothecoides
MDPTLRKLRLLDRTSSDPSISPSSAAAAAAQELQAVINDPGNANSWVAWPFASSSYEGDGPPPSLPPDQYPNVWQCRGWHWRAMMQAVMLSLSTISSLRSNITELLLHPQITIRDFEVYLRSLETGYAPRRESHAASSPQPLSLEEMQSLTGEGLATALRDVPAFFFDEGFDFDSPDLWRAVPDPADPVAGVQFLETLAQYLVRGHV

SEQ ID NO: 15029 - protein, 334 aa, Chlorella protothecoides
MDKDEAKAKLERAFPNLKVFTVGQDRVVTMDYRRDRVRIFHNNEGSVVRVPRLGCAKQPRGLGPSLQRHQRSDQLVRVLRFPHADAHAVLQVRGAVVADHDAVLPRQALPQRRRVAPVGHAAQQEVGVAGEGAQVGHLLQQGCAQPLPLHHQQVAHALGRKGGGGMDEDGAGAWTRMCGVGGWGVRMGSSFPAPARCRHGRRLTECPRPARSPAAAALPQHNPPRSYLYVGDVAHGRQAGHLGGHRDVVGLLRPPQHLYEAQGEGAVAEPGREQLHLRDEGECYLLACQLHPLVRQQTTQVPTQSRSPHASQRGTFAEGPQNNEVLILLHPAHL

SEQ ID NO: 15030 - protein, 375 aa, Chlorella protothecoides
MRTDAFSVQRLRGRGKRTTGLRDDDSVEDVVAVNDHDRLLLFTAAGKMHALRAYEVPEASRPSGGTAIKSLFPRIGALAAVLPLPGEPVAVPGGNSSSAEDADTGPPPPNDDVVLLTSKGLAKRVPLARFGRMSRHGKLAMGLSEGDSVRFVCTAGDTDSILLAASTGYVIHFRTSLLRPSSRGAGGVKTMLLRGDAHLVGMGVLPCGVAAEEEPEANGPEEEAEASSGEEEYEGEDDEEGPAAAAEETPGPWLLLLTRRGLGKRVALADFRLQGRVGRGLKAIKLNPGDALAAAVVVGGEGGGAVAIDRDGSVDGAEAESGDGTDVLVSTENGLSVRLALGDIRVLGRAGTKGHRVLKVQPGDAVASATLVGRG

SEQ ID NO: 15031 - protein, 318 aa, Chlorella protothecoides
MQDLSKRNAWRYRAAHFYMRLQHLGAYPLQHSSCAQLEEKRIPYTIEKINMQCYGDKPAEFLAKVGGADASRFCHATWTGVCVLGQPWNGDKDPIVFQLSHCLLVIAAHALPIPSFPSPGSAGAALPRDSPPAPAWDPGAWPGRRAHALGAAPLLRLAPVALPRRVVGLLGRRGEGGVGMTFRKLCLSHALPGKSRSSGTSPMNRRCAETLACHAQAIPEEARASVQTAQPHTSLPPILTNLRNVQGNRRAFCKTMEAVDDALRSTPGPFFLESGLSLVDLTFAPFLERIAASMVYYKGFVVRGQVILQGRAEFRVLW

SEQ ID NO: 15032 - protein, 82 aa, Chlorella protothecoides
MRAAETTARPLTTVPSWSDLESGVERAREQLSFPEPDYENGPANSYAVRRLFGQPGPPEIKLYRDHAAWCPYCHKIVLQARA

SEQ ID NO: 15033 - protein, 379 aa, Chlorella protothecoides
MALNSSFPSGIDARHSRGSVQREILEFLRPCAVRHGLERTKDPSSPDPWSPYTWAPHATVVTLAGKARCSRGPMDLYGGVRRRRIFACGILLLACTYVFYMTLPRLLVVEEYNSLQQARDSIVSGGNWKCGVDLRWTRSTYFLPASSPAQALGYRRVSTAVESLSLTFGRADGDTGYSAPCALLKGRGCPAYHSQEPIPSGALPRGNKSCILDCNHVGTCVATAGFCQCPMGEWVGDWQPAEPARCRCSIPPCRSTSRSSTWTGAASPHPLPKPPGWTGDGCHIRLRRPCTNKPRSWGLEQIDPGPENLTAYRPPNNPFWSSKAAMCSGACDKDMGMCYCPSHTPFGHIPAGEGSLPGKYVLARRFRWEKTEPRPVFRL

SEQ ID NO: 15034 - protein, 436 aa, Chlorella protothecoides
MLGSGPARCRTHGMPGFLPFKLPLSPARSRRVSAGVLQVPGWLVWPGLRLPGAGRAGLARHAGLHARSLAHPDAQPWAASMWAPGHAGLNTTSTPPSSLLPHHPTSAGMDNSTRPWIKQFVHTPAAREPGARGPRLRPLIWVYELPTDYSSLMLQYRVERWALGWLPAMLRGVGHLIWAGLPCSALTVRACPDMHGLQSRVSICKGRALSDLALTLVSDSFPPCPAPSRDDNSTVEAVRVYQLEMGLHEMMLQSSHRTLDPEAANNPPPPLSAPRYQEADFFYVPLYTACYIQPVVTWGDGPFYYGPSELGWVSTGLSVFFIMFWRGMGVQICPGRGPHVARSQPTFILSPASHRCAPQSRAGRSRPQASWRRRTTSSGHATPTGTGRAGGTTSLCVPGRGRIDHMPCWRASLRLPGCPYGPGQSRGHSGMGRQEI

SEQ ID NO: 15035 - protein, 374 aa, Chlorella protothecoides
MLLHTRGGMQSGSLSRARFTPCQPNRLNTIPLRRPGTAGPAQLALPCPLPPHGQPHGAQEVAGTVQGPAAGVLQGVRRATPPSWHCRAGPAEGRALLSTRPPPAQMKNLPYSQGVRQKIALVSREEDWLNNHGILYGDHEAFDGLPSYSQLMSESTFCLAIIALYLGYIAYPHAPIPPYPRCSCQMAILLEHQLPTHPILSNAQAMGTLQGTRMPSPMAAFPSSSWTMCRLPLAPSSTRPTYRAQGCHCPVDCHCQASAPVCQQSSSSTLPHTSTLTVRVAFKDVERLPQILKAIPRDEIERLQRNIGRVWRRFLWSSYPLTGPLLQAQLDANLARFNGTEDPSLLPARDTAHDMSQGDAFQTLMEWLYGRMDP

SEQ ID NO: 15036 - protein, 131 aa, Chlorella protothecoides
MTAARDVPSFAAYFCTFEAVRRACESSGSVAAPPTSTADALPGHGCVLAAGAAAGLAAWLAVYPLDVVKSRLQAHADASVPGAWRIAADMAAREGPRAFFRGLPATLGRALLVNAVIFSVYEGAHTRLAAV

SEQ ID NO: 15037 - protein, 231 aa, Chlorella protothecoides
MEETLQPAALTLSASTRDFLAGEPGQSRWDPCSACKSLISGALHTAKDLGAARPPRSIPFPLSGGVSGLSGVVAGQPLDVVRIRQQQRQGGGGAGAAPPTRGRQILAGEGPRALFRGMAYPLLTSALQNALVFQTYGAACRCLGAEADGVDPGAESALPLGRVAAAGAAAGFLQTAVCTPVELLKIRLQLQTAARGSPGYVGALDQALRIWRGQGISGGCLGNPARLLAGD

SEQ ID NO: 15038 - protein, 153 aa, Chlorella protothecoides
MRHGHSLIHDRYLHQNSLRSLADFPALPSLRVLSLCCNHLTSLSGLEGSNARLETLTLSGNHLAGDLDALATFPGLTTLDLSSNRLDDMDHLLCILRQLPLLRALYLSGNPCVTKAAAYRKRVVGNLPHLAYLDKRPITPLERATAEAWCGGS

SEQ ID NO: 15039 - protein, 226 aa, Chlorella protothecoides
MGDQGLGLRHRGSGSTEYQGKGWGWRQDARRMRAALGRPNEEVVLFNPSPSPPHQPPPCAPPSQKHEILINGFGWATQRHFQKNVLPDVRPSPLAFFDYRCHAAGGAVGTAFPGALPTCLAKLGGKDGLRNALDLGFSRRHAEHLAARAALLVEQGLEGAIASLAEARPAADRIPLQPACCAVNSQGFCATEFRPDLGNGTLREWQKEARPPPAPLRRSALRLGEE

SEQ ID NO: 15040 - protein, 445 aa, Chlorella protothecoides
  MOD_RES (417)..(423): Any amino acid
MECVKASTKPRAFSPLPGAKVAPPKASSPSGAMERGGKPGRPSRAAATPASCASPAGSNDSGSVSDYASDGEDAASDLGSDASGSEDGHLSDGLADSDGASGSEEDSLLDGLADSGASGSEEDDSVLAGMSDSEEEGSDPEGSDLSGAGDSSAANGGTSSDEAVGASGSEDGEDTERSAGKPQEPAATRPAPARPSPPAAVGRYLPPAARAAAAGSDPTIQDSRVARAVRGQLNRLAESNLQGIVGELARMHRDEARRAVTDAVVHELTAAAAEGPRASEAFAAVAAAAVAGLAASVRSAGVIAAFLSALGARLEASLRDDGDALAARNLALVVAQLHALGALRADLVMSLLDAWRRRFGEADVAATSHLLGAAGLSLRAADPQAMRDYIVAVTEAAADARARGALSARGQALLDLXXXXXXXGSGCAAMGSGIEDEWPVQRGAA

SEQ ID NO: 15041 - protein, 477 aa, Chlorella protothecoides
  MOD_RES (9)..(12): Any amino acid
  MOD_RES (259)..(262): Any amino acid
  MOD_RES (459)..(462): Any amino acid
MPLASQRRXXXXALARCSNVLIIMLDTHHINMPLASQRRNPRQIEYYACTSAGRLSPKLHWGLHLPKAAATAKPIMADRPASRSKADDCACNHQINVELGQLGGDWKAEGERLVAHAALLKGCLSVLGSTGEGERMLRHEYCMLFQVSRPLVLERCCGFGAFRTADLPSSRSTRGTPGPRAPNPATPSPGRMSQGVGMLNNPVARNRTIRHTWRSRIRGKYVVPWPDGPTGCHAQNHTYACHSSGLEDRVSPQHARQGXXXXSTMWGPSVDVPLPSTARQGSSPTPPYSPSQICLVGSNRFNAFGSHGSDAHVDFGWHASIEACCQELREEKGAQIVGVEIMPSALPVHSFPFRGPTAFMLGNEVRKLYVVGRVDVSQPAIAGPPMPLPPASASQGQGLSERQIRNCDAFIYIPQYGAGTASLNVAVAASIVLHHFALWAGFPERGREGQKFIVAPRPXXXXGLASRSGAVMARSSL

SEQ ID NO: 15042 - protein, 201 aa, Chlorella protothecoides
MDPPSPPLQFTSPGLRNTQGTQEQEIVRVIVLCCLQEGAYNPYYALLLGRLGATSRTHQTTLRYACWDALGEVGPDMDLRRLTNLARLCADAVAQGAMSPAFLKKGDWRGAQSARHVVFWRLFFEHLLLRCDDPAALFKPWRERPALQELRRGLRHYLRHSLGPWAAKQEPGQRGRSASDLETLLHRVHAVERALGGGSAD

SEQ ID NO: 15043 - protein, 197 aa, Chlorella protothecoides
MACCGGWAAPGSSTASPPFGVYPKHTPTPSTPTPARRKRDGGRHAVLSPTTLKWLRGLGVEEVAVGGIPWSKVLSPVKVGFWWQPSAADAAAAGRLPSLRGASLAAAEALEDTPGAGGQTPAQLLRLAARHGMNTEVRRTVFCLVMGSEDYVDAFEKLVRLGLKVSGWGQGRWRGRTGLHSRGSGECGGCIQAGGAE

SEQ ID NO: 15044 - protein, 194 aa, Chlorella protothecoides
MNRPPADHTLRLLGTLRDCIPDLALRTTFISGFPGESKGAHEELAEFSDSFGFQRGGAFAYSEEDGPPAAGFPEQEEGHARHGQGLTLSLPSLRPSPGAPCVDVRSVAPFRSASLLHSLAPPLVMQIPQEVREERRDELMSIQQRNSIAFAESLVGKEVRSDRCLRWEGTWAKTTCCDRGALDLPSEAGHGYRI

SEQ ID NO: 15045 - protein, 425 aa, Chlorella protothecoides
  MOD_RES (75)..(77): Any amino acid
  MOD_RES (139)..(141): Any amino acid
  MOD_RES (192)..(194): Any amino acid
  MOD_RES (212)..(215): Any amino acid
MVQCGIVSARLHHENSSNRSSPGTLGAWRFPAGGWSRPLSSDAGLQNEEAEAPHESSPHFGGGCQRATATATALXXXGVQGVRDRVGTLGAWRFPAGGWSRPLSSGAGLQHEEVEAPHESSPHCGVGYQRATATATALXXXSTNELESTVQYMWHDVHAMDLPHVTVLDVFQPMQRQSRLTAPPKYSRPEAXXXIVQKRILFARGQQASLIXXXXSGRPSRLSAPPKYSRPEAKAPCLARSPDAVCSSARQEAETRGRPGGRTVPVRFFRYRGKLCVPALFLGPRTAGPLPRRGRSPKPGRLCRARTSHIGAALLMFHVPYVLPERVYEWLCKEHGNSSTLPTAALMDFLRQEALLLGTPGECSATPVPVLPLAPPAVFSSAAAAAKEDEGVEGGDKGPAAVVRRLQQQQLHQQQQQHEEQQQSG

SEQ ID NO: 15046 - protein, 105 aa, Chlorella protothecoides
MLAPALRRHGMQAWLVNTGWTGGGAGAGARHDPRHIQAVVHAILSDALRGADLVKLPVLGLEMPRCVPGVPAPLMDPRGCWPNGEAYDDGIRRLAGLFAQVESWL

SEQ ID NO: 15047 - protein, 171 aa, Chlorella protothecoides
MVQTCTYDTALHHGLGSTIPALSITPCTRPDARPQVSLGCPKNTVDSEVMLGNLERSGFSVVDDHESADAIVINTCAFVEDAKAESLDAGSASFAPLISRAGCAGHPLSPLRSGRCLPVCCTTHCWPLDSPVQAIMEATQLKAEGGAVQRVVVTGCLAQRYADDLAGTDWW

SEQ ID NO: 15048 - protein, 274 aa, Chlorella protothecoides
MAAGDVLGGCLASGRLPLVFDLDETLLVAKSQSQLQRELAELRDVRLWYPPACQHPTKGATPLSCAPSQEPSWGPLRGRVLDLSPLEPSLKNQQHPPRRPALTQQPSSNDRALGLAALRREEELLAADLSLLQQFAEHDAVEWGGARLAATLEPAAGPALQPLHRPVVRLRRDGASVVLTRIDPALPATSMIFHVRPGWEAARPALAAAASHDVYVCTAARQDYALEAWRVLDPGEHLMSLQQRACLFFVLGGGGEMKRGGGGEVEGWGRESAC

SEQ ID NO: 15049 - protein, 322 aa, Chlorella protothecoides
  MOD_RES (215)..(218): Any amino acid
MSAELLRVACVTLLDMEILVRCRFPCHRPRIFRQPGRALETILMIMRTQPQILCGHGLASATPAPGMLGDLAGCAASRDPGPSLLFWCVAWRWDSSGSEAEVTILREIGCLPCPLAGAGVPPKYGDYEAQRHWMEITINLPLSQWYTNSTQNDLAYWGLDYPPLSAYQVGCPGMCHMITRSAGHRLPPSKPTLLQCRTELGAWKGAAAVGARSRXXXXAYRTELGAWQSAAAVGARSRGPGVLARHRDPPEQAGAASDGARLGPGRLLPGCRLPSPDPAWRQTVAAGRHHAGPAAAWPRPHPDRPRALPVQLHQSGPDGEAV

SEQ ID NO: 15050 - protein, 487 aa, Chlorella protothecoides
  MOD_RES (449)..(452): Any amino acid
MFFTSPMLIVQPCFPLDLLHFQPCPFTQIVLGVPLITSLSNLEFWLFLIGAGAGDEEAAQLLADFPASQDAEGVRAWNADLIRRVRLGRLDGTWGGGFPCHTTGRQPTPPHPSTPSTDARPSWRGGAACHAADQTGAAADARLPAGWDPAQELSRSGGLTKLDFGRPGTPGSAPHPLATPKRQRAPANPRLAADIPYCIGSYLSPMAHYPYRMNVMQGSTTTVATQQSTSGELDSGYRGGRSLIFGMSPLARASATAASGSFCSAVAAAFWMATPVPHRGLVWRGGGALARAGVAPDPLSDWPCVPQLPYLGPGEDGVGAEEQGLLVHGGVPDVLPAQLTLVGPEGEQQILRGHAAPQRSSGLGLEIVHGVAAIGGKADFRALHRGPLPDGMSESDLDRDFHAVLPTHAEIGWAYLEWGTFACSSAALLNHVHSPPGSTSFSHNSHGNXXXXCAAEPRALPPRIHSLFTQFAWQQAPQHAPARTFWR

SEQ ID NO: 15051 - protein, 210 aa, Chlorella protothecoides
  MOD_RES (152)..(155): Any amino acid
MLRDAGTARSRGELPADTRLWAVANPGSETLHRLAAKVEAGASTVLTQPPLLWRRSREWMESAAEKGLTHRARVGFERTAGGRPLTPRAVPRPSCLGRLDIFFTSFMLIVQPCFPLDLLHVQPCPFTQIVLGVPLITSRSNLEFWLFLIGAXXXXGGGAGSGWKERRRMASRTELGWGDELWYWDFVNGSGGSKPCLRRADLNVPQAAGL

SEQ ID NO: 15052 - protein, 76 aa, Chlorella protothecoides
MGDKHGNVVFFPERECSIQRRNQKVIEEAPSPFVPPELREAMGKQAVALCHAVGYHSAGTCEFLVDKHRNFYFLGG

SEQ ID NO: 15053 - protein, 143 aa, Chlorella protothecoides
MLAVTRAFGDPEFKGEGLQKLLRRGVEEGFWTQEEADQRLWVFIIINSPPPGHPPPACTSMSDQLPSRPTHTTNPHRHFSADPVTALPDVTALVRTPDDEFLVVASDGLWDVLSSAEVLKAARQGLRKGLSLQVLVGSGGTRL

SEQ ID NO: 15054 - protein, 120 aa, Chlorella protothecoides
MALPGLVAPARGLVEGGLWLEWLACRLPQTTYESNVLYALRFMVDTGIVGGNWVELPAGKYVLTPGPSQLSHCQLEAHIAAADLVSHAPEGAWAKLAPFRILSVDIECQGRKVGRLHNRE

SEQ ID NO: 15055 - protein, 153 aa, Chlorella protothecoides
MRWRDLIIETDPDVIIGYNIIGFDLPYLLDRATALGVPQFWAWGKLRNRDEVDLDLSPLPAGVEIEALHAEPALGTQVHTVLHQPVGDGPHGPKPNSTPPPPLHPSPRPPQAVQGQGRALQLQGLRHARVQGGGYRGASAVRPAPSHPPGPQP

SEQ ID NO: 15056 - protein, 178 aa, Chlorella protothecoides
MVKLRVKCHGRPELPYEASVWENAGAALRSIVALLNTAAPGDEARISPTKSQPVHPPALPDPKRETGPIASAPIDPDAVHLFFAGKTLDPALPLSTALGTNEKTSAIVWVHPKASGRPPREPALGPDEQKQLMAWQFARQEAQRAAQEAAEPEDGGLGWADPGTLHCSLQGLTAVRLR

SEQ ID NO: 15057 - protein, 245 aa, Chlorella protothecoides
MMGSVPRLWRSISQRMGLSTLVLAEQKGGRLDPSTAQAVSAARALGGPVTLLFSGRGLGGAPSAGAALEGVTAVLTADDEALDHQLAEPAGALIVAVQQRWGVLSGRLHRGCSQFPGQRVPLQIVKEAGGPGGVIGIGTLPAAPLRVYSTMPPSRSLNPRHKQEVLHAHPGAQQHAWQEPAATRCCQAGRASGGRRGGGPGAMHLCAPHLRRQRPRHGGDARGGAADAHGERRGWGWEAGWCLLE

SEQ ID NO: 15058 - protein, 237 aa, Chlorella protothecoides
MTTHPLRGTPHCLRLGAVPMHASLTQTAVGIGFAFLPENAKREGHIPQIWLQEFAWSEETKPACLARRDAHMRDHADLGKQPMFCMETCLKLLYWSNLIYDLESVVGGLATLETATSLYSQHSHELLWDLETDTKAVVAWGTSHVVVAFAGTSSMANVLTNLKVKAGRRRGMCQWGGGAVLGGKIHMSLCSLEKQPSGTQGLPVWIPPQLATTLHPPKRKKEGTRFGGYMRVHQGEL

SEQ ID NO: 15059 - protein, 404 aa, Chlorella protothecoides
MPSTLTPAARQKVMSTFNKANGYPADADVIYGDTDSVMVNFGVPDTATAMALGQEAADLVSKTFVQPIKLEFEKVYNPYLLISKKRYAGLLWTRAEAWDKIDTKGIETVRRDNCLLVRNVITTCLDMILVQRSPERAAEYVKGVIADLLMNKLDLSLLVVSKGLTQDAADYETKAAHVELAKKMKKRDPATAPAMGDRVPYVIIKAARGAKAYEKAEDPLYVLRNNLPIDSQHYLDHYLAQPLMRLFEPILRNPRDLLCGAHTRAILVSTPSSGSGGIMRFAQKKVTCLGCKAALGPGEKTVCKHCQPKECIAPGTHHSRSTHSGPQPNNICNQEGEVYCKTVAAVNDLEMQFAALWTQCQRCQGSLHQDVLCRSRDCPIFYRRMKVQKEVGEAAASLARFDEW

SEQ ID NO: 15060 - protein, 296 aa, Chlorella protothecoides
MTPTELPRCQMPFLRLAPASPRPPAHPPSELRPPPRPHQLFLLASIGGVVLASFGVVWVPFLATPGGALPVLRRIFPTARGLFEDYVANLWCASSLAIKWRRLLAPSQLLRLCAAGTLAAVLPAMACQLRRPTRRAFLLGLANSSLAFFLLAYQVHEKSVLLPLAALGTLGGPAAELAQYVGVYSMLPLLRKDGLATAAAAVAVAYAAVLGTLRPALPPAWRAARAVFLAGAAAITVGFWAVPPPPRYPFLEDAACMAWCCTALVCLFGYTNVLQVQECWGPGAARRGRHGKRKGA

SEQ ID NO: 15061 - protein, 501 aa, Chlorella protothecoides
  MOD_RES (50)..(52): Any amino acid
  MOD_RES (174)..(177): Any amino acid
  MOD_RES (461)..(464): Any amino acid
MATVAEHHRPLRPSPLADSRPGSLRLLLLQVGAGRRAAAGRRLHVCPARXXXLGRGGEPQRGAAFMFVLHVSEELQSWPESEERVREWVPLKLAPARCRYAWMRDALECWVAARGWPPLDPGRHSPSLVWTVGGKEVATWPPQLVTLHAGETQAFIVHFWTIIAGRREHHPALXXXXKHAHRTGVQGGCRPQYESRREGASTTQPCGICGKDRVQSGTLLDRNCRLDFEPRDPRLKELRDTMSGKRPTDHLEPSAKKRGSEKQITKDEGEESAEEHVCGDWVPGAVAEEPGTFQRASDEVLKQRKIIKARRPAQGPAGAAVTASPANPFAGIQLAPATENPFAGIQLAPAPVPAQTAAPSVGSGEDTQVQGDVEGAEDVATAVPDSALAEAPVTTAEASGTKETTSGSAAPEAPAVETAPVDAVASAAPTPEAQAAPSLAAPTPAVSSIFGGGLASASAGXXXXAAPTPAVSSIFGGGLASASAGGGFGSLGERECCAEIE

SEQ ID NO: 15062 - protein, 567 aa, Chlorella protothecoides
  MOD_RES (41)..(44): Any amino acid
  MOD_RES (96)..(98): Any amino acid
  MOD_RES (418)..(421): Any amino acid
  MOD_RES (474)..(477): Any amino acid
MPAPRMFQEWGGDLRSSVNREAQHPCSPPGGWPKAPFSMNXXXXREAQHPCSPPGVPSFRSKIQMNAMSQKLVMTGRPLGLTTRPCQQRRAARMAXXXTSRFENSNPCLHIHQAARMAPRAAHELPPLPFPIDSLESKGMSKVRGDGAGYQLSLSSWRMLHGKILTWLQGPLLPIIIDPKSSHKRAGNLRVPLGQAPQGICAPASKHPAHSTQLIHKSWNNGEPTPVFNNAAQTLNHTFFWESLSPNGGGEPSGKLAEAIKKEFGSLDKFKEEFGAAGATQFGSGWAWLVEAGGKLAIRKTPNAVNPIVNGEKPLLTLDVWEHAYYLDFQNRRSDEGARSRDGRTGCITRGKGAGGWGQEKRMGAGALVGGVRPDFIKNFWNLVNWDKVRLGSPSATEPEVDTSCHHFCLGQQSRLNXXXXSAWCRQQKSFSDRRLLFPIQCNTCGCPCAWCRWLAPNRSWATPVLNNRDQGQXXXXLICSGRIRHWLIIEWAGACCVLLNQHLRAVTQQSVPGKFAVGSPLRARPSSLERSHDHIQQAESGGPPNDRVRVGGTRLRPVCRGCDVAS

SEQ ID NO: 15063 - protein, 876 aa, Chlorella protothecoides
  MOD_RES (43)..(45): Any amino acid
  MOD_RES (588)..(591): Any amino acid
  MOD_RES (681)..(684): Any amino acid
  MOD_RES (843)..(846): Any amino acid
MLRLVRVISKLKVGKLTRSSQSSGLLGELAGVLPRHTAGRGTXXXATCAILLNERLTAYHDRGSLTLVKVSASGTHFTSLGFCNTPVDMLRLVRVMSKAEVVPWPYLGGLRARHQTSDARTCLLPYNGGSSPGDTGNVSPCPTSTTLSPPPRERLVPEDRNAIGSQCRWHPLVMKLTFSSYLQSTSAPHIPQAVLRTSLGDLDIELWAKEAPKAVHNFVQLCLEGYYDGTIFHRVLKDFMAQECGSSRRLSSRQLHPNSNKFTGGDPTGTGQGGESIYGRPFKDEVHSRLRFTHRGLLACANQNKPDTNGSQFFITLDATPQLERKYTIFGRVAGDTLYNLLRFNDLEVGEDDRPEHPPVLKRADVLWNPFDDIVPRVDREAREAEAAEAAATAAARAKTLQRKAAKNFSLISFGDEAEAEEEAAVEAAASLKIASAHDALHDAHLSKEAALDVDLNRRVAGCGCGCFQLLWLVVAAVAGGRSETLWLCAGGLAVRQAAAGGGGSPLDQRRACPPAVRPGVTHARAGAGPACSQGERGGGAARPKSVAQREWRRGGRGGRGRIRGGRAAAQEGGALPGRDGAGQALHXXXXEDEDASEEDGRPCRKAARSLAGTGQGKRSMAAVVVPSRQIAVADANLLSSWEKRRKVGGVAGGEGARPVVLLSAACAVHHDCTHAPSPPXXXXCWRQPVVLLSAACAVHHDCIHTPSPPTRPRQEYLERKRIGGSRQRDTLSKLQRFTSNLRSAAGPGSSAGAEAGPSTDGVEAAGPGPDGAAAAAPASQDRSGAPEGATPDPDFQGSIWIILALCPPGAVDAKCRRSKGLVPRARCDDACLGAVAHVMTTXXXXEQWMPNAGVQRVSRRTRDAMMRAWGLSLMC

SEQ ID NO: 15064 - protein, 450 aa, Chlorella protothecoides
MVARLSSIDPADRLVATRALKNESIVNPRRKLTLLRAGAVPALLSQLVQGPSPKQATQSLSALASLLLVQQGCACLVEEGGTEVLLMALCSQDAGVAAASASALRALCVHRPLRDLPPACCLALCRLVAQAGADSVAPAHVMAAVASSPGPARALVAAGAVPHLAGLLGMRGAGLARTPVLQALAGLAAGDPEAARQLAAAKPAVDALALAARNGAEAAASRYNAAACLLYCCPVLQERQGEAEKQALYGVPLVRHDHPIVARVTCHAVRVPAPDPAPLPGPIPQSLRCCVLSTLVALLDCKEPLGCERALLLLLGTDASLLAAAVDAGAVARLAGKVARCDCPPQHLNRIHSRWSADSMAWAISRPPECDPGRPTGSRFPPPTRLQPDALRLLSELCSDEEAQRRVVEEAGALPRIAASLAPDREQEERAAAVHLVRVLSRSTKLLRCV

SEQ ID NO: 15065 - protein, 133 aa, Chlorella protothecoides
MPRTEVARGEALVRAAVFDLVDTLAPGLGADGVARTYAWATGSFRRGAPESSDMDMLVGLPPGTEHVDCVHFLEQVGKEGWVASCGTLAERWTWTYKGRLACIHRGGAPLQAQCDEPLTCSIRKAAVQYNQTK

SEQ ID NO: 15066 - protein, 127 aa, Chlorella protothecoides
MLIHSFAESQAQPPPPLAKPLQPAFTPVASLPAEVPQATGEEDETTVFSGDGVLFEFDASKQWRERGSGEMRVNLGKESKQGRLVMRQRGNLRLLMNANLWPDMPAARMEGGKVGGGDGCRGGLAVC

SEQ ID NO: 15067 - protein, 77 aa, Chlorella protothecoides
MPRGVSALEPWKPSACRGCEGSPVYHFLQALLTNDITPLEAPDAKPLYACLLSAQGRHLHDMIIHKMPGGDVGTGLQ

SEQ ID NO: 15068 - protein, 300 aa, Chlorella protothecoides
MEADVGTENSGLPRAVQLHIADLESHVSGLTQQLAIEAKIHEAHAARYEKLKARQETQTRTASRLHARALDEVGDRADLASFQLSKSKVELYRWRQRSALLKVRHSSAVEDADRYDRLCASTSRLSAVGAMAAARHSEARREATRSGAALRAQLQQAQELTRAARQEAARQEAQAAGFRSEAASEREWLAQAKREADSERERRALAEEIAASARSRAEAAEARATRAGGGDRRIRALAGGGRRGCPASAGGPGGREGELGGGRGGPRRAGAAEAEGRSLRARLETLQAQVGECLSGGLGG

SEQ ID NO: 15069 - protein, 74 aa, Chlorella protothecoides
MPLEYNLDALRGVAYDKGCYVGQELVARTHYKGVIRKRLMPVRFGVGGEGGAEAARSRRAALAPEGGPRASCGP

SEQ ID NO: 15070 - protein, 140 aa, Chlorella protothecoides
MLHAAGYDGRVRQDIAHEAYMPAAWRVDAYLGKDGEDESDDDLASLRKHRVLGPSSSLLFHGKVQWISPACRRPQQGLPSYSHDIRLAFVKDARDAMARKESVEDYTVHDPLLEAGKAKFNKKSQAERKRGNQWAGRANN

SEQ ID NO: 15071 - protein, 133 aa, Chlorella protothecoides
MALKHVFEGCRLVFWHKSHMSRMKDRVVDRGGSIAAALDKDTTHVVSGANTSLVTAAAHLAKAEHVRHVAVVVSWLGADGGSPATSAASELWGRQVAPSALHTGHHMNLLQPKPQTPIHHPGPPCRSTSTRCV

SEQ ID NO: 15072 - protein, 234 aa, Chlorella protothecoides
MSRATREKLRHHWYRTARAATAPPTGKDQGGKAPRVNTVCRHAACAPHPFCIVEKLAEYRSVYVEGRDQYRIKVCVCGRGSRWLGRGVGSTGVPQYGGAQLGTGCQHSMWLCEELLHGCSTLLAKLLRSHPRSRSHVPATPLAFQALERAIQQVAGHGSPLEEDADVDHVGLGPKSAQKVRDVLRSGEFIRVAAVAGDKRLQVRGRGHPAQRGVHPRRRRRRGQAAAGAGPCVG

SEQ ID NO: 15073 - protein, 416 aa, Chlorella protothecoides
  MOD_RES (31)..(33): Any amino acid
  MOD_RES (79)..(82): Any amino acid
MVEDLLLLCAAHSHAVLQPPVTLRTHAEVLXXXRSPAAVQSSLSCSPAASCHSSHPCRACCAPPGRLDHAGAAHRRHAXXXXGNVDDGPDVDLPQHVVLRLAGWTMLVLHIAGMPPKGGTLLDGDTLGPSPLGMALIALHDPEIVVTGHSHKYSVEKCPAGRLFINPGSAGPARFKLPRSAAILALTETQGEAKTDWKKFLAAWHRKGSLFIPCWPHCVVVPPIASRPCTLHSPQKGQPGPQARPVAPSGKAWGSRRSRRSRRSRRCAPLRGPGHGRPLEVEGGPEEGRGVGDAERAAHALPGTALAPRPPPRVVEPPAPRRHGHGPRRAHAPLVPGALAARSEDGVRGTLPVAQTVGRHRQADGAGVVGGHGLVEHEESAGIQVLDYAVRRRPRGVMALSSLAWKGGNQGADRTG

SEQ ID NO: 15074 - protein, 431 aa, Chlorella protothecoides
MAAITVPSSMSLSVRSWSHSHEHRLVSHGRHGRPQPRPSRLAPRASIYRAQHLARLASPAGDPGAWDDGGLGTPVVRFYLSEGREQWYMWHSGHSTEDDPGVDALFPGSGSVGEAWLCVHACSMPIRLRAFSRSRCIIVPCWGCAWVVACSPGTVCRHGLRFSHPSDASLLLAPPTAAASFVEPSRHPSHRPGGLPGWSALAAEHGGRDGGEGRPRDVGRRPSAGPQRRGLVVLRHAPHQRLRRPDPGRQPGGQERCGRVLDVHGRRVAGGGAAAAAPGAAPGRRRRRADQGLADAAGAGHVAKRAGVGQDRDLRRAQRDRAPRAHCGSLQLVGGTGWHVPRLPQNFRLPRHGCAPPSQVVAAGPNDLRMYYYSWDEGSGRFVIGLARSEDGFRWKKTGPIFQVPWGGSGGGRDDGPAACLQKLGLWPPRA

SEQ ID NO: 15075 - protein, 385 aa, Chlorella protothecoides
  MOD_RES (97)..(100): Any amino acid
  MOD_RES (316)..(319): Any amino acid
MGVWSSCSPFLPCRLTLVGTGLVRDERVVAAMSRTGDKSELLRGPLFYVLVLFAVTLACWRNSPIGEGLGEAAQAVFNAEMGGGNPPQAEGGSLQHXXXXFSMQRWGGEAIQPRQREGPSSIHRTLTVIRLSSSTSPSHIDTLPKTHPISLFTGLVVIAVLCGGDGLADIFGRRFGGGARLPWNQAKSWAGSAAMLGGSLMVAASLISFYHLLGLVPHSLQDSLGPGKEGAWYVPLQGHADAAVAYRPAVDLCEDPCCRPWSARSGPPPGQHTVALTAAWEDIWGFVQLEAVGGKEQKEQRKRKPPPLPPQGFTPXXXXQGGCWWQGAEGAEKEKASTPATSGLHPGPLGVARDNGRQEARCGLQRRILQQLPTLLNVGQGQEGI

SEQ ID NO: 15076 - protein, 535 aa, Chlorella protothecoides
MFGEIAENKDDYAKFYEAFSKNLKLGVHEDSANRGKLADLLRYNSTKSGDDATSLKDYVTRMRDGQSAIYYITGESRRAVENSPFLEKLKRKGYEVLFMVDPIDEYVVQQLKEYDGKKLVSVTKEGLEFDDSEEEKKKREETKAAFEPLCRLMKDVLGDRVEKVVVGERIVDSPCVLVTGEYGWSANMERIMKAQALRDSSMAGYMSSKKTLEINAANPVIAELRTRAEADKGDKTVRDLVQLLFETALLASGFSLDDPNTFASRIHRMVKLGLSIDEEEGAGEGAGDDLPELEENADEGGKYQSLLPGAPASTALQGERARPYTHTVSARASQRGQGLTQTSGATGMSLTLNNATDFLAKRDGIDKVGRGQCVMGSTRRVECGAPFLMPMPPSSISPVPCPPVDPQGDPVHLEAAAGGVPPAICPGAGGPAQGPGGVPGHHTQGPQAGQVPGRGEEPAQHHAQDLPRRSQAGGGGRGHRLPLHGAAPVVGILSGSRQGSAWHPNTGDAVLRWRMTSFWLGTGLGSRSKACSPHP

SEQ ID NO: 15077 - protein, 283 aa, Chlorella protothecoides
MISVYTFYPGGVGDGGWREPVGPVAGVVFRAVLEAAQMGTVHMGWRERPILHAYHACSLPLQEHITRSAPPSILPTSLFAAGTGGHACHRDSVTPGGAPSGVPTGAVLPWAPECDTAHMDTSPSHPPSSIGCDYRRSGVCSPLPGGADRERIEVLAWVSGGPVHGIRPLVSARAYAWGAPGCAPASRRLHHSMYCLCRQAYLQTIYPVSDIGRSSLAQVKGHIIQVDQKGAHVDVGGKSAAFVPNVEMALGLVPRVCGLALVVGLVLVVGLAVCMRDGGGAQW

SEQ ID NO: 15078 - protein, 239 aa, Chlorella protothecoides
  MOD_RES (204)..(207): Any amino acid
MLRMQRHTGCCEVAQSSLPVYRRAKAGSIACACPWGFIVPLLDPVSVVQSLPRHSVVLCPLGPSLPILTPRHKPRSHFPRRPQSNDLLDAGTSREFVIVRQDHRGDIILSLKRIQLSVAWQRLRQIAESDAAVTGVVAATNRGGLLVDVEGVRGFNPSSQIGIVRVWKREGWGAFGSREPCVCRRGACLWKACMVFSTWVTQGXXXXNGRSGGHSGRGSRVSADRGRVSGRRAWCFQHG

SEQ ID NO: 15079 - protein, 658 aa, Chlorella protothecoides
  MOD_RES (501)..(504): Any amino acid
  MOD_RES (559)..(562): Any amino acid
ELPRPGRAGTRAGPPAPPAPGLLRRGRRGRGRRRVAPAGLRLRPPDRPGPGGVCAHRRRPPRAGASGRQPGDAGPVELRHRARRRAGRAGRAAQARRPLAARLAPADRRGGGGAGRAAQARAPRPPRLRAAARRGPGRAGRRPRPAHPGPAPLPRADRRGRGRGRAPGLPPLPPPGRLLAGDGPGAGRAGRLEEPGAPVSAGLPRGLHARRRRTARAGRLRRAPVPQSAPVRPPGGRRAGLPGLPPRPPLAGPQQLSPAHRRGPGPPGRRRQAHHPPRRALPGAGGPQRAGRAGRLPRPPVPLPLRLPQAGWRRAGRAAPAARPAPPLPPRLPRRARAGCGAGRHAGRRAALPPVPGHALPAGLRQRGRGFGAWGAAGDDGTAPPLAELHLQNCGAVSDAGAAAVARLASLRELRLKACRALTEQGLASLAAGLSNLTTLSLQNMTLTDGGVRPLARLAKLESLELQFCWQITDAGVCVCGLGWSGRHRWGAEDRGRGSTXXXXKLESLELQFCWQITDAGGWLGVCSLSGDVDTAVHGAEQKATDSPLPSHSFSLSVXXXXAEQKATDSPPPSHTFSLSVQHHRGHGADGVEGADAAGPAVQLAGHGQRAGRPGGHAKSAAPEPDGMPPHLTGGAGVHRPPAPHRSPGTVLTRAMAP

SEQ ID NO: 15080 - protein, 138 aa, Chlorella protothecoides
MPLIVRHPPLRPGLPGHDPRHLPRRCLARGLPSLISDAISPSSPTRDLLAAAFAITGSKLIVQIFDRLEAAAIIDRAWTRDPGLNPYQCDPFLCPQNLSRKLVHTLAGPLFLVSWPLFASNPESKLIAAAVPFLNVIR

SEQ ID NO: 15081 - protein, 112 aa, Chlorella protothecoides
MIKVGLLSKRHADSLSYVSAWFELVGYCGSITLATLLQQESLELELKILDDLARSRQTDESWGPQDERKVQARLSELRAVRTLRTLSILQDAAGAFREEGPEASSCVFGRGL

SEQ ID NO: 15082 - protein, 825 aa, Chlorella protothecoides
MSPGRSSAGEQGSGEQGRQDLVDLLHARPLVRVLLQLGQVVACALPRALLLVDAQAQLDHAVDAGGKGVGVVQGEAGRQQRGLEQQLHQVAHGLVPLVGLGPRAQLRDDGVGGVDLQRLLAGHVPRHGGVAQGLGLHDALHVGRPAVLAGDQDAGRVHDALAHHHLLHAVPQHVLHQAAQRLERGLGLLPLLLLLLAVVELQALLGHRHQLLAVVLLQLLHHVLVDGVHHEQHLVPLALQLLQEGRVLHRPARLAGDVVDGGLAVAHARHVVLQARRVVARLGGVVAQQVRQLAAVGRILVHTQLQVLGEGLVELGVVVLVLRDLAKHLDHLLDDVLADHLWVRGGGGGEAECDAGGQGGVEVHWWLPHTPGRGLRGARPPPGGGEPPFPSPPPYLEDLVLLQHLAGDVEGQVLGVDHALDKGHPLGAQLLAVVHDEHATHVQLDVVLLLAGVEEVEGRALGAEEHRLELQLPLHGEVLVGQRVLPVVAQRLVEGVVLLAADLVGVAHPNRLLLVHQLPVVGHLLHLLGLALLGRRRLVRHLLNLALLGLAGRLRLLLVVGHLLLRGLLGPQRDGVGDELRVLLHQVLQPPLLQVLQLVLLQVQGHARASAQRLALHVAGDGEGAAGLRLPQVLLVVVVLGHHRHAVGDEVGGVEAHAKLADHGDVGAGGQRLHEGLGAGAGDGAQVVHQVGLGHADAGVGDGQGAVGLVGDDVDVQLRVGLQHRLVGQGLVPDLVQGIGGVGDQFAKEDLLVGVEGVDDQGEQLVDLGLCGAGGGKGGQHAGSRRGREKGSGAGPRAHMHSSALTEGICLSFCGHDVALVGGSG

SEQ ID NO: 15083 - protein, 363 aa, Chlorella protothecoides
MAVETVKPMLDLVKSALDASKELEAHPSGPTEPALQALEALQARRVTAAQLASSQAGKLLRPLLKHASPAVSQAAASVIAAWKECVRREAEEGRGGSGDAPSEQPSSTARHPSAAAAGVPVKVEGAQRPAGAGAAAAAPPSLKRTAPGVGTCEPPGSTPASSRPAPKRPAVAATGGGGGSTATPAPVPSTGDKVRDLCRTTFAAALCLAVEELRAAPSPDEEACATPGALAVAMEEELRRQHGGVTEGYKAKFRSLSFNLKDRKNPDLRRKVLTGRIAPDLLVTLAPEALASDAQREENARIREKKLFDSAPSAAKQPTTDQFQCGKCRQRKTTYYQMQTRSADEPMTTFVTCLNCNNRWKFC

SEQ ID NO: 15084 - protein, 275 aa, Chlorella protothecoides
  MOD_RES (265)..(268): Any amino acid
MESPLLGPSGAPNVILRIVNIEYYLAPPIPEVDACWSSLEGSPVTHVPVVRIYGSTPQGQKACLHVHQVGMEPAEGEDVATASNLPQDADGGGEQGLRLSNGPCHDAAHLARRQVAPGTVPWACPSTDLPLPTRPGPAAGTQLRRLGMALEAVLSMSTAQAMAGGQAVTGDQGSAKRRQHIFDLTLVAAKAFYGYHAQDRAWVKISLYNPQDVRRAATLLQVGWCSVHLQQPSCMQVERSGAGPCGPQAPLIPLSADRRRPGQSXXXXTIGIPVC

SEQ ID NO: 15085 - protein, 167 aa, Chlorella protothecoides
MRVGLFTARQVPAGEELVYNYNFQQFQGGTERGEYACRCGAPNCKGSMDLRALARDPGARESGAAGERGGAEGEMQSPAGRRAGAKEAAAARQAEARAQPPEGAAVVSESQGERAWRPPGSRQSATSARWRRGGRSRDLLRPAGGRTLARGARHAGRGVAALGSEAL

SEQ ID NO: 15086 - protein, 427 aa, Chlorella protothecoides
PDEKLVGELRDRLLALLPSLDRGVAAGPEVAARVESLAAQLGAAGGPVILSRAGGYGSAGGYGASPSDSTLQQLGGRWRLVYSSAFAKAGRLTLPLPLPANVGQIYQDIFTDTNELDNVLELLSPISLASVVPGQGEGVLLAVAGSRGYPDWMVSVPCSPFLPPFHMSRVPYSPRSQPWHMIPRRPHKQAQACLEAGPRPRLPSFLLCLDELRFAVPCNPHTPEIPNPPPLMQGSASFEILYLKDDLRISRRVRAPVVTLMPPHPLCTTPCAWHVVSPNELIGATEMQCRRRLQQGPHAHTVKKTATPAAQGPGAAGSRSEGISATAWKGKARLTLEFFGSDSGGKGYGEEAQGSSVSGAGHQGDWKARTWPAAGGWGCPQANRSTRTETTRPPMDALFILSTARSASSLTGKRTMPKPLRWAAGTR

SEQ ID NO: 15087 - protein, 479 aa, Chlorella protothecoides
MERPQSVEGDRQEPSGSPEIAPEVPESPTSQQPGEGGTDPERTMPAQERHRGTVKWFNSSKGRFRGPGGRIKTGSCAKDLYPCRSEPDPHTGFGFITLDGSEEEIFVHQVGVPILTLMRGDGGGRGDAPGGCLLGVQTGQGSQGKAGRSDMSDDRLPRPRPSPAPTPSPLRAPFPLPLPLQSNIEAEGFRSLREGEEVEFELAEGEDGKKKAFQVTGPEGAPPQVGRVRRLLRAGCPALGTVAARAATSPRRSAHPPPRRPRPVPQGTTPSMRIMYGGPRGVGPRPLYDPYNPAAVGSMPGPAGGFVPGGYMSPVGDIIPGGRGRGLGPPIPGGAPPGPPGSTPGYSWPPNAYMGYYMPPPGAPPGYYPPGAQGSYYPRGRGGFFPGGRNWAGARPPPPGQPGFSSGLQVVVHNLPWDCTWQQLRDAFQECGEIERADVVFDSRGRSRWGLRGVEREDGCSGQLQYEDAWGGCRQFVVL

SEQ ID NO: 15088 - protein, 73 aa, Chlorella protothecoides
MSSAKLPVVSTFTREVFPAFCSPTRESSISLVKKRLGGGMGEARGEGRGGISGGQGCVTLEPHQAVIGAWRTL

SEQ ID NO: 15089 - protein, 137 aa, Chlorella protothecoides
MASGTPVVAVEAGGIPDILCKPGVTGFLYRSGDVAAAVAAVQKLVANDQLRCGPCGPRVGNVRCPQRGGQGGANCDGEEMRAQVAAAAREEVGLWDWRAATQYLLQYQYPMAIAAAAAAGLGRKQAALAAGPTPALA

SEQ ID NO: 15090 - protein, 560 aa, Chlorella protothecoides
  MOD_RES (414)..(417): Any amino acid
  MOD_RES (526)..(529): Any amino acid
MKAQIDITGRLIGAVVHLARQRAPRVVTSHPRSPSSRPIHSRTQILLFAAQSPLSSTESTSSVPMGKRAASVEHSTQSNYEAVTVTHADLGALAKGKAVVSRLIRSLHEAKPRGLYALSDAPCPAHATDLVVDFSAKTISGTAQAIPLGSKRVPAYSPSHPMSIPVQLKYEVKRSGCDALILDTRDLAIQEVSVDGAACQFTLASPHKVGGASGGTGPFYTHWIGRQPSASSENLPATVCWTPSLRTPSPPASSENLPALSAGHPSLSTPSVPPAFNSPWHPAHPPPTQALGSALSIPLPAGAGAGSQGSARVRFATSPASTALQWLSPAQTAGGKHPYLFTQCQAIHARSLVPCQDTPGAKLTYAARVRVPEVMTALMSAVPVDEAGRTGQESGDGTRMFSFAQQVPIPSYLXXXXADERRARGRARAHGPGKRGRHAHVQLRTASAHPQLPPGAGGGAAGKQGAGPRVARLLRAQHGGCRGVRVLGDRRLPAGRRLGGGALRLGAVRSPPPAPLFSLWYGCWGXXXXGALRLGAVRSAPPAPLFPLRYGCWGYLCMPS

SEQ ID NO: 15091 - protein, 230 aa, Chlorella protothecoides
MLRALTFLPLEEIDALLAPGQPPAAAQRALAAEVTRFVHGEEGLRDALAATRALAPGSSEGSVDLQTLEAAVAGGAPKFAVDREAALGGPLIDLLVRVGAQPSKGAARRLVQVRSMGGGFWCGVDAAVGGGVDAAMWGRGRARGGLIPTARLWRWGQGRAQGGLIPTARFWRFGWRGLRTLRCSRTHCTRPVQCACRSPAARQHPPGAPTPLPLWTAGQGPTREQQGCHG

SEQ ID NO: 15092 - protein, 526 aa, Chlorella protothecoides
  MOD_RES (70)..(73): Any amino acid
  MOD_RES (231)..(234): Any amino acid
MRDAQRSGGNFIPGPTACSRIFLAWRARNDTVGRIATGTSADCNGHCFDRISYACLCSDMCCLYLNWALXXXXRIATGTSADCAEHCFDRWPRLEGLRLGDGGAAPSQAAGSGAASLHERSPQVGERRGGQTKGTHHPCCRAAPRAWECAGRSRSPQWLYWWRQHEAHAPHMLYRGLEGGGKRAFQEGTPGRGCGQLHRQPQAEAHASRLCQSSCCISEEEGVGPSRGRLXXXXPTPAAFANRAAVYLKTREWGRAEADCSACLELDAGFVKAYHRRATAREALGDMHGAAADFEQVFCHDPSSTQAVESRARCLRAFLDSQPSNGAPSPGSQGPSGPLRVSVSLEGCEPGPSPGVSLLLEQEAGGSAAALGLEGRGAEMVPLSTSYKPAGGMQQVEARLSPGSGSPPALDDELPGSHAPPGPDSVETATGLPRSLVTVVDDDRGVRNGTAAQEGGTQADGQEEQGRRVITTAEKLLREGAAGPEAASSCPAPGLQNETRDPSTVEKQSLGALPSYQGRVPSSGMG

SEQ ID NO: 15093 - protein, 253 aa, Chlorella protothecoides
  MOD_RES (242)..(245): Any amino acid
MHASSLAHAGSPAPPCHAPGRQPCQTPPHATRRMMLLLPCPLLLARTPMAWAFGPEQATQGRPAPSGTSITATPTITTDGGSWPRFTGRAYYFSYPPTLQARVLPAPVRPRPGQTASSGVIKASFFRPDTKQQLVVLERATSEIKQSLLQPTTMDELGSPADTARLLLPRNTLLSRAWSQTYEQPAPATPGLPLIGALLKREPLVIHRHEARLTDGTRLSSASGIMSGLVISLIASGSDGNXXXXLRLASCRG

SEQ ID NO: 15094 - protein, 479 aa, Chlorella protothecoides
  MOD_RES (308)..(311): Any amino acid
MPVDIRHGRHAWRLKYPSTYAWRLQGIYWDKDRQSSVDRVMPGAFTMQTHGMCGASPQSLPCVPLAKPFVAHTSVHRGASGRRPGSPRAHRPRRGARPQCSAHSPTLAPDATPQPSPTTPGPTGQDWELDFCSRPMLDERGKRVWELLICEPGPGGWRHVQVFPNNKINSGELGRVLQALLTAPGARKPERARFFRGQMQTIISRALADQDIVPLPSRRCYTLYDWLAQRAKEVYPAHPRFSPLKAGTRLRSDWGPVAELPPALRGEAWSFVQLPMDVLLKACGLSFCGSPLWLCGCGWGGVGEQHWXXXXNLSEQQKVGAPSGYFRPENSIGIGCPPQFDAMGELVAQVPSRHDHPFTTLTRSGVRGRGRGARLWQPRAGAGGHGAGHARPRRGGVQPPGGAPGSLDRGPGAVRRGGRHRARGTGAASRGEPTVAVRAVWPERGDQRRSRGLAGRQGGRGVSAGGSAGAAERLCRRLA

SEQ ID NO: 15095 - protein, 174 aa, Chlorella protothecoides
MNPMPPEMWLLPYSKWTGIGWAHPGRFWCHCRMVRAEACARAGVCTGMRVELAAGTSLGPDQPCTGAACGAIGTRWACTSQRIQKSTLLELSINPCAMSMPLAGLPADELSVWQACHREAHPPGHVPEGRAVPRPLCQHRLECSQVIAVLMFWIILVSDGRDRGLVRVSWLNFG

SEQ ID NO: 15096 - protein, 319 aa, Chlorella protothecoides
MLRRNQVAAEDLYYPHPLIQDVLWWTLYKAERESSKRGHGLRYVTWITEEKCWGVLLVTSSSTLFSCPSPQCATPHTTQPCISTMGQRTQTGASSPHPSCCTQLLAAQPQHPTAPDPRMRTPDTLTLDRSTRSSIWCAAGLRTRTARSSSSICRASALTRTAPSRQAAAGVRLKCCQCLMSAKSGDLGEVNKQCYRFAISVHPHPSQHKLPPIRLYDYLWVAEDGMKMQGYNGSQLWDTAFAVQAVASTGLAGEAGACLQAAARFIDANQVAQEAQQPLEEYYRHISRGAWPFSTGDHGWPISDCRWDGKRVGGLRLGG

SEQ ID NO: 15097 - protein, 144 aa, Chlorella protothecoides
MALSMYVGNAMKDLVCGPRPIGLVHRDSTIRFLGKGHEEAEQNAKVGLQGQLVVVHSTGSCRDGTLHPAILLLGVLHHHQHSLSTAHMPASLAMPMTPMRSHPCVQEYGLPSSHVMNSVCFNFFTVHYLLENDVVGPETAGVPP

SEQ ID NO: 15098 - protein, 309 aa, Chlorella protothecoides
  MOD_RES (96)..(99): Any amino acid
  MOD_RES (156)..(159): Any amino acid
MATFLDLCRMGSQVLDARKIAMHDMQGRAAHTMQPAGGTPARSRAALHHFIGCGFVYVSLQYHGSVHQMIPMQFVEIHGAEIVQFSPDPQQWRAVXXXXQDQDSAPRFSEIVQFPPDPQQWRAVAVAPAEGPAVMPVVSVNRDRLFEALGQVYSDXXXXGCGVPQGCADTGLRTYTASLLPAADEEFDKLCFEYGIELDDVGFSSQRGLSSGHPPLPRPQTSEKEMLRKEQAIKADSAALAEASEEVIYKIDIPANRYDMLCLEGIARALNIFRERLPAPTYTLANNGVLHLHVVCCSGAALKSAGLGS

SEQ ID NO: 15099 - protein, 511 aa, Chlorella protothecoides
MPQSHSSLLLPPRSLCHVLRVLRRTLRDRAGGGGGRLWKVHRCMAGGQAGCVGMGCRARRMRYALFERTPLLVLKEEVSPGHDQAVLGAHRAWQHPDAWNTRARCPPPSSSHPPLPHPLSVTPDVSPREMQVELAYIRSTTGLTLDAEQASAYLRRMQLEVRALPGGQALGIRVPVTRSDILHREHGDWLSLESSEQEGNVVPVRASHLPHGPPSASLPSWPACDVVEDVAIAHGYNNLRITQPSDATTGRELPLNALCELLRGDVAAAGWTEILTWALCSREENFGALRRGDGAGGAVTIGNPATAEFEVVRTSLLPGALKTIGGLGSGFGPGGWVERGRMGGGRHVCTWQSADGSVCTCRDLWSIRITPRLSPLLPLYLRSLVAGANRDAPLPIKLFEVSDVVLPSDSAACGAVNRRRLVAVHCDKTSGFEVTHGLLNRVMESLRVPLVARLGGEEGERARAAYGGGYEWKAEDDATFFPGRCAAGEAWHCGLWEARGFKSGYGRRGGR

SEQ ID NO: 15100 - protein, 326 aa, Chlorella protothecoides
  MOD_RES (104)..(107): Any amino acid
  MOD_RES (256)..(259): Any amino acid
MATIRAPKPHTRTQDNGLALKNEWKGFYILLNPPFHSQMQWRFVNRAIDAVERGEVSSSLHEGPSQFLEGYVLPDGKGVEGGGTPAAVPALSEVLEPCEREGLXXXXTPAAVPALSGALEPCEREGFLRGPTHRRRHMRPTRSKVPGVLLVCRNSTDANYFQRLRPYPRVLLGRKCALFKDYDKSGALHLLPRCPLQLQLPSSFPRPNGFGIAAVMLAKRERTDLYLRFYDAFEVGQSARELGLPCSEGGFGTMFXXXXEVGQSARELELPCSEGGFWYHVRLKECIQHAAADLQCSLSPLRDPTAEVWGALHPHRPYIPAFRGVL

SEQ ID NO: 15101 - protein, 347 aa, Chlorella protothecoides
  MOD_RES (188)..(191): Any amino acid
MGGGPLKASARLGAVQPGAPCVLSRRQPSHRPFLEGPRVLEHIVDVVLYMEGGRQSPVRLVGSWRTDGGVGGGVSGRTLALTTPPCVGWTCRPEIRGVKNRYGATEEVGVFQMFDDGMQVVADPSSLFLTSRRAGCGAGCGVGLLEQSRCRGHCATPGAPHRPSPCVHTHGLTPPVPPAPPASLQGDXXXXQPFPCVHTHRLTPPALPAPPASLQGDLPRRQLRRHRDHGGLPPHAHGGPGPLYQGLPGGHRFERGGGGGCLGAWSGAGQAGQSFLSCPVAPHHSPSSHSPSHHPHGPTGPRPASHPSPFRGQAGAHAAHPGRVEQAHRHEALHARHPPERNRRCGS

SEQ ID NO: 15102 - protein, 139 aa, Chlorella protothecoides
MPALTTGITGPLVLSTSYSLNDPPPHPRKKTPLHPHEGLIMAEPATDLAVALAIASSYYDRAIPRELALIGEVGLGGELRQVPQTERRLAEAAKLGFTRAVVPPGGSAGSGRQLAKMQVQECRTLAAAISAVLGGGLAK

SEQ ID NO: 15103 - protein, 439 aa, Chlorella protothecoides
  MOD_RES (116)..(119): Any amino acid
  MOD_RES (392)..(395): Any amino acid
MSAMERQVLPVPGCGCVGGTQLSILSCVTAAEATPSKATHASAHAAPVIGIGLIGGWSRYRASSLATRLRPRARLEHRGVTNGFASHSNCHAEFGRRVRFRGTCSLLDVVVPRDAXXXXSTLIQEHALKGANFAFRHEHRGVTNGFASHSNCHAKFGRRVRFRGPGPKRAALVTAGRGQHGRFPGQALHGASQHTPCRTGNVFGVLHRCTCELGACAGVALFAAAMPGRFLGTEVRPRKFKCVAGWSGCHVIDGQWASREYIISCCNEAAQRRDVLRGQAPRAWVPVLAAEVPLFAPRLVDTGAHGPQPSALLGMEMVSGSASPSGSTLRTSPVLCAGLPTPLNPLISVNSLQISPVAAVVKDFSHSVCSLGGGMSTSRPAPPQYASDAAMXXXXCGLLGVRVRWMGGAQRISHTQFVHLAVGCRPRGQHFLGTPVMQQ

SEQ ID NO: 15104 - protein, 311 aa, Chlorella protothecoides
MADGLIFLQSLTLPSPPPPHPHPAAARLPLHPPDTVMASATGCATRLGPRVAEETLASLQRRFVTAQTLATPRLGAPVLTLDLGRLPAAGADLSPGGESGSEGEESEDGFTLHSQPAYERSLSQAHCAPGPPSCRTPSDEGGSTRFSFGCTQDAPMPLSAPGQGPAPEAAAGNTPLLDLAAPIGCVSDSTQKLFPIFKPKKDYKHLYIVRHGESEYNAATAAAGTGWDDPLIFDAPLTARGRAQACELRNTLAALGLPADACWVTSPLQRAIETLVLACTGKERGGGGEVRLPASLHIRRWVRGPSGARVY

SEQ ID NO: 15105 - protein, 114 aa, Chlorella protothecoides
MQLLVPALWRVLQYFHRAAALTLVTSGVMKGVLERAAVAPPAAIQVWKKGVCCDTFNPRFASEEARRKMLGSHGEGPLLLCVGRLGVEKNLTFLKVGSHVEGQGRGWGEGDERW

SEQ ID NO: 15106 - protein, 116 aa, Chlorella protothecoides
MPGVEFERAWRGSKRDPAAQAALLCAIPPARLPHLLTHVLTPELLAEVAMRVLESVARRQPSLALDLLRALRSVPRFPMLAMGLAPRQCAALRNALDGCGGLPGAEPELLKAFGLQ

SEQ ID NO: 15107 - protein, 298 aa, Chlorella protothecoides
MQGLTGSVPSFQAASRLTHLDLQHNRLEGPLPALPPSLLSLSLQGNMLSGSIGEGWVAGLPALQSLDLGANSLTGGLPEGLAAAPHLRKLRLARNVLSGPLPGAWRAWRLAALDVSGNRLAGELPMGLARLPALRSLALASNRGLCGDVARFLSAALAARSPLRALDASWTGVGCGEEGLPPSLAALAMFRGGEAAQGLAVVGGDPADAADAFDATDAEAPASPPGRLSLRGTRVRGPFPVWVLSALARAGEGQGVQIDLAATRCVLGSRTEDAGRALCASVHGGRGRLPALHQARAE

SEQ ID NO: 15108 - protein, 211 aa, Chlorella protothecoides
MPPSLLSCPHRTIRRVGGSRSCAGGLPRRTPSSQALPAGMGEDDCIRDAHFRSRAHEVPRDAVWEGGQRRPVALMSGTDRGRRHLVRGCCQAPPSFQPLERLPCTAQESGSYPPGTRLWVSGKWPGVAWSLSLCNKGVAAALVLSRPAATTTVLVRYYGEHTTAWVTAGRCQPFASCEDEERAQHAALAAWCQKTGRRVSSWTWLGAMHLS

SEQ ID NO: 15109 - protein, 280 aa, Chlorella protothecoides
MTRHRPLTSLRAVGVGAQGLQVRDGGSTPSPGPTDAAAERRSSLLSVLRSRGLLADVAGGAEGLTAAAAAGPLRVYCGFDPTAQSLHLGNLLCLMVLAWFQRCGHQAVALMGGATGRIGDPSGGRLRALEGGFPGAPAGMELGACFCDAQATVGSGDPPHRAPPTPLLVRRQGGSLGCLLACGSERAFAMLRPPWARAARPTPHRPTPSPCAGKSSERPVLDEAEVAANAASIARNVEALLQRVPGSTGEAPLVLDNYEWWSGMGLLDFLRDVGEAHGGW

SEQ ID NO: 15110 - protein, 236 aa, Chlorella protothecoides
MAEPAPWSELARGQPGGSVETVIGPAGTPCAARGFVGHHRRCLCELAPQPCSALPPPLPRSATAGAARQCRRQPGPPAGSPGWAAGPDRAQAVPGRQHPGRPGPAAGAAIPHPPRRRAGGAGRFRPRMPGPARPGVPGCVLLARAAPPPRRVPGLPAPTALPPLAHPARLRAGAGAGGGARPAPAPAALRRQPHARRRLHPRRAVPCHAAHAGLQQPGAVPALQGRTRGRRRFRLG

SEQ ID NO: 15111 - protein, 201 aa, Chlorella protothecoides
MPRNPSLALHPAGDAHRYTYHAESPGSQDILITVASPKADITVLSALGTPLVASGVLGDNQFMLSRAAQESDPGPYELIVRGVVPETQYTVSTTVHERRRCLAGRDRSALQSVLEGPGCCSAPGSCARLRAALSADPAQDMCDQPGSLCDDAGQLVKLDLSDQAGAGGFGKTVWELYAGLTAAAADVANWKSQCSRLPPLL

SEQ ID NO: 15112 - protein, 211 aa, Chlorella protothecoides
MWKFRPSTDFDGLGRSSPLLRSVNKHCGRQVWCWEENAGTPDEREAVEKARQVFTENRQHQKHAADELLRRSRGPFPVDKRGLSGSGAPASAATVEASLRNGISFFESLQCDDGHWPGDYGGPMFLMPGMLIGLYVTSALDSVLRWGGSGTAGLGVCGGAEGAGWLGAAPEVCGPSSGSPTVARVASSSLCSIEILGPRHPRAVRSTRLRW

SEQ ID NO: 15113 - protein, 344 aa, Chlorella protothecoides
MRSAEGLKAALTLTSLGRELGGPPLPAERLHDCVNVLLSYQNPDGGWATYENQRSYPILEVWGWLGAVDRNDECCFREHEPLSRQHLATPTPHTPPCQLINPSETFGDIVIDYNYVECSSACITALLSFAAQHPEHRTNEIEMSVHRGVRYIKRYAWAPIALLCGAQDGVASDGVAGVGPWGCHGVQVGRWTAHQPPPPAHAPNSHPSPPLAHSIQRPDGSWYGNWAVSFTYGTWFGAVALAAAGEDVHGSACLRRACAFLLSKQRQDGGWGESYLSSQTKEYHQSEGEASHVVNTGWALLALLAAKYHEIDAAPCHAAARCLILAQARVSEVKREWEVHAPAE

SEQ ID NO: 15114 - protein, 156 aa, Chlorella protothecoides
MQPALVSWTDDLHAGRHARVGTMLAKDSVRTRLESETGISFTEFSYQLLQGQDFVHLRKTHGVRVGGSDQWGNITAGTELIRKTMDADAFGLTVPLLLKSDGTKFGKSEGGAVRVRGGVGGSGAGGLKSFVMDPYGLSSLPWGLQRNPERGRKSGP

SEQ ID NO: 15115 - protein, 143 aa, Chlorella protothecoides
MELSLVGLQNAGKTSLVNVLTTGSFAEDMVPTVGFNMRKVTRGGITIKLWDLGGQTRFRSMWERYCRGVQAIVFVVDSGDVDGLEAARVELHELLGRPSLAGIPLLVLGNKNDLPEALSAAELTAKLELEEGERNLAARLQGS

SEQ ID NO: 15116 - protein, 73 aa, Chlorella protothecoides
MVRYLNNHSNPDGGFGLHIEGPSTMFGTVFSYVSLRLLGVSPDDATAAAARAWVSAPGQGIDVRSLWVGKSPG

SEQ ID NO: 15117 - protein, 225 aa, Chlorella protothecoides
LHQAASSLRLGLNSAAINGAVNLLIHPSTTAMLQKAGMLAADGRCKTLSPDADGYARSDAAGMALVTVPEAATGVSGRLVAVPLALIRGTAVNQDGRSSTLTAPNGPAQQEVMRGALRWALAAAAEVTALQMHGTGTPLGDPIEIGAAAAALVEGRAEGNPLLLQAAKSWTGHAEPAAGMVGLMHTHAALSARAALPIMHLGNVNAYVEGEMLCCGCGCGAIVRT

SEQ ID NO: 15118 - protein, 102 aa, Chlorella protothecoides
MQRLAARFQFLRGIYRAHSLSGEGSRMGRGRHATQCVPQVESRGWSPTQEDEVVFPALEGKKVLRNVSHAYTLDHEQEEMQFQTCSEVRDGWGSEVELSLTL

SEQ ID NO: 15119 - protein, 183 aa, Chlorella protothecoides
MVRLLAAPGSADVMRSSQVDASRLDEELSLMLREQFLGAFSLFPRGTVTAHLPEIQLALDALIFYLSVWKDAPLPGMALMNLRFRDERAVPHSASGVGGPGLARSQKAMYGLGAVLLRYAWARTGHAAASGGSDGDGGWRATAWQVMRRAETAYRLAALVNAIAFLRAGKYRYRVCGTSLWLG

SEQ ID NO: 15120 - protein, 146 aa, Chlorella protothecoides
MFEAEGVILDPALLALAQAQQRAQGRSGRAKTLIFSEDRGRYIKPMLPKGDKVRRLAVDATLRSAAPYQLSRRARAKAAAAPGAAIRPVFVERTDMRAKRMARKAGALLVFVVDASGSMALNRMAAAKVRVGVGDLGGGRRPWEVV

SEQ ID NO: 15121 - protein, 64 aa, Chlorella protothecoides
MARRVLVSNLQMLLIDTENKFVSTGFAEEIAKAAGAKYYYLPNASDKSIAAATTSAMNEAKISP

SEQ ID NO: 15122 - protein, 141 aa, Chlorella protothecoides
MRLLSESYASRDQVCLIPFYGDQAQVLLPPSKSIAMAKRRLDSLPCGGGSPLAHGAALGGMSLAVRTALQARQRGEVGRVMLVLITDGRANIGLARSNEEPDAMGPDAVKPTTVGSGLTWEARYLGAHIVGLRVRQLTFIC

SEQ ID NO: 15123 - protein, 163 aa, Chlorella protothecoides
MALDACKGMLYLHSHAPPIVHRDLKSPNLLVDRHWRVKISDFNLSKLLDGSPVMSSLAATNPRWLAPEILAGHAATFASDVYAFGIVLWEMLTWELPWPTSNPWQVVTVVTEGGRLAVPDRAALPGPDTQDWDGLDAYVDLIRACWAQNPNDRPTFSEVIPVL

SEQ ID NO: 15124 - protein, 316 aa, Chlorella protothecoides
MPPDIAAARRKPPPMASHGVNPAHKAVKGCFFPLRPPWPVPFWRRASAICPECWRARPYPRHMAPHTSMNWPSFPAKCAPMRPWLASTSPLVSPGGLRAKMDCLSRVRVPFTCDMTPWLPAGTWLLLWPCFWSIALAAPAGSLPDVGLLISFGIGATVLRGAGCTINDLCDRDLDGSVERTRSRPLAAGDVSVAQAIGEAAEKMEGFVFAPCPGMRPRTCSPFCTIGRRAGPRISRQAHLPLATLLPASAFLALQTAVGVGWMASLNPSALQLGLSSLGLVAAYPLMKRITDWPQVSEGSVSLWKLGALGSAVPDS

SEQ ID NO: 15125 - protein, 187 aa, Chlorella protothecoides
MMGWAAVHGDCDWNVVGPLYVAGIFWTLVYDTIYANQWHPAVSAPALPSMPLASGLCPLPHDAASLLQPSWPASTHTPTLPPPRLQDKEDDREIGVRSSALALGSANRAAMSAFAAASVAGLAATGVMAGCSGPYFGGVAAAGAHLAWQLGTVDLGDRADCGDKFRSNTWVGAAVFAGIVLDRLAIF

SEQ ID NO: 15126 - protein, 157 aa, Chlorella protothecoides
MAFNWGALLGWAAIHGACDWSVVLPLYGAGILWTLVYDTIYAHQSPDPRTPLTPPHQDQEDDAKIGIRSTALTLGRHSRAAMWSFAAGTVGLLGFTGFQAGCGLPYFLGVASAGGHLAWQLGTVNLDDRADCGAKFDSNKWVGAAVFAGTVADRVLG

SEQ ID NO: 15127 - protein, 299 aa, Chlorella protothecoides
MRRRAGCLLRPVVRLLSAKPSLQTETLALPAVHDRSWTWEPPAWAPSRTPREGLTPFLALPFGVGALPITGSAWQPDHAAKESGAKADCRSWETGSATPSQEPSGEEHRTRQGPAGPGEATAVTPPQPAATWVDRAPPSLQPYLHLIRIDKPIGTWLLAWPCFWSIALAAPPGAAPDLRMLALFGTGAVLLRGAGCTINDLWDRDLDGQVARTRRRPLAAGLLTPRQAVAFLGLQLSAGLAILLQLNTYSQVLGASSLSLVVVYPLMKRVFGWPQVGTFMGCALHERLMAACEWRAGGA

SEQ ID NO: 15128 - protein, 205 aa, Chlorella protothecoides
MQHMWREYLAQRAASGRPAQDQHGGRPDPGSNMGSARMMGGMPAGEAAALAAAAKHGAGVDPAATGQNPSKRRGKGELERRGARAPENLARSLAVRVTRGSFDVAEAGPGSLEAAGGDEDEDAVPPGTESERQPRASGEGAVSGVALADLPGFPPGARGRVDFLVLEEHDERLVWERAPGSVIMYDPDVALTRQLELYNAMQTRC

SEQ ID NO: 15129 - protein, 204 aa, Chlorella protothecoides
MPLCHHPHPGGGLPGRAAGGPGPGGPADPQRPPRQRRLRRGLRRAALPRHQPRRQRARVDRRGAGPGRRLQPRGEGAQGPLCAPRPPLAQVPVPGQGRPGDGAARGEGRGHLGGLEGWDDGCGTHTARVHEGLTVGMAAMYDALAQLMDACVKEVRKSNKIDATDLTLEQVRGSFLSSLLVGTRWLPRLPGSLGCGFRRRTGAS

SEQ ID NO: 15130 - protein, 474 aa, Chlorella protothecoides
MLHFTFLTAVPGRVVCDRHFSSTRQTQAAARARHTETLSPHDPLPITRPPRSAKEPCLPAITRERASPEAYAEELARRGTALAFETVGRLPSPLPDTPLPCPQGMCRAVADNLQTQLETLTAGLHAVNPDSAAAARLSLPQEQGSGAGRPKRFGLGSLSHDAQPHEHTQGPPSPILDPPTPTFALEIAPSSIQHASAGRGVWLRGHAATGQPPMRWSRRQVRPEAATLQCKYPSQPWSPQIVALYPGVAYRPLHHRAIPGYPMVGRDNEFLLSRFDGVALDGKPWGLGAALERRWPPLPPHNLAEEALGCLEARPGSNPRPDLSALWLLPTIPLSNCHRRTLPHIRAGWEQPRGRAPGEASLATTILRGWNGRALPQKGQVPGHSFTESINLPFFMLTSLAGSQSYLRAYIPNIEYTSRPALQTLGSVPGLALVALRDIAEEELFLNYRLNPNLPNLPEWYTAVDADEDARRWN

SEQ ID NO: 15131 - protein, 218 aa, Chlorella protothecoides
MNRTDTLHEFPQLALRLVMPLDDWELCAMSARDHREMGPGGTACEARDQGTQPDGSEAPPLHIARLESPSHPPLLLVQSGLGAVRGMRSRHRGHRSIHSTQQTSGMASEADVEEEDVSATAENVSDEILMWEEDALQRLWDEIPLHGYLGGGQSGCMRQHLAPHSRTPACACSGAGCLTGAQQACPPCLHPAMTSPDVLHSRASRPGVRETSPPVPRV

SEQ ID NO: 15132 - protein, 470 aa, Chlorella protothecoides
MPPGSSFQRKGTVAVSGEHGWRPGSTHPSRSAWSDSHIKRLGRCGCHLWRWLPPRLLDPVARRWLHPPTSLTGAILPCRRRRQWTGGHGWAPGIWVGYAAPEIPPHDCRNMINPITTQRVLLGHGEQGPAPSLATWLPAQLQTKDKASPPHAGPTPDHSPASPRPLQEPPGVEAEGDAGLRIAWQYRRYITKAQQQQEGIGTAVGRGSGLGPSSSGAIATAGRAAPPSKPRPWATAFDLRKAAGAEALDAHRHRVVSLCCEEGTAPGTHEPVDPARALLREAGSFVADLRDASAAPAPGGPTGAGPAPPGGECSASGLATPTPSGAPLALPAPSTPTAPRAPLPPRSAEAVGRLVFTGLAGGSWPEGAEAGLAPLLSGIRARVRAAAAVALVTLSPAGLAPAVLAQAQHAADAVLALETVASDAELVRMVPDPGSIAGLLCVRRLPLGSALQPPVPDAPLHLIRSVLWVG

SEQ ID NO: 15133 - protein, 841 aa, Chlorella protothecoides
  MOD_RES (575)..(589): Any amino acid
MEDWGRYRSLCSRRVEHCLWRRICESDVTICDSRGSLNSQLRILDILSLIEGQVKDCTMFRTRVSDMEASCDSFWEILDHHLGSGGRCPPPGWSSSPNIPARGVEGQWRPGQHMDDRNYRQEYSALDEHKASAYNCVGTGISLSGIHRAMTSAEVATSEHDLAPKHELRLEVGWENSVTLTVGPGLHTGKIAAAIDLAIGHAIVRNTRPVIASLRCTTYAAQTRGGRGVWDGAGQPDILLSDVAGVSAGQVLLWAVNRYTSEDTPMQSYVNVHDVLEARRQQALTEQRRGPTTVRSACATCWASVPGIQIVGPTDAGKSTLCKILINYAIRCRWTPALVDLDIGMHSRGRVPSILAQVSSLAPHDSPLWSTGQGSITVPGCIAATSVEAPIDVEEGFPVDAPLVYYAGTVAGGENIALYQHLVERVADALERRAGTDAKVIRNPKSLSARAAPPHPSHAQVAASGMMVNTMGWIEGDGYSLLRHTIASLAADVVLVVGSDRLHSQLSSDLATSSPGVVWGAHACCTAVVTELGGNGFIDCFRFFGCMGSSHKVFEPSIHPACPLPTTPAPPPPPXXXXXXXXXXXXXXXSHFGGEACQVGRGGDADARAPPGSAQGGGGFKRSQRLRIRPLAALPSQPGIDASPPAKPPATPRAGPGGGVLLRAHPLSGPRVPDAEAGGGGGVPGGRRPQGPTLRPAHRRDLRGRPPEAGAGDQPPGAALHGAGGESCTRPGPPPLRLRGGVCVCPGCGPGQGQHERPGTAAGAPARLAAAGRELQGVPGLKRLPRHCGLYTREIGVGWERVVFGKGCKGCSRRQGGATGYYTRGLVPGDMQNGEAPVEGV

SEQ ID NO: 15134 - protein, 357 aa, Chlorella protothecoides
MLGTVTVPSPSRPFNRGWGNGEEEYYTTDNVAVQNGQLQITAKRETVNGFSYTSGRINSQGLVGFCPGVADSSGKTYSTLKLEVFLQTPAPGLSLVILGGGMSREGGGTAPDCGCQLACQRQPQACMAGLHNFQISAPCLSLPCYPPPTGQGQWPAFWLLPTTLTYGAWPMSGESPISVLANEWPSSVWVLEEIDVLESINAMTRATQGLHYGKGSSGAIKNTFYTKSDADKSWSSAFNTFAVTWTSTSITCEQGDSSVDILEEAWHQPASSAPSSFKGYMLAKIPYHPILCFAVSINGNDIRTLQSSSVSGDGWFTSASNKTPNAPFDVPFYMILWVPRSGGEGGPETLIWALVLL

SEQ ID NO: 15135 - protein, 572 aa, Chlorella protothecoides
MPAHQLPLPTSYCQKLESRLSPSNSSHHSAVQPGRQEAHESEQGLPPHPPDGTVKGTSPEGVGTTFEEDPGGGGKPGEGDGLGEPLPGGGGLYFFPGGNGGSGGGENAGGLGGPGLVEAELVFVFRAIVTDSPTAAPTRRIAPRAHSASLNLMPSVNWEVAVSSCHVLSMQIFGGPDGGIEVTGSAPPCAIAVAASLVGRGGDLQASPPGSERPQVSQAGGSIRRITGFATHKVPMSMYLQVVIMKDARVSRRSLGRSSHTTPQSDTLGELALIQGGQPPACFHPRGVESLGSWNPIMAEKLGAFATDITDEEREKVELLRAEVKPFIKVCAGWVRVRSHRDQGMPELIPRLPPAPRRPRVPFRNRPRQTLPFAPRAPMRAEYKPYELRWSRVQHDVDKGKLYILKGTDNAGRPVILMRPRTPSSAHPAIALLTPGSLHLPPLRLETIQDNEARLRFLVYTLERAAQLGDSSRKFFGEDMGLLGWSPTRPWQMSFQPSAGCACILKEMHTLNMADTHPYCSRWEDDMASGPGRILSQELPTHSDGPSDPAHPAKSLPGASGPGRLLSDSVCI

SEQ ID NO: 15136 - protein, 281 aa, Chlorella protothecoides
MSLGRLVPWLDWAEWRTVGDQLFAAEDSERDLGVARVGAGELISVTMWSWRARWRPLLTAAHTHSPDALTAHPSPSPGRGMEGARAGPPGCRLHRQSRGDSAHVRCWMVCRSGKKHVQPLPYPLPGPPPPPFPAPPRAATRRRDARGQGSDAALRAQFCMVLVRLVNGVADSAQRGRVASSVASLAAAAGLPRGLVDLRHEAAHNELPSLAAARAGAGEALAWLRDFYWLRQADHLAAGRAQVLVLARSYLGLHLAAAAGAAAGARGEDGEDRGGTGAAAR

SEQ ID NO: 15137 - protein, 148 aa, Chlorella protothecoides
MAMGQTVVKWRTDPATSALRGVEVPDHLDVLARMACGAQAHLLLSAVAGGSDRPALEFWLHGSQGALHLDLTAGALTLSRPDVEGGAPQPVTLAHPGAWRVEEEFVGAIRGKERVRLTDFPTAARYMEFTTAVARSLRSGHSVGMPLV

SEQ ID NO: 15138 - protein, 399 aa, Chlorella protothecoides
MRLDAYLSKMLPGASRARLVSCIRSGLVGVNGAPPPKPSTPVRAGDVISCGLAPLPASRALPQDIPLDIVYEDAHLLVLNKAAGIVVHPSAGHADGTLVNALLHHCGVRGLELEPGHAAPTALLGGAAGAAEDAEDEDDDSDVEDEVASLLGDGGGALRGNGAGDTPGVSLQNHTSHQPGVIRPGIVHRLDKGTTGLLVVAKTEAARVGLVEQASGEVVMGTFRARTVQRLYLSVTLNTPHPARGRLETNVGRDCASRMRMATFAAASSRGRLAISTWAVERELAGGGAALTRWRLGTGRTHQIRVHARHLGCPLLGDEAYGGGAGASGAALGRGRRFLTERGAAVARALGRPALHAATLGFTHPATGEALAFQAALPRDFEELLARLEDPVWQEAARR

SEQ ID NO: 15139 - protein, 84 aa, Chlorella protothecoides
MLEESRRRPPQVAQIVPSPLTLRYDAAIQETIKSGVLGQLTYITVRGVSGWPEANGAPMTFRQDAELSGDNILFLGIMYEALAR

SEQ ID NO: 15140 - protein, 330 aa, Chlorella protothecoides
MASPNPLLVVELQGPDGSSAKIHAQGATLTSWITPDGVERLFVSSKAKYQAGSAIRGGVPICWPQFAMRGPLTQQHGFARTSTWTLASCETASVVFSLDETSAALPADWTAAFHLEMEVRLGHKTMTQELRVTNRGDSNLTFTTALHTYLAVRDIRAAGVRGLRALQYQDNTRPGQALTEEEEVVVIQAEFTCPLLQALSWTIPTPPAGSPCGPSGLLVHMLSRAVWPSKLPITLPTNPSPCQVDRLYVQAPDRLVLEDGADGRRTLTLAKQGFPDVVVWNPDGAKASGMADLSDWHGFLCIEVAHAARDPVVLKPGETWAGRQVLGAEG

SEQ ID NO: 15141 - protein, 218 aa, Chlorella protothecoides
MPFPCALWTSPGSVGTVVGGLLLDAIGASLRNALLVCATAVFLGSSIVMAGFAFVSNLPAFFITLTAGNLLLFIIGEGGVASDINNGGSQLPVNTVTLLFSDQAPSLGVLLWSCPPQMRPFVLSASEVAQHVLGDVPTPPLMGALQQWKGDWRLTMVASTGLIWVSTFLYVAGVFLVRRAPLQPKTVEGLDGSEGEDEQLAQGLLEVVDARLVGVLPV

SEQ ID NO: 15142 - protein, 154 aa, Chlorella protothecoides
MQEFEFGTVADAGVSQAELFEEVAPLVRSVADGHNVCIFAYGQTGSGKTHTVTGPAHDPGLAARAADALCALASAEGAERRALEVGMLEVYGDVVRDLLAGPDGAAGAALEVSGLGPGQVADCRARVPGLGWRPVAGREDVLALLREGCTARAT

SEQ ID NO: 15143 - protein, 478 aa, Chlorella protothecoides
  MOD_RES (61)..(64): Any amino acid
  MOD_RES (431)..(434): Any amino acid
MHITLCVISGWMSKWHRHFHSKLESVVHSPLVCFGIQSARSAPIFNVARAQRHEKDCIHPXXXXSRLLHALHYAYIREGRCYRSLCVISGWLSKWHRRFHSNPESVVHSTLVCFGIQSARSAPILNVARAQRHEKNCIYPFVLLMVESPLGIRVVDAGRVNCVAPPWQNMLGGVLSTSEERVLSEVAGRVNRKQYSSYVLKQADQTVANKLAIRLALFAGLYPPPCLTCSESQDARGRRCQTPPDPSLAQLDDVDGTACYTALGLDKRCSQEDVKKARPHPNPQPDPHLSPQAYRRLARTLHPDKGGRPEAFSALQHAFEVLIDPKRRAVYDTWAAQLQYRSVRSVAQQAVRWVLGAAARTFYWMSLMRWGCTASRPPSWLSPARCAAGPPPSSAGRVACPSASSAPSSSTGRWGGSRDGVRWVHWWTQRXXXXQAALEGGVGAGMGPGWGMHSTPWVEHSLTFNPSSSVLSRTAGHP

SEQ ID NO: 15144 - protein, 151 aa, Chlorella protothecoides
MRNVEHEEVVRIVRRHAPAFAAGRGVGHRNPHRWAGVHPAGSVPAPTGPGCAGCAVQDLDPLQLVPKADQTLCSIANPPPSRQDLLVPKADQTLCSIASPPPPRQDLVGFFHPFADAGGGGERVLWWAGLCASQIAPSSCCGLAVSDDHQV

SEQ ID NO: 15145 - protein, 283 aa, Chlorella protothecoides
  MOD_RES (61)..(64): Any amino acid
MCVWRMFPSHRMQRTRERPPSQHASTVISSFNHLDHPAAKVHLLRLSLSLNPVRTAGHQAXXXXLGCVLCVYAYASFSPYPTHSRASPLAACIHSRQLFQSPRPPHGQASPSPPFPPHSTPCGLQVIRLESREELLPARYPRFTMLRQALASVRVAFAGLRRRVPAVWLDTTGWAFPYPLASLLGCRVAAYVHYPTVSSDMLARVAGREAAFNNDVGASTPATLAKVAYYGALAAAYSLCGLCAHTVMVNSSWTKRHISLLWLGHRDPFLVYPPCNTEALQVD

SEQ ID NO: 15146 - protein, 243 aa, Chlorella protothecoides
  MOD_RES (162)..(165): Any amino acid
MYGRGAVQGSRYLTGDTCVIPSPSHTLRSLLGPISLLVASFLPLPQCIPPIHLPSSHHTPSSHQELPLSRRLKRLYIVSVSQFRPEKQHALQLRAFARARRDAERLESDAGDAVLAARLELVGGCRNAEDAARIEELKGWCWVWMDETGRGKEWLNDGRGSXXXXGSRSSKVGAGFGWTRRARGEEWLNDGRGSEGGWRALKSSTRGMLAAGGSLYLAGGDRGLKDARLYQKSAVRLMQCASS

SEQ ID NO: 15147 - protein, 373 aa, Chlorella protothecoides
  MOD_RES (25)..(27): Any amino acid
  MOD_RES (303)..(306): Any amino acid
MIPTVPSPPLRSLAVHSPAPSRHPXXXGPKGRGEAGHLPGIATCGGGCTQDDPQGALSTAPFPGGPPPTTLPAPPRADCGGAEREHGAGILQGRHPVPGPAQGPHRNRKHHRVQRRGPRNPHRPPHHQGARAAQQHQRRRHPHQGVGRHGESEMLCHAGVTRAGGMKRASRCPPPFRRPNSPQIPTINPQGDNNWGDDRSLYPRGVRWLGRHHIMGRVIGYLPYIGQVTIIMNDYPIVKVLLIAALGLFVITSKEPFQDRGRFAQLAALSIHFITVGDPTGTERIEWDEYGSGNLGGRLIACXXXXVGDPTGTERIKWDEYGSGGAESVQGRQGLMRAFYMLSRRYIPRLSRLPGPTHRQGTLTPRAPGCAPP

SEQ ID NO: 15148 - protein, 96 aa, Chlorella protothecoides
  MOD_RES (49)..(54): Any amino acid
MKRLALPAIEVYIQALVGVVTQPPLRDATNTIGCGRGEEDAEEAAPATXXXXXXLLQAAPTHPHPAGLIITSALMIWKFLVLVTGSESPVRPRGQG

SEQ ID NO: 15149 - protein, 227 aa, Chlorella protothecoides
MKVAPEVPEAGEPGSEASLSPLALTAGTPFMLSVHASLLIYIARRLANPRNRGLVFEFSDSTVQGEGELKLLAKLQDQGGGRGAPTPGDTHVILGGDSDLYLIALVAPRPSVFIAADADIPHLGAPADQLTVFSRAALANVWGPHADVARLGLDLCLLAVLTSGNDYLPAIQASLGWVGGNQERVRLWTDQGSRPAARSAVTPTCLRIGAPPLHRHIHNPPQDRAWC

SEQ ID NO: 15150 - protein, 108 aa, Chlorella protothecoides
MGIPGFNSWVRKEYPEAFVPFERGRRVDHLYVDLASTLHTVLRKSRTPAQLHRRLHNRLDNYLARLRPCKRVVLALDGPGPLAKLLEQRSDRWDGVAWDQDCGVLVRP

SEQ ID NO: 15151 - protein, 875 aa, Chlorella protothecoides
  MOD_RES (80)..(83): Any amino acid
  MOD_RES (137)..(168): Any amino acid
  MOD_RES (379)..(382): Any amino acid
MHDLWNHGADLEAYDHHLFPGVVPRTFLGGWSGCLLLPESRDALPVTACCLNCCALQPQPLTHRRCHEYRGPGQPGPDRXXXXFLGGWSGCSLLPKSRDALPVTACCLNWCAPQPQPLTYRRCHEYCGPGQPGPDRXXXXXXXXXXXXXXXXXXXXXXXXXXXXXXXXQRLIELYDEGTLGVHTQSLVLWGVCCPLGCQLWSLKRPRMPGSAVCGIPAFHPVRAGCQVWAAGSSALLPAHNRAVSHTILRVPPPAQRLGVCADQLGPGRMAGLCLSGARHRALCGSSEGGPDPLELHTGLPLSDAPGKPSRHTAATAVAPVGAGVRRGLCWQDSTLPLGGHDRVSSPPECLCVKFMVLIKGCDPLHTRHRSSSGRMRRXXXXVYWQDPTLPREGTIESQALQSAFVSDAALLAAPIGSHLLLSKQVTFPRAVSLAAGAALASLALTVAVDSLMWRRLVWPEGEVFAFNTWHNKCARFGRGVCCRDQAWVWTGGHRIWHQCPVSSYLTPLAFLLPSSTLLHRSSEWGTQSWHWYCTSALPRALHGGFPLAALGATWDRRARPLLAVGLAFVGLYSFLPHKEVGRGKGAGGILGACMALPCTLGGCILGFLSLASPARTHTQPFPLPLPHAQARFLFPALPLFTACAAVALQRILHNAWHAKHGWRLAAAGTLGIFLAGAGVTALTTAVSRANYPGGVAIRRLHELGGGSKGAGAHPTRVHVGTLAAMTGVSRFTELPGGAWMYSKVDMQEGDPMACMGHSEGNEMEVHVGGGDINSQTIAHPDTRLMTLTDTIPRRRDCLPRRWQGEAGQAAPAHEAPPAHCIGSQGLDSEMHGSVTLTTYHEGIPSVFAPPIVPPIPKNDVGLTETDIGLPLGQE

SEQ ID NO: 15152 - protein, 300 aa, Chlorella protothecoides
SFIDRGELVPDALVLDALLNAVLNPEINDGAGLVIDGFPRTALQVDFVKLLHDRLLALSGRHADTAEAWRFPRPSFKVVILYVDEAESMRRQMRRAQIADLHNKRVADAGTGEVWDVRTTDINEQLCRRRYQVFKMHYQTILRLKQFFPFSLIDAMGTPEECRQQIMRELRYQSSLDLDAATYGAIRHLPLARDLVRVARQRLVFRLDSYAKRAAETFGAVISLIEAELIPLLKTCSLAGHAVYRSRSPVLLGDARAVDMMIDILSDRGFSVAHSEEERVVPLRVDLGSGEIESRAEIVH

SEQ ID NO: 15153 - protein, 181 aa, Chlorella protothecoides
MCIALRTPVWAAGSARFAQTHQPAAMCPGPQTPRLAPASPQLPRNPPLPPHAAAPQEAQKLKEAHDALAEQLAERALEDRVGRAVAETNRLASLADDFDRELAPGRGEEVERAKREAEALRARVGDLEAERADLERRLAAAERRAQEAERRAQEAERRAQDAAASAAVGVAAGAGVVAGTG

SEQ ID NO: 15154 - protein, 99 aa, Chlorella protothecoides
MELKGAHITQLMCPHFLQERLLLKKFKGIGDGGVDIFFREAQLVWDEIYPFADKKALKAARLVGFREHPKVRSCAWDEVQEELWMGRGWLNVGAYANSL

SEQ ID NO: 15155 - protein, 47 aa, Chlorella protothecoides
MHEALTRGAARAALASIVVPDARRLEGAEGWAGRLRLERAREGTGIR

SEQ ID NO: 15156 - protein, 290 aa, Chlorella protothecoides
  MOD_RES (35)..(38): Any amino acid
  MOD_RES (223)..(226): Any amino acid
GARRAGLAAARGRAFPALQPADQRARGVADRGAVXXXXPRRAAAPFRPYSLQISARAASLTAVLCNDKPETFGAPDVLLAGVSEVEAGYDTALVLPDRPPNKAGQLSLSSSAAFLNSSTSRWEAVYEPWPLRLEVVDVVSPLYLSDRRTNLWVTSDQHLDAAFNPASLMSFGDALAFYNTLLRPEPEPEGEPRFGRSGVLGGPGRGFGAREPGSGVLQGVQVXXXXLATRWRFTIRSSGPSRSRRVSRALGGAGCWGGPGRGFWSRGVACCRGCRWSVKGGWGGGGRSGA

SEQ ID NO: 15157 - protein, 361 aa, Chlorella protothecoides
  MOD_RES (224)..(227): Any amino acid
PTVLADAGAVLAAHAAAAAELRGSPTLHALLARVLALGNVLNHGGRLGAAPGFRLRGLAKLNDTRALDGKATLLSWLAGQGAAQEPCVGRSRGGGGDGLGGGGVGGDGVQRPGDGGGAAAGTGDRGMCAPPPATSPGGELQQRRAAPPTLLAARLPALASPRLRVPLADVAEQLGELDRQLAAARVEVERARCGAAAADSGAHKGAVAPNPDAVFLQAVEARVXXXXAAGNSGAHEGAVAPNPDAVFLQAVEARVTELSAATAAALAQLEAVRGVVAAAAAFFGENAAAVAASEQELWADLQAFISAYTAAEKACHARAAAASPSPRRGSGALGRSARRASGLDGGTGARDLSAALDAAAA

SEQ ID NO: 15158 - protein, 790 aa, Chlorella protothecoides
  MOD_RES (670)..(673): Any amino acid
  MOD_RES (700)..(703): Any amino acid
MNESIHNFAMYKGVRSFAILLIPHDQGGRSPLACNTSHASYTQEALEEIRQGARTGPTRGAKISRFSTEKRLRRTPSTGLLSAPNTHVPSKYNMMHHSLSPRPMHVSSADCSRRHISDMSLALGTLNHVSFVVADVAIAAQFYSCGTPQGRAGIHLGSRPHGAGSARFIRADLMPLRPTRLRDRLWRHGLGVHLIRGTPVNKDKSSIVPQSNHLSFLAQDLDTVERQLDDFRIKYVVQRCCEDGVEMRQLFFHDPGRLMVLDDGMGEACAWVLCKVHARCGRWRSLKACLLSSMSGHLFHTLSALRACPRTNLTHTACIGTQNVTREDLEGIVCGGPHRNVQAEVATCCEVQGNAQSPFISMALDGRGVGALAGPRVLGRLTPELILRSPQYMNCVGQYELDMRANRINVIENLGATEVRRECAPCWAGSGLGYSHHPRSPPTLSPVQNQFDSIDLSDNGIVRLEGFPKLLRLKVLHLNSNRVIKIGRGLEGGWDARAALPESPSSVPALEWLLLTNNKLTNLTVRVEDACVRARSLPCNQLGGRPCIQEYGLCFHRLPMTGREPVHSGVCPLFPSASHEFPSIPLTIVQDIEPLRTLPRLKYLSLLENPITKQKGYRCEDVRLSACPSMAVWVRGCARECMPEQGCLLCQGCYKKVWLVPRWPALYTPXXXXLRVAGAAGWLGAAQTGYPARCPRPLTXXXXPLDSLAFRLYVISRLPHLKVLDFRKVKQTERQEAVRQYPMGLAPAPAATFEPDEDLAEVRGLRVAGAAGWLGASQTGCPARCPRPLT

SEQ ID NO: 15159 - protein, 298 aa, Chlorella protothecoides
  MOD_RES (144)..(159): Any amino acid
  MOD_RES (285)..(288): Any amino acid
MLRRRVLLIPSQTELREKLAKLYDVKDDKLISVFGLRTQVWGDWRLKGAMTPTAIPLSFSQFGGGKSTGFGLIYDSLEAFKKFEPTHRIVRASHHLPDPAPPTQCPPQNGLAEAVSKSRKQRKERKNRLKKVRGTKKAGMAGAXXXXXXXXXXXXXXXXEGPSRGRLSCGEHVCCLHQMLYSGRVTTSLQAATCLSLQLGCNRGNHRSQLQGGEGRVGISFLENMTVHDDNHRRRCLSGLFSVLRLQVLVTPRLHAQGQSRASRQSLPSKKGNKRPIAESSLAPXXXXEAITGRSCKG

SEQ ID NO: 15160 - protein, 220 aa, Chlorella protothecoides
MRALLSGLRLGWGPAPCRARLCAGSHQPGRAVPRRVPARAMSEAAGEAGRGEAVVESLSPPPLPPQLLSVAPMMDWTDLHYRQLARMISRHTWLYTEMVVDKTLIHNPDHDRFLWFPPEQHPIVCQLGGSDPDELAAAARIVAGYGYDEINLNVGCPSDRVAGAGCFGAALMLRPELVARCCAAIAAAVDIPVTVKCRLGERVCGGGDSEGQGSCIQLEL

SEQ ID NO: 15161 - protein, 182 aa, Chlorella protothecoides
MKSGMLAAEAAAAELAKEPTAAGRALDLGAYETAMHDSWVHTELHRERNIRPSFGLGAGIWGGLLGSALEAYVLRGKAPWTLRHRRPDHEALAPAAQAAPREYPKPDGSLTFDLNTSLFRSGTNHEHDQPPHLRLRNAKLPEAINLPRYGGPEARYCPAGRSARGVDLGIQQGVSSACVCVS

SEQ ID NO: 15162 - protein, 446 aa, Chlorella protothecoides
  MOD_RES (12)..(19): Any amino acid
  MOD_RES (39)..(42): Any amino acid
MSSPSLPAFQNXXXXXXXXVLSFVQGMCIHCKRTGHSRXXXXIVLRSGHVYRLRTIARLGIPCASFRSRNLSKRGRGSRHRRLPCAQLQPVSARSGPDLADAMSGTRPRPKHWTAGTSGPVPYVHQPLPLAFVNGSVVGEAGPILQDLPSTARGSELEGGVLLSLASPDGPVSSTSFRLGKVGRGLPAPSRFLALGLTSVWWMTPAWGSCASRVPLETQFLLLELPEGAGCAVLLPLLSNHGTFRASLAGSGPGSEDPALHLHVDSGDAGVMTQTWTDVLYIAAGKEVYPLVDAAVATAGRLSGGARPRTSKAVPDFVDTFGWCTWDAFYYDVTPAGVRIAPDCCIVCVRHAGRAPGTALQVGGINPGFVIIDDGESGARAGEHPGWQHTDVDVPYRGQGTLVCRGWLEGLAEPTGVGVGPGKFPAGTGCKIAGSALKDPSNSVPR

SEQ ID NO: 15163 - protein, 1027 aa, Chlorella protothecoides
  MOD_RES (277)..(280): Any amino acid
  MOD_RES (453)..(456): Any amino acid
  MOD_RES (816)..(819): Any amino acid
  MOD_RES (988)..(991): Any amino acid
AVARAAGVTAPLRLLTHCNTGSLATAGYGTALGVARALWGSGRLARVTCTETRPYNQGARLTAYELAADGVPATLIVDGAAAARMAAGEVDAVVVGADRVAANGDTANKIGTYALAVAAAHHGLPFFVAAPTTTLDPATRAGADIAIEQRDPQEALPLTTPMSKEAAPARRPLLIPPASTCLQITHFRGVRVAAEVPVWNPSFDVTPAALITGIITEAGVISPSRPGGEYDVPAFLAARRDKAGVEQAAAAENGHGRQAQSARDPEKGVVAAAEQPXXXXAARRDKAGVGQAAAAENEHGSQAQFARDPEKGEVAAAEQPAKGTQARGVDSGDSRPTGAAAPQGSSPAQPLGRQGVRGVGGRVSSWLPERCEGGLVAWGGVAARWCADGGWRDAQAAASQWPSRQTAGWTVHKHSCSCCVVIQTGRALLRCLYTPLHPHPSPSPSQPPPPSTXXXXHPDRPCSAPLSLYTPTPPSLPLPLPTPNPFHHFQGGWGRQHQLRVHCHRARRRAVPEAVAALRAHGGGGLALDPGAAGGGGGGPAHPGPALPAPRPRRLHLRPRPGGGGHAVRAAASHHPARRAGQGGGLPPAQRARRPFPRSHAVQHLLPGAQPPGLPVSYLFVGGRGERRAPPKIVPHRHAGAGRLPRGQDREQTERFVNRGMCELTEQVIFTDPYHGAPHNRAASPHLAALVGELRRPRARLAATRLKQTFMHQPQALLHGDFHTGSLMVAQDSTYVIDAEFAFCGPIAFELGKWVANLLLAFFGATGHGHVMVSCHMSYWDGRPPSREGTLLRHDRWALLRAAPHDAQAHAIYINXXXXAFFGATGHGHDTAKARRQEEWLLQTARESIDGFLAGFQTLWLQHGASEDGGVASASLFEGPDELVPVIEAFLQDVTRDAARFAGAVMIRRIVGIARVADLETIQDPQLNCLRVSITKSAACWTACSAMRKLHTLTGCFMQGEAGGAGPEFCPAAVIWHDLLKGSFGGAXXXXRERLEERALSFALPLLYGTISLEAALEGLQEELRSA

SEQ ID NO: 15164 - protein, 230 aa, Chlorella protothecoides
MQASTSGLGGLLSVHRVVRKIQGAASAVPGALFRGLKKAVDASSADSWFVRAVIWLVRGPLRPALLAFYAKATNHGQRLLTVKANSKFRGLGKPRSLALNEAGGKLGPVVDKIKDMGVRHVIAWHALCGFWGGLSDELGEQYEAELIMPEPPANLLVRPHGGWALNPETAWIPPSVAGVRIPRDPTALHTDMHAYLAGCGVDGVKVDVQVGRGVLQGPAVGHQQGGVCLL

SEQ ID NO: 15165 - protein, 113 aa, Chlorella protothecoides
MELRAALVAKAEYLADTGDAAGAAAAFDAAERKTAGAGPKLDLVLARARLELGLELRAELRRTLDRARALSAAGGDWERRNKLKVYEAVEAMATRRFDVAAKLLLDCIATFSA

SEQ ID NO: 15166 - protein, 122 aa, Chlorella protothecoides
MGGGLEGGPGEGQGCPALGGCVSVVCRGAMAALGGSLWPQAEESQDRAASQGHKLKNPKTELRQKCDHIPARSRLVITGTPIQVEGEARRCITHCMVLDVPCRLSATAGCVSSKTLPSALPT

SEQ ID NO: 15167 - protein, 332 aa, Chlorella protothecoides
MVDEEDYHFFGAPLVDESDVQPFQRSDPAATRSLPLHQQGARSVPIVDARRSSSPGSAAPHPAHIVESPHIPHACEQEVKDDQGRRRFHGAFTGGYSAGYFNSVGSKEGWTPATFSSSQGARAGVRQSVEQFLDEDELEQYRKQHLQVRAFMSTDCLCPAVGSPWFRPAASGRPSLVHSHATTHSTSPPWPLPQTTAAYDTFGATAAEASRRAVWEQAAIRPQAVPGLLPEDVIAPVADSVGIQLLRRMGWRQGRGLGGRPDAAGSRGAAGSEVISGTARETGAALASLLPPAPKTDLHGIGYDPFRICVYCARELGRVSRWLRWTTGTIHP

SEQ ID NO: 15168 - protein, 431 aa, Chlorella protothecoides
  MOD_RES (31)..(33): Any amino acid
  MOD_RES (258)..(263): Any amino acid
  MOD_RES (292)..(294): Any amino acid
MQIHDCAQSTNSPFSPTPGSKASAKQDHSGXXXHANSRLCSFHQFSLFSNSRNQGFSKAGSFRDSTLEIMGLSVSAVSIEPFKVLLPRSTQIILTVECLKPGQTACKADSKGNIGTGNDGKNNFGDYNIGDNNIGGRWGNGIDWVGGKCLCTGIAGVGFKSKLPYVSHSYRTELLSRAGRYNKGNSNWGFRNNGNNNRCNHAVGNRGTVNNCDLMELRKNADLNYNPPPPPIKPPPPPPSRKPPPPPSKPPPPPPSKXXXXXXPQNVCTASSVQEVTPSFPQVASSLHQVTXXXPPKTSAPPPPSKKSPPPSTKSPPPPSTKTPPPPTKPPPPPSTKSPPPSTKSPPPFIKPPPPLTKSPPPPSFKSPPPPSIKSPSPVHRPPPSPLAVQPPPPPSPPPSPRPISFPPPSSPPPSPPPASPPPSPPPPSPQ

SEQ ID NO: 15169 - protein, 219 aa, Chlorella protothecoides
MLADPHLPAWQRNQNVTPPPFSQSPLVAQGAREFEAAKRARLEAGRRQSGAAGPVPRRHPGVAFGTGVLEEDDAEGIMDDYVVHGDVGGEVESVNADARGLPARRGPGVQRVGLGDRLLAGGYSFEIQVLCLKGLWGLEGGGRCGYWARWGPSHGCLPAFGEETPGLLEAAAGHTEEEEDEDEEEGRAPLLALTGARGPAMLTGRPAPAAIKSRVSGEV

SEQ ID NO: 15170 - protein, 389 aa, Chlorella protothecoides
MHAAKEGENAAPGAATIPAETERALPQWTHKSDFIIWLQLKPLQLSLYQVCGWLGKRGGEGLGPPCPASIPFNHGGVCSGIKQQTTRCLLSISLTPPPPHLIPPQAFLSSPLIKSVLNSSRSALGALTVLKKICDHPALVSERAQREMMAASATDEAGQAADADVETSEEVAALTEDCPTWLGAREEEGLRRLLAAVDESTFLASCKTEFVLGLLRHLVGSGHKTLVFSQSTKMGRARRVRQRPGRRSGLACRQVEEVAWHAARSAVPWHAGPRLTHRSDPVATRHPVPALRTWPRLPLLDCLRVLLPNSPIVSRAPLHRLTILETAIRKEGVRMVRIDGQVASVDERAARVHAFQTCPDILVFLLSSAVGGLGLTLTAADRVIMCVPG

SEQ ID NO: 15171 - protein, 128 aa, Chlorella protothecoides
MHMGVRMHSLPPAAGLFAPPPLPSSNPDGRPPPSSPQDGGDELRAVRLLHRPHRRAHPGPAQPEGQGSTRSRAEHWRPAQVMWLSGLAVVISSPEVLSVIDTIPHLSSFLNALHDCKYAEFFRVRDGG

SEQ ID NO: 15172 - protein, 173 aa, Chlorella protothecoides
MGAFDMVHCAVLQRLATHWPLATHPSGVQGRPVEDGHRGWRAAQVLCPAGGLMHWVELTLLGLKRCSRAARLLWWGLSPCTAYVALAYHCDAPPQPLQELRDLLKLDLAEVHASPTLRILNEMHAGQRRLTPQLSEHLQFLETLAGAGRDEECRKAWSGGKQSHEAGRGPGAT

SEQ ID NO: 15173 - protein, 423 aa, Chlorella protothecoides
MAPGQTGRDQGPSAGPPAAPERKAAFTSAEERGRALGETPLPSQPGAVDTAAVSGAESSRGGPPAPRRDVLLSVAAADRLRLAGMLSRSFVSGSAECGDAGASEVPAGLRPGARPERPPGSQQGPPPAALGPAPAPVGAVPRAAGHIVTAADLSRAGGFGGEDKQAPGAAPRLPIRRSKEWRPAALLCKRFNVPDPFHGRPREVEPSRFKTDFLALPDTAAAAVAQAAAKLGPGAAELLAPPAPRGGAAEATAVGDAAADAELAAERFLADLLGQAAEPEELPPLPPAPPMDLFKAIFEDDEEEEEEEMEEGARKPGGLEAGGGGGDASVVLERSVDQGRDAHPSGGASERREPQADFGFSKLRSERGSVRGAGAEDSAGPRLAEDPAPAAGGIHGLDPALRQRVESTLKSLGKRERKENKRR

SEQ ID NO: 15174 - protein, 150 aa, Chlorella protothecoides
MTGSDTGPLPLGCRRQVPDTLPPLNPAPQPPTLDPQVHAGNTPVARKPTLFFLAHCGADLTDSLLSSNRAAGTLHNLVLLGNSLSAIAAAWQHRGPAAGHAAISTILDLVQPGSCMREVALPEYAFPVISAFNDISIHTFWAAPPLKQSD

SEQ ID NO: 15175 - protein, 205 aa, Chlorella protothecoides
  MOD_RES (140)..(143): Any amino acid
MQPRLPQAHASSVTQATNSSETPAIDVSAHEVPCSKSLSVTAPRAPSSARAQTSLGPIVLVAKPLARVLLLHTGGTLGMDSHASYEEDVDGHHVLVSGTGGKYHAQKSQSLKPGNMLNNLLGIVPELRQLANLDLKVVFXXXXECGAQMPLHAPELFADCTASPLKGGLQPRFLQHRTQRMTAASMLVRLCRGRLLPALLGLSGS

SEQ ID NO: 15176 - protein, 333 aa, Chlorella protothecoides
  MOD_RES (324)..(327): Any amino acid
MSEMSAMERVMYCSMASMDRLGYQRCTPKDHSALHKPWLVKPSSRFMGRPENPGRWATISRSMALSMGGLASPAREKQSSRLVRSCAENSSACEGRASLHIGWYGESDPPSPNHAPADDLLGKRGAEPDGRVLQHGARPGDVGDGLRPHLGQQGHGPPLDGRQEFGVTVAQHRTGPHDVAQALGAEVIDVGRANIARPPRATNHESGSQCTPLCGPAHLTTPSCTTHLQFDFAADIVNNDELARAARAEAASASPRCQPSFEPLQHGPELDRQAAVIDRLDAGAHEESGVNQALAALMQRRLAAARSASERTLGALRALAGAEXXXXGGGGGG

SEQ ID NO: 15177 - protein, 466 aa, Chlorella protothecoides
  MOD_RES (445)..(448): Any amino acid
MVVSHLVLRVARAGMLVAMLVCISGGWAHVPRMLLLEGGRQLALPGAEFPHALIDAPLSSSFYFRVSLDRCLLPVTLFLRLGTVCTTLSPRACRVSLSSTDRCSTFLNFEGDFTFTRSPSSPPPSPLRSRPTSTLLAGGCGPPPARAPFDFPNRGSKSPSSPPQPFPPSGPYLSSPQTAMDLELCTPQDMDHRHPPVDSNTSSTSEADVASLLDGADQRSHHLLKHCLSHGQRDGALAHFTTADVKEAAREVSRMGQRDLQARFKAVYGTTTHSNNNDWLRRKLYEAIGAAPMKAAVKSKPRKAAAKARSRGASLPASPVAARGALAGAHRASCDLGSGKAQDGDAALLGMESDLSLTEDGSEEGSFTHAPGAAHEAKAASQVGESGSELAEGVWLHVLGSDRCASALVSRVWLCRKLLSQDACSDATALMCLLYKPCLALYRPXXXXPCVSGMVVPQAAITGRLL

SEQ ID NO: 15178 - protein, 83 aa, Chlorella protothecoides
MPTELLLKQRLCTTAGSAFLGALAIAPAIVEGLTGMTALRGFAGTSVLILVGVATDTARKFRAELAMGKYKDIDALYDNLDDL

SEQ ID NO: 15179 - protein, 275 aa, Chlorella protothecoides
MDRSGFLNSQGESRPYVADPSCRSEPEGRTCGQAREEEASGNYSARFRSCTLEIGQPSRGIHKYNACSTICAASPHSKPSNFLCHEQAYLAIKHSMAAPEGPSQPAGSVRRDFLCIQRLGCPSLYSVSYGQPPTLSAAGLGAQPFSDVPPSLVPSSPTRCCAKHSTQRLLKLASRGTPRPRILCRAASKDEGNIVSQFFSGDLPKNTAILLALLVFSRLGVYIRLPGVDVDAFAASMQGGGLLGYIDTLSGGSISRVGVFSLGKWSWPAREAGGP

SEQ ID NO: 15180 - protein, 174 aa, Chlorella protothecoides
MPSGRGGEGRGLERGGVVWSCISCPIMAVCTAPLSYRTHTLRSFDVRLQQRGNNMYLHVMWRFLEQKSFPLTDEEYQEQLNAVAAFVDAWGVADMVRQGIAGASRKGPGHTGETPPPVRLVAWPALRCHNCSACQQGPSPAVLPVPLTGGGGARAISIPLRISSDVLKSSEWNI

SEQ ID NO: 15181 - protein, 669 aa, Chlorella protothecoides
MQEAQIMMPLPEVRWPTNSGCSVRRWCSCVDVLVIAYRQDRRPSFTHPMAQASAAVMSKQQEIMQELELRRRMKTVVVPTNDGEVRRLLRELGEPITLPRIIFRDTVHLQMERSDRLRKIYALNDYAAPSGLTLEPAAQLVSQKEIFYTEGSDQLKSARLQPGACIPSAREWKQTGMVTKKVWSKLLGLARWRQLWACHRCPYLADVRPHSPRRPHCVELPLRHLINQVSEIGDDRPIVGCVFSPDGSQLLTGSWSGAVKIWDSASCRVVTSIKAHTDRVTGVAWNPNVAGVWRLLLRLSLIGGRVDLYHNKLLQFASQDRCQQVCFAMPGAGTSTEGVAFVSGATDGTACLWSKEGRCQATLSGHTDRLGRVAFHPFGRHVGTASFDTTWRFWDIATSTCLQEQEGHSRAVYAIAFQGDGALVATGGMDATGRLWDLRTGRNIMKLEGHVKSILAADFSPNGYHVATGSEDNTAHVFDLRKKGTLTILPGHTSLISTVRFEPITGSYLLTCGYDKVSKLWAGRTLRLAKTLAGHDGKVMAGDISPDGACLIATAVLHEKEDLLSRANAKRKPDRKHHHRGLEQEEVGVRLQLRISETLLLIARLRPRMHLATACTQCRPVLLTGRTTAPVPTSRRTNRALHRRRYIPVHSSTTEGGDPGAIREGMPSS

SEQ ID NO: 15182 - protein, 688 aa, Chlorella protothecoides
  MOD_RES (211)..(214): Any amino acid
MLSAVKRIGRVLHDKGNSPVDAFLDCVLSLSSKIPLYSLIVGLLNVDDEPFVSTLLEKVGHRLAQSLASGAESSKGRILLQFLASLCNVNVVDTGSFLAFILEQMQQVTSVAEQRKDDAPEEWQPHLDSLVYSYLVALPFVEEGAPSHFGDQLQAILRVCRDYLGLRRLRGKSLHPFLMALSEEDTISQMAVLVANHCNRFECPIRRSRSXXXXRRILQYRMAVLVANRCNRSDMGRASFIPDLTEALDQIISLGAFDISSIPRLHAKYEIDLANGKIRSLPDIAVPLDGGNSYPSGASPSVRAALQLEKYPPRRTLQLLDKQHTDGERPALERIIVEDYVLDVLMAFEGDRIECARRLVQGLPITFPYEPLLCQVLFGQMLGLPHSKFRPVMYATLMVDLCKLCKTFPRAMSACVRECFARMNTMDMNLRFRLAEWLAYHLSCFEYVWPWSKWEHVLTKPEHDGQRYQGLAILRAGPGQAGPAVVLGEDPQCGAASVPGLAATKTCSGKNRVRAKTSAEDLDVWLESISETNELSAFDLCNLLVRVILDAGSKSYTHMLTLLERYTGPLVVRVTALGRQSEMSLIDGVMEVWKEAPQRVVMAVDRLMTLRLVSGEHLLDHPLHKPYTTRGTHERTTLSYAAEAVISWIFHRNPFKAANDSLSFATVWEVLHCALDKTVARVQVRFPA

SEQ ID NO: 15183 - protein, 264 aa, Chlorella protothecoides
MQAGAPAGGPHAPLSRRAGQACGQPGPPGLLQRALEHRRAAGGSGEGNPGYGASQDPGCRSHVAHQASSRTPPPQSTESEAFLRLLARFIELEERERLSVLQCNQVRSGPPGSVVVGARRGWAAFAVLQSVTLALCEQRAQRSDSPWRLGKHFTPAVLKACLQRWSAKVQSERSSTTLSRFHLVVSTLLQQLGIEHQLEHCVIKPGVHVDIAILRPSGERLAVEVDGPHHYPFNSFAPLGHTWVRRRVLRACGWKVLSVPFWAW

SEQ ID NO: 15184 - protein, 239 aa, Chlorella protothecoides
MTEKIIANHSDSSVVRPGSNIWTRVDKLMTHDVCGPGTFGIFQKEFGENAEVWDRERVVLMPDHYIFTSDERANRNVDILRDMAKRYNIKYFYDITDRSDFRANPDYKGVCHVALAQEGHCKPGEVMFGTDSHTCNAGAFGQFATGVGNTDAGFILGTGKLLIKVPPTMRFEMVGQMPPYLLAKDLILHIIGEISVAGGTYRAMEFSGEAISNMSMEERMTICNMVIEAGGKNGEGAGG

SEQ ID NO: 15185 - protein, 147 aa, Chlorella protothecoides
MCRLARPSQAEEFSAQDLTNLLLCFSRAGLASPPMLSAIEREIVAQRPGFSGLPINRLEGFTSQGLCNALWSFGVQRWYPSLSMDAMLQYITLSIADISDMELVLTLWACARQGRVVGKGSGGEVLLVVRGRVFLALEDRRAWANNA

SEQ ID NO: 15186 - protein, 150 aa, Chlorella protothecoides
MLTSLRRDGGHSAARAALLSSPAAPSGPAAPGRGRESEATAPLTSAGLLELQRDVMSQQDRELEQLERGVASTKHVALRINEEATLHNRLLEGLEEDVDVSRSRLAAAQRRLKGVMHRARSCKTQLVILLLLIVLVIVVVVGFKLVLSWF

SEQ ID NO: 15187 - protein, 206 aa, Chlorella protothecoides
MCPPDETTFDYVTQRTSEPFEPVYADSAAQYVESFRFDVSKLEPTVAAPHSPDNRKLARECRHVKIDRVYIGSCTGGKTEDFMAAAKLFHAAGQQVKVPTFLVPATQKVWADVYALPVPGCGGKTAAQIFEAAGCITPAAPSCAACLGGPRDTFARMNEAQVCVSTTNRNFPGRMGHKDGQVYLASPFTAAASALAGHVADPRDYM

SEQ ID NO: 15188 - protein, 241 aa, Chlorella protothecoides
MAPELGSHHVQAYWPFHRLHCKRNEFADAMEEADPKFATWMRGHGKLAVLKDDEVDRLERAAQAASGPSRAEVMDSMYGRLEPKPAGARRGREGCAAVHEEVEVFFLLGMVHGPSFSAEELERMSEAAEAVKASARRALPCSKAYAAIDVPEGMGSDAGGYKWRQSQTHVEVFVSLPPGTSRRAVHVSLTSVSLEVSVEERPVLGGTLWREVKADESTWYIQVGCLDGPCQALSVGVEGFA

SEQ ID NO: 15189 - protein, 164 aa, Chlorella protothecoides
MVHSTDIVELELNSKKFKLTVKKREALEVAEPTIQYLPGPGHMQAPTQQQQSYAPPPPPAAAAPAPAAAPAAPAAPAAPAPPAAVDGIEVVSPMTGTFYQSPAPGEPHFCKVGDTVKKGQTVCIIEAMKLMNEIEAEVSGTVVKIVAEHGKPVTPGSVLFIIKP

SEQ ID NO: 15190 - protein, 326 aa, Chlorella protothecoides
MLDSVLVARNKFLKPGGALYPSHARMFLAPITTNQTQRRQAELEVGSQGMEPLLQGHGSRTLPLSPCSPAIPPLFHLSTPQAAVDGWSDFVREVKQYYDVDMSCLTEAYQEEQADYFSRTAAWADVHPSQALGPPACLKSYDLLMLTLEELKADLQASFKLRLLQPGPVEALAGYFDVQFRGSPENPADSPVTLTTAPDPTGVRLGARGCIREFKGRCPFPLLLLGGWHPIVFFMHPGIQADEGTTIEGSLSMSRRSDNHRLMDVVVKHKVGGAGPEAWRCRGLPCAVLQWNLAAGARDVNMTPPCASMKMSCRVATPAGLHGADQ

SEQ ID NO: 15191 - protein, 527 aa, Chlorella protothecoides
MASAAPLPPNSAVAAAREAFDHGPWPRMSGRARGRIIYKLADLIERDLDMLATVESLDNGKPLSVAKAADITLTIDHLRYFAGWADKLEGKTIPTDGNHFAYTLVEPKGVVGQIVPWNFPALMMAWKIAPALACGNAIVLKPAEQTPMSALIIGAWPSWMVWGVAAVSFRGVVRPSGPPCLHIHPHGEPFPRLNIQGCAHILSPSTLPILSAMFHFLRPHPPPHSNSTSTGKLALEAGLPPGVLNILPGFGPTAGARLTSHPAVDKVAFTGSTEVGRIIMKSCAEHIKDVTLELGGKSAMIIGPTKDIDNAVDIAHFALFFNQGQVCTAASRLFVHESVYDEFCAKAAEYARKRKVGDPFEAETEQGPQIDNEQFEKILGYIESGKEQGARLLTGGARVGKKGFYIQPTVFADVKDEMKIAREEIFGPVQSILKWSTTEEVLRRANASEYGLAAGIVCDDIHLVNTLSRGLRAGTIWVNTYHVYDHGVPFGGYKMSGVGRDKGSAALAHYTNTKAVVHKLEGEQAWL

SEQ ID NO: 15192 - protein, 229 aa, Chlorella protothecoides
MTRPVGRRARTSSPNQPWGPRAQRAQRALRGAARGGQPPLHQRRQRLVHAALLVRARVQAVDHRGLAVQLRTVLQRLEGGLATRRGGGRLRPRGARQLVVVHDVGGKVKLKLWGTVKLKMNDPRVFAHMLKQVTLTIDDFSTQGLSNIVWACAVLRHRDPEFLAAIERRTMALLTEMRTQSIANIAWSCSVLEYTPVRLCAALSKEVVSRRVVWGWGISFLKGGYGGQA

SEQ ID NO: 15193 - protein, 240 aa, Chlorella protothecoides
MAYTASAMSLMLAGFRKPIVFTGSQLPLAMPRSDARQNLIDSLTCATSSFNPPHVHLQEVALCFGGKLLRGNRARKVHSNVYEAFASPSYPNLARMGVDVEWNTGAMLQPEGVYRPRLRLDPAVLRVPIVPGVDPRVAYGDLVGRGVRGVVLESFGVGNMPSSAWLPWLRAQRKAGLLVSMVSQCAGGALQPELYASGSAALALGVEAGPQMTAETAAVKMMLCLQYPDLPLGVPLAGEM

SEQ ID NO: 15194 - protein, 405 aa, Chlorella protothecoides
MNPIHRLSVPRHMTHSPQTHSPPPVRPRRAQDDAEIAKLTARMKSLLGPFVLRRLKTEVKSQLTEKAHKSEFIPMAPEQQALYEAAVAAYRRQLSARAISADAGAAGIEKWCKSVGARKISHIFSHLRKIAQHPLLVRHHYDDARVEEIAALAHERQLFSGNATLKKVQAELAGYSDYALHVFCYNAGPEFDAYRLSSEHLWSSSKFRLLRTMLPKLKAAGSRPLIFSQWTSVLDVMEWLMSELQLPYVRLDGSTAVEERLATVDKCVGVGVGMLLIGGGKERDARLGPGSFGKDRDARLGPGSFGPGGPNQATGFTAPWSAGWRAGLWAPRHTAIGRDHPTPPTRARTHSHMHRFNGSEEVFAFLLSTRAGGQGLNLTGADTVILHDSDFNPQTDRQAEDRCHR

SEQ ID NO: 15195 - protein, 178 aa, Chlorella protothecoides
MSLGYAEKLSFKEDVGGSLGAPEVFDTATELAQSIEKLIQLVSGPNPARQGTALSMIHWVSEARSIIAFTGAGISTSTGIPDFRGPNGVWTAQKLGRALPKATVEFANAAPSLTHQALLALHGTGKLKYLVSQNVDGLHRRSGFPAAALAELHGNCFLERCSTCGATFTRDFEVETVS

SEQ ID NO: 15196 - protein, 126 aa, Chlorella protothecoides
MLLYRQRIGGAILADEMGLGKTAQVISYLGAIRSLDGDAGPHLVIVTASLLENWQREFARWCPGMRVVPYYGKHRKIVRARLNTLRCQEGREGGGRLRDFGVMGGGSRGRGPAGPGCLLGGARGLV

SEQ ID NO: 15197 - protein, 404 aa, Chlorella protothecoides
  MOD_RES (231)..(234): Any amino acid
GGGRRPPCLAWALGSQTPSLHLPGKPQQNLPPCSQPHPLPHRNPGPHHRRALLLPRPHHAAAGDRALRRHLPPGDPGHAGLRIAHPEDARGGGQLHRVCGQPRLLPILHGRGHAGGLGAGPVPRGCRRRRLWHAHGALPPRRPRRLGRQPVRGQVLPGGLPGAHLPLRPGPAAQRGGAPGREGQEGVGGVPRIWGYESWWGGRGSLGGSGFAGPFARCDPRPHHHNPAKHXXXXVAQGAGVVWGALEWGGGRSWDYGSWWGERGSLGGSGSGLSGNAAFAAKLSDQDIAEFVFFPVINEACRVVAEGAGLECVNWGPTLTHPLDVPFSISPTSTPHLSAGIVDKPADLDVATVMSMGFPAYRGGVVFYGDIVGAGLYGTMEGKECLGVCWWYCTGMASLSLDAP

SEQ ID NO: 15198 - protein, 128 aa, Chlorella protothecoides
  MOD_RES (119)..(122): Any amino acid
MTSSAADTHLHPNHACPILRTHQVGEFFETVGIDAVLLVQHAGLNPMVRLQSGAWTPVLTCSRITLGVAAHWLPLIVPVAPRTRACPADRCIPARTGTPAIVCDGGRYGRAPRPHLPSXXXXHPCYRM

SEQ ID NO: 15199 - protein, 363 aa, Chlorella protothecoides
MLSSATPPFSPSSRGMYSGFDPSLHTWMSCNRPHAENVPLEERLRGAVRQIDRNLGRVGSRNGTRSAGITGPWGGWVAHPSLSLDDWLRQGLDQRGFLQRVDRRPWHAPLPNEEVTSHDGPPKWAVLPPRVHQGIRGGAGRGTAAYPDRHQEMGAGLPGTLAPLQAALRRHGGWKSVVQGPCHHASQPKVPTASVQATWYPAAGPLLHACLCLKGPPCPASIAQEVEEYWSSILEGVEKPAARKLVKLLDPRQPMGLPAPKVEESNAKRSGPGKVPLLRFFLATKAKYPMHVLLVRVCAAGEWWIGWWGCRSRVGWRFQWDQRHVRGTIPEMQVSVFGKGYAGGWGFACPPEIEAESQRFEFA

SEQ ID NO: 15200 - protein, 106 aa, Chlorella protothecoides
MAAFIRKNEDFRGKVKADRLPAVHTAVMNAGLRVEKELRAIYEPLLEASVRAGDPVKLRPMLRLDEHNNAVWLRLPRACSALHLADELGLWHPKDRMGKVQKLLES

SEQ ID NO: 15201 - protein, 452 aa, Chlorella protothecoides
MLSMMAAALEGHVREASRRGWQLPTLAYGPDAAVRARAGDAGLAPNPLPPAPLSVRDMWPYWLQPRGAGASAAVFNSFDMAGLFLLTGPNMAGKSTLLRSTAAVALLGACGLAVPARAARLPYLDAFMLRNFSADSPLEGRSSFAVEMTEMRYVLEDASPHSLVLVDELGKGTEARAGAALAGALLESLDATGCRGVFATHLHPLLELPLRLRATCRMRMATCTDASGARRPTLRMVPGSSTESLALEVARAQRLPARVLERAAALYADVQALHAAPEGGRGRLDDDDDEAAGRSGDAAVAAGRGIATDLTETRGLEPASAPATLKLRSLAEAGELLAQTASRVLEQLGAPGAASAGRSPVPAIDAPSPPESPGPTPAPTLSPLAVVRAGQTPPPRTVGLSCVYIVRRTDGWFYVGEERSLWRYALQPCLHRAAMMAMRCDDLMPSPPGPDP

SEQ ID NO: 15202 - protein, 502 aa, Chlorella protothecoides
  MOD_RES (166)..(169): Any amino acid
  MOD_RES (308)..(311): Any amino acid
  MOD_RES (348)..(350): Any amino acid
  MOD_RES (454)..(456): Any amino acid
MPRSLDADSFISIVQNKTRVLILAFFIIYQLFFWSWGSLYYLLVRFKPGCIYGADSFVEAWVFAVVTQMTIGARVHGSCCGIGVFPTGGEGGQSRQPAGGRTEPGGLWNEARALPALRKLTETFTHRSHHRAPFPAWHPPSFPDAFPILPQSISPPRRFPPVCRSXXXXFPDAFPTLPQSVSPTRRFPPVCRSPSHSLMPNLHPPDRPFPPSRRIWQYGSSELLARLRHDCGPGHPLGPPRRHGRWHHVCAHLAPALPRPLHLHERPRVHSQAGRHPEAHVPHRRHPTHTGLWVWRRGVAGASGWYPXXXXRGKGSFSKIGVFRVAASHGARRSQPPLSLERSRAGAXXXLYTWGSGRVTAEGEKIPGGGRDVRSRGKGSFAEIGVFRVAASRFCMGPGALSRCCPWSALERAHGCCLGRRAHLNPDGSPSHAIHTQTPPCLRAVRCEALDIGXXXTACSPEPRWFPIPYNTHPNVPMPPCSTLRGAGHRIYRRHAAAAPHH

SEQ ID NO: 15203 - protein, 436 aa, Chlorella protothecoides
MGDGIGRALAGEAGYQRLIRLVGRAFYAGECPPPVAIDPDALLPPTVSRFSKFSFAGLGVLLLDYLATRADGYCDEVTVCEDTRLSQKQVRRALKYLEDAGLVRCDVVKYSLARDKEPSDDPEVAARRRVETHAFWAVDYPRVKDALRLRLALMREALRKQVCVRRVGQAPAWVGRARCVEEEVNRRPGCSCSPYPRMRAGGSVIPSCVTRCWAGLAASASPLQSPPRRATAGRRHRRTTAVHLSALRRAGLLAGRRAAAGPENGEREEWGEGGWGGGNGVSKRCSSGGVRLDMPREWSGTFLCEECGAELEQRAAGDSQAGGPGGSAAGNKARQAAAKALQAAFERQLAPLIEQLERIKDADPPDPGSLQVSTRRGDRMLKGRGVEAASILSNRGAGGGYERIFGPQGPAPHATAEAHCLVFPSFLPVPAVSSGS

SEQ ID NO: 15204 - protein, 372 aa, Chlorella protothecoides
MILQRARACNSARAVRMFQEWNVLERATLHELFRCFNSGTDRQPRGLPSPASPGDLLPSFFPGISRHPPLLFNTHLVHILHDVLARGLEVGEEGRAVRHGLEVIKGEGDAAGRSHGDEVQHGVGAAAQGHDQDHGVLEGGAGHDVARLDVTAQQVQHHAARHAALQPLQRVLGGGGGGVGKRHAQRLDGAGHGVGGVHAAAGAGAGAGVAHHVGTAVLAQQARGEGTVGLEGGDYVQRGAVGGGVPGADGPPVHHERGAVEPCGGHDGPGHVLVAAGEANVGVVPLRAHHRLDAVGDEVARLQRVRHAVGAHGDAVRHANGVEAVAHQARRLHARLHLRRQVVQVHVARVALVPHAGDAHLTIRAGRGVQRF

SEQ ID NO: 15205 - protein, 290 aa, Chlorella protothecoides
MWYEGNPCNMHLNDLAAEVKAGVEAAGLVGYRFNTIGVSDGISMGTDGMSYSLQSRDLIADSIETVMRAQWYDANVCLPGCDKNMPGTIMAAARLNRPTLMVYGGTIRPGHAAADGATLDIVSAFQSYGAFTAGLLSEDGRADVVRHACPGAGACGGMYTANTMACAIEALGMTLPHSSSTPAEDPLKRLECRMAGGVVLDLLRRDIKPRDIMTRAAFENAMVLVMALGGSTNAVLHLVAMAAACGITLTLDDFQAVSDRTPFLADLKPSGKYVMEDVHKVSVEEKGGMA

SEQ ID NO: 15206 - protein, 251 aa, Chlorella protothecoides
  MOD_RES (43)..(46): Any amino acid
  MOD_RES (183)..(223): Any amino acid
MPPAVLHLSWPELVPTCASAWAPAKHWNVGSDGDLSSPAQIRXXXXMPPAVLHLSGHELVPTCASAWAAAKHRNVGSDGDLAQPAICQFNVLMLGKAFVLAGLLDSEGLQEVVDSFTVALSGAFSDAMRRKLGLRDFDPGLYGDLMALMIQDKPDFTNTWRALSSVAPGDGAEGLTPALAAAXXXXXXXXXXXXXXXXXXXXXXXXXXXXXXXXXXXXXXXXXWDVGVAGAERGPGGEGGELGGAGEGCWT

SEQ ID NO: 15207 - protein, 159 aa, Chlorella protothecoides
  MOD_RES (31)..(33): Any amino acid
  MOD_RES (63)..(65): Any amino acid
MPPSFSPSPPQLPVPPLPAPPFLHRSGWRLXXXSGRRPGTGAVCGCGGVLYSERPRDVLRAAXXXWSAWAAKYRAVLAGQDLPAAERRAMQDAANPALIPRNHVMVSLIAEVESGNTQGLEAYLEALARPYEDGLGESAWKVPAPRQIRKGIELLSCSS

SEQ ID NO: 15208 - protein, 250 aa, Chlorella protothecoides
MTATAQTEPAPADVKGRSLDNLKFDNRFTEDLPADEKKLNRLREVEDAVYTWVDPTPTDTEPHTLAASQEVARLIGLDLGELQRPEFAAIFSGNAPLPGAKPYAQCYGGHQFGYWAGQVRGCSAHLRGLSGVEPGPGVALGLGEVSTTGHLMSTEERDVRTSAEGADVVAGLGDGRAICLGEVVNEAGKHWELQLKGAGKTPFSRMADGRAVLRSSLREYVASEAMAALGVPTTRALSLVATGAGIYRDM

SEQ ID NO: 15209 - protein, 274 aa, Chlorella protothecoides
MVSGHHDSPHLTCTVVIAATNRKSDLDPALLSRFTTSVYFGLPTEADRRDEGLGGGVLGLRFDHRCETLHGRGLRTPCSGGQRLVLDVWIGSCPHARSCASCLTSDASWGSTADPAAAPLTHSRCRAHILEQYAKHLTPEELAELAGGTLGLAGRDLRDVCEQAERRWASKVLSGRSAGEGLRSRVMSVAHGGAAWRGRAAVSCDVCGSRRGGLAIAMPAPRRQLKTKTQRPTFFPAQVIRKEADSSSLPPLQEYVQAAQQRLAEKTTEPAWLL

SEQ ID NO: 15210 - protein, 289 aa, Chlorella protothecoides
  MOD_RES (211)..(214): Any amino acid
  MOD_RES (244)..(247): Any amino acid
MLSRGVRELARRWLPALEATPATAGLHTEAAQIYSERLASPGAGSGPTADTGTICVVHGLLGVGRNLATLTRTLLARAEQQSGRPWQAVLLDQRCHGRSGHLGLPPPHILAASAEDILRLFRSGLEYADAPDVLIGHSLGGKVCLELTAQMSRLGKPPSQARHGNGALTSMLRGRRRVLDGRVHRTSVSTIVVASANSHPPVFYPRVTIPXXXXGWSGAPHISLQDSFGELRDTERVLDAVAAXXXXPAPAQPGGLVPAIGGAGLQRRTAAVAGQQPAPAWQGAVRVAV

SEQ ID NO: 15211 - protein, 476 aa, Chlorella protothecoides
  MOD_RES (114)..(116): Any amino acid
  MOD_RES (186)..(189): Any amino acid
  MOD_RES (255)..(269): Any amino acid
MRGRETGLGNLLADAMRVAMGCQVAFFNGGTVRSDQVSRGAGVVLEVGLFVFFDCGEGVSGGSGSEDMGQGPLHRHPRDARRLASSGSLDSRCQPHAYAASPPSTQPPLPPSAXXXVSWRWGCLCFECGEGVSGGSGSEDMGQGPLHRHACDARRLAFSGSLDSWCQPHGYTASPSSTYPPPPPLXXXXDTQGARRGAADDAGRGHHASLHRRAGGGGADGRRPAARPGDWRGRLARAGGPVPAGVGPALRLRPXXXXXXXXXXXXXXXGLRFAFDPARPPGTRVDAASVHVGGAALDPARRYSAVTKAYLRDGRDGFACMRAARPLRVELNAPSLATLVRHLFFRIQALNEGLARGEGGKGASAAAAGKRGDLVGARQGVSAGPQHGTRTSGDVGSGGGPRAPAAGAAHVADPADSPPSEPVSPTGWSPEVLMQPYEAGLEKLYCFDPGTGKWGVRPKVEGRIRCVPGCLPEPGV

SEQ ID NO: 15212 - protein, 856 aa, Chlorella protothecoides
  MOD_RES (173)..(176): Any amino acid
  MOD_RES (531)..(534): Any amino acid
  MOD_RES (607)..(610): Any amino acid
  MOD_RES (714)..(717): Any amino acid
MGDGCANLPPPSRAAPALAAACPRPLRKSSLFGTIPLNNMQSSKVGGQRGAHVPAMLPQAQLGSLLVHLKLPHQNLHVRGLNLDRRQRLFPPADPIAPQAKAAQHILPEPGGFMLHTLLLSKLCHGCLNLGLVHILHLPLLDLAKGTGNWVMGLSVKSGAQGGRVAQKRQLCXXXXVSEERGTGWARGTEAATVPASQPPVAPPRVVFQDTQAHLEARPPWRRWTAMARAKTAGVAYALLLMGPLSLYPMISEASSSIPLRRSSLGGIAGPGTLAFSTRPLLLTKCLHRRAPSMHDLPPFPVQSSRPWLTPFQGRQCSRAAQRGTLVITASKAVTHKKQVILLKDVRGLGKQGELCEAPVGYVRNYLIPQRQASPASPAILARLQSERDAEAKRAQEVLGKARALALALSTIGKFVIRKKVGTSGQLFGSVTTADVVAVIEQQTGRSLDKRAVNLPEIAALGSYPVSIRLHPGEREGGGCNSGAMLSTGARCKDDRVSLGGAWQFHMSWEALRCKYPSDVLCHHAQNLMLXXXXDDQPHALPLPSCPRCGRGVPTCDPEGHLGLTHSPFRCCIAAPSREECSISAVDAWPVSRCAHCMSVTLSAPHXXXXIQGGVLHQCPRRMACVPLRSLYVCNTVGTSEAVSDAAVMMQRSSIAAMHSATLFPACMAFVSAAWAAACRLSSTTSLMADHRTCAMEETERIGDAVVRPLKPPXXXXAMEETERIGDTVMRPLNPPSSLSLALNSAHRHFVYLVISLGLVEVDPPQQRVQLGNVGQPALGPAVDHGLSAHAGQTQAGEGIETVGGQLPAGYLSLEVAITELGPRLDTQPALPAEDLGDAHAPEVPSRVQSLLLAAQ

SEQ ID NO: 15213 - protein, 1214 aa, Chlorella protothecoides
  MOD_RES (653)..(656): Any amino acid
  MOD_RES (1149)..(1152): Any amino acid
MDPGRRARGALGVVGEVALQHRRGAHARPNAHGDDAEACGLAAALHLVDQRGGLARAGAAQGVPQRDGAAVGVHALQVQAQLLHRVQGLAGKGLVDLKHVHVIQAQPRAAHGLRDGSHGADAHDGGGHAHSRKGAEDGEDGEAAAPRLAPRHHEHRRRAVGGLAAGPGGGGAALLESRLQRRQCGQRDLGPDAVVLGDGHAPLLPVCILEHRLHGHDLVLELARRARGGRQPVRPQRKGVLLRAGHAELGRHVLAGDAHGDEAVGGLLAGGHTRVHSALPVHGVAGHVLHAAGDGHRVVPGLDGGGHRGHGLQAGRALPATRTGQACMVIAPIKGRHHARHQHWAVPQLSRNSPVQGVDRDGVGEAGEEHGHAQLVSALAGGAHDGAEHDVAHRLGLDAGAAQGVLQHRGDQVVHGGVLETAPPGAAQGRAAGGDDDHVVQVARTAVVGLGGGGLRGHLGRAVSLGGEGVVTGVRSGCTRPRGGLQTHRDRGTGSISHRPRTDASSRPCFQGYTSLSELCISVAVTPAVRVSRCPRNFSRAGSPPSPITHLRRGGDPPDGKLRLPQPLICDSPLATTTPLEHQVWALRFLRCIVCMRPMCREEELIPIFSHRRPIFYIHSSAQERTPPGDPSSASQDHIWPEQWGPGTRLLAXXXXEHQVWASRFLRCIVCMRPMCGEESLYPYSHTADPYSVSRAPLRSAPRLATPPRPHRTTFGLSSGVQAPACWRRRCVTAAASGMASLTIERVPCLSDNYGKAVCAMLHIPTSPVASALSSRLSHSPAPQLGSCMSRPATWSPSWTPQSPSLWWLPWRGGLQSMMGSSCFLMPSLPVQPSMPQGAASSPARLFHPPSSVIGRLSHSHTLPRAPPPSGLKLTHILNTHHHWDHTGGNEELKARFGATVIGPAADRDRIPGIDVALRDGERYSLGAAEFLTLDTPGHTRGHVTYYFPGAKAMFSGDTLFSLGCGRFFEGTPAQMQASLDKLRGLPQDTCVFCGHEYTAGNARFAVSVDPDNEFLREWKGRIDAARAKIWGMRGWAAWSERPAHRAQPARGRAGGQPLPAPKQPRDPQVSGHPRECQLGRGPGRDSRRQGQGLSGCGCALAAHKPGVDSCVQDCCPCDHPRVRGLLAAGVQQQMFTCVCGGRDWTSPXXXXRVITHEREVCWLPVFSSRCSHECVEAGIGPPPAHCRSEKNAAMAGTVLRKVLGHGEVRVDAE

SEQ ID NO: 15214 - protein, 281 aa, Chlorella protothecoides
  MOD_RES (29)..(32): Any amino acid
MGTCTPADPRTGAGLMVKPSVSHQQPPSXXXXQALPACLQGCTAIAGGGGNEAGGGEGGRGWHRVGGVQAPTVPWGAGHTWGPIPRQILIQELGSWSNLLFPINSPPNPHATLPPGAHGGRLDHILSNLGCLYRYRHLNLVLVGEGNITRLVPRGRSVVRPHADLEGPACGLVPLAGPARASTQGLKWDMGESGGWVGGGGGGGWVQTGPWFEYVPSRAKRESMHRTCLCHPARLTLPASRSTDDTEMRMGGLLSTSNILEAEEVVVESDSDLIWTVQCKG

SEQ ID NO: 15215 - protein, 135 aa, Chlorella protothecoides
MSRTQKNKATEYHMGQLKAKLAKLRTMLQEPAKGGASGEGFEVQKFGDGRVALIGFPSVGKSTLLTELTGTKSEAASYEFTTLTCIPGVIHYNDAKIQLLDLPGIIEGAAEGKGDEVGEVEVRHIGWVILYGDCS

SEQ ID NO: 15216 - protein, 109 aa, Chlorella protothecoides
MIRRTLEHPPAAQREAPPIQCPWPNPCTDYTGLLTTPPPGTTIHMVRALESDRWTEESVETLRGLAAVPGMADRGVLEYHELPDAGHWVHVDNPQGLLDMIAPSLSKNL

SEQ ID NO: 15217 - protein, 127 aa, Chlorella protothecoides
MQATGLARGHLSPLHAVPPCRRHGIICKGYARTQTPLLESLKPLNRALESGTNDEAVAAAQELKESGVLCLFGEGRQVPKRPYTLEEVRLNRIDPAALLSPVDATMNGVRTGLQVRKSLCRHVEGSW

SEQ ID NO: 15218 - protein, 132 aa, Chlorella protothecoides
MRIPQVLCRQGRLGVQAGTEFCDGDFQREVASGKLSSNSLDAFTCLGLAGVCAETVVYGRSEGGLADIAQLDSLLRRINFNQAKADDQVRWSAINDVVLLRRHAAAHAALTKAMQAGKSVAECIAAIEAAEA

SEQ ID NO: 15219 - protein, 86 aa, Chlorella protothecoides
MPTFHFHHVSLARLNRKPPDIFFKKKKTGGIAINSMGTLTHLDEKMVWRILQEYRIHNADLLFKEDSTVDDLIDVIEGNRRYIKCE

SEQ ID NO: 15220 - protein, 148 aa, Chlorella protothecoides
MEKAAQRQKVLLSHLASPSPWSCAPRSHPSHHALPSQAHGTPEVAPQPTSAESHDRRAGDLDDVVIVSTCRTALCRARRGGFKDTPVDDLIAAVLKDTLRRTGIEPEAVGDIVFGSVMGPSSQRANELRMAMLFAGFPHTVPVHTLNR

SEQ ID NO: 15221 - protein, 360 aa, Chlorella protothecoides
MRCHPLNPTTSATPRVGLGHTLEDEDVVQIVKKKVSDTDDARGRFKQSGAEAYGHQERHRAVIPAEDCARRGLPLEPSHSRLRQAAGDTADAPLHLWAHAPLPRAGVEAVQLLQPCLVRLHQHLRRPPRRADWFGRGAVCWVGDVCSARCGRSWPAAAAHVARGPCAVLRPCTDSLSCSHEVATLSRRRRAGTLPPLPPRQALIQGLDAEEEVAHQGGQAGRVELHAQRPRGAHACKAVAAVAQVRLGHRGVAPSGVERRAAHVHGGGVDPRAGRARRARHLQEPALRLGPGAHASLQDAQQVGARQLHRHQLVGEGKHGDHVPRRQLPRGVDEGEAVYPWGWHQLSREPENARRLASQA

SEQ ID NO: 15222 - protein, 120 aa, Chlorella protothecoides
MERAAGSWAAPSSSPIAHAFPLAQAAAASGLLALLYGGAVDVSGAAVLVLLGATLAVADQVGTGGGVEALLLDSAARKVSGSYASRVATHEAGHFLVAYLLGLLPRSYTLSSWDAFQACV

SEQ ID NO: 15223 - protein, 319 aa, Chlorella protothecoides
MASVAASIKAGYYTMAIAGGVEHMTSNPMNWEGTVNPRVATCQEAADCLIPMGITSENVSAQFGMTRAEQDAFALRSHRLAAAARAAGKFKNEIVPVETVLKDANGEERRVTISEDDGIRPEVTLATLAALKPAFKKGGSTTAGSSSQTTDGAAAVLMMTRREARRRGLPVLAIFRSFAAVGVPPAIMGIGPVAAIPEAVRRAGLGLDDVDVFEINEAFASQALYTVKKLGLDLERVNPNGGAIALGHPLGCTGARQAATLINEMQRRGKAARFGVISMCIGSGMGAAAVLERDFSDDAERSARPATGVHAGLSRQFAG

SEQ ID NO: 15224 - protein, 166 aa, Chlorella protothecoides
MPRKLCTLAGTSHHGCEVADACPSQPIPQVAGKTFTPLAEAPAAVKAMNGGKSELHLQTRGSKFVRYQECKVQELPEEVPQGSTPRTLTVQLRDALTRRVKAGDAVTVSGIFLPEPYAGPRSAMRATLLTATYVQAMAVTQNKQSYQVGDVWGTRRGRGAAVSRTP

SEQ ID NO: 15225 - protein, 419 aa, Chlorella protothecoides
  MOD_RES (349)..(352): Any amino acid
MAGGEAHKKPSVAASVLAQRSVRPGQAKTKRKATVSYKNQIRSVERLLSKVPPRPSSPPQPPMQFEVDPKLRARQEKKLEELRAAAAAHSREELERKYAVRYHKVKFFERVKLERRLRQLEQQLAAAGGAGEAATALTAQLEQARRDLQYVLHFPKGEKYVSVLKDPETEADAARVQAERARLRALVAADLARAALVGEADEGRSLAATLKHMQGAGAGRGAAPTPTELPAELAAAASGSEGEGDDFFLDEAVDPELSAPGRGVAAEPARRQPPALLGPLPKEKEKRRGRERVTLPARGAEASTRDGRGSGAKSPAVTRVPGPSPKMNEKQGKPALPSRPAALRLRIPXXXXMKSKASRHSQGGLRHCGCEYRPSTPHRRPSSARPPSAPLCPSLWSPCGRGQRAAGNGGRSLLDWLCD

SEQ ID NO: 15226 - protein, 168 aa, Chlorella protothecoides
MASLVWDQCVVVTSDARLPMLARHCRCHGVAHVGPVQCPKIPLRPTTPHRSFLLQLSLLDLECSAYSASLLGASALSVALRFFGKPAWPLSMQQYAVYRADELEPCAARLAFLQSSCVSECVMRGEGGWVQGHDLREAGPAQDCRATHSIHFRWEDPKAGQLADLQPP

SEQ ID NO: 15227 - protein, 441 aa, Chlorella protothecoides
MTSPFLQACFFPSHPYPPHPPSSTSPSLPHLLHGVCKAQARQRLRQAQDGEQGACRGVGVRDLGGRLLAAIAVWTHPSGRQGPASHCHTVSSSSRTTGAPAPSPACSSPSSRPHAMGSNSPPHLGVHGGQVVGEARGDHGLVALGGGDVGAEQGRGQWGGARGRGGRALPVHGQHVLRQGQVGVQPRPVEDEPEDVEAGEQGRGEVDVLRRRAAHVVAAKGRVGGGQQRGARVQRGGDARLGDGHALLLHDLVDGGAVALLHLVELVDAADAAVGHDQRAALQHHLAGGGVAHDRRGQAHAGGALARGVHRTRADVADIAQELGLGHPGVAHQAGVHVAAQLHAVGQLAADAAHHAQQQHALHVLVAPDLGRDAGGQAPVHVALRRQRLDRGPRLPVQPHVLGWLFGDGGLCLRGGAEGERGRASSRGPGDCSAPPPPCPP

SEQ ID NO: 15228 - protein, 103 aa, Chlorella protothecoides
MPLPPGIHDLAQSTRIPALQHRALVLTFVVQWSSARCSYSCQLLLQHSLPLSQAVMALINDTTKVAPNPKMFLRTFWYRAIFKGVARADDMHVYILARYVEAL

SEQ ID NO: 15229 - protein, 115 aa, Chlorella protothecoides
MGGHGALIMALKNPGSFRSVSAFAPIVNPSAVPWGQKAFKGYLGDDKEAWAQYDATELVKDYSGRKQAILIDQGTGDDFLNKQLQPEVFQEAAGDKLALELRMQEGYDHSYYTIA

SEQ ID NO: 15230 - protein, 126 aa, Chlorella protothecoides
MPLVPEKLRARQEVRAALGSQFWGQEAASPRSIDGKTVLNPCEPVPLGLMAPSGLSRTQQLLAAQALGILALPSYLGDRGGLVGLGVGCSFESMRTMLPSPHAWVVWAQPQAPVAGCEHRAWLPLA

SEQ ID NO: 15231 - protein, 433 aa, Chlorella protothecoides
MEARDLRPMQRRLDAALQGAAPPAPSPGDEGAAARGTLHMALPGHELTASLTSGQEVVDATGVACVVPLTASLDLSSALDRGDGMQYRIGLHQALAPADSDGSGPLRSTQHVQGAVAVEGEAYLWRAGPRGGRKERAGAASDAGGVIGPEASTSTGMECSSRAEDVVQVLEVDPPRPVSESTHSSASGPAGDFAGEVAKGLDVAQPALNSVAEPAAPMVAVNAGGPQSPGAPVPLEAFIISKQGLEPEATTAPSNSSPAPRPSPLDALNAQVLSALGTLRRAQSALADLRAGGAEAWDLDALGRGTGAGRRAGEAPHSLLTPGPHLKLNGAIGCLGRVPLPGSTGLPLSRSRGQQVGEAAAAPAAGQPGWRASSASLASARGGDAWEPYLRSVPWWPGIGADLAHAQCRGKCRRRCSRLGAVWKGPASKAWAQ

SEQ ID NO: 15232 - protein, 78 aa, Chlorella protothecoides
MALPGLTWHVHTPPLPQILDRVLARIGGRTWWATLGSRMHAQRAFRQGAALDGPAMLRPLKDPQNYAACLRLHSQIAR

SEQ ID NO: 15233 - protein, 148 aa, Chlorella protothecoides
MNSNELNALVHMQRGVDPASAEQYGHPPSPNILPRTPQQAIVNRERATLEVDLDDVASYVKDGDLVHRMETNTQQYLSLLASAADEAMPAPTRSDLPDDIFDILLDQVLRRGWREGIIWRGRGPGGGRQCPCALPAGAVCADVELTRR

SEQ ID NO: 15234 - protein, 130 aa, Chlorella protothecoides
MEVDGRTGQSDPNFALPAALTRRFEVCIRPRSTTEHARLRQVGAAQIGHLVTFRGIVTQVTDVRPLLTIATYLDDQTGFEIYQEGIGAGRLRWLGGKRSWEGSGRGRALTVRGQAQGGRDHHGLPCCGEG

SEQ ID NO: 15235 - protein, 287 aa, Chlorella protothecoides
  MOD_RES (58)..(61): Any amino acid
MRLQTHAQTAAWPGRPVFAAGEEPEQHRPGAGAAHQAGRRHAQEPVPWRAPGVPWRRXXXXGRLAACSRACPSAGAWCTVASRSSAGTAWRQPTSPTRQPRRCRVSSSTWRRRGRGERCGAACAARRRMSTQALPLPSWLRREWQGLAREWDRLTGAKAKPCLTACEAAELRELSGKLREARLAGDLTALRFTLRMDLKRRSGYEAVQRSMYFPDPCPIPAHSDRLLDTGIQCITLPAEVEEYLSEAIQALQHIVGTPGETKGCFGGDHAAECSCLDFLAGLRSGTG

SEQ ID NO: 15236 - protein, 461 aa, Chlorella protothecoides
  MOD_RES (196)..(199): Any amino acid
MVDATENALRSSLFHMPLSTASVSSCRALIARDAASPVVTFLNTGTGAGGPVRGAGGPVRGRGNPSQPPDANRLGLETCGAPPPSDASTASTGQLVAMAVEEYVPRSILITGGAGFIASHVTIKLVKRYPHVKHRWGPSNHPSASIRPTGGCPGQARLLRDAGELEVHPGLPQLQVREGRDPVHGPDRAHSGDRGXXXXDTVMHFAAQTHVDNSFGNSLAFTMNNTNGYGDVMHAPLYAQSLCSQSAPSPSCFGSYGTHVLLESARLYGKIRRFLNVSTDEVYGETSLGKAEGLSEASALEPTNPYSAAKAGAEMMARAYHTSYKLPVIVTRGNNVYGPHQFPEKMIPKFILRAQRGEKLPIHGDGMSVRSYLYVEDVAEAYIIVMLKGTVRCGWVRGSTVSVVMCLPTTTWTQGTVRCGKDGWERRLSGMCLPTTTWTLVETCADVSKGGLRVRGSLFGA

SEQ ID NO: 15237 - protein, 453 aa, Chlorella protothecoides
MITPPYPALAPRYDDSSSRYAGGSSYGGGGYGGGGGYGGGGGYGGGGGFGGGGFGGGRGRDDINFTSLPQQDFRDVPALEKNFYYEHPDVTARSDGEVERYRAERDIHVGGEGVPKPVTTFEEASFPEYVLHEVAKAGFKEPTPIQAQGWPMALLGRDLIGIAETGSGKTLAYLLPAVVHINAQPHLSPGDGPIVLALAPTRELAVQIQSECLKFGSSSRIKSTCVYGGAPKGPQGNDLRRGVEIVIATPGRLIDFLEGRTTNLRRVTYLVLDEADRMLDMGFEPQIRKILGQIRPDRQTLLWSATWPKEIQALASEFLTKPYQVTIGSSDLKANHKIEQAFDFVSEHEKLPRLLRLLEREMDGRRVIVFCETKRGCDAVTRQLRQDGFPALSIHGDKTQQERDWVLAEFKNGKHPIMLATDVAARGLGEEAGGGGVYTHAPTPYAGGVRLRL

SEQ ID NO: 15238 - protein, 563 aa, Chlorella protothecoides
MPGASAVPPFTFFYPPLLLIPAALVHRGKVSFFRELRHAYGRTALVLSGGGSFGFFHYGVIKVLLNAGILPRIVAGSSAGALGAGILASRPVAQLAALVNMFPGDLDMNLLSNNTTPHILRHLVVKGEAGVGVALRREPVARRAASTLVRGIPLAVRTRLLLLHPSPPILTRRFRWRALPDGRRPIPPDLIPAHHPIPPLTPPGTAQDGSVFVERLKRLYGADLTFADAYAVSGRILNVSVCAADTREPPRVLNYLSAPSVLVWSAVACSSAFPWLFAPRELLARDPHGATVPLGAVGGGGGAALPRRWRDGSLELDLPMRELGETFNVNYSIVSQANPWLLPVIAAQRLLPAGLGRALETEFKHRCGQALTFFPRSPLLKMVGQPWGGHVTLAMPAAAFGAGQAARNLSPADIARAVREGQLRAWRALPVMHAACAVEAAIDAALAQLLAPSDSRDGAATAQHPLPRKIPRASLPSWLHLPALGLPSSASLEHELGAHGSLAASLASLDEEAGEAGGSPLADAAPDAPMSYAAGDVAAAEHVWRDLAELSTRSHSALDCIAP

SEQ ID NO: 15239 - protein, 188 aa, Chlorella protothecoides
MRSLLKNMSIDEVDAVAALSARGSLDRSGLWFGAGLGLHPAGSTITEESSGAAEGAARSASFEASVSGSEAAEPALRFAIEDFMPETALVLGGDKMFVTGSVRSAAGLWERHVHLKFGEEEVPAVVLNATVLKCNVPRAPTPGRVRLCVTLGDGVPVSNTVAFTYRHVEAWNGAPAPPAPAAGADVHA

SEQ ID NO: 15240 - protein, 320 aa, Chlorella protothecoides
  MOD_RES (189)..(192): Any amino acid
  MOD_RES (279)..(282): Any amino acid
MVMGHGDHMEWRHRQPIGALHPECPCGVAESQARVRPSPCRCREAQAAGPPFQLQDPGTNVLGPMACIQALHWSFASRSAWPGGLGGKQERGRRPPVDGGSRAWCRGCDQTPHPVPAQADGRRRDVAGPGRQPVWAGAGVPGEPLEGGDGGVGPAWRAGIMQAIMPQLRVHQRPRACGRPGRRATSARXXXXMQAIMPRLRVHQRPQGAGPARAKGHQRPGPARAKGHERLGPARAKGHQRPGPARAKGHQRPGPARAKDHERPGPASAKGHQRPGPAXXXXPSPSLGSLTVAPPPDPPDLPPTRRRCSPAPAPPCHLRK

SEQ ID NO: 15241 - protein, 440 aa, Chlorella protothecoides
  MOD_RES (63)..(66): Any amino acid
  MOD_RES (262)..(265): Any amino acid
MLTQLLEEGPDSSPFLPGALSAAEEYAAGVNGRVLPQDVEKVRWDQCQVESACFVLDIGAPSXXXXWRHGRTDSQDGMVPDLARPACCESFQLRPPLPALLTQCVLFITPRHIPNFARYVLKNLMRDWSEEGAAERAASYGRIMQEVQSIASRQAPGQVPLSILVPGAGLGRLCANLCSVRDRDAEGYGVLSQPVGAVSDQQPACRHHGSPSLRKVCHLCRWAIMCAGWRVCMHAWLAAPGCVGQPIRHHIPHKPPFAPTDXXXXCLAGGSWVRLLTTTPSHPPKTSLCTHRKWTVHPWLHSGCNHFTSASQLRGLAIPDVLPEDLTGAGTRGLRVWGLGFVIEQRGCWACQAGADSSLKKQRAYLSFLLPYPSSSSPAPGELGMVAGDFVEVFARPEYQAVFDVVATCFFIDTAHNVIDYLETIVAVLKARMAYRLALH

SEQ ID NO: 15242 - protein, 322 aa, Chlorella protothecoides
  MOD_RES (57)..(69): Any amino acid
  MOD_RES (229)..(232): Any amino acid
  MOD_RES (316)..(319): Any amino acid
MAVCRTEFVVEHAQHPQSVPPLESGDHVAHLHPIKMVYTIVDPDDRSACPARQGHPXXXXXXXXXXXXXGLSSPLQSIVSIFAEAKFRVLDNAGKRQRNPWLPPPEWESRLPTEWVFQYTRHERSASFLNPIPIFCRRDDMANGFRLHCSLHAATGRMFAHASEVLRDGTLVAHNIQVLGLQLQKYTVAGPTVDRSWRGGVERGGRKTGGEMGHTIWSSRKTREPISDXXXXGDGSHHLVLPQDTYANIRQDSLSPPFSPFSVDSDIVQNESALVDMVRQYLIHPLLDQAALAPQDSSLPEGTSGGDTSQTDTGAXXXXFSA

SEQ ID NO: 15243 - protein, 166 aa, Chlorella protothecoides
MEDADLREASDEDARRRAWLLHLESAALAAIDDVAMIDGEVPLLKHASSLPTAPGGGPVGVADRRRTEKAGELLQGLRGVVQGLQHGALETGLGERQQVRDNVFKPSHILPTMSVEQFGELEARAAAQRAQREEEAARERARAEAGRRSDDEDDDAAAKQKVLVWR

SEQ ID NO: 15244 - protein, 664 aa, Chlorella protothecoides
MSRGKRAAPANPAGPRSTAPSGPPWIVARRPQTARGGRRFTCARDHPLLLACLQGVTSLMERPLQHPAAPSPAPTALFPRSAHLIAVGYDQPAKIQRLDDVQQVVCLLPAPTLLLRDQGGPLLIVVPQHYHLAMPMSSGGVGGEKRQEQVQLDGASIPQPNQTVCHSAQAHLFVVLGEAVFTRVRRGDFACSILKALHPVLELETVCPARVGERPPLEDGPPCGGVRRNMSVFEGSSVAKTGQSATPRVPRCRLAPPLVQEHSTECQNCLFAQVARQVGGVQRVGGAEQCKRLPADVQVKEYWVIVVGIACSLPCPPGHRRRKRHDTSQLGCSPAHPLGLDKLLFLDLLHPLRHGTGGARHSEDIFDIHGPRANGSASAVGSLPPPIAGKSSTALLPLEHPLNVCCSLRTFFWRISPAFGVSEVKVPSKLQHLTGHHYATSIIHDMMPCCAQVEAVMLRMQFSQAHTGRSAHPQEWLFIYQMRTSSPLCILQELPNKRAVGFLVPELLQDYFVDPPHFTIVPNPSTMSETPKMVYKQLGKTGLKVYVLGFCEGCRCSGPLRSTGIACGAQGGFLTILTGFRSELRSLGFFWRPAGPRGGQGAAQDGIRCGHQLPAMPLEGAQRAAPHPDCIPLPQAEILMGKAFKELGWKREDIVVATKVFPWW

SEQ ID NO: 15245 - protein, 294 aa, Chlorella protothecoides
MEDLKERYYAVQRDLLVRRAFLLTCWDLEMLPACSGSLPVGRAGGPEPVAHEPLVRHPYNRQHEQERKKGLELLLDRTKEQINRAKAHLLSACAPSYGPPHTDTWLGHSCFVAASVLACPQLPPSPAQEEAESRVLAEAAAIESARKEEEAARRASAEHGACLGGGGSWHYGDEGSVQRSPRASICSSLADAGLWSACRLLASRHARHPFTHALLRNSSGGSPGPGGVPQEAASTAAAAGPGPVSAFSNEPELGVPPVFDESGKPAVPPKRAIVRGAFCRELAEGVAARLQPAK

SEQ ID NO: 15246 - protein, 78 aa, Chlorella protothecoides
MAELKVTEFPRAPTRAACGAYISLQAEVLALLELKRQLATNQALAAGNKRPAARMEGGDDGTPRSDKRQRVARKFADD

SEQ ID NO: 15247 - protein, 235 aa, Chlorella protothecoides
MEELSAGQATTLLRNEQEVDRATAEMEEMEETLLESLRDSIRSKAAAAAGGGEAAQKKRRRRDPDDDDDDQGGLDPLRPTATLHAEWSGKEDGFMYDRTQGTRKSRAKAARGARSGPQAADAALDAASLLARKALLEQERTALQERLDLARRDEASRAAGGAGVVATSEALPESAEAAPASGSSEAVVDSLDAFMTEVGSRLESEKVEVLTRQLAEVEEQLDQTQKLIHIADPEG

SEQ ID NO: 15248 - protein, 200 aa, Chlorella protothecoides
MPSTFPMYPYIGAGTHLMLGQSQRCTARVLVRLNRCSQQAGHGHHRATCMQPLTGREDTCVAQRPTLSCDQYNDGACCVPAPQRHRDRDQGDLGAGAGADSTARGEEVGKPDHGLGEYALASSPPCSHECDYGPTSLAGLPILTAARTKFTTSADVDEQVRTSLAAGESLYSVDRDLLRSLKPDVVLTQTPCSVSALVPP

SEQ ID NO: 15249 - protein, 86 aa, Chlorella protothecoides
MQRFPELSVSGIDLLNKLLTYDPSQRISARAALRHPFFSEHPLPKAQEFMPTFPSGAILSDGVWLGAQSPFGATPWRSLMIAGVVC

SEQ ID NO: 15250 - protein, 779 aa, Chlorella protothecoides
MLCSLSARSRRALGKLGWCRGRARGSARMRTRTPTRQRAGSHILGPRPESNGAVAHPAQSSADPRRRKTIPASVMAPAGTGLVPLLLAGLASRLALLIWAGWQDTHMAVKYTDIDYFVITDAAQAVLAGGSPYDRATFRYSPLLAWMALPNHLLHPSAAKVCFCAADLGAACADQRPGTAAYHQHPLPSTPDQVDGTPSGTQACSHCLGQGRLGGVAVQPLHRRDLDPGLGRGAGDVHAAGYAVPARRRQTPARWALLRPGGALAALPHNLCAALAAKPGHAAGGAPAEHPRHCVWGGGRGSLLDTGRSWVSPLRALLPPGDLPLPPWKGGPAPQLLALLPADSHSADISHGSIAMWMHGIVWKGVHTAHDHLPPPANINECNPCPPPLLRVFGAAQALLIAVLGWLHAADLPYAMLLQTLAFVTFNKVASMAMMCPRSGECYQWVGCHVALLSVLKLGTQLVHWYRSRPLLLPIPSHAGPIALGSRHVFRRHRPLACLGIRSGVPGMVGLSTCLGGGAGCVACQVLAAGLPDACPAGTGIRWLPADLRLMVGGGWTARLPPFPPVVCSKCAHFRGDWANSTAHGRHIHATSGLHAGTESSLTASQITQRDLLRCLEDAGVVRVSESYLDANNTRWAVSGQLNVAPEIAGAAVSRFQMAHLQEEGSNAPARTVHLLPAGTGRQMALVNHERAVCIMVQPLAQGLTPLSRLERRLGDSVPTVVSACSIIGTAAATASVFGAGFLLDGGPLSSDTLASLSTAGWGAFAVALILRSSGTVSH

SEQ ID NO: 15251 - protein, 490 aa, Chlorella protothecoides
MDSRREPLQALAGVVAGPYGPGMDQARKLGLSEVEELYAYDGGQDSGVVDKVLFIHRGMEAPGCEHAPAPLEHHPAAAIRSSVLTLSFLRSWRCWTDTPPERTVGSWASSWSCCAGGWAPSSSAGGTACTAGWALPRPLWPCPPPSARPRCWPGSGPAASPRSRRVFLGEPGWPHRERAGLDSGRRACIVASRTGPSSTWTPNPQAWTGVKKLVALCLMSKLEADGSSRAMRALGFPIRDPRSDPARTERAGRAEAGLEAAICDVASFSAASPTDVTALAARLQSLGLQPVDPARCAPPGTPAALLAGAPHLVLSADVVVVGSGAGGGVAAAQLAAAGLRVLVVEKGAWVPVDAMTQQGGRREGAAVRELHFRSSDPEPGVGCHLLTTPHATESPIFPQEDEGYSALYEAGGFMQDSRGVMGVLAGATLGGGTRVNWCASFRTPEHVRREWAAAHGLLCFTDATYESAMDAVCERLGVRTGGQDFRGGGG

SEQ ID NO: 15252 - protein, 46 aa, Chlorella protothecoides
MDPLVAAASVVAAGLAVGLAAVGPGIGQGTAAGYAVEGIARQPEAE

SEQ ID NO: 15253 - protein, 419 aa, Chlorella protothecoides
  MOD_RES (307)..(384): Any amino acid
PPPQTTPCLWGTWPRTSPTSSSRSTLGNFTRPCAAPRFAGLAGEGCRWGGCAGVGPGGCPCMASLLGQGRGDWGLCGWELRAGARLLAPAGEASSALPAKLAGVTPPASSPSLALPPHSHTLPACQVITDAGTGRSKGYGFVRFLSEEQRDAALEGMGGHFLSNRPIRVHLATAKKNANATTASSLQAPHPSDFDTSNTTLFIGGLSGGVTEDELRAVFGRFGDIIYVKIPAGKGCGFVQFVLRVAAEQALAAMNGQALGGGAIRISWGRSSSRAAGAAALGGAAGFPPPAAAAADPRAFSLYDPGXXXXXXXXXXXXXXXXXXXXXXXXXXXXXXXXXXXXXXXXXXXXXXXXXXXXXXXXXXXXXXXXXXXXXXXXXXXXXXGRPPPRVAGPPPPTSTTPSRRTATAWAAASAAWPA

SEQ ID NO: 15254 - protein, 107 aa, Chlorella protothecoides
MIMQCSADAPLHAEVWPGETMADLCGSNYTDYEFASDFYGPLQFLEIPDVVVAYYRFGNASTDLPPVVLIMGFSGTMKNWPITMLVDLAEDREVILFDNRGQGFSKV

SEQ ID NO: 15255 - protein, 621 aa, Chlorella protothecoides
  MOD_RES (53)..(55): Any amino acid
MVALKIEGAAQGQEAEQKGDTQHFHSQTATRNYCWRLKRVRSQSHHGNLIAVXXXQHGIVGILDPVKGLDNATNAEAQIRRALTIYRFTGTEQSGRPSHHLAPVACRGRPRNLLSLHELTDGLRGRYEVAWEAKRCAALGKGFASGIRLHSRQGTKKDCHSSAREEAQSVVPVAGRAFHPPTSRACREHSGRKANSMTDVADPVSRPTREDKQDGEPGLEAGPRDTRFEFDAPRYYDFGNGSPESTMDRPDDWFSTKATAGGKTGGAVGFRWAGLTHVHSMSRVSEPIPMYAGLRTPPGIAKDSNPPAPTTTPKASQVQCSRLSSRSRNFAKLRYCGAQTLATSHPIPKSSENKLASQPAGKASSKRPALASITNTVLDVEAATAAVAAVDEEQDTTIELLLDDGPIQDPPQGSAPAPEKGAGAQPSRPDPPVLSHGITGKAARAVVLPQQPEVPAPRRTGQPSHRAGPASQTARTPVEAGSQAQKKARVHGMRTRSAASEVRPGDFSHSVVGVSLVAGLEEPPSASPWRSRAERIAEFEGRQPARSSHAAARTRAGGRAGPAKRPRNEGAETGAGSGLTLPRSPALATRKRARPPRFKPREEVEAEEMAAMPPFRARQLE

SEQ ID NO: 15256 - protein, 489 aa, Chlorella protothecoides
  MOD_RES (138)..(153): Any amino acid
  MOD_RES (318)..(321): Any amino acid
MSQPGMQGPASRPLSARSVHTRVETDFRSCHHDAGVRAPICHLDGQSADVGSRWGWAIPWASWWGSHGARYYRLTTAAHAPIKSSSSHLGCCISHPLPLWYLQPLAWTASLPSSSASAPAFILQTPPANPPPPPPPHXXXXXXXXXXXXXXXXAGHGHLGRPDPGRVSRACTGLQARPGGAAAAARGCAPVCDQPRRAAGGGGLAQAGRGVRGEEPEDVRELLGVCHHGRDRGHLRDRHGQAGLAVGAAAGGLRPRARPWLPRRPHGFCVRVRDQERGPGHRGRLRVQGGGGGVRSGARGSPRGDHRRVRGRAAFRRXXXXEYVIKNGGLDTEADYGYKAAEGVCDPAREARHVVTIDGYEDVPRFDEGALRAAVARQPVAVAIEADQRPFQLYAGGVFDTPCGTALDHGVLVVGYGSENNGTADVPFWIVKNSWGGAWGDAGYIRLLRAEIAAPAGPGQCGIAMQASYPVKKGPNPPTPPPTPPAPPP

SEQ ID NO: 15257 - protein, 65 aa, Chlorella protothecoides
MSHTPQSTTHHKQVAHTDVVLDDVWSLDLSKLDGWTCVQENTGGEELKDLSDWESDEEDSDSEAE

SEQ ID NO: 15258 - protein, 119 aa, Chlorella protothecoides
MTTALSSSLQLATTKRASTCTDPAAGKSLPSRELHHSSHLPLTITSSHRSDLEQAAAAPVPETKPISNFGDGFAEGAGAFGSSILRGLRGVVEKPREGARQRGFQGGFAVGCERRWEKI

SEQ ID NO: 15259 - protein, 133 aa, Chlorella protothecoides
MHRDIKPENILVRGAGSSGIMLGDFGLAINTNLEPPMSRVGTLDYLAPEARGGWGYIGGAQWSTTGVHSIPIVQDTCRSPSLCITARIVKLTVSSTPVMPTGANYTLAVDCWCVGVLAYELLIGGPPFEAPSK

SEQ ID NO: 15260 - protein, 318 aa, Chlorella protothecoides
MLCSTSQARKLLHPGYLEFPSVNETCFGRAHEFVFAETADFEGSKSGLIKVGSWLNVNPSGLAGALCACIPARISTPPTRLTSLLQLDMASLEAETWFPGRHQFVGEPQFVPRPDAGAEDDGWLLACVFESGERRRGRVPGPRARVAAHCSVLACRGHRGWRINEALSQTPCGTKTHRKPHKPVRDPGCSSHRCGADRRRFAASPTAARSAWELQRHGIHADAWRRLGDPQLQCRALHAPFSASAWGGDQPAGDRVREGKAAGGTQWCTGMPPGHGGWLKEHSSSYQLVRQSVPFPWHHSGCSLLCADLECIARAPTR

SEQ ID NO: 15261 - protein, 184 aa, Chlorella protothecoides
MSKLTPALVGQLHPGESLGTVQRLDVAGRGITTVVGMESCTGLTRLDASDNGLTSADGIAALPALRWLSLAGNQVESIEPLRSCDSLEVLNIANNRLSGKVALGRLSRLKALVANNNAITLVGALDRCKELNTLILSHNAVASVSGWLAGAGPLQKLQLSHNMITDLGNALRSVVGGWGGGKQA

SEQ ID NO: 15262 - protein, 229 aa, Chlorella protothecoides
MQAPPLPRLCPSREATYTRIQKAEPFLPRHLSHAAKAFLGAALQREPSQRPSPSAMLRDPWITGLQEGHLARAGAATPAPAPAQDQSRSQPDDGAVAAASPTPPSSEAPSTAAPACVPLEGREDGADLIPAARRPGGATVILAPAGTKVRAGIAAEGPGKPLQALRKKLSGCCKAGREVRAEPRSSIAMVNTARVPGLGTHPVKAGVVGETGCTATRHKPQGRQAGPAP

SEQ ID NO: 15263 - protein, 369 aa, Chlorella protothecoides
MEASFSHEIPPTPTPTDPVPHVRYEAAALNAAALQLPYTALASLLHASPDEIAVMGSATLAWQAVVYGLAWTWRPGDTVLTGVNEYASNYLAYLQLARRTGARIVVVPETAQAELDLTALAREIAAAPRRPVLLALTHSPTNSGRIYDAAGAGAVARAHAVPFLLDACQSVGQVPVDVQAIGCDFLSSTSRKYLRGPRGVGFLYAARSAWDLLEPACIDLHGAEWVARGAYALHPTAKRFESYEISFASKALEAPCIPARCTASQCRLSATPCLLTILPISTPAVKVGFGVAAQEAVDVGMDTISTAIAKVATALRKGLQGVPGITVQDRGRRLGGIVSFTAVRKRGWQGEGLLRSSIEQGDDVVSTRI

SEQ ID NO: 15264 - protein, 221 aa, Chlorella protothecoides
MGLPDSQQSIAVSRNGTVYLLDGSGYLKVAHGSTRQPLDITIDAQPQAYLGPGRPLGFHLDGDDDLYICNSLLGLTRLPDGARAQQLLANSVPGAAPGSFSPIAYADDLDILLGGDVVFSDASAIPPALGRAGRYDTMRSYVLTVLQGAPSGRLLRWHAGSGETSTLADGLWFPNGVALAADGSFVVVAETVTARILKHWLAGPKVLEEGGIWIAWGACNG

SEQ ID NO: 15265 - protein, 188 aa, Chlorella protothecoides
MAKSALGWGLSVEQSVPALSTAPGHLSALRSGSLDLAARYAERYVSVAWQPALRALSSDSSQQLRGAAALPDAQRAAVKTVWTAVNAALDTFTSHPGIVESIVWQKRVREQVGAAFLPAYRAFFTKYEGVPFTKGRRSKYERYSLAEAEAAVQGMLSGAARAPLEGSPQRSGASMSNRLARFRSKLMD

SEQ ID NO: 15266 - protein, 575 aa, Chlorella protothecoides
  MOD_RES (251)..(253): Any amino acid
MSDFERRGVSQGCGTPACLNLRGARAVRRPGRQGVGRGQADGTASPAYAVPRRLPSPPPPAFSTDARTFSTLPSGTAGLYTNPVAILDFASLYPSIYRAHNLCYTTLVHPEDRVRVAGRGGCGSTLWGGAARLPSIPAVCGACRALRHAPSIPWRSEAQRAVLDGRQKALKVTANALYGFTGERDGACSARGGACSAVDGLPPSFLLQTAGPSPQPMLLLTHCSATQAADPAQPCHPSHSHRYTHSHTLLXXXSLAGLRRAPAASIAPSHFFHRSTTSRVGASCTCIGDWREAAVSPLTDRATAQGHFAEDQTTVTPTGDVFVKPAVRKGLLPAILAALTVARAATRDQLKATTRWGAGGARWGGLVTTARHCPQRELGCGQRSAAAGHLCRGWCVPSPSPPPFYPMAQRGAAGGAGRPAEGPQGHGKRAVRLHGPCHRSSTAPPPRLQTQLNHAIPPACIDTHTRTRSRRRTDLAAAVHPAGRLMPGLRRTGLPPRAGCPGKREQVWRAGPHRTRRTRHLRPHRQPVRGRVGPVPLALHWCGCRLKAAAALIGLSRPAGHEAWAGPAGREAWVG

SEQ ID NO: 15267 - protein, 780 aa, Chlorella protothecoides
  MOD_RES (123)..(142): Any amino acid
  MOD_RES (222)..(225): Any amino acid
MSGFMPAPLSTTEAASCLTGGGPRARPSDTGARLGRPSQPGYFGDAMRQPMLIYADSGPAHLTVRGRPHTTAPTWSSSQTGAVRTDWSHTRCSRAGPLMAMWRVGILLCVGMSGPSSPPANPXXXXXXXXXXXXXXXXXXXXDILEDDHGQFTIWGASASGASVLLQVQGFRPYLYVVAPAAMPGSAPALDWFEDRGLRESFRAAVNRAIPPDLRVAAVLAXXXXRGLRESFRAVVNRAIPPDLRVAAVLACDRRPLQYCRPADLGPAASPMLRLEFDPGTSLRRAAPALARCLASPGLLEAGGNFGAGTMFESEIGLLQRFLADMPVSGEGGELVGGAWLYVPPAASPKAGAPAPGYTLAQEDRRAAGFDIDATAPWQALTCLTPDATQLADAGWSPFPPGSAAAGSAAARAAAAAAVRGDLPPLRVCTLSTLCAPADGADRVALPEKGDPLVAICCLLTPLDGGAVQAKVHESETEGAEAGVAKTEGVEPPPSPSQSDDGAEAAQNGEESEAGTGPAALLTEAELAAGPRRVGLPPAPPGAAPPGSLVFTHSEAATAATMPDPASGARTLVFRSEAAMLRAFLAWLRAADPDLLAVFDAGRTLGALGARCAALRVDGGAAALGRAPPGSSRSRPLRLKRITTYSAAWVRSQSRMSSTSNQETLRAEPAGRHAGDPGAAGGRRAGGRRQRWAAAPGAVHGDARARGARAPPPPGHGAGHGGDGARDRPDPGPGGVPGADGAHAQPAPAHRRAARVRAAGAAGGGPAPGAHLHPAPRGEQ

SEQ ID NO: 15268 - protein, 366 aa, Chlorella protothecoides
MAGPDKGPLDLAMQQSRCPLLFLSPRASSACGARRLPSSARPCMASWSGSSCVATWSEREQVSTLEWWQGAGSWYSICAPPLRARSAIAFVEEEVRRLLSGRVSLHELIMTQGLWRVRWRWDLDPLGSLPVGLHGMSGLHPARVLFLAWVCLPGVMPAAIRIWQDTLGKTALVGSQGPLGPSPNHPPPLNQITGEQVSSAAAGDPAAAAEITGEQVSGAAAGDPAAAAEVRGPHASLAVRLVQRDPGRAFVLGERLPYVLLAGAPKQDDAAEDPVMAARSGARADYLLYWNNKLVRPLSEMLGHCMPPARVQVCLWGWGEGFGVRGLTRWVGQRGAARPGSARIHMAAELHGLLGCGAYCTCVHVW

SEQ ID NO: 15269 - protein, 250 aa, Chlorella protothecoides
MVQVTGTMNSGSSNSDEQLIDRRLTIRWGPTEEELIERQDTFNGSVPDETAAEIASLHGNSVRGSAGTCFAPPSPSLVVIPIFPNPAQAAQRRAITELLFFACVGDLKRCQRIVRLWNLKVRLARDVHLPDWQPRDLLSLSNLELLVPKFEQFHPPSSPPATHRQVAAPDCCDYDKRTPLASALSGVISPTHLRHLAASEGAYSVTEWLLAEGVNVNALDRFNRTPLEVRSVVQRCVLRSAHGSGAPGAL

SEQ ID NO: 15270 - protein, 273 aa, Chlorella protothecoides
MCADAIGPAFVRLCSVPSRPAWSDPAHPHTLPRAPPNPLCWPRSGGWKAEADWAQTLSIGEQQRVAFARLLYHRPGLAFLDEATSGLDAATEDALYTALAATGASFVSVGAWGSRGSCVEVKGTPGQKIFHAALRRGAEQPSPIVRVCLCLGVPEATALWNLISCPSELIHLPPNYAIRPPPAAGPVAHARAGGPGPGQVGAAGRGGVPRQQGPSREPPGVGRRQHDAAPAHWHAGDCVARKSPPGWPVWGGGVVSTGPVLRGPMPGSQAGTG

SEQ ID NO: 15271 - protein, 661 aa, Chlorella protothecoides
  MOD_RES (24)..(27): Any amino acid
  MOD_RES (265)..(268): Any amino acid
MLKGSWSEHEDYLTKLFPNTVEHXXXXLKGSWSEHEDHLTKFFPNTVEYTGENRAMAWRLAIASTALSIATTLLLLKLSYTQSNLSSNLSEKSECERGGIQDRGGAFHDLPAARVSFRPILSRLTPGPQTQSPSRLLLGRVGVCGSGGRCHPPLCPVRDHAVLPPGSGQPRPGAGKGGGGGGGGADAGEGGMRFSLGAIPLQTSHVRGRAQFRLLQRGPHGGPESQALLPGRLLGPALQHRAAHDVVPPGLRRGRHRGHRRCLWXXXXSIAPRMMWFLLAYAAAGTAVTAAVFGRGLMRRTYEVLRREADLRFQLVRVREAAESVAFYSGEAREAGVSHARLAAAVHAALRRVAWEAGLALWVNAYSNTTLLVGVEIGGGRRADATQGRPPTLLDCSTGDAPGHTRRIPLTTPPPPPSLPSSPPGPLLAHGAGLLCGPGALRRHHPGLLHLPAHRVRAVLRRGQPGRALRPGGPDRAPGRAAARACAARRPRRQRCARRGPRRRRAGAGGAVPVDSGRGPAPGGRPGPEPGGGAVAAAAACVQGGMYGRAREWGTCSEHATAALRPGRGRPSAFLDEQAGQHGRWVHETLEIQAAHRLWDEGSGTVRTLPRDSLFFLPQKPFMCLGTLRDQVTFPHVHTRGSATDLAALLAAAQLPDLLER

SEQ ID NO: 15272 - protein, 369 aa, Chlorella protothecoides
  MOD_RES (66)..(69): Any amino acid
  MOD_RES (181)..(183): Any amino acid
  MOD_RES (210)..(213): Any amino acid
MAGLASHLTVRPMLVPTRHRFSARLVPSRRQKPFVRAAYASGAGEDPYKILELPRSADSTAILRAXXXXGLALGWCIGGIEVGNMTPSSDFPPDTGASSFSRLHCHPEGLPEQAEGSQGQRKRDRQDRKCSLPNHDVIPQHQTSGRCNALDVRPLGDWKVPVSTAASEDETWTWSIAECLXXXQLNASLACELDALLGVAFYKCIRASLXXXXSWQSTSGKSDVGKEILYADRAKIFPWRPRVYPANRKLLMYSAIAQALFLAYGVFNPSLTLPIVYGAGGGGICVVYMARLSWEVMLTEQRCDVQRGAMGGAVGQLLKQNEINPPPPPGAEAGAGGGGWSRVSGQGQRWGQPVRTWDCCAVHGMMAVA

SEQ ID NO: 15273 - protein, 139 aa, Chlorella protothecoides
MVMPGGHKAAASLVSQYMPSTLAQGPGMLRPCRSFRPAFVGLHPLGGPRSRVPRRSPATAAATPYKPPSEEIASEGLPSEVRQRAETAILKRGGAVTVGDVAAVAGISLKEAEDALRALASDSLANLKVCGLEGSTRGA

SEQ ID NO: 15274 - protein, 131 aa, Chlorella protothecoides
MRSRRIRASHFPRCSALHDRRFPPVEAHELPALECTVSLLHSFETGGSWEDWVPGVHGIIIEFACPLTGGTRSATFLPEIAQQEGWTRVQTIDQLISKAGARGGQASLRSIRAGLSLVRYQSTAASLTHAQ

SEQ ID NO: 15275 - protein, 140 aa, Chlorella protothecoides
MVESIALLPNLPVHGFVGVNMYVDDEGSIREAPFNARASELATLCGKPLQVRGDAFLSRVLDDGEAFRRLDFGANDLSSSAPWVAAARAKNAEARRGEGAQAILQRMQAEGAGPGPASSPSPADALKQQGNAGVCWGGMG

SEQ ID NO: 15276 - protein, 106 aa, Chlorella protothecoides
MTTAFKRCEWETAVRLYTQALEAESGLVAARNNRAQALLHLQRWREAGADAEVVLAAQPDNAKALLRRAAAAQALGEHAAARADLEHVLVLEPGHREAALRLASLT

SEQ ID NO: 15277 - protein, 106 aa, Chlorella protothecoides
MPLPNPSASPFTVTPPPRTARFGTVVAAKVLKASSEIAVNDFRAEIEILQRTATAHPPRLPHPSCPVPGSLHGKGAVHSGDRIDERRLAGRRLPYAAGVDEAGQGG

SEQ ID NO: 15278 - protein, 115 aa, Chlorella protothecoides
MAGNIIHAVATTNAIASGLIVVEAMKLLAGQSKACHTTFLLAEASNKKLLTPMQSPEPNPNCVICGKAQLLLHADLHALTLGDLITQVGMLDMIGVGPSCCLAGSMALLSRPRRQ

SEQ ID NO: 15279 - protein, 206 aa, Chlorella protothecoides
MRAPCRLSCDVLMRREGEARHPGPGRAGDASAEAATTAGPALLRRSGEPAEEYALRVFQAVFVADMERLAGVEEMWKGREPPTPCALDLAAVGERVRLAEESAAGRGPGVAASGMSSALGLPDAQRAWAPEDSAAVFLASVRAFLTHRAEEVGALRFDKDDALATEFVAAAANLRSHCYGIPPQTLFEAKVCGRVAGWIGKEAVGA

SEQ ID NO: 15280 - protein, 187 aa, Chlorella protothecoides
MRARGHLAVPGLGRGQVAHGPTPSLTHPPPSHVPQAYAFSFFAIPALRALSLRARNAGIEARNQARLAASRRLRAPDPQLATKLRAAQVEAQQRSFQRDRVVYATDTPLPTSSRDEPDEWEARLAARQAARGRGAGGRRGAARRRGAGGGGGVPEQRPGAGEQPVMDRKGGSQRQRGRDLPSWLRER

SEQ ID NO: 15281 - protein, 213 aa, Chlorella protothecoides
MRRALEIALDAARGLAYLHNRKPTPVIHRDLKPGNLMLSGSQYQDRAQVVFNTGVVKLADFGLSKTLPTNRHANFHLDERFKLTGETGSYRYMAPEVFRHEPYNSRVDVYSFSMIVYQLFEYQPPYADMDPVEAARLAALENARPNFITLAQPGPHKKELRELIERCWAPNADERPSFPEICRIIETLLAQIPRQEYQSSGAVGGDAGCCVVA

SEQ ID NO: 15282 - protein, 88 aa, Chlorella protothecoides
MRHLFPQDAVRGDFNLVASLLMKAGGKVHASGKLIPLEDSELVNGLGFRAPQQKASGFALEWELDPSTINIREKLGEGEFGVVHRAKW

SEQ ID NO: 15283 - protein, 175 aa, Chlorella protothecoides
MVAPSEGGAIPWPLGATSYAMRTRVRMGADLIDLDTIETSNLNRQFLFRQQHVGQSKASVAAAAVQAIVPGVSITAHRANVKEARFSADFVSGFDLAIVPGVSITAHPANVKEARFSADFVSGFDLVLNGLDNLEARRHVNRLCLAARVPLVESGTAGYLGQVCRRRVRVVDEAT

SEQ ID NO: 15284 - protein, 127 aa, Chlorella protothecoides
MLEGQVGNTTSIAVDESYVLPVLTRFGGSPVVGQDGEILYHFPNLQQTAAAQRLPAVQPKLVQERPVQLTQANGGQKLVAIALGAANLVGVVALGGMLGSPQGYYALARNGLGWIPNAMPFLQVSFG

SEQ ID NO: 15285 - protein, 851 aa, Chlorella protothecoides
  MOD_RES (317)..(336): Any amino acid
  MOD_RES (552)..(554): Any amino acid
  MOD_RES (586)..(589): Any amino acid
  MOD_RES (711)..(713): Any amino acid
HAARPGAGAGPAVVVPPAPSGATSTGGGSLAGLRADSGSGGDRQEGARSSKRAIKNRESAARSRARRQEYTQTLEAKVAELQEANRLLREQVLTAAAAAAAGSGHAGAPRESGAANGPAQVGVKRARGGQAGPVALTGSVTLSQPCGDKRKFHPSFLDVTPRCSSGGPGPHLVTITLHSPPHFSVCDTQGQFDGNQGENVYRCVPWPCVGGCPSLSTGAPASARGLTMRGCRLSHARVQSPARGVSGWDPRLERRGASCRVGRGVAWRRLVVMAGRPKSARWVDVGVVDPDLELRAHIASLPAARLPLPPTRLPPPXXXXXXXXXXXXXXXXXXXXGYFLISASKDSSPQLRNGETGDWIGTFQGHKGAVWAAVLNDSAFLAATASADFTARVWNAVTGDELHSFAHKHIVRTAAFARGQDSCKLVTGGELWLYIAWLAAGRLVVGEGWVSEWLEGLPLPFVSGPEARGPEKLLRVFDLSRPDAAPETAALASSPEKLLRVFDLSRPDAAPETAALASSIRGAAWIHDNKAMLISYSDKPNLEHSAPARLAXXXVAAARHQRSPAFRHPSVLSSCAQRAGHADAEXXXXCLHETAGRLAHPLVLDTRTLSVVKTLETAGPVTSIDVTDCGRFIVTADGSQVGAGGRRGSGAVFEKEPGGATARRGARPLSRGAIASAGRRARVAAGSHSPKCIFTLSTPNSTHNPTASQVXXXLPPGPHSPECIFTLPPLTSTHNPTASQVLLHDGTDFAVKRTFRPSGYSVEAAAYAPDRGKLVAGGSDMWVHVYDETDSEVEAGRGHHGPVHGVRFAPGHATFASGSEDGTLRIWQTEPPAAAVAAPVAAKETRDGQGV

SEQ ID NO: 15286 - protein, 298 aa, Chlorella protothecoides
MRTTADSPTIGLVLQRSHLVTGDEGHYSGVVSELEARGARVIPVFAGGLDFSLPVKKFFYDPLKPSKAHVDAVLSLTGFALVGGPARQDAPKVPDVVDLSCVCVFWWWVLNRYPGTITQSLVLLYLFDSVSPSSGPAQTAITALKALNVPYLCSLPLVFQTTEEWLESQLGVHPVQVALQVALPELDGAIEPLVFAGRDAGTGKSHSLPDRIESLAARTVKWAALAKKPVAEKKLAITVFSFPPDKGNVGTAAYLNVFGSIFQVLKELEEEGYDVGEMPADEKTLMESVLNQVCVMRG

SEQ ID NO: 15287 - protein, 330 aa, Chlorella protothecoides
  MOD_RES (238)..(241): Any amino acid
MSGECYPDSLIGSLPNLYYYAANNPSEATIAKRRSYANTISYLTPPAENAGLYKGLKRAVSIKESDLNVSRTVLASRESCVCSCPQCALINPCLSHPPIKFQELKELISSYQSMRETGRASAVAASIIETARQCNLDKVWRCVGGPTCGSFVHWQPKEAVFTHTHTSSSSSVGPNRMWSCPTPRPETSPWRTGTLSWVRGNPELCDVVVGLEPPGLMAYIPSPPPPFPPLQARCTRSXXXXLGSTVHLSVSIDPLMCPCIPTAWADCLHPLPSSPVSTSPGKVYQKLMEIESRLLPCGLHVVGVPPTAEEAIATLVNIAELDRPGEGAGP

SEQ ID NO: 15288 - protein, 221 aa, Chlorella protothecoides
MPLTSDADPPIRGLPGILARAAGRSIEEVYAGSNRGVLKDVEDLALITDTCREAVRAFVSGQVDSAGRVKRSTTGGGLGRMFGLEREAWLAPLKGTPFARAKREELRTLFDYLAGCLAKIVQDNELGALKSALRGEYVEPGPGGDPIRNPGVLPTGKNIHALDPQSIPTAAAVKNAKVVVDRLLERQRQEMGGNYPESIAVVLWGTDNIKTYGESLAQVSW

SEQ ID NO: 15289 - protein, 148 aa, Chlorella protothecoides
MEDAALPGWVLPVTLVLGAIVLAFIRVWFGIDEKKNRKYAGKRAVATKPIQKPLGRYTKEEVARHASESDLWLIIRSRTTGVAGVYDVTQYIEDHPGGDAIFTHAGGDATEGFHGPQHPATVHDLVREYLIGTLVEGGDAGVSPVTTS

SEQ ID NO: 15290 - protein, 238 aa, Chlorella protothecoides
MEGTAILLRCLRHPFLHTHTLAQVCVEIVGYLLEELRDATNFAHFKADVADANIFIGSLIFIEDLADKVVEAVGPARDSLDACLVFPSMPAVMRLNKLGTFQMSQLGQSKSLIGDFMKNARKNNDKFEESMLKLVRTLPKVLKYLPSDKARDARNFVNALQYWLTGNVDNLENLILSTSQAYVPALKGVDFEAAEPELLPDVGIWHPLATHMFEDIKEYLNWWGGWCFFGGGRGGVEV

SEQ ID NO: 15291 - protein, 238 aa, Chlorella protothecoides
MVGVRPVPDALGRVNKLELVSLEDLGRPRIDVVVNCSGVFRDLFVNQARVGGRNLRGMPCSCHCGALPAVPTPQDPASTSRLPQQEPLTHPPISNPPPHPNPKQMALLDRAIKMAAEQDEPLEMNFVRKHALAQAEETGRSLRDSATRVFSNSSGSYSSNVNLAVENSSWSDEQQLQEMYLSRKSFAFNSDRPGAGGEESRDIFVSALKTVEVTFQNLDSSEISLTGEGGGRWWAGGG

SEQ ID NO: 15292 - protein, 303 aa, Chlorella protothecoides
  MOD_RES (116)..(119): Any amino acid
AAWRGEVPPDSSTRSTTEASSTCRPGTAASAACIAALYSARSIWARGPRTAGPLLAFSMRNWMPASSATRPCCVFKGGRGGGIMDLRRSVPVDAPHQCPLACKPAFQFHHLMPATXXXXGGGGIMDLRGSVPVDAPHRCPLECKPAAQFHHLMPATHLRAQAMPTTSPLTPKTYHEPIQSVDLPDQGALGQAPDAGVAAHLPDCGGGGGGDEQGAGTPPSGSGRSLAPCVAPAHHDDIHVAGGGEGSYRTRGMPGPGPRHPEHARTEPVRWEGSEVSSGAPTGLMHAPQHPPHHSHISRLVED

SEQ ID NO: 15293 - protein, 99 aa, Chlorella protothecoides
MHNRISIYQGDVVLKNLRLKADALSELDLPVTVEAGLLGSLTLKVGCWHAAGATNSVCLESTLTPLHTPASCLGAMERAGSGARGSAYGPPVFARKAQG

SEQ ID NO: 15294 - protein, 159 aa, Chlorella protothecoides
MFRVARPWTRHPPRPIRAFSSTRDVDVIVVGGGHAGCEAAAAAARRGARTLLITPSPSATIGEMSCNPSIGGLAKGTLVREVDALDGLMVGFGGEGRGCGHSLGSEMRGGHEVVELSSRLAFQRASRALVWCINRDRPPQVHDAASPAPLENATGPRGG

SEQ ID NO: 15295 - protein, 428 aa, Chlorella protothecoides
MLMFRRLAHAEVQRERKREARAASRAAAQQGAAAGWVSWLTGRAAPATGGGTAGSPDAPAPDDPDMRSDFSPDEFARLVDLVGDQEEGLVYGSASPHSLLQRLRVGVGSASAELVGRDGRRVLRGGLDGIALELRKFPKTLAVGLRVAAMGVDSPEGVFVRTGRGLSAGTGGEGAGGAGSGEAGADGAEAGGAVADETPPPPEEEALTVTFVHAPQDGSADAEVGVVLRPSYVHYSAPTVARVAAFFRAPEALDFSNLQLAAGGQLERARKAAAAYAAAAMQARPRFNLRLQLDAPKIAVPVSDADGDVCLVLDLGQFVVSSDRGAPRGLSPDQAALYECVRLEGSDVAAFLGAAGHTPRSPTAAPRPPRIPLLERCGLSVAAQLSRFPDPDRPAVRLQPAVPSLRFHLSPGRLRALLRVLRAVAPGE

SEQ ID NO: 15296 - protein, 146 aa, Chlorella protothecoides
MHESQWLAELERLDKAKEKAEGGGTGGGLFGGGRLKNVIDTVIANTLALGGRLQFTDPCTPTSPQTFSLHTGPLPTPGNLQLSITNIHVRYEDDVTNPGHPFSCGITLDKLAAATVNDKGEEAFVTTTPLSLLRKVRGGVFGLFAS

SEQ ID NO: 15297 - protein, 287 aa, Chlorella protothecoides
MSDPLTAGYQVGRAVVTGATAPLIPPCRGSNSSGFSMRGAIHNLRHPLAVSPSFCLRIGWFDLLLSVRPHPLVADVLPPCAIEVILREGLWWRRWRFERLRPPRGYTSGDAHTLLPFLTPRRHPARQPSTRYRVQSESPLAMKCAFGAIKDLRVPLRNEPGPAGRPAGSELSEVPRRQSPSPCPSPCDLQIWEHRAPSQGRQQSQGHTEAGSVRSGPLGSLVLPVAAISLKSFQKCSGASCQALLGVECLRRGEAACSADAMGNIGTGNIGWHNFGSSNVGSRNIGK

SEQ ID NO: 15298 - protein, 118 aa, Chlorella protothecoides
MVNSGASTPSDFVRATSTAAARAFNIYPRKGSVAPGSDADVIVLDPSVRHVISAATHHSAVDVNVYEGMEVTGKCQCKNGAGHTAVPDAVQPPPTSSHMAATATMLLRGATASGMAVI

SEQ ID NO: 15299 - protein, 126 aa, Chlorella protothecoides
MATVAAQGINSFKFFMAYKGSFMVEDDALLRGMERCAALGALAQVHAENGAAVAWGQERVAARGVTAPHGHALSRPAALEDEATGRALRLAGLAGARLYIVHVMSGGAADEIAAARCANERGGWWR

SEQ ID NO: 15300 - protein, 118 aa, Chlorella protothecoides
MWDSNFTVAAAHVMSPPIRSTTHRASVRQALAGGVLQVRGLLEGEEVLRGSKGEGWDGPDMGGPGEVREVLNSSPPPAPPAPRKIVGTDHAVFNSTQKAAGKEDFRAIPNGVNGIEER

SEQ ID NO: 15301 - protein, 118 aa, Chlorella protothecoides
MQVLDATGKLVMPGGIDPHTHLDMPFMGQVSCDDFARSTPQRGKRCGIPTPQHPSTPHPPRRRSGQRAALAGGTTMHIDFVLPVEHDLLAGLEAWRKKARHGVMDYGFHMAVTSWSNK

SEQ ID NO: 15302 - protein, 98 aa, Chlorella protothecoides
MLSACGQAWRWGWLLTGTFAPASSPNSTAQASSLSETLSTLNFGKGVTEITLGAARKNTEPGAVFEARDAAGRHEREAAAARVALAERSARCEELEGE

SEQ ID NO: 15303 - protein, 92 aa, Chlorella protothecoides
RRARRRPPCPGAERLCAPHPPESERPSAPRPPTRPPHQPRTPFTSRIPALQVLLSQVHRLRALVLLGRFLDMGSWAVDLALSGAPGVDGRGS

SEQ ID NO: 15304 - protein, 512 aa, Chlorella protothecoides
  MOD_RES (19)..(22): Any amino acid
  MOD_RES (135)..(137): Any amino acid
  MOD_RES (275)..(296): Any amino acid
  MOD_RES (325)..(328): Any amino acid
  MOD_RES (499)..(502): Any amino acid
MPRGSSREFLWGHRVTQTXXXXTLWEFQRILVGPQGHSDGTCRFPGPGAPWQPNPLSILIPGPVLSPATGALYAPCTCAARRSPGPCGPPLPLFGGNMAELLEQHFSPLASTPKSQHILKGTAECNGMCIMEWAXXXVHLATSNRDVDGEMPCLLDCLCGSPLASSSKPQHMLKGTAGCNGMCIMEWATPEYVKELTPEFYYLPDFLENGNAYHLGTRQYLMGWRRRDPSARCAVLILGCIQVAAVQSEAFPCLQPFYCLRPFLQDGVRLGDVQXXXXXXXXXXXXXXXXXXXXXXVDRLGVWLQAARCVGRSVEHVRVSVCAWXXXXSLSPTCLLLAPFPTGWRAAGGRSAARMGWDLAPHLHPRHAGGAGGAPRLSLHAPLDRLGVWMQAARCVGGCVEHGCMPVQSTHPYPAPDPLVKSQVHKHTPSTPKYQALPLWRLTIPSTTSPTRIWWTWIELPTRCSAPRWPLRSGTLARRPASCFPGGRTPPAARPPPPXXXXLLTPRSNPNP

SEQ ID NO: 15305 - protein, 542 aa, Chlorella protothecoides
  MOD_RES (79)..(82): Any amino acid
MCCLGAWIWTWISRPAAGLPGCASSYLTGAYPRARSGERRLGQPGTVWAGGVVAEGVYYRSMEIPWETQCPSPQACDLXXXXLTIARWESLGRLDAPRPRPATCAFPCPPSACRLERDLGIRLSLDPATNKYFPTTNSAKTVRDALLGACLRAGVRVRYRSPCGAPVPAGGGGWALGLAAGAATAPRPAALVMAAGGASFPALGTTGDGYGALGALGHAVRAPFPALTPLTGRHPGGARLAGLAVHGAALEARRPGSRRALQVSPRGDVLLTHRGYSGPAVLDLSHHAVRAGMVRVGEEALPKGKAPRQAPGAGEEGGLAGRRHSRPLAAHLGTCPLSSEGSLLATRRACNQASRRLTITSSSLFHRTPSPLPQPRRPLPQLDGSGPAGLGGGPARHARRQGRGRHAQGTRRAGAPGGRAVPGGGRRARGEAGEHHPHPARGPAGDPGGVEAARQRRRGFCQGGWVEETGVACVSLGMHRGIGLSLRSCRTPCWTPRILKPPALPHAHAGRGVRRGGAAGGGALVDPGERGRALPVHMWGAA

SEQ ID NO: 15306 - protein, 697 aa, Chlorella protothecoides
  MOD_RES (34)..(37): Any amino acid
  MOD_RES (341)..(344): Any amino acid
  MOD_RES (408)..(411): Any amino acid
  MOD_RES (672)..(675): Any amino acid
MNTNADCLRLPPTTCSRSPPPSLHTETAHSGARXXXXLDLSKSSSRLLGQSGSLYAWTPIQSAFACPPRHTAGHHHLHSTQKPPTPEPDPKNEEFVMFVRSKKLMKWVPLSIMKGGTAANMLVKSMQGNLGKKMYTNTLIRNIAQGLYKVEWPGRARCRGCRGMLQATAACWRVFCIGPIDSCDACCAVCPSMCPRGSTLVPPNPSMQDRLEVERQLRNQYPFFKETKEFEYAFKIRYGERSVFTGWDGWAPLPNVLALMRSAAREFWSHTIQFAYSRCTLAEPVTPPCHLPGTRPSPRSVVWALLIADSPGSVACSLLHWCSGPRMSQPSVALWPASTCXXXXSPVPCCNGVQDPACRCRVLRSGLPAHARQEGEREDATTNILAMKEKQCESLTKGSSAYTVVSSXXXXPTGHERKTMRVAHQEFQRLHRGQLLVLGLGQRIDAGDVLIRQLLHGILQVLALVLPDCTFFLTLLYGLHRVAPHIPAEVARGAYGVKPKDTRRCEPAAPYGHLAFLGQLGNNFGHLLAPVLRWHGERLSVRGHRSLIRARQSERAGRLTPPWVAGGMLPSQAPHSVPLWPHRGERRDLEPDEAAIVVGGEAQVRLHYGLLDHCNGGGVVRLDDQQGGLGGADACQLAERGRRAVVVHLAVWAVRGSNQRSGVGTSTRQGCXXXXQRVKPALLGWEPRPDKAAHLSR

SEQ ID NO: 15307 - protein, 538 aa, Chlorella protothecoides
  MOD_RES (366)..(369): Any amino acid
  MOD_RES (491)..(494): Any amino acid
MTRSRAAGLARPVRTVPKLRRVASIVFSMRSIWEECKGMRGNGIATIAPADEPSNSRDLGAYQAAHTGHALLAPRLTVSSSMSTSTASLPVACRTWDVRFAGEGMSRGMMRRWAGLRDRAPVTEDAASHFMSNINFIPSSGVDTVAVATFDVEEDCMVALAGGNLVVSEFLLAHKDLEATVPGSDPNAIRLPRRMHDGPGVIVKNARGTQSFVIPFVPNSIHSSMPGGEVVAPLKSLYWKSCAPAMCPMQCRNSMEVRATHGDKGHLPQLGTQKASLSHNLISEACREGSLPRLVKMLVVFGKQRKSLLSPTKRKNTLMVTPEEESFLASLLDNLYSSLPRRQRGYVQEHMFGGGGNGIAYLASDXXXXPFQAPSCHPTFPSLDEHLSYPPQAPTPPHGCLGPAPHLEILSGVLHGNSVSSSSSLRLDPLEDIEEASYILQKYEDDWCTDIVRERPNFSALQVFQGPFAFVLFDRSCLRIVAGRDAGGEEXXXXDRSCLRIMAGRDAGGEEPLYWGAALLSDGLLFASDRQGLWVSLG

SEQ ID NO: 15308 - protein, 811 aa, Chlorella protothecoides
  MOD_RES (534)..(536): Any amino acid
  MOD_RES (595)..(598): Any amino acid
MCVHEAVGIRRKSGIPRAKTSALCVRGSPSRVADVWPQDAGEWAGTMLSVWTEVPCIVHRGAGVHPQLHCWDEYKTKDCLWDKAAMTSSQAKMGVHEAQHAVPSIPRMDIGAAPSGSGPLPTRVRLRRRGSGHTRSGPGVAVWPRPRGAAHPRHLLRYQCQAERARPRPGHLQHQGLADAVPQRGDEGLGGGRRAARRASPPRDHVPLAQAGAVGGRPGRHRRHQDARGHVREPRVALAEARGAVPRQLQHLDADVGPDDAAVRRQLAHDVYRGVHGDGEGDAVGGQGLHAADAHHLARQVEQRPAAVPAVDGGVGLDVVGARAGQAQLRRAAVDAGDDARGDAVLEVQGGAQGHHPLPDAEAGGGAQPHAGQRRASLHAHHRQVRDGVGGDHAPLKNAPVLQRYGHGATGAGGGAGGPAAAARRGQRVRHHVRVGQDGAIGVAQEAGAGGADGEGAAADHHDVDHAGGGLGCRVRDEVGGEAGGPGSGLGQGAERRQVPWWSRGRSEGASSFMKGMRSVVVGGSTGWGARTLXXXGGRSEGASAFMKGMRSVVAEGSTGWGARTLQKVSLFPGASPLHPRRSSRDPCDLPLAFXXXXLHPHQHTRAAPASWWERADAAPGVEDGVEAAPPCCATPSLSTGGSPAECRCRPAPRVQPRALAPLGQPLPWRASQTTAGAIAGPGAAHPWTTGASLGGSGGLSAPRREQPHTKAESLQAWGFALHLGASRHLQFSGYRAGNFFVAPRATMCSQGEGFDPRDTTLQIQSPESPIHIPATVEVGQAQTLARSPQPPAKRLAIALQHILNPLPCLT

SEQ ID NO: 15309 - protein, 82 aa, Chlorella protothecoides
MPPQDRRKEMTKIVAKLAEEGKVAIRNVRRDSMKAIEKREKESAIGEDERKDLEDAVQELTNEYVASIDALAKSKNEELTTV

SEQ ID NO: 15310 - protein, 99 aa, Chlorella protothecoides
MEKTMEATRRSFGTVRTGRANPAALDRVDYYGAPTPLRQLAGISAPEASLLVVQPYDTSAIAVIEKAIMQSDLGLTPNNNGRLIRLQIPALTSVRPEGH

SEQ ID NO: 15311 - protein, 218 aa, Chlorella protothecoides
MRSCAEFWSGRQRLDARRWGQQGRATQSSLGRRVTQRPLIPCSSSAASIPPPSPSSTGDCGPGGLVPEPRLHRPHCGARTPRRAGRLGGLPPALRPHRLLWPLQHVDHLLHVCSHHPSPPLPRPSRTQVLRHDIGDKKTVGTVSEAYPHLILDNFSSRLGSRVSNILKHLFPVPKLDTKRVITFANQVDGEGLGLATWRRPANGSMHMAIPASVVQLL

SEQ ID NO: 15312 - protein, 353 aa, Chlorella protothecoides
MSTSPSPSTQQEANTSFKIRGVVEGLLPDTLRRIPIEKRFNRAYVREICREADGSQPHLVSPERGIRRLVAEAMLLTNDHVHRFVDEVHGVLQDTVREAARRSVLAEAGLGATPGMEFLRLKGFENAVVVAADRALEEWKAEAHKVASTMVAMECDYVTPSFFRELEREWQEAQHGGAGGDGEEGAGGGAGPGAPAIRDAGDDDDDDSEDGVADGEAGRGSATPGSAPPPVSTAPDLKGGWLDKRSGDSSSLNALPVDSWKWQRRWFVLAGAAGVLAYFRNPEEAAGRTAQPRVTIPLKACVVDDFAAAPRAGGADALLIRIAHRDPAQPVAKAHHSVVLRAADAADKTEWLA

SEQ ID NO: 15313 - protein, 137 aa, Chlorella protothecoides
MQTLVGVLGLPRPSMFLHSAGLSHQARTRQTLATSTELDADEQEFALLWNVWLRVHKLYRDADMADTCRAFFAHYVDLQADTPMRRCFVSHLLMLWSYRLLSPEDVQRVLRLPVLSPALGPSQPLLAAQSAPSLVQQ

SEQ ID NO: 15314 - protein, 186 aa, Chlorella protothecoides
MLRRNARLRKEYLYRKSLEGKEKEQYEKKRLIRQALAALSPACTLAHAPVPPPTPPADGKPIPSELRKEEATLRHDVALEDDNTAVPRSHVDDEYARAGERDPRPLITTSRDPSSRLVQFAKELKLVFPNSIRINRGGNVSQRMRGGGTGMGQDGTWAGHGMRGLGKALEQGPPQTVFCTCLPGSR

SEQ ID NO: 15315 - protein, 537 aa, Chlorella protothecoides
MVGWSYLHLVLGFDAAVYTIHTWLDARQLRALRRAHPPKELAHLYPAPQDYASKQAYSLDSLCFGMARGAFDSALSAALLLSGFLPWSWNAVGHLLGGAHRPIAQAVLWTLLTSGLNATLGLPWSLARTFGLEARHGFNKTSPATFAMDALKSLGLGLALGPPLIAAVAFILERAGPWVALHLWAFLLAMSMVLMALYPSVIAPLFNSFTPLPQGQLRAPPETSGHSIGGKDLVLVTQPGGGLVHPFLPTRSTPTNKREEIEALAASLHFPLTKLFVIDGSKRSAHSNAYMYGFWRNKRIVLYDTLIEQSSVPQAGGWAEDRNTLAPTLKPIPAALSSAPHTQVVAVLAHELGHWALGHTPRLLAAAQVQILGQLALFTALRASPTLASSFGFDPVTSPPFIAFVLFQYLSGPLDEVRGGRGPGGKLWEWGKEGKLKTSREPGARRLCESGALGCLNNYVTRRFEFQADAFGVAQGRAEDLKAALLVLDKENKSPPHTDPLYSAYHYSHPPLLERLRAIDAAVARGGSCAAEAKKKE

SEQ ID NO: 15316 - protein, 161 aa, Chlorella protothecoides
  MOD_RES (39)..(61): Any amino acid
MPTPDVRLYHRAVVVAQDVQGELRGLVRQLSIDQFENEXXXXXXXXXXXXXXXXXXXXXXXARVAGRRRGGRAAGVGAQPHPAFRTRVLHAGERTCLAVLGRGGRRGAGVGEARGRRGRGSRQGQRVGRTWGLGHRAADVSSVGGRLCAPRGNRGRGGILV

SEQ ID NO: 15317 - protein, 183 aa, Chlorella protothecoides
MQTHGMHKQVLRELLIPRHWRPPESRDFFLDADAIHTLCDQAEAIFQAEPTLLRLRGRCGDFGRLERGKGEGGTRGQRDLPWGSGVCGIGSARGCMLVTGLVDSSRSRQACPPAHTTTLSQIPPKLPEPTAPVKIFGDLHGQFGDLMRLFEEYGTPSTSGDITYIDYLVGVGFWEGGVLWQEN

SEQ ID NO: 15318 - protein, 722 aa, Chlorella protothecoides
  MOD_RES (77)..(79): Any amino acid
  MOD_RES (406)..(408): Any amino acid
MGNDSKGTQHGMAGPACSEGACLHNHCPALVGACASGHLQLQDGTGFGVLVHQAASLETVGDEVYVPLLRGLVLPLXXXSLETEVVDTTGAGDAFLGSLLVSVSVGASLEAAAKLGTVVAAAKCTELGARTGMPHLAQLHPSLQACENPKKSKGLVAHCSLSQTVSLPAQHSAWQHPGLLRHTVQCNTIAAAPASQAPPQLCFCYIMRLQAGTQVNDGRMGGREGGSQHHSHIGELPWEVPSSSFPPSNARLGAFENEAMHDTAEWGLPIGRMHPTHQYHPDPLPRAPAHLHPHVARGGVGCGRVLDDLLPRQGGAVRLSRRRRGQRVDQLGHHHLCRMHECMQWLYDLRSQARDGSLDWPTCRCLHIPIDPSCSFCTSSGSSLCIPPTPSPHRLTTRPSPPNPPXXXIDPSCSFCTSPGSSLCTPPTPSPHRPTTRPFPPNPLPPSLATHQVPAQDEHGPRVIGGAAVVGGGEEGDEAAVREALEAIHHALVSAHDHLQLVRLAELQHAVGAKGDQARAARAGLHPLHRVVGGGVGPEQVHQHHAAVLHGERARQLRDLLHAVDGAPDAAVHAQNLVLDHRRQGQPVEELVEAVPGAQALRLAQPLHALQPEAEEGVDVGGLVVAPDQVHVLGVVDLQRQQQAHVRDWGRQLHRQNTWAGEREGLEPWRRLKWQGCAARCGFKVAHPLFPCLEWHSAHGVWWDPSAPGPLPDRLGPHSSLP

SEQ ID NO: 15319 - protein, 231 aa, Chlorella protothecoides
  MOD_RES (31)..(34): Any amino acid
  MOD_RES (141)..(144): Any amino acid
MGDIRKQRCSFWVVRMREVRESVGDGVTMAXXXXLVFLDGRHPEAAVQLLGGAHARGVPVLVEAEKPRPGLDVLLQGAQYVYTNATFPKVSIALQRGCRCSCRDQGGHNFQERWPTGTANAWHRQAIVHCLGTPPAQAFMXXXXRHLPQGHCPLSGTPPEQAFMALLQPSLSMNSAPRSQYPPPPPQDVDPGTLAGLRPAVHAEETDLSPLAGHHTGSERVGGIPTAGRQW

SEQ ID NO: 15320 - protein, 484 aa, Chlorella protothecoides
  MOD_RES (135)..(137): Any amino acid
  MOD_RES (164)..(167): Any amino acid
  MOD_RES (432)..(435): Any amino acid
MAARGRPSRVDQHDPKVRFSLPETVPVLHGQEPGAMLFAVGSRSVSIPDHGVAHRAGTSSEHTVPPTHRVNHRRSLLAAVPGFPILHLLLPRLAASQEAELVNKVSPLSNLLQSPAGMMAHLETCTLTGHPFLPXXXGESSTQLACRCAGLPNLALASASFGSXXXXTFYRSRQQAGGGAKILAPIRGSRAGLERCRFILNDGGPNPYVAMLRLARSASMNCYLYEPNAGEGWEARASLIQQSLPFSDPCTLRLMRSLKRYKREQLPYLSLPSFYCTLHSQIQEQHHPEQGPCAPAAREGATRTSDQAVPGHAGVHVDLLKWALREYTLICSSGAVVAFRLEVDDHRSSHQPLFAILSKGTSSFWMTCWSGRRRGTRQQCSRCPKFLMTPSRLMLVLRPPSLHAWGCEMATMCVDSLADDRLAAIEQGQYTXXXXKPSVSCSLVDGECTTHRAIHPCDWSTKPIAVGQTSRERPAVILEHEVEQ

SEQ ID NO: 15321 - protein, 327 aa, Chlorella protothecoides
MAETLRSLTRRPPPPLQIVGRYFKVKERNTSFTQELRGGSVTFLTVRWRPGICQSRDTSGRAVGVAYILAVNAGILADTGGICPTNGACPLGPGSIGTAACDDCVANTKRSFISATAAICVIANFLMGIMGNLPLAIAPGMGLNAYFTYTVVGFFGTGMVTYQMALAAVFIEGFIFVFISVIGLRTWLTTIVPKSIWLASSAGIGAFLAFIGLQQAEGLGVVTYNGATAVGLGGCPPGYRNHQYTFSTAQLESACILSDGAAIANPANSGWTPSSNYFCESAGVMRSGQTWLGIAGGRGGKGRRREDGLGTMGFALALEWRRRPLAV

SEQ ID NO: 15322 - protein, 214 aa, Chlorella protothecoides
MGRPRKPFIDKKNSTTYNLIHRNTDAGEVVDASGRVFVDAGKGVGLGRVDEEAAAAARAASGTANRRYSEALVWAWEFERARYPPGHPLAWLEAEESGPSSSLTPARRRELIELGFPDDGYDYLAHLRALGGGSNALEGPDRSEPAAAVGPGVFVPAQKPLAPAADVALYDAHALALPDGAVKEEEEEAEGAMGGVTAFTRRRERAPAAIGEGN

SEQ ID NO: 15323 - protein, 372 aa, Chlorella protothecoides
MVPGPPVHRPTCFACAVASPNPSLFRTISDPPSPSPYKKFLGDYVDRGAHSLETMCLLLALKIDHPENVHLIRGNHEASDINALFGFRLECVERLGEPEGLRAWNRFNQLFNWLPLAAVIEDKVLCMHGGIGRSIHSMEQIAELARPLTMEDGGVVLMDLLWSDPTTNDAVEGVQPSPRGPGLVTFGPDRVLEFCQANELQMIVRAHECVMDGFERFAHGRLITLFSATNYCGTANNAGAVLVLGRDLVGGQRWGKRTTTCGPIQAAIPGLAAQIVEPLHAFMHAAAPDPGTPYDERPLSETPPPLTHAPTTGDGAQADPPAAPDDAATTAQPHPGGGGDHRGPAHTPPLLGRHVDAGGLALLEGGRGDIGG

SEQ ID NO: 15324 - protein, 202 aa, Chlorella protothecoides
MVVHAVGPRPDHVAAMSGIASSSAAADRQRGAKHQQPENRCAYRHRPSRYPIVGSAMKEPRPAQLDCAVLGLGSCGLDTLALVDSFPAPDEKIRARRLLIQGGGNCANALTAAARLGAPVAIISKAGSDAAGSSIEAELQGEGIDTQCLLFSKTGPSPTTYIIVDAAGGLGPRNGPCWLPNRVFIELMMSVVVVIMQVLQGT

SEQ ID NO: 15325 - protein, 321 aa, Chlorella protothecoides
MAVLLAKNLKGALMVGILFVTFISWIPSSGNHAAYLGSSAGPGGQERLDYFRKVVAVPDTSYTAAQLDFSGFKTGQLWLALITFLYVDFLDCTGTLYSMANFLGLYIPNFIDKKTLQFERQLPAFCVDGVSITVGAVLGTSPVTVFVESASGIREGARTGIAALMISFWFIVSLFFTPLLASIPPYATGPALVLVGAMMVINIVKIDWANIQEAVPAFLTFIVMPLTYSIAYGVIAGIMSWIIINGSVAAWNYVSLKIWGRPDHVEEGSSWKMVRQESEALHTFQDPSTRGMKDGDESPSASQAAAEVELGGKSVDTSVKP

SEQ ID NO: 15326 - protein, 409 aa, Chlorella protothecoides
AAETRRKAQAALRDRDSDGLSALRALCAYLAHGRDAGWAAGAGLHARHLEEAVALRAQLARVLAACPVGGLGGDHAFSLAALDGVKPLPAPGPAVADALRRAMLAGWPDRVARRQRSAEYLAGQREQVWILGRGGRPDQVGVKGRAVTLLPHLVVWDETPWQAGKRDRQPLHASILSSFTKPPTRPTPQGYSSRAVRYQAAELEEPVFLHPLSGLHRAPPAFLLYTDLVRTAKRPYVSGVTALDPAWLPATAAALCSLSAPLPAPAPFYSPARDAVLAWHEVTFGRHGWAMPRTAAPHPDPAERCARFAAALLEGRVLPALEPLAGGLAAPPAALARPEARGGARVSNLLLALERAGVDSRRSLLAALRDEPGFLLRELRAWYPAPALPILQQAWAALLGGACREGVPA

SEQ ID NO: 15327 - protein, 419 aa, Chlorella protothecoides
  MOD_RES (289)..(291): Any amino acid
MLPVYFTISEAPEHKQPGHVERPERIAAIQAALQSSGLLDNLNQVHRTIPGEIRDAVIDSVHAYRDALLSRGAAAPGPYIGDTLAIADFDDPDGQTFLTSASLPLALQACRESDAEHPEPSRVEQLPRGLLPAAPGTPCHNSGCVAVICVHDGCGAGGTFWRQSPFWQAKVMILDFDVHHGNGTCEIFDTDPSVLVLDVHEESAVYLEYGSGVDDAGRGEGGGFTINVPLPRAWDAGMLPVFCGACSAVHTVRSLRTGIACTHSMWQCSFPTPLMSSHRHSTPPLCLPXXXACSAVHTVRSLRTGIGCTLWMWHCSFPTPLMSSHRHSTPSLCLLPGGAGHASVLKVWDDIVAPAAERFRPDLILVSAGFDAHEDDPFQLLCYRTETYGELASRLCALATRLCGECHPAYVCGWFLARV

SEQ ID NO: 15328 - protein, 146 aa, Chlorella protothecoides
  MOD_RES (108)..(111): Any amino acid
MPQLFSLGHHQCRWNYKDEADIAAVDAGFEEHALPYDVLWLDIEHTDGKRWVGRRSCGDCASLRKAGCWPSNLLLGLECSLGFPRILRPSPSLPRACREGCCCGWATXXXXTLWGFQESSGPCQVSQEHAGKDAAVAGPLYAQTPS

SEQ ID NO: 15329 - protein, 116 aa, Chlorella protothecoides
  MOD_RES (34)..(37): Any amino acid
MVGGGVMNGGGVMIGGGVMIGGGVIMGGEVMMGXXXXGGVMIGGGVMVGGEVMIGGEVMVGGEVMVGELCKLRYPDACQWRAETQSEGPPTPDWPPPRTLRPRDARSLCIAIGFGK

SEQ ID NO: 15330 - protein, 151 aa, Chlorella protothecoides
MAQTSRGGFGPEHFWPFNGMVPNRGPGWEEQHAFTYYAVLPHSDPYREVVFKTVESPFSPSIHYLFSRHCWPGESAYLDMLNPTVRDWWADQFSTSVYEGSTTDLYIWNDMNEPSVFNGPEVGFGAGTLGWGTRDRVRVWLHLGDTAPKPA

SEQ ID NO: 15331 - protein, 379 aa, Chlorella protothecoides
  MOD_RES (288)..(291): Any amino acid
  MOD_RES (341)..(344): Any amino acid
MFLGVNIRLSNLAWLVGGFTAALFFTTLVGPLQTQPVLPSEVYENLRALSEPAQDVSAKRITAFVGIQVRDSTPHGDRERTLQHQLPTAQSHHFPPQTGFTTNHNNPKYNYENRREALRATWAPSNESERSKLETESGIVARFVVGHSPDSGAEAALNAEEAKHGGFMRLDLVVRGHGKVWEEEYSAQRRRGALGIFHEDRAQSSPPCEDCRARPSHPGLPPGCPRRKGMQTCHERRCSSSRPCCGSMTRSTSSRSTTTYTCVWTGSRQPWSSGPASAQVGRCWDRLXXXXQPWSSGPASVQVGHCWDSLAGVWRRWCPSRICRGGEPGERQVATAPYHSXXXXWCPSRICRGEEPGGAASGNGVVPFSDCAFQRRHPG

SEQ ID NO: 15332 - protein, 275 aa, Chlorella protothecoides
  MOD_RES (140)..(143): Any amino acid
MACHERGGQWRRVVTTYEQMRGGGGRPDSVVYNVVVGALWSTGAVWAQARAAAIFRQACRSGHFRLTVHTTEATGGETAQGATPPAHALAAALPGLEGAPSWCTIESADSAAAPTASLPQSPLLVVEEGDGVNAGSPGPXXXXSGPRRRAHRVQRARIQPGLGRAVPAALGGRAAGAPAPRQGPSLWGGDARGPGHQQGQALQGACLPGNAQRPAPVCRRLEGPVYVSFWEGEDGEGGGLGNGRGLAVVHSNGHWKLQCLWQYGARLWEGRRGGF

SEQ ID NO: 15333 - protein, 166 aa, Chlorella protothecoides
MPKDARHVQGVEHRDLHNANGLFYHMATASGLRVVVVPRIRHEAIGCSGHADWAQVIDGGATACGLTACVVACSALLTSTPRIPPSTRRRGYKEVDTVSGDRPFVLSRAFFSGTQRVGPIWTGDNAAEWAHLEVSIPMLLSLNVAGLPFSGEETGQSLVCGCAALQ

SEQ ID NO: 15334 - protein, 415 aa, Chlorella protothecoides
  MOD_RES (38)..(41): Any amino acid
  MOD_RES (175)..(178): Any amino acid
  MOD_RES (332)..(335): Any amino acid
MELALATRRAKRHLCCRGSLGFRDPSNMPAPCLTAYIXXXXRPKRHLCCRGSLGLRDPSNMPMPRRTAYLRSTPPLTPLHLHTLPSARRTPPPPHLPMPRYDIAWKYVQYGRIWDYLRSELEMDARFKTLDMKLNLVQDNLKYFLEIFQDRKARSGLQRWLLLEQGCSYPAGVRXXXXDRKARSGLQRRLLLEQGRSYPAGVRFHQGQDTPQILLCSWSGACQHTGCPVETCIRARHHGCMPRPQPPDHPPAAPVLQSTSLEWIIIILIGVEICLSLLDLYHKGMMVVCTHPQHGLGCRMGGSEVRVFVCKLAVHGSGDREHRTLQRRHHPXXXXCSSANLLCMDQAPGGTGPSSGGIIQTGSDKFEPSGIATRLCVVTCLPDPCVPGNAPIPMLPIRVPEIHRIAAMPAPPALP

SEQ ID NO: 15335 - protein, 182 aa, Chlorella protothecoides
TRGGGAAPADELVAPTFRRVLADVRERLTFRAQAFIRERVAGHAAVPTDFDGYYSLDGRGQGGVARAVQGGDAAAGSAMRADGASESVGPGGVAKGDGDPPTDSSTPPAGPPAARQYPPVTATLALLGQLAPRLDARIFAGLAHEALAAATLAVLAGSRAVAKVEMGGGGALEMRWESRQEV

SEQ ID NO: 15336 - protein, 109 aa, Chlorella protothecoides
MEIEDSLPGCTPLQAQLFGVSQLLALREGAVRHPTTFAVRDLDFSHTRETLRRAASGQLPLFTLSSSNAVLQLMSRGAPRLLESRFEAKKVGRLWCWRVYKGFGTGAWG

SEQ ID NO: 15337 - protein, 83 aa, Chlorella protothecoides
MSSTHQRTPSTQELERELKFSCESFIMSVTKLAVEPALSFMSKAAAAGKVPAAPAGGAGADKEAAVGTKPLHQLVSRKLENGE

SEQ ID NO: 15338 - protein, 201 aa, Chlorella protothecoides
AAATPHVPTPPAPVPDLLGDLLDLGGADADAATPAPVQAPTTHAAAGAPDVLDLLGGLSVSNGAVFGADAGRAAPGAASHLPVLLAAEAGKGLVIRGGVEREAGGQLAYQVGVWSFRAGAMGGRARKVGTVGMGTGQWKLGGVSTAVGDDIPGVAWAARKASAVVLWPPRGAPLTPARRLAPQTHSCTWRMRGRASPWTAS

SEQ ID NO: 15339 - protein, 472 aa, Chlorella protothecoides
  MOD_RES (64)..(67): Any amino acid
  MOD_RES (92)..(95): Any amino acid
  MOD_RES (205)..(208): Any amino acid
  MOD_RES (237)..(240): Any amino acid
  MOD_RES (414)..(417): Any amino acid
MPMDESCLSAWGDKALARWARGVRHAEGGTCAVHGASHLPIYHSVACLVQAHVPHSTHSPWPPXXXXLMISWVAPACNSPIFAEVVGGASEXXXXQLLPMGNSNLLVWIYSICFFSWGLMISWVAPACNSPIFAEVGNYMDVSQHMATTQPWVIIRLPIPPYRSPPSCAPSSTPLTAPLRGSCMDVSQHMATAQPWVIIRLPFLXXXXLLGNEMLLPLLPPPGIVGGVGPMSGRAHXXXXRRHRCDGGAHRGLAGGAPGVQHRPQQARHRPGAGGCARQRHRHLHLHPLGALLLPVHGLARDLPARQGAGLGAAAHAQWRAQPAQRGPGGGAAGGGGGKGGGGGGGPHARGIALPVGPHAGLTWEGPGPWARPRVCSLARMRMAQARMSLVQDAHKRIGPRTSCRSAGPQLRAXXXXAATCMLSCSNEDGPGGNEPRAGCARAHGTKNVPSVCRASASSSCIHLAFELCTVL

SEQ ID NO: 15340 - protein, 1144 aa, Chlorella protothecoides
  MOD_RES (113)..(116): Any amino acid
  MOD_RES (215)..(217): Any amino acid
  MOD_RES (581)..(584): Any amino acid
  MOD_RES (814)..(817): Any amino acid
  MOD_RES (848)..(851): Any amino acid
  MOD_RES (1020)..(1051): Any amino acid
MWPYSYSTCDDAARKVAWSTLPGQRFSACMDRPGQDRGRFGWEQGRGRGAPEVDLIEVGGSVGMPGGDPVSWRRHGDGLAPEHSVPAASCPATQPPVRSLRPPQAGVQEGGQXXXXPGVGTETAWRWSTLFPRHHGHPLSRPCDPFAPQDGVQEGGQGGQGQGRRIPSDSLAQPADGAPAAAGDALHGARRGVPGWVGHSVRAGTFLAHCSVRAXXXGDALHGARRGIPGWVGTACGQAPFWRSAVCAEQPTPLTDEGQPTTCTARPRMMLASRHRARPGTGSWRLGVQPPRAPPALASNTVLAGPASPAGSQTHHKTTKNDWKGVHGRPGNLWQDCFSAKSLLNGTFYAQFHKFGLFWQPGEDAVAQRACGSPALAASEGSLGSGLGPPCTARTVAVRFLVQTSAECRLWHARRGNGRVTRMPGSSAAHRTLPPRCIAPPALYGGALRAVSLPRARRWCLRSTRMPWWRAVRWSRAAAPARLAGVPPRWLLPCVGHPPLLPGTPLRPALGSPSPAPPTRRHELLLFVGGPRPPGVPFHHEDRPRQVQRRRGGGAREAWQCARASVDSLARRALSVPFPRXXXXHLAFPSIMKIDHVRCSDAGGPVRVRPGSVQGRPWTRLLVADLPSLSLIPPTSPPQAVPADRQDQRWMLAHEVPHESVPGLQQGEVCAVEGGQDQDPRQVPEHHQELPPSAVQQGVYHGCGWMSASMAAFEMEDREGAPDHSTHEMNVGSMHECFRAAVVHFTSSTNSSESVMGRLRERHGRLELVNGAGSEQGEVSGRSIWGQRTAVQGQRLGRAVFAWRHMPEVPRQYXXXXGAATRTTWTIRCGVCVGEGVYQSGPTADVPXXXXPPGNGRDRSAMPPGRSREGGSCLRFPDSSAEETERHLGMGEIEAQAPGGDHPPLHPNRSPPRPCRMPSSHTATSRGPIVACHPSRPLAAASVPLDRQAQEESSSGVAVWRVGRGRSPDPATVLAHELQSDVAALSWRPVGGRDLAVGCGTGVALWRVPPDPGAGALAVXXXXXXXXXXXXXXXXXXXXXXXXXXXXXXXXPALAGTGQVNMLTWHPEGHLLAGACRGVAGFQVWDVATGRATPVRGEAVLSVSWSCQKGGLIQWYCCVHAQDRIGGLVRQAFRSRLGMHRGFL

SEQ ID NO: 15341 - protein, 427 aa, Chlorella protothecoides
  MOD_RES (123)..(126): Any amino acid
MASTGGMWPYSYDVCDAAAGKVDWSSLPGQRFSACPDTAGNNQTRYGWPAGVGRGAPEVDLFEMRWGAAASVGGGGRGRGPLSSPSAESGRRGGQGTRPDELTHQWSLIRSRFLSMQGFTCRXXXXGTRPDELTHPWSLIRSRLLSMHGFTCRSGHMAIGPSKIDDPGHPTPPLPPLHSVPSSVNGLKGTPTAHDSDYSLPYVSQTLQMAPLQPPGTAFMASGVNYPGPWAGAGAWGPWRGAMGMGSCLVDHCNCTWKAGSYVSRRRHPSPPTVCTHAQGGWACLTPHSKSCIWSLLGLPPTPSLPATLHILIIQFPQILHNHPTIPFPGASSDFDTQKSSWSGIYGRPGNTYQDSFSAVSSINTSFFSEYHNFGLFWQPGEVLRWYIDGQVGGEGAAIAVAGRCGGRTGIAWHHPLHSSAGARGSC

SEQ ID NO: 15342 - protein, 145 aa, Chlorella protothecoides
MEWHPVPYTGKYLRKLSSPPAPPPHRPNPQATSDPITALAWSPCGAYLFQGHASGTLRLWETTAWTSQAWAYGGSHSVHSARAGPRPSPVVAAAWAPARLSAQGLMLVAHAGAPGSLTALHMTGASAPSLEAQPMPVSLAWPAGA

SEQ ID NO: 15343 - protein, 234 aa, Chlorella protothecoides
MAPPRKTVGFVAVPGEDEDGAGQSAFSSPFQTTGAQESGEPVKKAGGVLRDKHGWYREGGDKGFGGSTDMPRLWVVRGAGRTGGLPVLTGPRKSTAPGLAMLLVVNPRPPSLSPPPCHPSPLCKGNLRTWTDQRARTTVVVNLAGILERCNEQTLPALYRYVGKSFKASPRQLGYITLACALMQAVCAPLGGVLGHLYNRVYVMSAGAFIWGVMSIAFAFTTNVKQVGEKDEEG

SEQ ID NO: 15344 - protein, 198 aa, Chlorella protothecoides
MLSGTMNTAAAVHSRCGACGGSQALALVRGDSRRSRAFSCQGTPPNLTHQTMCGGGLTSASTTAHGRVSWVSGAASPQQTTLYTAGSSTSSTSSTSSSGSSSDSEEPTTSRAARRTAVKAMQPTVSVCQDKSCGRKGSAALLAAFEEAAQGACVQASKCQGYCKVGPSVRLHNRQGGYVQYAAVNTEDVEELLDKLKQ

SEQ ID NO: 15345 - protein, 225 aa, Chlorella protothecoides
  MOD_RES (26)..(29): Any amino acid
MSQTGGLWPCACRLPGAAGEQWFDAXXXXACGPVLAVFQVQLASSGLTPHGGRAASSKVPEQMHAPSTGPLDAAGPPGPLTPHDPSLPCPGEKYKHCAAFGVTPVTADWLVDSITAGLLQPEKEYHPGRRAAAQAPLAHQSQAGGRPRQGQSQEQCGAGEGRASQASRKRAGEGAPADLGPLNLESLLEMTESGAGHREKAGPPPKRCVLGGHGRSRLPRAGSGE

SEQ ID NO: 15346 - protein, 232 aa, Chlorella protothecoides
MLEQTRDGSGAAAPRSGSSLLPTCVLQPSSRPPALSDPSAGPMSLCMDACYLWLVGCGPQEQLQALQAIRRVAAKRFAVPHPLLTHVIVGGALGDTDARRVAAVASGNASLQVVCLDWLLDCVKKGCILACGPYHFRAPPGARGGAGAIAMVGQGWLGCGRDPASGWRGCLAPWNQSQARSSLHSVGRYVVRHGGAVGVGGKQGPCRHPCGSLLYTVSAVQPRGACAGPPSD

SEQ ID NO: 15347 - protein, 158 aa, Chlorella protothecoides
MSPSRGLFAGHRVLCTAVTVAERDRLVQHLREEGATLITVFSVESPPDVVVTRSALATGSRLCRLSRPDIPAVTPDWVTACVSAGRLLAHHPHRLPCFSGMTICLSGLGSSEKQDLVQLVEAHNGRHSAALDRRCTHLVTCTTQSDKYRCARSLSSVP

SEQ ID NO: 15348 - protein, 553 aa, Chlorella protothecoides
  MOD_RES (35)..(37): Any amino acid
MPPSRSPHLRLLGRHRRRVHCRSCGWVQLVGSGGXXXGRHRRRVHCRPCGWVQLVGARRCEGRSSTPPWPRLLSPPSSTPWAPCSALCHGHRRRPTPPQAKHNPAPPPLTPNYQRPLPEVRAIVVEEKKVSQLAKVANGISKLVRDVIVIGEPGSEAAPLRDAGIEVHGFAALVDGASASDVAPHPPAPSHHACIMYTSGTTGTPKGVVHTQASMTAVIAGVVNLTRQGHIPVTHDDSTLSYLTLAHIFGRVVEEFALSRGASIGYWQGDVKALMDDLKELRPTLFIAVPRILERVADGVRKKVAAGPALSRVLFNAAFTAKRLLLKTGLSHGGGQKPGVKRGGEETLGVRESGGRVAGCEGEWEGCCARHSRHPSVLALPRAPRRTAPIVCRKESHVHTHNHSLRANQHPHPPPQPRCRLAGLGGDQVVFSRVRQAMGGRVRFIVSGGAPLSPEVEDFANVALAPVLQGYGLTETCAASFLMIPDPRLAYSVGPPLSANEFRLESVKELNYSAEDSPPKGEVCIRGPMLFQGYYKDEKKTKEDMDADGFFHT

SEQ ID NO: 15349 - protein, 225 aa, Chlorella protothecoides
MRQGTATRSLPPEPHHRCLGWRPRGSDGKCGPYKWLTYKETQGRNSCGFVWGGLCVAVQDKAYSFAAALQKLGFEPQGEIVPESVVGDARIAREFVMAATAWGSWVSSPMVRMFLSQWWEMPGLLEYSSWRLQPGGVLERLVVIRTHVLILFAYPTDKLGIYSSNNVEHMLTLKAVDVISAVVGGWDLMVPVLAQRSRGRGSQSGWDVSDWMCFVPDQPGYLLLV

SEQ ID NO: 15350 - protein, 65 aa, Chlorella protothecoides
MSSLKHVGPLTVEVTPGRPEQGDTPAVSAVYRNVAAAEKFTTTVDGSTTLYEIFKASAEKHADQK

SEQ ID NO: 15351 - protein, 477 aa, Chlorella protothecoides
  MOD_RES (425)..(428): Any amino acid
MCVQQGPRADSLTDTPTILPLCSHALRALHVAGSPQRRDGQPGREKGWFRARADPPTSLKPCAEQAQVKEDQVQLTYGLAPPSHIFPPAEPTRDSLYMSISKSCATRLQKEYKAIVRHAWDASLLVAPLGPMLLQTQHVSRPQDPVPCIEAHPSPSSLLVRGGSAPPVHDRPASGCPSSGSCRVRPPSFDQPHISLSLTCVQEWHFVLQGQDEFKGGVYHGKITFPSSYPYKPPSILMFTPNGRHAGLGIGNGHGKLCKRSSACFGANVCDQHQAVHEHGEPVVPLVSSCGLATPGWTRNNHSAAQIVTVSGPVHRPVPSKTPPIPADRLPPGELESNVVGRHHPDRPALLHVRLRQQHRRGDLHARREGGPGGPVPGVQRAQPHLPQALPPLGGEARGGPARCPPSGNGGGLQTPGTGCGRGAXXXXPPPRGWGGVAYPRNRMRQRGRRGLRRRQQPQPPRLHPRLPQFSRVGASW

SEQ ID NO: 15352 - protein, 224 aa, Chlorella protothecoides
MAVTAAHLPSPCPQDPKACSIVLRGASKDVLNEVERNLHDAMGVARSAMGSGLDGEGVALGEQAGPLAAHRAAPSVHRAMCGSFPNRKTILVRPLARPWPVLRWRCRVLHLPCSPPHPHTKTPCCDPPRNVVLDPRLVPGGGAVEMAVSHGLAELSTAGGVLGNEQAAYRAVGAALEVIPRTLASNCGANVIRTISKLRAAHAEKSSSFGINGEGGGFSEQGLG

SEQ ID NO: 15353 - protein, 284 aa, Chlorella protothecoides
MRMKLARHLHSCILENTNTFALTPTGNTGKVEDMRELGVWEPYEVKAQTLKTAVEAATLLLRIDDIVSGLKKRGGGGGKGGGVPQKPPWCATGLNTALGATGAGRAQGGGDACSRGPPCGNPWALTRKQGQYQTLLTDTLVSKAAAGLVTTGHATRERQQGGIGAGMPTNARYRGTPPAQGASRVRCSAEKLGVWSLASRSWCLRAESESAAGPPPPAPLLKTTSLLLVANVQLRHVEQQGLGAEVHAVGGGGHRAGDLARGLDLPARCYRVWGWMGGCWVRNI

SEQ ID NO: 15354 - protein, 225 aa, Chlorella protothecoides
MLRPSRRESPAECNSPSLFPFLQPTQSAGQHRPACAHPAHAREAAGDLPHAGHRLRGARAAQHHPGDAQVGDRAVQCLPAAHHARGGIARHPPHPHPARALLQHRAGRREHHQPHLLPRVHLRRGGQAGGAAGRGEGQVHRPSAVGAWPAVALRDITPSLPLLPTLPRSLLLPPTPLFSLSNHQVDKAQQDKQSAIIRAQGEAQSATLIGQAIKDNPSFITLRWV

SEQ ID NO: 15355 - protein, 453 aa, Chlorella protothecoides
MQAPVTVLQTNTRRDTGKKAQYGNILAAKAVADIVRTTLGPRAMLKMLLDANGGIVLTNDGNAILREIDVSHPAAKSIIELSRTQDEAVGDGTTSVIILAGEMLAAAEPFLERNLHPTVIIRAYMRALEDALRLVDAAAFPIDVQDRDQMLKIVNSCIGTKFTQRLGNLVADLALDAVQLVKVDVPGGTPEIDLKKWAKVEKIPGASLEDSRVLRGVMFEKDVVVPGRMRRKIANPRILLLDCPLEYKKGENQTNVELAKEEDWYEGAGSCAAAPLFGSCPPSCLPLPACPPFPSSQPTPRTRDPPHPPSPFLIHRAALLKLEEDWVARTCAQIAALKPDLVITEKGLSDLAAHYLTKAGISAIRRLRKTDNNRIARAAGATIVSRPDEATERDIGTGAGLFEVRKIGDEFWTFIVDCEVCWCLSSVLGWRRVRFGVKESDHGLAATQVQSFG

SEQ ID NO: 15356 - protein, 303 aa, Chlorella protothecoides
MHALMTQQCLAPRNVAGSYYAILVDFDPGAFLATTLHSAVLYAACAVLSGVGTALQRRLALSWRQRLTATLHAAYCAGAAFAGLRLDNPDQRATRDTRALCDDLAAVARVAVSIPFRGAYYAALTAGYLGLRGLAVAAAYFICATLLQWWEGRSGGKVMAVDGSGGRVMESAEGDLRTAHARLRALRHDAALAGRGGAGHYGAEAEALGAAAAAALGAQARLVPRQAALEVSTKAVDYGGALLTYTAVAVAVFSGTGPRGGDPGDTARFVSNAAFATMALVYTFTELMDKLNTYARLPGEEEG

SEQ ID NO: 15357 - protein, 152 aa, Chlorella protothecoides
MALSIHSGAPAWAELATVPPETALQAARPLPQQPIDKGRIWFVLIVGASALFGATVLLENRAAWFPAIAKANQAMKSAATASSRNGEALPQEGPEGASPVPLDRSGHEAGAITGAAGGEGEPLDTAVLEGLREGRQKALRGSEETVADAADR

SEQ ID NO: 15358 - protein, 772 aa, Chlorella protothecoides
  MOD_RES (85)..(88): Any amino acid
  MOD_RES (417)..(420): Any amino acid
MVLMSEVVAPWENAWLSVVGWLASLANTSSLAEGVTAGRGTQGEMEYGLRRGVGDRPHFIQIAHRHPMEQDKHGSQRRRSIAQDXXXXLLAGRGRDCGARDVGGDGIWVMEGGGDRAHFIPIAHRHPIEQGKHGSQQCRSIAQFDNRKGGGMRPGWPRAPSGRPRSGWHPPEYRVEIFRTTEPATHRPGVITGVILANPRAGGGWTPWGGGPSESLEPSTCLDDGIPSSSGAPIYCTDAFTIENNVDTPLRGSGLHGAWLLALSEAGWKVHTPLRPHESVRRGACQVLGNPSVPQQAARGIDQGHPAVHMSEVLISFPYAELYIVRGSEAPILQSEGELVISSSPGTGDAAEQGPPASCIQLAVGKVSWEVKPSSKALKAGEYTWVFSTSEAGIFYSLTLLASASEEDGEAGTPPVXXXXVLENIAVVKYVGCSVKYWVPSWDGTCFQGEAGTPLMASMSCPWHVWCSRTAHPSDHTCARLTGFRRIVTILHCMISPPHTHPSHKLTYTPVFRESEALLADPEAQHGEAALAGAAYNSALARGVHRASAGLASGLLVSAAYATGAIKRVTDAARPAAPTAAPVHVSEATKRRFERTAAAAEWASGAAGAVVGGLAWVGAKVAGGALWALGADKPLAPGEEAGVLRETSHAAAAGFSQVWEGMEDAGRAVLLSARDGAAGVVGDRYGADAAGLSLHSMNAAGSGANAVYAVRKLGVRTVAKAAAKRTAKGVFKTMGAGGAGAGAAAASGGVDVAAEAPPGAKQQQLVPQGKQA

SEQ ID NO: 15359 - protein, 417 aa, Chlorella protothecoides
  MOD_RES (45)..(48): Any amino acid
  MOD_RES (210)..(213): Any amino acid
MAAGAGLVDWTGRTACGARQRCGLGQPGSRRAVHSPVHRGDDHLXXXXGHAVPCTALSSEVMTIFTPGPTPQRGYYNWNAVFAPYNSATAEGAQGRVAREQPCDMPAHLWMVATPAVAACLGIAWPGGPDAVSREAQRSEGGGAQAQETAEQTTPRLPCLEEPPAGWERAYAMACEAAEDLRWTHRGLRSDHESAAAAHEAGGGEPAVEXXXXERAYAMACEAAEDLRWTHRGLRSDHESAAAAHEAGDGEPAVETQGTASSIEVEESFQTPAVADDGEADGRLVASLVSCEAPSSATPSPDSLCCATSLAGHRDSQQPGPLGAAAAWRALRGASAVVAMHPDQATEFAVDLALALDVPMAVVPCCVYASDFPHRRLPDGRRVTSHEDFVEYLCAKHPSIGTATLPFEGKNTLVFRR

SEQ ID NO: 15360 - protein, 395 aa, Chlorella protothecoides
  MOD_RES (98)..(101): Any amino acid
MMTIPPNRTPADGPLHPIGLGAEPAAPDRPQCQGPAHCPPQRHHRGVQVCRLGRAQGGRWGLTGPGSGHSPSSAGQMGALVASAPRSHEPPPSVSPPXXXXRGTPPAVLGSWGHWWPVLPGPTCPLHQSTPLFEYNPQAGLAGNDVLGMAGSSNVQGEDQKKLDLVANEVFKNVLARTGQCAVLVTEEEEEPIFIRPEQRGEYCVVFDPLDGSSNIDCGVSIGTIFGIYKVAPGSEGSLADVLRPGRDMVAAGYCMYGSMTYLMLSTGRGVSGFTLDPSLGEFVATHRDLVMPPRGSIYSINEGNAAMWDAATSAYVAEKKRPPGGGKPYSLRYVGSMVADVHRTLLYGGVFLYPADAKNTKVCGVVGHAVLVFGREEGVPCSGVEAAHAGPVHP

SEQ ID NO: 15361 - protein, 98 aa, Chlorella protothecoides
MGKGGTKFCGDAVGVRLKSVGYTLKDAKKDMESFLQTGHHPEVERLKTKQANAVVLLPEASTARPHVYMDLTISGKPAGWHGHTVGVPGPGVLLKKIC

SEQ ID NO: 15362 - protein, 79 aa, Chlorella protothecoides
MAVWDPDTEQLQSLCRCMSGFSDAFYREATERLKATEIPGPKAYYDTSESPDMWFEPREVWEIRGADLSLSPVSVMEEL

SEQ ID NO: 15363 - protein, 260 aa, Chlorella protothecoides
MGSFHTTAWYTLLPSEHQHGMPHHPTYLGVLGVGRVQEDAAVEEGAVHVGDHGADVAQGVGLPTPRRPLLLRHVGAGGGVPHRRVPLVDGVDGAARGHDQVAVCGHELAQGGVQGEPRHAPPRAEHEVGHGAVHAVPRGHHVAPRAQHVRQAALAPGRDLVDAEDGADGHAAVDVGGAVQRVEHHAVLAALLGPDEDGLLLLLRHQHRALPRARQHVLEHLVGHQVQLLLVLALHIAGPGHAQHVVPCQASLRIVFKEGG

SEQ ID NO: 15364 - protein, 127 aa, Chlorella protothecoides
MDARVGSWGWRGRGLDPAAQECVAPCRATAPFPPLRGFPMTPASLVPDSPPPVWSPDGPTPPPPQPPPLLTYSTGESKLDALLHGHSYTAHPTGCAAALAALAAYASPALNPNAGALAGAAARRLPL

SEQ ID NO: 15365 - protein, 209 aa, Chlorella protothecoides
GQGAGQGLFRETAWVPGCGQQAGSCHAAAAPAPAPAWLGIASVLHGVGQSILQGAEHRCGALLPRQIDLPGHPPSPLSQLAEAMLDSVGQGWASRAFFSDDGSTAVEVALKMAFRKFLADRGATDWEVDDGPELGVRSGPWELAGGVQGRTPCTGPAAVHPRLPCRGHSAPGPPDGRLDSVGSRCRMGLSTSHTRDDPAPRPLGPVRSP

SEQ ID NO: 15366 - protein, 324 aa, Chlorella protothecoides
MMGGRGGRGPITGGGSGDLGFWQPTNYPIMLMITCARRPYRASLIPVSGRCTAGPVVGTETAALTEALHGWGGKDGPSQPSLCAVSVSRRGGRTRLISTSETSSESPVLPPDRASLIDTERLRRTWTIPPGSRMPGFKLPAIDQNDEDWGPTTVPEAFRDVPFMPYSKGDRLGRIADFSQQASQRGYQGRYRDREILPGMAVFNFEKGEEVGALDLGKYVIESFYSVAWATWIVYAAGHGLSGSIAWVPEKKHSGFTWEQQRLLSSHSISPPSPPLRAPPIPATQDEAFELVDTRVVRKPPGGQRGRGGRGGWGQGRGDGGRPT

SEQ ID NO: 15367 - protein, 479 aa, Chlorella protothecoides
MAQVAASSAVKRAIFWAAYGYKRRRMAEGDMTGGRWAPFLNRLVFNKIKAVVGGGKRWLWLGLLGLGVWGGAFNAPPKFDQCCSGSPGFLMETAPSLAEAFPQSCHPMHSAPPQPPPGEVKVMISGAAALSQDVFEFLRVVFDCVVVEGYGTTGFERLHALRARHRMVLSPPEDETTAAATVTTPGDPVVGHVGPPLPSCEIRLADVPELGYTSADLPDPRGEICVRGNIVFKEYYKDPETTRETIDAQGWLHTGDIGTWLPGERLKVIDRKKNIFKLSQGEYVAPEKIEGLYTHSPYVAQVFVHGDALRSRIVGVVVPDQEALLPWAESNGLEPDLGQVGGWPSGVGNADEWLSLPGHDCRASWRLSGAPLCCVWLRVPGDVRRSGAAAGVSPLWPASHHDLQLCKEERVKALILQSMLEEGRAAKLNGFEQVVDITLTPNPFSVEAGTMTPTFKPKRPQLRAAFSGAIADMYARAPA

SEQ ID NO: 15368 - protein, 472 aa, Chlorella protothecoides
MPNAALTLSQALGVTQFLKVVVTSSAQFESRFNSVERLLAYWDLPQEAPAYLPGKECVVVDEGYCWGQRVFIELALQVMEFVPPQERVASCRVWPPTCPHPYLRLLLCRAPDAWPKKGALEYKDVWMRYRAELGPVLKGELGLAGGDPRLDGAWHPPPAQVASAGVCALGGVTFSVAPGEKVGIVGRTGSGKSSLIVSLFRLVEPYQGSIVLDGIDLLSLGLNDIRSRIAVIPQLHSRVVIYSVPLYTLDYTYTLASSNRAPLPDSLPTTIPPPLHAQDPMLFSGSVRANLDPYDRYTDADVWEALAHVGMRDPVAALPDGLAARVAEGGDNFSVGQRQLFCVARALLRKPQVLVADEATASVDSETDTLIQQTIRREFWHCTSLTIAHRINTILDATKVCVVHGPFFVCNEEVSVREGECNGRWGFCQALNMPLMASKSTGGRLSATLPDPPSRAAAIPCCPSLIPVHLPP

SEQ ID NO: 15369 - protein, 516 aa, Chlorella protothecoides
MQGNRVRRKVSCSYQIPMITYVESLWVEYQPVLACLCQWLIHLFTLYATNPIQIKPGELVCCVGRVGMGKSSLVQALLGEMDKESGHVRVRMVKCTVEYGCTVPITQPDASRIPIRWVARWHTLHSRPGSSTPPSRTMCLSERSGMRPGGMRPWRWVEQLGRKCSYALMATSYLSIMPWLNAFCSWPLAAAPRSPSPRPAPPHQACCLSQDLATLPGGADTEIGEKGINLSGGQKQRVSLARAMYQVGAWLGLSGQLVHISSTVLLSFFRAHLCLGEITHLVSPSRPSSSQDADVYIMDDPLSAVDVHVGRHIFENLITGALKVGKIAYGVYAALLHVQPLLLQSPTHASSPPLPPQAKTRLLVTNQLQYCPHADQIIVVDEGRVVVQGDYDTCMAHPIFAGLVREHAAEARADEEAPMAVLSSMLLSVELSMRAVSRGEAAKHEVLEELDWEPEFSFEELPQAPSARLALTGSPLVRPSRVSTTSGIEQHDVKVSIGVQAGAGVREQGCQPLPSR

SEQ ID NO: 15370 - protein, 70 aa, Chlorella protothecoides
MLFYSSEKYPVEDEYSKFIAKHGGQTNAFTASESTNYHFDVNWDALAPALDRHAGGVSGALFLPQAIFAM

SEQ ID NO: 15371 - protein, 61 aa, Chlorella protothecoides
MVHARESTDLGGGAPGLLRCPITDENGYRFVKLDNGLQVLLVHDPKTDKAAVACDVRRPRH

SEQ ID NO: 15372 - protein, 165 aa, Chlorella protothecoides
MVAEDKAQGSVAWSVYWRYITCYGRWAALALLVCWSGEETTSVLTNWWLSKWSTAETLNAVQVQAGLPTDFNRISYIGGYLGFALTYVLLGTLRTIANLASSLTASRAIHARSLLSLNRSPVAFFDTTPIGRILNRFSKVLEPEVEGAVQAQGWEHSPEGLRHGL

SEQ ID NO: 15373 - protein, 114 aa, Chlorella protothecoides
MLGTVRIDALIAGNVPSADARALLQALEARLLAGAPVALLRCPLIPRFAPGTTTTLPRTRRHRRRCSPPPASQRNEARVVALPSPMRAVHAVPGPNPANDNSAVVVAFQVLGER

SEQ ID NO: 15374 - protein, 155 aa, Chlorella protothecoides
MHGLCLTGNPVHAYLHPSPPCQLPPDTKVYGRHDLLLAIHHVPQRYDPELLDTVLSTLCPSEVRVLWASSSFQVPTDCPLKEPWYGTAHSAGPLPAEWLTHWEAAWGGEGAALGDKDGHRFCGMHLPPPNPYIPSRFDLIKVGKGNGGGGFTATV

SEQ ID NO: 15375 - protein, 515 aa, Chlorella protothecoides
  MOD_RES (248)..(251): Any amino acid
MVQGRTPGTEHANSWNTSLNSTFQAAVMYAEWVADDIWGVFVLQAISWWGSSETVPGETRMCAGSNAPCPGLAHAGARCPAQYARRPSHPTPSLLAWSLALFHTPSPGCGFHPDQDPATARSPGACLVPGLTRPSSPACARTGCPPSLPPDLPLDPPPRSASAACPRRVRPHHGGVRGDGGDRCRADGVERVAAQPAGGCQVRHSLWRDVHPCQGDSRPAGAAPGAYGVGLGAGAGAVTPGARAQGPXXXXGGRCWRRDTWHSCPGSPRGILRRARPLEACLGSSALSGLGSCRSGALFRWLSSTATGWQAVLPARGCRDAASWSGFQPPPTPRLAAHPTHTHTPTPPTQAIEYDPVQCRGCGAVLNPYAAVDFASRQWGCPFCLTRSPFPPHYAGISETVLPAELFPSATTVEYATARHAPPTPPTYLILLDTSVPEDELAAAKSALQQALSLIPDHAQVGLITFGTHVHVHELGHAECPKVYVFRGSKEHAAGAVAAQLGAGSPGPRAAGGAG

SEQ ID NO: 15376 - protein, 107 aa, Chlorella protothecoides
MLSLLGQNPGVAVPVILARLVQKDGEWREARAGLMPVWSAIFRDNFYKSLDHRSFYFKQGEKKALNTKGMVAEVREAAERRRGDRAAVLAAVSGAGLGGEARGAPHA

SEQ ID NO: 15377 - protein, 130 aa, Chlorella protothecoides
MSISELDVSTWERCTPSYVALPVNYPRLAATGRDTAGQALLNDGWVSVTSGSEDYSFKHYRKNQYEEALFRAEDDHFELDMVMSQNSSTIKALEVWWVGWWAGSGGWEGEWFEGRKGGREGEWRLLGRER

SEQ ID NO: 15378 - protein, 203 aa, Chlorella protothecoides
MNSHRIDTAGVILKVKELFKGHSELILGFNTFLPKGYEIRLDDDPIPAKQWAEPARAAPQAPAQRTDREPKAPVEFDQAISYVNKIKQRFSTDERVYKAFLEILNMYRKGQKSIGSVYEEAGVWAGAVGAGTPGACEGLLLHEEPAVRSTGALSKQYPPNLCSPQVALLFRNHDDLLREFTYFLPDNTPPVRTWGWNEGASAW

SEQ ID NO: 15379 - protein, 302 aa, Chlorella protothecoides
  MOD_RES (265)..(268): Any amino acid
MAFRNQKLSVSAQQNDVHKRILTGLLRQEENRRCADCHARGPTWASVNLGVFVCLNCSGDERIDEGRVASLYGRLIVGAPSTATHTPSQLTHYPSTARCTSQSRDGSKAHDHGLPSPSMLRPRTHGCQSRSPLSRPWGTHVRPGTGKQTSRQASGTCGGLCRCSACMSLTSLFRIKTGWFIVLRLPARPHQPLDRPPAFHPCSRPPDSDMGLLRTFITDKYVHRRYALQQSSEPPSIDNFAAHPVCVDVCVGGGGGLLMVVPDAXXXXAAHPVCVGVCVGEEVGGSSWWFLMHHKYPSNGSS

SEQ ID NO: 15380 - protein, 421 aa, Chlorella protothecoides
  MOD_RES (109)..(111): Any amino acid
MRRSLVVSEDRNLCWARKVGDGRPKYRDHRVPRMPRPTKYLQSLLRGCSSDIASSLVGCLDSSGVSLSSPAVPRVRKQRISCLGANPILPGSDSQAYVFTINHTQHLPXXXITGGAKGIGLACAQALGRGGARVVIADVSAEDLKSAERDLGAEGIECASAVCDVGDRTQVEAAVDFTVKTFGKLDVAVANAGIVRAADFLDLTDADWDAVIRVNLTGVFLVRLPHGGLFCLPLPGHVSAGAHGVRSRLKLRAAALMLPAPSSADLFSPLLQPQTGQVAARQMKAQGHGGSIVNISSVNGVMAIPTIANYNASKGGVNNLTRAMALSLAPHAIRVNAVGPGSIMTDVLRQVVADKAAMAKVLSRTPMLRAGEPIEIGNVGPGGVGGVGGRGPRCLCCGKRWSMASVARADLWPRLPLAVCT

SEQ ID NO: 15381 - protein, 502 aa, Chlorella protothecoides
  MOD_RES (180)..(183): Any amino acid
  MOD_RES (265)..(268): Any amino acid
MSGGMRPDPPRAVPPRPAAALTVAVARDGRHDCSSASPRYHSSSTHSKRQRNQSPGKRLPHVRRATHSLGGEGSSLLPEAGKCTTFIRKGGKAMLMPEPFTTRNPPITWSVRTSFRVSMHSIYSIARCRAGWVPCRPHRGAIVARDPSVHSSAARFVPRAAHNRPPSSVEATNGELINEXXXXGRCGHHSGSRCIQFILSPDIGAAGYHAGRIEGQSSRGTPPCIPLHPDSCPELRTIAPLQAMQSCEAIRSDPGAQHPQSPSWXXXXTRINGAWIAWKAMQSCQAIKSDPGAQHPQNPSCYCVQVHRIQHLQGEVIKGVAGVDRGESTLDLGCVLLANTAALMLPSAVGARSLRVLTSQCRTLAALLAGDGACFLLFAAVGRMQHGEGLAPLSLLGTAGPFLAAWYGTALLLGTYSRQELLRKPEQLFKTWAVGVPLGIGLHSLAKGHVPALSFVLVSLASTGAFLASWRAVYNALAGPMVSLMGGGELGRNRPSSGAERG

SEQ ID NO: 15382 - protein, 134 aa, Chlorella protothecoides
  MOD_RES (33)..(36): Any amino acid
MRYKLFFIAFGGPGSCTPSTHPCIIGHSRRWQXXXXSATRAEVGCGTSSSSLLLVGPVPAHRAPTPVSSATPADGKTFKKPRRPFEKERLDAELKTVGEFGLRNKRELWRVQLVLSKFRSRARELLTLEEKDPK

SEQ ID NO: 15383 - protein, 103 aa, Chlorella protothecoides
MADAMKGATRAMGMMNKRMNLPALAKANLSHTRHIPLRLIDSQIMREFERQNEKMEMTSEMMGDAVDGAFEEGGEEEETDELVSQVGPAAACAAARGRLWTGH

SEQ ID NO: 15384 - protein, 171 aa, Chlorella protothecoides
MHRQTSLLLISNASLLFPQTFTASLQFILRPGFAFNQGYHVSLVPEDPSKYASGHMFGKAVREESIVATFPRPELPIELYEFESCPFCRQYLTLLDACSAPRRKVREAVNVLDIDVKFFPCPKNGPTWRKQVKETTGKSQFPYMKDPNTGGCEEGGRMRGRAPECGGMRRV

SEQ ID NO: 15385 - protein, 174 aa, Chlorella protothecoides
MLEGGTVGTCSLLGALVTPVRVRGVQQLARHGGPGDRSAPSNEPPPPARPKTQELDEAARRRMPKQLYIPLPCAEARRAMVQRALRGVRSRLDPSELDRLVARTAGYSGSDMRGLVAEACAGPVREAVAAAAGAGAPGSGVAALREDDLRPVSLRDFQVLPGPCAGRDLAVKRA

SEQ ID NO: 15386 - protein, 321 aa, Chlorella protothecoides
MTPHQGEAKRLLVNALTKTLPTTLGFLQSVLEGNYSALAGGGGGPAAEAAVHAALGMRCLSEHCSAVGQRPEVCIHPHLQSQGRRGALGARVCLGGLAAPLGPSPPTRSPDSTPGATATMADWAPQGSLLSSGLLNACGFLLTREEFRDEALGILRHMAGRRARGGWSAGAWGRVLGRRGTAAVRGPPACRAQGLGGNPWMPSGGGHPPCAPLAMHKGLRHQCAPPPPPPNKNHTHATGRKVEQEDEAAVAAAARAVADVLSSCAQSLLFPSASLGWEGEDEEFAEGVCEACSVLAATHWARAWGLAPAIPAPAGAAGRAA

SEQ ID NO: 15387 - protein, 321 aa, Chlorella protothecoides
  MOD_RES (245)..(248): Any amino acid
MIRPPPPLQTRPAAAEIWRCSSRRCSRNGSHQCPQAPGSEGAGFHAPPAPGRLCPGMLERGGLEVVEGSGRAGPSSRSRTSSSGQQSRLRSCSRVSWFSPGTRAHLDPLQVLPGASSFCRQIRPIQTRCNPSLSPYPAAASGENWALRSKAALLLALVIRRMGAEVWDSALQRLLALAGEGPVYQGLVALVIKYVAEEITQASQDDIGVSVTTLCTCFGESVGMGTGVKGERDPPISLGEHVWSXXXXGVKGERDPPISLGKRAWSGQGARTRVLAWVAAFGCQCAPIIGWHHTLTLAALTLDPIPNPHAHFCDPDPMSSS

SEQ ID NO: 15388 - protein, 332 aa, Chlorella protothecoides
  MOD_RES (267)..(270): Any amino acid
MRREGPTTSGCLQGSHPWLGSTDCQPTIPMDIKFDLPDPSKRSLLAAVGVEARSPYTPLRIHACGQNVTLLMLVARVHCLSKVCESRVGRQGPSTSWHIVRWDTRNPRPRPAHAPPVPPLQIESYFLESPQELQSPLNLRNEAAAVSLLLSYLPGPGQEEGCEEVRQALRQHCEGLWPSFVHGDASMQADSVRYPADDSPAADFQRLIMGIMPGRLTSVKHCAVFSQKMWARCGPSPSPEPRASVQTRSSALNQHTRRWAADVGIQXXXXPAIRYPKAHHGDHGWKADSCEALRCVFSKDMGQVRPLPIARTPLVRPYSLIRLEPAHKQVGC

SEQ ID NO: 15389 - protein, 354 aa, Chlorella protothecoides
  MOD_RES (188)..(190): Any amino acid
MQGFVIADNPHDVVPLTLELPAEEDAALHARRTAVWERLGLATEHNLSAARLSPQLLAALRVAVATAEELAGMETGDDPGRAPLNPENEAQALRTLDVALAQLLDPLEACPLLAGSPRAANSLESRQGVAMAGAGGQDASGVDMEDATGAQDSAPGLGNEVHAAGSVGPGPTTAITPELDENGMDDGXXXQSPGSRVCWTGAKHSHHAGAGREWHGRRLGGQLGCVPAVRAGPAGHPALRAAGVPRPAAGGRRRGLMRTPWTLARSAGPVQDLSSQTSKYACQAGTHSLAHPSHSLQTITNRISFSRCCSPCCSWMLAPPELLKHCCQPSCLRVWQETVIARDSDCQTCTGVCR

SEQ ID NO: 15390 - protein, 395 aa, Chlorella protothecoides
  MOD_RES (281)..(283): Any amino acid
MPSDACFFTRPARQGTSTSSPPGTCSIYATRLAWSPADRAIAAPALVELAAVTRTQQAPNKPFIRLEWPTGTLVLGFNSVSDRDEAVDLIKKLRELADWRLYLKGQHSSNLKGCCLSTAPLMPLTRVCPAKQSQAKLLASSTPPPGVPSAPQKAAYFAQDRLAMPFRPAQPDCPRNCCWRRKDPAGAPSRRMDIDHCQTCCRRFCIQHIVHHLCLLQGPGKAVPGTGGARHPARAGVLGGPRFAPGEAGEWGWGVCVWTPHSLELAAEGGPELPDLRGQAXXXSPRSLELAAEGAPELPDLRGAGLIPRARNRSLECLKGGGTGGESKQCIFNERPEVHRAFLAKVPHELNEKEFWTVYFKEQYKRLARRWAGLACWNPSPPCTPPEQGHHIWRP

SEQ ID NO: 15391 - protein, 561 aa, Chlorella protothecoides
  MOD_RES (8)..(11): Any amino acid
  MOD_RES (44)..(47): Any amino acid
  MOD_RES (240)..(243): Any amino acid
MNGLRCIXXXXTKRILRTRCLAHFDDGLPCRSEDGQGVARRCPXXXXTRKILRTRCLALFDDRLPCRSEDGQGVARRCPGVGSHQTLVDDTASKLPRLHRDRPRGRSGFLNLRSCCPRSGCVGQDGVSIIQQNGVSIIQQFPNAPPHQPLHPPRRFPTGGSTGSRQDAGGGPHAEPGGGPGRAVRHAPALGGGRGRAGRRGLPGQGPQQVGSGVPAEFQGQPLRTCAVNRPCLAPALSKXXXXTSTNVRSQSPLPGPGLEQRGGSHPSSPLGWLPRDPSIIQSPLQGAFADMGVLDLAGDGDGPSSHDTAAIATRLAASQAGASRTAAREPRGEPLRHRDHGLEDLRGPEQARGRSFLGGGSRPFRCCQGRGRGRGGGREEREVGRCPIQAAGHLPGPPAPSLQPPQPVRRACLPYITRFSSASSWQAPGIPLNIRDPAAYYRAGAPAVDGAATPESEPMSTLRDPGDHTPTPLSAVLRSIDPTALPLCPCDPALARAVLEELSAGTDAGLAARFGALAAGVHGVRADAALPPGLLGLLRDEALRTDELLRHFWGALPWAA

SEQ ID NO: 15392 - protein, 270 aa, Chlorella protothecoides
MLSAIPDLTVDNLLILFTMIDRHDPDSTWARYWASLPAAFHTGLSFPPTLVHRLAGTAGALELTRAQGHLKRQYDATRPLLAMLLAAYPALLSPAWFEFGQYTWAAELWYSYAFEIEFPGAGRDPAPGAGAGAQGTGEPRRASGESIAVPPGPPCSPAAAACPSAGATSASAPAPAPSTSTPVMVPFACHVNHSPAPHVVRYGRLSEAGMLNFPAFRPCKEGEQVFISYGPVPNLKLLCYYVGRREGWGEVGRGFTRREGQGIERGWGVG

SEQ ID NO: 15393 - protein, 86 aa, Chlorella protothecoides
MPVNSGPDVGTISGLTVGPPEAPADDPALAGVDRSYHVVVSAQGQSVHWQMRINYYHYKKAKRACAKLPICHVRQTGGSVMHIAPR

SEQ ID NO: 15394 - protein, 167 aa, Chlorella protothecoides
MHLAPIDLRLANSSKLHPLEACLLFQPPPSSNPQDHLRANHPSIYADCRYSIVEISAALAATQAARLGADSGHARRFDVQRRDATRADGWPAHPGPCFVLAMEVLDNLAHDLVTRRGGATWRQVSVEGGADGDAASPPREVEGEVADEHVARALAAWLHAAPPPRRG

SEQ ID NO: 15395 - protein, 352 aa, Chlorella protothecoides
  MOD_RES (154)..(157): Any amino acid
  MOD_RES (310)..(313): Any amino acid
MSLAAALRAVWSPGQCRKAHRWAAYIPFRQLQTVQSELEEPGTDKRYIDRLVVTAQAGRGGSGSSSCIQKSNRGEACEADSGRILVRCRIDGVARAFVAPRPKIMQRGRKITADGGNGGSGGDVIVRASGRYSIVLVLAWAQRGWPHRPPASLXXXXASGRMKSLAGVGQLHKAQPGSHGSSRVQHGGAGDNATILVPLGTLVSRILEPSAMDGAGEEAQQPAQGQAGVLRRPAPRQPADLGREEAAPPPEEAELPPWLARWRTAYTGDAVDADRRDGFDDEVGGGAGGQPGAGPSAGAEKRRGPRHYPXXXXGLVASPALARARAQKSVGVPGTTPLRFWRTWWRRGRRWW

SEQ ID NO: 15396 - protein, 275 aa, Chlorella protothecoides
  MOD_RES (272)..(275): Any amino acid
MLMPEASLGVPLVTAPWPDLNPKACGMSHAGDFRKGASHPPQPSQACTQGVHARRGGGAASTAAGDEDPGRHRWGGVALYVDLLLCGVSCYENKAALLTLRSNCCLHPAGTTWRLGRTPTSLWPPPSPTGLVGVPNAGKSSLLRALTAARPKVGSYAFTTLMPQLGVVDLGWGERMVIADVPGLIAGAAENRGLGHAFLKHVERTRALAYVLDASAGLHGAISCAVVVQRSKLESLTRDPGPGREKNVQSGVSNCQGHALETLSHSHRQAPXXXX

SEQ ID NO: 15397 - protein, 112 aa, Chlorella protothecoides
MFRAACPTVKGTLLGHSPTPTGLRPWRQLELLREEIAAYSPALAALPSIVIANKVDLLPRPSLVLCALRERTHLPVLASSARDGTGVPELLRALHALWAGEEVDGTPPPCPT

SEQ ID NO: 15398 - protein, 226 aa, Chlorella protothecoides
MPELCVHTPSSPSPKQPPFPPSPTHIVGVAHEVSGHPAVAPNHAKFHGIRNGIDPEIWDPAEDEFLPRSYSADTFTEGKAAAKAELRAKMNLCEADVPLVGVVTRLTHQKGVHLIKHAAWRTLERGGQFVLLGSAPDARVQAEFNALAADLARQYPDRARLWFAYNEPLSHLIYAGADMLLVPSMFEPCGLTQVVVACTCGTGKMRGNDIRHAKRVRGMWDDGRCG

SEQ ID NO: 15399 - protein, 352 aa, Chlorella protothecoides
MVKGPASAWWSRQPPAAPAHRSPAPQSVFPHVSLPCSHTSCPSHLDNTQTPSTAPHPQVELDEVALVVDFVFCDERREAWDNNERRDYHTALAGALADAELAARLACAALERDADAAARQEDLAAKRALEKAEIKYEAAKARRAAQAAFLYTRPTTPRAGEAVELLYNPDFTTLRGRPEVWVRGGFNRWTAGNFPPQAMRATGVGGFHATTIQVPRAAHVLDLVFLDSGDAHGGFTDDNRGLDYHLPVAGGQGALDPLRVVHVAAEMAPIAKEGGLGDVVTALGRAVQEEGHEVEIVLPKYDCINYDLVEVSGGGGGWGKVRDALWGGEAGESQGGGGRRGRDRDGEHLRAG

SEQ ID NO: 15400 - protein, 397 aa, Chlorella protothecoides
MHAPSPHLSATLPRASPAFPRPCIAQLQRRPHIQRHEIHCRAVTGSRTCLKEWAPVVEALRDGTQTWRTHRFSQFRQSQGLNPLPVKPTQILLRKGGLREPVFRPTDSSFLLFPTAFHTEDDLLRPHAKERYRAVRHVADGAEGHVPWTATQGGRALGGPVAAAVTDTFPAPAPRPSAGPGIRPSQRPPPGAGHGCGADGGLDDRGPRRPAAAGRLSHLGAALPGCPAEVAAAPAHHRPGAARLPVSSAGPLQHGCRAVSRRDAACPGQACAERANPHPPPRSAQAGHPRPPVHRRPRRPPARARRVPSAPTHTLRPARPRLANPARLATAGPDVFGCFSWLRDAPGAPQGWLPSSTPALDDVAFAARQLRCRRLLSALTADEICGDLVQPGRLGAL

SEQ ID NO: 15401 - protein, 248 aa, Chlorella protothecoides
MGRELALTEVAGPLVHARFEDLCGRPLGAADFIALAQAKHTLLLRGVPVFTGASRSQAYRFVTLIDVLYEHRTRLLCSAEATPSDLFANVVTVAAAAEARRKGRPPGPEQASGRRECGCCCVCVSGEGWGARNDGGDLASGHAQRPQSGGGLTPSGSLAQARGAQARGVTTPRQSSKPTPTVATQVVDDNLGFAKDRTISRLLEMQSGEYLEAHAKSHAPHLLLAIQEQRRKEEAREAGLGRAAGDSG

SEQ ID NO: 15402 - protein, 259 aa, Chlorella protothecoides
MQLGAGIFAVGAPFGTVAPAHFQSLLARGMLSGSVPDCSRLPQPVLWLSDLVCLPGLEGSPVHAMAATDAAATPTGPLGVLLGPLAPRSGGGGAVATLLVPMARVLEAVRDLENQGAAGVAGLSAEAGRGTPSFVGPHSPDTPSTSKLPASPAPPAAAAAGRSVVAVKARGGWASGVLVSHRGHILTVAHLFADPGGGAGGRGGGEPKPLPTPRAAWVAWAPDPGRPPRWLPARVLHVFRGPMDLAVLQVERGVLPRHA

SEQ ID NO: 15403 - protein, 106 aa, Chlorella protothecoides
MINIKQIAKFVVGLGDRVAPTDIEEGMRVGDIGGCKEQIDRMREVVEIPMLHPEKFVALGIDPPKGVLCYGPPGTGAEAGLFLVSRGRANTQSRRREEGAARGLQF

SEQ ID NO: 15404 - protein, 91 aa, Chlorella protothecoides
MSQACWLAAEPLQVDVSENDHSDTIQIPGKHTQNRPPRQGLFHPARKVREVYWRHYNNLYIGSQDALTAFYPRMEDEGINTYARAEMDVFI

SEQ ID NO: 15405 - protein, 207 aa, Chlorella protothecoides
MTPNPPDVALDAHGTGVDAEDLAAGLQVRQAKLHLAVQAPRSQQGRVQGVGPVGGHEHLDVPPRVKAVQLVDDLQHGPLDLVVAACAVLKARAADGVHLVEEDDARLLAARHLEQLAHLIVFRGRALSQPPFCSTHHAGALADVLLYQLGPDDSDEAGVGAVGHRPSQQRLACEAKGGWALGMSDAREGHTIWSGAYWSSGAPSHIS

SEQ ID NO: 15406 - protein, 111 aa, Chlorella protothecoides
MAKPGASDPEKDEKPIKTLSEEDVRIMQTYGAGPYSHRIKKLEIELREIAKRVNEVSGIKESDTGLAHPSRWDLVSDKQALQEEQPLQVGRRAPSRLMLSLNFIGNMVMEH

SEQ ID NO: 15407 - protein, 155 aa, Chlorella protothecoides
MPCSHRGCQVPAPALPHTMHCRCCKPCAGADASSSPFPPRNAQLPAPEPRPRLALEGPGAEPLTLMSLLEGLAAGIGEVAARLEDAFAQVTQLLRSLGESLRAALDPDGPRPAVHGAPGSAAADPRVGKAVTRLALAVAVFVIFRRAAPGLLMRV

SEQ ID NO: 15408 - protein, 75 aa, Chlorella protothecoides
MLGLSSAAEAMLGKPLDKGLRMSAWQRRPLTPAQLRYAALDALVSVQIVDAIVRQNPKLGSRRGLHAYLFDAARV

SEQ ID NO: 15409 - protein, 480 aa, Chlorella protothecoides
  MOD_RES (327)..(330): Any amino acid
MGRLARPGRRTSSACLRTTWRHPPGGTPTSATAGGRTPTVLGRWSLWFVPWPQLGTTTTCLTSGAPGVGGCPFHWSACEADGEVHRILHRMVLDWESQGAAGCYSMLLRSIQRRKYSTVSLSGHRPNSTAPTPFQHHPGSSATPPSRSRSPWPGTAARRCVVLGCVRGRLLSRPVNLATAPPNTLPWRPTPLSQTVKAGTFAEALKDVDPGAEAPGWISEPVLKYISTRRPDKEVGLVMNASQPTVWQFVNEKETNAWGMPRGYVIQSGVTTAQLLPPQHPLTKAAAWTKYHLAVTRSKDNEYRSHASMYDFFNPADAIVNLDNYLXXXXAHDWDRVHAYDFFNPADAIVNLDNYLDGRASIQPPSPASKQYQTIHPLNLPLALLQTGESVTNTDLIGWVTIGVQHIPRAEDVPLISNFGANFYIKVRCLASSCRDHVGCLGETLVASLAMSPDCAACSTHLSVPSKTPCLVQPWNYFDS

SEQ ID NO: 15410 - protein, 565 aa, Chlorella protothecoides
  MOD_RES (25)..(27): Any amino acid
  MOD_RES (50)..(53): Any amino acid
  MOD_RES (224)..(227): Any amino acid
  MOD_RES (346)..(349): Any amino acid
MVGGVKWIEIFAAVEPRLAELTMSXXXGGWGQVDRNIGRCGPPARGRPPXXXXNCPYDTQNVVQGDSGGPPARGRPPMLVAGRHRAIDRSHGMHLHSHAAHTAGADPNECWDIFKGSKATLSTNLCEACAKRVRCGKHARRARHTGSLYMVPGVGNVIPGDRKFLSGRGGCSPLIGGSWIEQALIQRAQTQTGERVPAATLIPSRRPQKSWMVLGPLAVTSLTXXXXLSGRGGCSPLVGGSWIEQALIQRPQVTFDITRIVGRHLSTAHSGMEPNGGACASCDADPQPASAKVLDGISPGADKTFPSPRASVLRCLLIAHPAWKLLGVEVTAPAPISPAPRLSDSXXXXVLVDCTSCLDVAWGGGDCPCYHLPCTSTLRLIPQHNHAAPLQPTQDILYRIEPMPPPKAAAVAYLDGHGPEPERFAHVITYRGTASPRDIMEYRVSSGLASARMALGVLLLIYAELAGCQHQSIRCGTHEIHVQVGPLPVSNTTITVALRAPGEIPFVKHPVDSISGGWGQEAVGKVRSARRSWRLRVLLGLPSLSMDPGTGLQNAVAITPAYNSL

SEQ ID NO: 15411 - protein, 418 aa, Chlorella protothecoides
  MOD_RES (79)..(82): Any amino acid
  MOD_RES (187)..(190): Any amino acid
  MOD_RES (211)..(214): Any amino acid
  MOD_RES (360)..(363): Any amino acid
MRYLSVGRCGFDPGDGAARASEALLRLPRLRSLEAPLHEVGPDLASLPRLTALTLTGVPHGELRGAAWLGALPDLASLXXXXLEAPLHEVGPDLASLPRLTALTLTEVPHGELQGAAWLGALPDLDSLSLVLESDLAAVSWRDWLDGFLARLVVGMPRLQHLTILGLAGISEAGMASLGQMAALREXXXXEEVKSDSCAREGSGSTAKCLXXXXCTWMWNPRYTTCWGKCGSTWFKVSLGARDLGGLLGEEGKGGSEVRQLCQGGVGEQSNVPLGHPCRVPWDAFLHFNTPTTSPSFQEEALPSAEPGELATAPHPQPVPCRLPALRERRAEHAARAALPNPAGPRLPGRRRCARSAFPXXXXSLQGPLGRVPTLQHANNLSLLPGRGTPRCRAWGACDSCTPSACPTSTSCALGAAR

SEQ ID NO: 15412 - protein, 73 aa, Chlorella protothecoides
MDACASEAQRQGDAMMSKWAEVMTNMRPKTYFLRPDVAFNMSRAIVRELWNQKVLNRPSAYVLQEPAANGKAH

SEQ ID NO: 15413 - protein, 342 aa, Chlorella protothecoides
MVAGNGEEPGAYSFVPHTTPRVPHALDSPLFCSTWCIPSTLKPALRPRHKPACRQVLTRPFCTHPFLELGEDSGGVLPPTPLLVGRVPLLGVGVRLRRGIETQTPDPGHQMLEGSGQEGGAVHRRPSRCCAPGGRRSVFKRSLGSGCPSSSVLQGTLHGQEGRREGTAPLPYTTEDLARCDELQKLVIEWEAQFCCSKQDHSVSDPRPHRLVVTGVSLPLEAAPLSFKTRQLQKACPAAGTPSLRSCSFTWTNSHITAMVQFQLPAADWKDRQTQLYAAGAATAVLGGALLAKRALRQRKPYNGSYTPETLPSGAYDVIIVGAGALSGTGAGGCGRDQAHNF

SEQ ID NO: 15414 - protein, 167 aa, Chlorella protothecoides
MLCLGGFSPSVLHSKQPHLPVLAADTGRRFRWFGWEGHVTLRGDTGIALHDVTYKGRRILYELSHQDMYVSYSGYGGDGQTFYLDSAFGIGQNTRALKRGYDCPWNSAYLGSGELRCGAEGFLTVAKAPSMLVETAGMWHTRPCQAGAVLLGRSVALGPNCRTLPAK

SEQ ID NO: 15415 - protein, 244 aa, Chlorella protothecoides
MPTPSPIHTPLAANTHAVCSHNPPPFQGKAVVGRVLVCADGSTSRLATQLGLCTAPPQGVSSRAYIEGGTHNTDFDGVCFYPRWSLPGYAAIFKHAKDELGFCYYLIPCGKNADKGQLGNVTVRRVGVVYQEEGDERQGRGPGKPACPGNREAPLLPRHPQPCTAHLLPSQHPSSAHPENPNNQADDLKRLHEDALKRDPFISRAVGPKAKIERMRAGSLRIGSQGECVCVVGGRGFKEGTRGA

SEQ ID NO: 15416 - protein, 81 aa, Chlorella protothecoides
MCGASSLAPSRLPAHLFWGEVVDDVEVLPDFLWRLALDHVGDRQACQVQEGLDVQVVGSLWGIWVIGARYGCLGEGLSAVL

SEQ ID NO: 15417 - protein, 221 aa, Chlorella protothecoides
MSAVTLEFKHNVVGRRVYAEGTVDAALFLASKIGEGAEKRLYNMVDVLSGAGKRGRCHPPCIERSGISLDLRNSLLNTPADVNTANRAGTANPALAASPRCISSRSAFTRQRRAPPPLWRTARNPGRNVAVSGIFGLGVPELVVIAGVTALIFGPSKLPELGKTLGRTAKSFQSAAKEQCAASWPRSHHSIPTIQEFESELKDAAKSDDASDSAKKLKDGQ

SEQ ID NO: 15418 - protein, 492 aa, Chlorella protothecoides
  MOD_RES (132)..(134): Any amino acid
MCERGPRWRCKALVACAEQWCGVISGTDLRTLPVTRSRDSSCSDPYGRTNDTCSRKLQGGMACLLFATISSLALSRRKAPGGEGKIRFWAMHRVAKREGKGFKDTNCKLYLYNPRTPRGLCPSGCSLIFLAXXXLRWAIECIMMLSLASWQFCVCRNTSRALPVWMQLDIPYRVEAVLHLSIRSMHSRWHTQRPTIALSHRINRRGACRSSLPPAAHCTFSSSHTSGRTACGGRETHVGNACRGLEALCPVSTGSQNAAPCWSSPIIRRHSGLSEAAHHGQQLQWQAAHDAWLRLQMGHAAAEAAVRAGLTLVPFSYGGPTESGRAVDVGGVQVTLVHPDEKLDVLHRVGLECRLCARVYTIHGAWPGNVREEYPGTVMVDYTLPSVVNGERQLWSLDVLVCELSRLTQGPCACDPRQALSSPSYQSSLPPSAPGNATFYSENSVPFVMGTTGGDRDKIMREATESGVYAVIAPNMGKQVGLGWDVREVFMT

SEQ ID NO: 15419 - protein, 65 aa, Chlorella protothecoides
MIKGKSPEEIRQHFNIVNDFTPEEVCREAAGRETACSTHDPFPDMSSRHCWSAGGGSPTGEPVGL

SEQ ID NO: 15420 - protein, 87 aa, Chlorella protothecoides
MLELMAAQFPGCLSGYTLRVVESHQATKADASGTAIANIHSFQRMGLEFDLVSRSHVHRTPSCLLTAPGQHEAALNLLPNTTHPEQH

SEQ ID NO: 15421 - protein, 235 aa, Chlorella protothecoides
MGICRLGDYVREGLGAVITVQVPSPEFEGQTKTRLGNPEVRRVVDGVVAGEAAAALEEQPGTLAAVVSKALQAARAADAAKKARELVRRKSALVRSTLPGKLADCVSGDRDACEIFIVEGDSAGGSAKQARDRGTQAILPLRGKILNVERKDDAKLYKNTELSNLIVALGLGVKGAEDGGGALRYGKIILLTDADVDGAHIRTLLLTFLYRYQPSLFEQVGMCRVCVWWWWVGAG

SEQ ID NO: 15422 - protein, 315 aa, Chlorella protothecoides
MPPPLAPPPHPRGTSPSPSPPPFTQNLQVLQGLEPVRKRPGMYIGSTGQRGLHHLIYEILDNAIDEVQGGHASQIWLEMDLASGWVRVRDDGRGIPTDLHPATGKSALETVLTVLHAGGKFGGEASGYAVSGGLHGVGLSVVNALSAHLAISVWRGGVRHAQRYARGVPLAPLAPAQGPGDEAPGGPRLTPEAELPQAAPSGGAREEGPPNGGQAGPPRRGTDVRFRGGTREEGPPDGGQAGPPRRGTDVRFRYDDAIFAAGAAFDPDTIRARLRELAFLNSGVTIHFRARPAKGGDAPWEALHYSGEGRGLVAG

SEQ ID NO: 15423 - protein, 80 aa, Chlorella protothecoides
MHRSVEVGLSMDEANLEANEGIKRDLNPQKILEPKTPYLSPMETDDELDMGEWAGCVGRGERHWELTARLILDLPATPAV

SEQ ID NO: 15424 - protein, 429 aa, Chlorella protothecoides
AAWAATNLAVGPGAAARAVAAALPPLTALLPSADRELAEQLAWAMGNLAADGRELRRRLVAAGVVPLLARRVVESAAMFCGEEAGDGVGGGQEPAGGNGQECTAAAVAAWALGRTLQDAESAPVQALLCPGPTSLGPALVRLVRLAPPALATEAAWLLACCASAPDPGPGWAAMLDEGLLETACARLQRAVAGGGLLEAACARLRCAVAGGVATRRGPAGALAQALLRTLGHMVAAGDAARLRPLLMEEGRGTLHALCSCVESVDQGLRGEAAWTLGNLAGLPGREGAEAVAQAGAVQVRLRLVKAAGGLPGHLWAWASRCACCKVDGPWKQAAGLAAALSSPSIPIPTPNQALLRAMGRGGALAVRHAILHALANVCAGGGDGRGDAAAIQWVLTQAGAKEALVEIAAMAGCADAQSAALALQVRCQA

SEQ ID NO: 15425 - protein, 85 aa, Chlorella protothecoides
MRFLAPLHCPATRCAHAVQGLGEMMPEQLWATTMDPARRTLRRLSVADAAAASDMFGMLMGDKPALRRALIEKHAAGLQLEELDV

SEQ ID NO: 15426 - protein, 380 aa, Chlorella protothecoides
  MOD_RES (120)..(123): Any amino acid
MFAGTRPRCNAPTRSACCANGDVCFGSQVRGEQWRGLGSTGSPDLFPVHLGRWFDLPPPTAPRAQRKWQEHGGRHSRVHPAPKWVAGSSGIQTTRVFWGNGGIICRAPSGLLSMPTVARXXXXMDSTPTLDSGEEWVFLQGGWIFGNPNNKGVVGEWWDHMSWPQWPVGHANCMGTLWHQRRALHPSHSAEDRAENIRRVGEVAKLAAESGILTITSFISPYRADRDAVRARMAPGERKICGIVECSDDGRVGTHESLRMLLPEVRMPLWLLCEIRVPTSRSDAVMLPSYSHASILQVISWRSISGSRWRCVSSEIPRASIRRRERGRSPTSRVSYHAEGVVRTCGSQAPAGCSLSGHVPAGTDALPTYIPTPKAAEIPG

SEQ ID NO: 15427 - protein, 467 aa, Chlorella protothecoides
  MOD_RES (38)..(41): Any amino acid
MAAVPRSPMKTIQGPRAMHMPTQPLLKLPAPLSHTQQXXXXNDCCASFPYEHNSRAKSTAHADTAPAQVPRTSFSYTAERSRRASTPKLNAAPVVMSCPKRRRGSNRQPWGWGGQGVRWDDGKKVEHGRPIPQGPASATSAAHTLRPPGLLLDKKTPFNRTSHLEDQDTPDQECHTRDDDIIVLADPRLGLPDLPQCESAAYQAYSQNDGRAYVNVHHGERERLDGRAWSSPRPRRASVRGGVEPDPKAPATTFEWVTMSTSSSGSLGDFLLNQQITRCSRASYHSCVCAGWGGSGLHLDAGGTGWWPRRMALRALAQEAWTVGSALLRRSIHSSATTSCLHAARQVPALQSCAGLSTSSGRSLPGLTRGFAAQASYSDEEIREIEARIFGSHIGNGLPSGRKILKQKLVGEKLASYYPENVLRADPYMLNIQAESINFGALPLLARPSPQGEAQAGSPTKAGQGTS

SEQ ID NO: 15428 - protein, 141 aa, Chlorella protothecoides
MTVFAVSKELPEALQGLQPAPLWRFFGELSSIPRPSYKEQKVLDWLKLFAEERGLAWSQDAAGNLVVRRPGGGGGEAAPTVIIQGHIDMVTEKNADVQHDFEADGIRLVRRDGWVTADGTTLGADNGEGRRGKGARVLDPC

SEQ ID NO: 15429 - protein, 151 aa, Chlorella protothecoides
MHGRFQPSFARVQASELPDRTDRPDGRFWLAGVAQGRVSDPYRRGVSGIARRKPIVAGPRTVAAVIDGESHTLGNAFRDVAWAHPAVEAAGYSQEHPGYNHVNLRVQTRAGAGVSGEQGLAQSLELLKDLVGVVGEGMGSAMAAWEARQAS

SEQ ID NO: 15430 - protein, 206 aa, Chlorella protothecoides
ARWLADAEARGARGAGAPDAAIVPADDLSAAALAVQAQDLATEDALYVLDGLLNRGGIAPEAYLKQVRGGRLRGRVRGWWRARSLPVFRTWVSKLGPVTHPPSPLSLPSPPGAVAVPPAVHAARAGQQDRRGAGGSARRARLAAARAAQRLRLGTRPGGRRQWVPVGRGGHASGRWLGQHGHPQQPAGGQPGAAARAVMAQGVACR

SEQ ID NO: 15431 - protein, 417 aa, Chlorella protothecoides
MAPTGRGVSPALTPARTRCHPTGAKGAEVQGGQGHGGHVGRQGQEEGNSWDSVTGHGRTACGVVHGDRRCVLGCPDRPVRHVIFPPYASQKWSKGKLKEKVNNQVLFDKLSLARPPHHSQATYDKLQNEVPKYKLITPSVLSDRLRVGAGEEQGVSMVLDWEQVPPYAFAILHKCHLHDCCAGKRQPGACRHQGAAVPGSHPRGLQDPLPGDLHPGNQHRGMRPRIWRPMRAPVVASCRWIHGRIRIGKGRGGREFAREQIATEAGLAIWNGPSSQIGLHRPNQPRNGMGGMCMYNEPCKRMERRVSFCKPSRTLTTGVLVTDREVPFVLLCGPSPAGAQAEITFTRPKDHAHMGVPPDQFDRRQGVLNKPTPAFHPSMFLSRVRAAALQTNDATLKLGLHQTRRAPPEEHTHARIS

SEQ ID NO: 15432 - protein, 314 aa, Chlorella protothecoides
MLSRKIDAQEVFCRRQGLVATLLCASSADDGFRHPSGMMCMSHAVQGGLCESALLTLRLTRGPAAGTELVVQAPAQILGRTRVPRQLQIKDPNVSERHAQIAWDGKTWTVRDLGSSNGTTLNGRALERQGDACPLHNGDVIGFGDETEAAAEVLPAPDESQTVEHYIQAEAARLAEKLRVRWGCAGKDALVGPSRVPWPARQALPDPLSLRPDTNSATFSPLKGGGAVFLPRHHWPAAQWIADEGGGSRQGVDGKQVSARVQDSPSRCCPKAGLTPRRSWRRQPPTSSAAPQPPPSSAPSSPRRVLPPPVGGSS

SEQ ID NO: 15433 - protein, 109 aa, Chlorella protothecoides
MAVVKKSKKSVESINSRLSLVMKSGKYTLGYKTTLKTLRNGKAKLVIISNNCPSVRKSEIEYYAMLSKSSVHHFSGNNVDLGTACGKLHRVSVLTITDAGDSDILKTTE

SEQ ID NO: 15434 - protein, 186 aa, Chlorella protothecoides
MLRLCLQRACAASYSAAASCSPAPPCVATSALRLLPSPGPRSFSSDAEAETREITNPRVLELADQITQLNLLEVSDLTELLRKRLNLPASYARPMYAAGPVAAAPAAEPEAPKVEKTAFDVKLDGFDAAAKIKVIKEIRAVTELGLKEAKELVEGAPVVVKKGLKKEEAEELQKKLEAVGAKISLE

SEQ ID NO: 15435 - protein, 153 aa, Chlorella protothecoides
MASYYASCWRGAPRLPLHGAHWLSRSWQLTCQHAGLCQSPSHALLPFPPPRVPWQTEDSALTRHFSQYGAVEDAQIMRERYSGKSRGFGFVTFASPSDARTAVASEHVIDGRKCEAKFALPEGKVRGQHVARAGRRVAGLALLRGRTTQKDAR

SEQ ID NO: 15436 - protein, 402 aa, Chlorella protothecoides
MPHQPHTVAPAAPTLPAAANSTPGFVRALGVGVGRGAYPPALLSEWHRWDAEHASENDPVDVFGQDQLYTDEGVHESNPSCGGLRMSDRHRGTPKLHDRGPSHLHPTLQTTLALAVAEEAAEFEHRDLHWGNLLVKPAAPGEALRCRLRGVELEVCGGGPRCTLIDFTLSRLQTAGGALAFCDLAADPELFLGPRANAQASVGREDGVLGGGRLGRACGSEGCAGEERHAQADPLQPAAGRGVSAHAQAHRRLLGEIRAGDERGVAALPGRHLPHAEAGPGVWWWGGVGVRAPVHGLALRRGARMCWRPAHSPFSGGETLHQAPSSHTTFPLAHPSAVQAHASRQGGPEGLPEAGTGLRQCRRGGVGRVLQGQLDGHRLIDDSPASWPCGSLMDAAAAHASM

SEQ ID NO: 15437 - protein, 396 aa, Chlorella protothecoides
MVGEGATPGGQAAGSPSSSGTHPFPLAPARLPPHRRSSVGGARWGAGKVWRTSLAPRLSLAGSQLASGVSSALRWVGVVQPPSQAGDEEPSHEAATSPAPWGVARASLAAGRPAAPSPIQESPGSATDEEPAGGDGDNHAAGGPSAVGGSGPLPLTKTGRASGLSEALKANDTSEPGDALELGEALRRLTLASEGRAAGEGEAAKTGLDLLLEFCGQTVGAVTRLTARECCCLGACWTERHQAWQGPSLQPRTLCPHDPQTVPSMEELLGQHVDLSTGLGLESSYSGHAMQWTSPWQGFCMEWLASLTFPHFPGLARLSRYPAQVRKIGEGTFGEAFKASGQVLKIVPMEGDIRVNGELQKRADDMLGEVAITKTLSALADEDAAGEVADCLGRGL

SEQ ID NO: 15438 - protein, 713 aa, Chlorella protothecoides
MGGGRGMAGRMAPLFYNCDLMTLALVPSEEACNTALDVCDPSVRKSADLSSNSQLSRCQARTIFPAFWHPRDSLCDQNRIVQVDHGTKTSPLEPAWGRRPAWAAPPAGQVASFAERGTHRASAAQIGSKVLIWIQRSESEHVRSALSPLAPVPRYTMPELAQHSALPTPEGTGRGNKSSRPRPPKWGVRPEDNRKSAHEHYADAEAARYTETGHANHIQAELALRAVQCLGLPKVDPQSGREHARCQHGPWQCDTSGLLGGGAPCLLADLGCGSGLSTAALLSLGGSRHAVVGLDAAGGMLSLAAQDPALRGCLARSDFGQGLPLRRASLQGAISVSALQWLFAAPDPARATRRFFADLHAALEPGARAAFQLYLPGDVESRALLRAAASAGLRATYFVDFPHPTPAKKYYLCVRRDDRTRREPSHGHPPCCPLAWPHTAACTLSWAAGQGLGSDLDQARTRLRAEHARHAAHALRMLRRAARAFLAARGAEVAAAGATRSEHLARPGSGAMVPCGAPLHAWCSVVLGPTTATAPVGPSDAEDSIGPAPDSTRVGPMADAITIAEQLGIPGAEEWVLEPGPAPPPAPPYLAALQLALEESQTGVRAPRPDPWLWLEPVPWAKATPAPPSPPAQTAVLHAAKQAPLVVSLATAGETTGEAVGRACAALGAAVVGLEAEGAREGAIAAWLVHVPAPSGEQAARAWQHAWQHAWLA

SEQ ID NO: 15439 - protein, 113 aa, Chlorella protothecoides
MVVRVDKLFGRGRDSKRRMRVSEARPLLEDAEAEKLVSSEVVLRDAIAAAEQDGMGVEEGTGRGEGWRPGRRRWRAGGGGPSAGPPLAMGGVGSSCTHGSRGVRAEAGAPRPQ

SEQ ID NO: 15440 - protein, 318 aa, Chlorella protothecoides
MPCTGQRPSHSTQGEPCWRYAGVLKLGTACILLILHVSMLHTCLLPPPRPGRRASAAEEIVTRSHGRASGSRSVEATCHTAASHAALLGHGLDPVPLPPRPSQGRSASRAHALRAASHPPPPQASGFGPPAPSFAPDSPSEDASTAEAFALARTLARVAEEGKGGNTRALHVAPLVYWTRVMVLSTVTNRPQLRAMLARMEAEALSRHGATPAPGPGPGRSTWELLDFGDVVVHLQTADQRAFYDLVGCRTLASGRGPEWWDGHRMLACAGGDTCLANPLCQGASCVGPDGRQRVGRAREEGASPRSLARLVLVDAEP

SEQ ID NO: 15441 - protein, 99 aa, Chlorella protothecoides
MKREAQAAIDAAVEDRIISALLGENVTQETRSSFRELYRCSGLLLGLCAGLPPKGRDNVFVLAGKLPCGLAPGPEVRSALQLVPCLALPGPHVLLPPPS

SEQ ID NO: 15442 - protein, 103 aa, Chlorella protothecoides
MNHQSLLHPHVVQLKEVMCVPPFLAIVMEFVPGGDMFQYVVSRRGLPEAEARWFFQQLILGMDYCHRKGAWCRSRVGSGAAGARELGLAWGEVGPCGAPRPRP

SEQ ID NO: 15443 - protein, 279 aa, Chlorella protothecoides
MAPGTSTSSCSCTQHRYVEQTDIHSAPVTVRESLLFSARLRLEESVSYDQVFRSWLEPHDPSTNHESLGDPGLMLAKEGSQHRSPSSPHWDMDSWDAASSFPSPPFYQVKSIVEETLLMVELDRIAGRVVGGDGSGISIEQRKRLSIAVELVANPSVVFMEGGGLRGGSGTTPYSEHFFEPTSGLDARAAAIVMRAVRNVADSQRTVMVTIHQVGRGPMKRQGTQVVFESSMGIVIARSGLDYQYACCQGWGGVRSLLSIGLAEQVCGGYEICLHCMRT

SEQ ID NO: 15444 - protein, 149 aa, Chlorella protothecoides
  MOD_RES (20)..(23): Any amino acid
MDTTPAFPDIDPTPLHTPGXXXXLDTTSRVTLPDLHGHHARLTGCRSHSAPHPWPISHPTQGKLTLLIGPPGSGKSVFLQALSGRLKPHGGLRCSERRVLPAPGSCHATAPPALPTSTCCPPPPAGVREHRVQWAAAGQLHGAACRRAG

SEQ ID NO: 15445 - protein, 227 aa, Chlorella protothecoides
  MOD_RES (119)..(122): Any amino acid
MSAQEHIDPPLVNRTDSSFGVDGASTVGDYFVTSRKRLDASARRDEEELIDAARGQPLSSQSRKALDRWGDLSPATRSSPPVRSAPGVSSVVMGHCKEPAERGIHRPPSVQGLTFDRSXXXXVMGHCKEPADRGIHRPPSVQGVTFHRSLLPFRLLPGAVPQIEIQYKNLVVEADAAVGLSNNPSLWNSAVGVLNSLLLRGRANKQPLRILDGVNGALRPVGAGLTW

SEQ ID NO: 15446 - protein, 242 aa, Chlorella protothecoides
  MOD_RES (33)..(35): Any amino acid
  MOD_RES (97)..(100): Any amino acid
  MOD_RES (206)..(208): Any amino acid
MIPYSEIPRGWKWLNRIRWAAHSIVGDVAGRPXXXGVGSGSTGSGWAVHSFVGDVAGRQWAFGVQAGPICPTQQGVATAESPCMKHLRTANGHRPPXXXXAESPCMKHLPTANGQWTPGEPPSLVSPTRSPATWSLYGLACSQLCDKETLMTGLSGSDIYLPDFMRAYFGWDFAMIWWCVLIVFAYCIFFRTASVILLSKSENSRXXXATLMTPWEDGALLLVQRVVPPCKQRENSQHVEND

SEQ ID NO: 15447 - protein, 365 aa, Chlorella protothecoides
  MOD_RES (144)..(147): Any amino acid
MRAVRNVADSQRTVMVTIHQVGGVWGTLAVGVHRLCSSILWDEYTDTPPPPGSYMLSQLAILLPALQPSMDIFEAFDALLLLQAGGVWGSCVRNVWCSRAAILPTPANRCCHDALLIPHTTAPSQRGGRLTYLGDLGFESSQLXXXXSSSPLMPWSYSRCRSGFLSQCPAKLGSPVTGQRPDADTCALDPGGIPGGPARCGAHPPRVQSRYLDAGGDWWVHEHHVQGRWAGLPHPLQGKLGAWTGMYEARGFESVDATPRTLHTMVMCPAQHRFGVFSAHPSPPSINRHANPQVSHLFQQNEAHASQLLERCAKEHPPLTLRSKYAASQATQRRWLIRKFCKMYWHLPQYSEHLWRWIGVGVTGG

SEQ ID NO: 15448 - protein, 162 aa, Chlorella protothecoides
  MOD_RES (130)..(132): Any amino acid
MARMSSMAMSTLSAQASSREPSFGGKGMCAAVVHATLGRGEGSRRARRSSDRCWAPLVHPPTPPIKSDLGAQLSCGSDELETSTSQRSAVPFDPITLICRGIKYYVPDPSKGKAVRKGAVDDGDDPALAXXXGWGGVRSLLSVGLAEQVCGRYEICLHCKRT

SEQ ID NO: 15449 - protein, 147 aa, Chlorella protothecoides
MRFWCTALRTVHARVVPPYPSGNLETLTSIELQALPAKHVIIPFTPITLVCRGIEYYVPDPAKGKGSGRGIVTGTGDAELDGKLQLLHDISLVAEPGRLMALMGGSGAGKTTLMDVICGRKTVGVIRGDILVNGHPKDQATWSRVVG

SEQ ID NO: 15450 - protein, 158 aa, Chlorella protothecoides
MLRSLPFPPHAAEFWHRSEWGGRMLASLDSAGDGAEQQAPLPSTKFANRSQGGNAGHVGSLRPGKVLPLESLVAFRLRATWLVIRRQALLNLVRQRAFIIARSIEAAIQALIMGSMLFGITPGTTTWRKAFAACVVAVNYVTLMSAPQLILVFNTKRC

SEQ ID NO: 15451 - protein, 362 aa, Chlorella protothecoides
MLVSLLQPPPEVMRLFDDLLIITDGHVIYQCVEWRLPCRVASVRRGLAQALTAPTRSAATERRLLCHTAAWPAPQPGTLHLLRVTLSTPLQTLPPPQWPGGVGAWLLRGPRLRLPAPKGPWQLPAGGHHASGAVDLRHQGAAGGEAGAGEPAEPSPAHQPAPNHAADTCRRHCRCEAGATSQGHRGLGLCLCPAAGCAREGWRAMQAAWPGVCRVRRAGVPCVMPEFVDWEARRVPVPARAPCRPAPTPAWQPPLRRPLLPHPMHIAADAVLSRSNIPPSLLPACRCLLEGYGVGPGHAGQTRQRQAGEGGGRAPTHHPIRQQVPGRVCWLSGGLPVSHSPPPPQPCHPSPFPAGSSWRAWC

SEQ ID NO: 15452 - protein, 157 aa, Chlorella protothecoides
MEELKRALEGSEPLPAYLSQALSQALSQALGQLEEGLEMVAHGKDASPRSSNGKEPDSPAGSPAAPTGSPPRPAEGGASPASPSLGPPRSAVRGTQGLDGTRRHGSGAPAAGRRAASATLGRAAGLGVQRQAVRAPPGCCQTDGMEGPDAEFLKLVL

SEQ ID NO: 15453 - protein, 162 aa, Chlorella protothecoides
MQGPAASIHEFPVSFPPCDGAVALLHQPPCLDGPGSVHQRAHEPAVAVPRATCRGRHDPGRVCAVRVRHEHQHVSGAREGGGRGPQRRIEPDRGEGRGVAPAVSSRRSDKHGPVAPPPPCSIFIWMSVVFSWVFLLIFTILGALALTITDPPKPRPTSASRE

SEQ ID NO: 15454 - protein, 106 aa, Chlorella protothecoides
MKLMGLSHAADTQIGDGLTRGISGGERKRVTTAEVLVGPQAVLLMDEISTGLDSATTYSVVRHLRDACHTLDKTVLVSLLQPPPEVMSLFDDVILLTDGRVIYQCV

SEQ ID NO: 15455 - protein, 570 aa, Chlorella protothecoides
  MOD_RES (139)..(142): Any amino acid
  MOD_RES (317)..(323): Any amino acid
  MOD_RES (376)..(379): Any amino acid
  MOD_RES (469)..(519): Any amino acid
VPVRLGAETLALESGVQAGARRETLRTLCVVRNTTALALEVALGEAPDADAGAGSAGNGAGVVEEVLEHQRWRPRVGWAGSNLHPRDPARFEHGTARRDDFPQVDPPRGWEWDSGWQLDRGSAGEKEGWVYAPDFSRVXXXXGTAAQNITTSMSQEVGWGDCDPEWRHPAAAEWGPGSSLMHSSVSRETGERCRRRLHPARLGLRHRTSPPLCLVRMLPRCSTLAHTGTTNPSSRRVQALPERYGARAALGATARACGVGAPGPDPAGLAGAGGAPRAPPSEGGGRRGVRLHPAPARRLGPVGVPAPPAPRAGGVRXXXXXXXGEEEGEAGEGAVAEQKAGKRNSPAHSAGPPSHGWSEGAVAGTHTVLLDCLDEXXXXAQPRLERGRGRGHTHRPAGLPGRGGDAAGALRPAGRPRCRGGRHARLASGGFDLQSPTPSLGGGGVQPVVCGHAGEQPAGGGRGAGLRGXXXXXXXXXXXXXXXXXXXXXXXXXXXXXXXXXXXXXXXXXXXXXXXXXXXSDAARAQRAKRAGAWCRPALRGQLLLLSRRLRVDGGGAGAGRRRRAPRGGA

SEQ ID NO: 15456 - protein, 461 aa, Chlorella protothecoides
  MOD_RES (180)..(183): Any amino acid
  MOD_RES (331)..(333): Any amino acid
MGACHKKLEWQGEWVTPSPYGIVSFPLNRLEITSPNRNLRWFPTPTRSLKDQLCPISGIRVSRVSNLLMMRYALSLLASAAPTARVAGGMRHAAALHTSRAHLHTPTQHMLSSWRQRGVESSRRAAFASQSEGRVAPLEEVPYNKDKYNTVSLIGNLGGDVDLRYLESGSKTATMAMAVXXXXVSLIGNLGGDVDLRYLESGSKTATMAMAVARKTKPAFWSVVSRLVALWHRSIEVHACAILAMSTCNRVDVVVWNELAEAAAQGLRKGSKVEVEGYLTILDTAAGNRKAQVRSAEPGMPSKDPPWDTECLLPILSLGLGSSVVHQDTVXXXEGSPLGYRVPVSVFVVRFGILRGAPRYRDSQMMSATEHVCAVLNSPLLQTSNLGCGPRHTESEQASPAAKQRLSNEEQDQLWMNLFENPSGGISGWVGLRAMTGHGMACLQDPSPPAMVQHPVALSGE

SEQ ID NO: 15457 - protein, 155 aa, Chlorella protothecoides
  MOD_RES (26)..(29): Any amino acid
MTPGPQTWIPTKERDAKITPRPKQSXXXXGQVREQGWAGVVPQAVRLDTQSAGTSVGICTPARLPGCRRFPAPKLGFPPKSVMRRSPLAPNNLTPTAVLVALRDISLGEEITISYIDEDAPLQERQDALAEYEFLCTCEECVAEGVALVDQSSTL

SEQ ID NO: 15458 - protein, 842 aa, Chlorella protothecoides
  MOD_RES (179)..(182): Any amino acid
  MOD_RES (209)..(256): Any amino acid
  MOD_RES (483)..(486): Any amino acid
  MOD_RES (519)..(522): Any amino acid
MSSTAEGDLIARQVATLLEVPSDETRIAHYYTKSLIGNTRNLAMSSTAESDFIARQVAALLEVPSDETRIADYYIKFTRKSGLSVNPHIGHGRGKGLQATAYLAHTRMLTLTPSHPPQSFKEGEVVLIEPPLVACQEPDSAAIVAACQHSFAVLGPTLEAHLAHAARGAQAVWRDSGYXXXXCYVGWWSMDVQYLARTRMFIVTPNHLXXXXXXXXXXXXXXXXXXXXXXXXXXXXXXXXXXXXXXXXXXXXXXXXFAVLGPTLEAHLAHAARGARAVWRDSGYGRLFLGPPACSCCGDNPVELSGWRQWAAHEPGWGREGRADALVWVWTPNPHHLARPAALRADPALCAATTCQSDESDDCEEGSPPCCPTFPVSEEVESGLRSGAIRLPGSDQWPLPSPVRCWITCRARSPCCRCPPGCSPESRSQRQPCMEVSSVGVMPACCSPARWPRPRHGRGTPSSSAPNPPRAAAAGSLGQARSXXXXAGLLAELAVLAANAPRDVSLCRALSGSPAWMCXXXXCANPPASGGRRVPQADAQRQRRAALRQLRSFARECNPVFEFVARALAGVLSRADAELEAGGLQPEGERTDAEWAALVKAWEPLAHGHKRLWWELPVTGLGEGEAAELRQREGFRGRDRIGQGGWRFVVASVAHMSLEALHRSRLNRLWGGMRRRPAHQHAPPGLLGLQPAGSSPAAHARPIHPLTERHELCQTAADLLRRALWDPRFPALFHEDVVGCLVGMVELNNLDLVVPSPALAWYRWYQEQYLTDPRRSEGQQDPAGAAAREVAVFVEAYGDALSVSGTGFYRLQSCCNHSCRPNTHAFKRDQDTTGAGAGAGLG

SEQ ID NO: 15459 - protein, 333 aa, Chlorella protothecoides
MWATTLVKRLLAKSQLHPSLPPPATCYSQAGYSVIFLSRTGSLLPFLSECQEDMATAFSVSGPGELQVSALAEALRTFHSCTEDPGTFLHVPFTTVFEYLQTVREREWPRRAWRCQAWRAQGLKHIKLGTNLGSWAYFSCCPNLRAPRSGEPVTLPIIISRIAVSGGDSKTPRISRSLGPLLPRSSSSPPPFAPTSAQVEHKISGAGPLVLELQKVPKLLGELTSVWAPHATVVSFKLETDEEVLLTKGTPPAHHHPLQAKAAIQKYGVDAVLANELHSRKERVTLLVRAGEGRAAPIHCSVLRLDPSAPPGSVIEEQLVGAVVDLHRQRSRR

SEQ ID NO: 15460 - protein, 162 aa, Chlorella protothecoides
MWFWVLGGSKSAHTHGVSHVPQGVRSKLLLFSPAIISVHTTITPCSPSQLVPRLQERQAAEAKRLKATERVARRLGEPSLYGDEPGGRSRRERRAVNYAFTDYDDMLRSAIRRSQRSGETGDEFLEEGRRGKRGASPVRLDPAVEAQMGLRRGRSVAGHHSG

SEQ ID NO: 15461 - protein, 189 aa, Chlorella protothecoides
MYSPSDCRDVAPPLPIIPPPYPPQKTNTVPRGVNQLAVASSGLFFVSASSDGTTKVWDGRRLDRDVSFRSRLTYSGRKVPQGRLLAARPPRAGKSILGTTLFLPFLTPPGGKINAATTLPDSSSVVTGSSDGSVHLWRVDTVARSGGERFTGVTAQRQVEGGEQREEGGNFGEWVSAGRGSSHTLDTVS

SEQ ID NO: 15462 - protein, 284 aa, Chlorella protothecoides
MIRFFLLLNRSGKARLAKYYTPLSDEDKKRLEDEVYRLIVNRDSKFTNFIEVGRRLEVPCIAGVLQKDMVPDPGHQHLDAVHNRNTLTCAPQFKTYKLVYRRYAGLYFVFAVDPTDNELLYLESIHLFVEVGLPMQCRGGHDSISRALGSGPAPCRYLGCEAPHSFPWPLRTPRVPARHPTSHPSTCALQILDHYFGNVCELDLVFGFHKVYCLLDEFVIGGEIQETSKKAGWGQGLGVGLAESKGSQPQQPWPVQLMIALDVPSLMGMQVILERLKELDAMET

SEQ ID NO: 15463 - protein, 241 aa, Chlorella protothecoides
MEHGGRAANRRLACSRPPASRVAAHSCEEQPVARSPSPVPATVSPPTPRTLGEAQAQGDDGVADGHGGSHRGADPGGVQVGHLRQEQLHAAEGQDDGPQGLVHTVVPHCHEGCPAGRHGRGVRWGGSGSSLVWSARARSPLPQGSGYMLCGLGVRGPGAGRHTGLLCEKGACRACSSAWTTTGLRALTPRHPWCIPSLNVSVSPSRCAGGDEVCQTDQDERAQLQTGQQLACQGALEGRAM

SEQ ID NO: 15464 - protein, 66 aa, Chlorella protothecoides
MQDTIRIPPSSEKTMKKAINISITIAYVFYMAIAITGYLAFGNGVAGSILSQPDVGPGVVSHGDGT

SEQ ID NO: 15465 - protein, 192 aa, Chlorella protothecoides
MPRPRQGRREPRRDRAEWEVAADSRSLNETEDSSDASSSGSGDESEAALVPIRLAMWDLGQCDKKRCTGTRLVRHGLVQELRLGTGFHWNATQVFPGVILSPMGRNCVSRADRQLIASRGLAVVDCSWARLDDVPFARIKGNAPRLLPWLLAANPVNYGRPAKLSCAEALAAALYICGFPAEARAVMGRFKW

SEQ ID NO: 15466 - protein, 391 aa, Chlorella protothecoides
  MOD_RES (232)..(235): Any amino acid
MTCSIVSAGANSLVGLHERPGCPPRHAAWHGTRQLTVLKTGSHRNTVPRYAEPERVSAASRDSTPASSASTTPPTQEGVRPDSLPSPDTSLGKKLAGGALVGTLAVFLAARGLTGPTSLEQLKSDAVDLDIALTNGKPTLIEFYADWCKVCAHADCLLYVWGENGSRTVQQHVAQRDCVFKSNFYAHQACLDPLGHLRTALLTVWKAWRLHACVLNASASCDGEHQGSPHSXXXXMRPQCQRFMQWGAPRFTPFSTPSLPPSQVCQEMAPILTDAMDSAASTAPTRPPGVNLVMLNIDNSRWTQERRQYHVRGVPQYQFLDGQGRAKGALIGKIPGLALVADLEALKAGDELPFLSAAGDAADLDSVAPSAGVSPLPPAAPAPSALPRDHS

SEQ ID NO: 15467 - protein, 1274 aa, Chlorella protothecoides
  MOD_RES (507)..(510): Any amino acid
  MOD_RES (607)..(610): Any amino acid
  MOD_RES (647)..(649): Any amino acid
  MOD_RES (686)..(689): Any amino acid
  MOD_RES (937)..(940): Any amino acid
  MOD_RES (999)..(1002): Any amino acid
  MOD_RES (1112)..(1115): Any amino acid
  MOD_RES (1166)..(1169): Any amino acid
  MOD_RES (1232)..(1235): Any amino acid
MPLMTLAATAIDAPRGRAVVVDTLIHYLHTDSLLCREAPGRLAVLQAETYEPILGWARARLGAALRPSDSIFGAGLPDADLAAAQAYLESLDRWHLTALEHLAACCRSVLLACAVVEGEVGVPDALAVARLEESAQIAQWGLVEGGHDIDIADLRVRVAAPSVFLRLLRAGETVKSREVDGVDGRGDLMGKAGAPRRCRKAPGRGTQESFTIAPLYAHAKELEEKSLDLRSDRLPRCAPKVTLGETVLNPLTHALLKHSGSGLTPVDGHLTVAEMRRLCGGHGWQVARPGPTHALQLPGPGAARGLHRAAPAPPLLRRRLGAACGAPGAVHRAAARGWPGGLRRLAREWRWGVRTLGARQEPGRAPAAPRRRASSRLAVDPWAPTSPSTSPQGMESEKGNTLADLLLPTAHSALSALPAPGGPACLVLLACPGAPLQVHAVAQPLATDPYCTVPPGWAAVLGPGRALPLAKDSAWVRERAPLEGLRRPGAVEVLLANAAGGLLEGLXXXXQPGAAEVLLADAAGGLLEGLVTNFFVISGGWHRGRGWGRAGRCESGRPRRGRLGVAAGWTGSHRRIVVGGLMNPMLQGGKLAHTCRALPRRCQRPSXXXXQKGPVIAAQQAQGVPATTVSATPAHPSHPTRAACGAXXXTKGSRHCGTASSGSPCDNCLCHPCSPLPPNPCSLRGXXXXRLAAGVGLHTPDRRRKGWRAGRDGAAGGPPRGGGMRPDRVGATPGSLTSQRLEGGLPHQQNLTRIVRPGHWAVDLPPFRPWTAAICALLTKGEGGVDLRRPALEALEGTPGPGWQHALALPSTQETESGSVIRARPQGMCSACGCQQKETQQKHLDQQEFKGRAGECSKHKRGVRSPGPVQGVVVGQVEGNERTDRGSNSPGPGMAVPPVHQGQRDAPRKSEVGINLRECPGMRLPYGSVGMLAGPSXXXXIWVQQVPSVHQGQPDAPRKSEVSINLRECPGMRLPYCSVGMLAGPSWSGLIPNGKQAGXXXXHGADLACGKLPGWGRPGRAAGQEMPCKGSTWEQHGWTKCPPVCNRVPVGGRGSNQDSDDLPDLELPLPVRSGVLEGETRRGEPPGERVGVGGGDGLRVDMPLVPDAKRQXXXXEPPGEGVGVGGGEGLRVDLPLVPDAKRQVLGSTRAAAGVPNPTAHLCSMPXXXXGAGAGVPNPDRTSVLDAHATQMHQPAPTLTQHGARAGQGLVRTGAREELDKSDLGGVVPIPQXXXXHGARTGEGLVRTRARKELDKSNLGGVVPIPQQAEAAHRA

SEQ ID NO: 15468 - protein, 539 aa, Chlorella protothecoides
  MOD_RES (368)..(371): Any amino acid
  MOD_RES (470)..(473): Any amino acid
  MOD_RES (491)..(494): Any amino acid
MDTHSPWQGINSTSYPSNAALESLEQALSGMPSVGADSIETLLSMRSSLEGPPSPQFHLPTSYPVPPANFLPRCAAVRCGPAWWNLAPGITSADPPITDPMTGLQTHASPSLTAPDPLETYSCPNLNSFLEVGPLYSSLGSISGAGGQALDGLQAPSATPSWNDTQGQVLAQALRNILLLKNWSLNTSGSEVTAAPHPPSRQVRLRERNSAGEPGLHRHALRPPCHLTALSPFLFSSSQVATLQPSAAAPSPGTGRSSPRGGPHASAEKIQRTVYVSDLSQDLTEAAISAAFLSCGSIVDCRICGDTQGPLRFAFIEFCSVEAAQKVRGCVRCRGQGHAGCCAPLAPGQTWDGSIRRCAFPSTMPASXXXXLGWLDPPLCHSIHHARLDCPLQAVSRSGQLVGNCIVRVSPSKTAIVPVSNTYLCVVRRDLESSLGYDVVTHKCLEDVPSSSQVHTFISARLPVTCSFHXXXXVAGLSKGERGVVSLFWGXXXXPAGADPARAANGSKWRALWHSEGPGTMTSPCPVVNHVHGCLVLSP

SEQ ID NO: 15469 - protein, 280 aa, Chlorella protothecoides
MLRQDPTETLFQFLCSSNNHISRIHGMVERLCSGWGPRLPLTRSDEYGGPAHHAFPTLDQLAAASEADLRAAGFGYRARFVTGSVARLRALGGEAWLATLRAGPPNVAVAALCTLPGVGPKVAACAALFSLDAHALVPVDVHVLALATRHYLPALRGKALTPTLHAQVQAAFVARFGAHAGWAHNTLFISELARYRGRVPGTKRAEKVLLARGSEVAEEVDAGPDGNACARVVGMDGSDASTGKGGRARRKRKGGAASVASSLVEEQMELAPTTPPQAAA

SEQ ID NO: 15470 - protein, 354 aa, Chlorella protothecoides
MLDFHRVLSNLSEVTSQHATSGDSSDGSGSESDAEEAPAAEATPAPAKPAPPKPAPPKPAPKSVSHQGRFKRRESAKDVRQYTSDSLQAILGGWPSAARSADAAPAPQVSRPDASARPCPAAPPTPALPRTDPGAWWAGYFERSGRLGSAARRAGPRPGAIAVHNFSEGDQEALFTRTHDGATQGRVGLGRAGAPKKVAGTRWAGTKTRLDSEDEGEEEAELALEGEAEEELQGVTIVMPPGRRPADPTGGTGEGRGGPAAARNPSTPTDAHPAPRQADGRPPVAPRTVKWKKLTLQVLQGCGKPSMRLSKLVKAVAAAAGVDCKGADVAAAVAGAIAGSRRLCQGNDGRVSLS

SEQ ID NO: 15471 - protein, 79 aa, Chlorella protothecoides
MASALLAPVQRYQGVQKESAGYKLLSSMGWKEGDGLGATGQGIKEHIRVKKKFENWGVGAVSRAAWEEGGGQVGSYMGP

SEQ ID NO: 15472 - protein, 269 aa, Chlorella protothecoides
MRRALIALAITLTLINPSAHALLESQASKYSWLLQNVGTVTDADLGQHLITLSEQGVLASLSPGDGRLLWRKVLSPGARLVSGPGVAVAIEPARVLAFAATNGALLWERPAVEADVAFTANGRLVLTAQDAVHVLAASNGVVVASSKVHVDGEEPSEARPSVHSAGADAATAVLAIWAPIRRALVVLQLDSSSGALTQIASHALPAKVQVDLDPAAVAFLAGSRLLAVTADGSTLCHAETQGGQRIGAEHCGEVGCGMQAQHMWQRSAA

SEQ ID NO: 15473 - protein, 275 aa, Chlorella protothecoides
  MOD_RES (119)..(122): Any amino acid
MDGSVATGDVEPCALGRMPPGFQAGTGRGLGPGTLLRFELGPGGFTLLDGRPVGADLRLLGVAGARRGRADTLSKVLFQHLARTCPLTYAELAAAAGAAPGGDAGSAVAPAAASDMVTXXXXGAAPGGDAGNAVAPGAASDMVTGGTSEREGMETEGEESTPASSMQQGQRRLERGAGIWVARVSVSPGREEGKSNPPAILTIEEGILQGPGRARHHPHHWQHCMSRFPLYEEWVVDSTPSRSPLTPRVSLLDAMHGPVCARPGPQMDVGLEPWS

SEQ ID NO: 15474 - protein, 798 aa, Chlorella protothecoides
MGDDLELYSREVNIEAQYERPCCMASSAEAAFRVDERALALWWVALALLRLTHVIGGIALLVIMPIIFLLAVWRRGGHQSLRDPDLHRRPGSRLLPGPVLLVQPHHGQDPGPPAPHQSPRVPGGGREDDGGADHTGPDLPHPPLHPALYLQHLRCGAHWPGVFLEVGMFIQDGRGAHQPSGASPHHAIPLARAVAMSLAPAQHTPTHPHMPPFPPSVSGTDGARPAWSLGTRLARECACCLASSTGVQACLLRAGGPTCLGGEGLCACDAHACEAGADVPCVGVQPGLTSCGEGRVPLVSFLALEQVHILIFVVALTHVACSFFLHSVARARIRLWRRWPEMDHERAALCVVRAMLSFAVCVGGRRGGRGARGFGGRQCMEKPCAGLLRQALVGVSSAPEAQGTCQHLIWNVRPRYFISEGVNAQIEQYHARLHGGGDAAEYGPPGASSSPANVAGGGAAGEPRQPSSSPLVDEGMATALRRIQTLMRQGSAAPGSEGVPPSADGASTVVEAPAARMGGERDKRWRHWAAWWREFAFCLYHGLAPNSLTRTQYQTLVMSFRLTHRLPASFNFLDRWRTTCRPSWVCPLNFGCSSSSTGWWRALMVSPRALPTRRGKEEGHVGTCAAQMLQEICSHVIRDMKTTIVQGTFHGKPQLFNCGPSCPPSPPPRGTGYPTMIFFALNGAVLALTNTKLQHIIRYVTNKVLAICWACRVLHSAVDTHGAPPAPTRLGKINMEKAPYPPYPDPRWSAPAAGAPRVLAEPATAHAHPHQAHALPLLLHLRQLHLLPLAVWGELLCL

SEQ ID NO: 15475 - protein, 355 aa, Chlorella protothecoides
MGYGSGPWEFEGRALYQLSLVRVDEVGCYHGCGAQIHDAMDEVGSCRVPGPAPFHGQGAWAGSLPWTGGAGHVRAWRPPTFPPPHFQARRHIPADLPLVSLFGWTLGGLYLARYTSSPAGAFDELVALAGLVWDGPTSCAWAGRVLVNSPAALQHGQQAVGLPSHAARFQAAGHSAWWHGGTPGGEIAATQARGWGQTRAESAAPAAPCLVVSLDDQAGRRGQPGPEARHSPTLCALRLPTVPSRKVPRMKLTLPSFRWGCVCVPRVCRAGGGMAGHSQGAGLMSSRLPSPHAAGVQRSHRGSSHPAQVLPEDACQDTAVPPNPAAPLGARGRARRARRRDPAADGGQGCALLGL

SEQ ID NO: 15476 - protein, 456 aa, Chlorella protothecoides
MENFDHVSFRKFSSWKPRCIENFRAILHQALHARGGGRGRGGNMLGQVSVLLCLREHAIVQEILIVKELTQGASAVAQSLWVLADGGLPGPLDLTLGSWDRRGDMPLQSNGQSSVNICESLDSQRARETGWEIKAGLPTAASTGAAMMPERSIFPNYCPEGSQRHGEYITHVTSESCNAMVPRERTPLLGAALLLLSLGVLTRVRSKEACDVDESYRMGVWAGPFTLKCAARKPFFHTSRAPAPPKFSRSQQPREYLTFLLAHWGRDLADASVRASFLCAVEPACPDSGPDGWKLLLIYAYGVKVRNPPDHRSQGYSKAGAVRKTTLHILGLSVGAIRMSPFSVIEARSTEIIVGVECLKAGQKACVADKDGNIGTGNRGKNNFGDYNVGYDNIGSFNEGNNNWGERNKGTNLRCNNAKGTRMIVNTCDLEQLRTSVRVNYNPPPPPSKKMMPPPP

SEQ ID NO: 15477 - protein, 159 aa, Chlorella protothecoides
  MOD_RES (70)..(72): Any amino acid
  MOD_RES (128)..(131): Any amino acid
RTAARAGPAGRATPRSCAWWAPSSTRRWRRWRGRWRRRPRTSWAAASCRRSLTRAAARRWRWSSARSWTXXXPLPAEEKLLDRCSEEQRLAVLKRVAGGGELVEVALNTHGTRAVQRLIETLTAREQXXXXGELVEVALNTHGTRAVQRLIETLTAREQ

SEQ ID NO: 15478 - protein, 446 aa, Chlorella protothecoides
  MOD_RES (211)..(214): Any amino acid
MVRAVSSARPRTSLDDWQSDGPSLGGMLGGSSNGARGSGSAPPPMEVNDVPLNSEVYGTPQSIRKRCDGYAWCTADAVAMAWVPWHGWWERVAVRRAAALTSFPLPPQISASGPPPHPLTLGPSFDAGQAGLHQAAVPSEGWRLPGRGRRDAGAAHLPGRARGQAPQLGVLVGSGGHPRGRPEDGRRAVERGLRGSFWVHRSAPGLDAAPXXXXAASGGRFGFTAQRQVWTQHRRRWVEFFKAINWVAGEYNMYRWVCWWDHGVCLCAVLPGMLTGIIGGGDPSWVYHVSHPVAVALWKGTVTLLRRRYSSPFMPCTRSGVNAPNSHDTTPPTRMPAQEMAPGVHLQHRGLQGTPPADQCTAWHAAHGGSVGAPGHCRAHEGAGGRGGGRKRHRGADAGIQAPRLAFLKSWTPNLWDSLTVNTGSTAWTQLQAAPDPYSDHFTAPH

SEQ ID NO: 15479 - protein, 263 aa, Chlorella protothecoides
MDTSLGPRSHGFPRVGRPWGLRVLDSSEAPGGSRGATDLASSLSLQGLRVLLVETEPELGAIASQLTQHELGYTGKGRLARRTWAQYGAEPVPCHATGSDSVPSIAGSSPPQSLHALTLATPWPIRRTGRGGLLSADDTTGRSFVDAFFDVPIVAMSDSAEATKEAMHAVELGAVDLLSKPLSMLKLKNIWQHSVRMVRRWRGGLGWGGMGVILHPMQRAAWAWPLPHQEPLVLPAPHHQPLPFTPAPTDDGHSPPPARGRHV

SEQ ID NO: 15480 - protein, 124 aa, Chlorella protothecoides
MHSTGRGPSPPPPHLPPPHRHPPPPRPAPTSRSQVVELIEAGADALRVGMGSGSICTTQEVCAVGRGQAEAVFECARVAAKFGVPVLADGGVQNGGHITKALALGASTVMCGSLFAGTEEAPGV

SEQ ID NO: 15481 - protein, 101 aa, Chlorella protothecoides
MHRGSLPLLRRPPPGGRLRGHPRLRQGAVAPACVSCAPKADMEAGIDVVVIDSSQGWSLFQLDMLRHIKREHPGLQIIAGNVINAFQVRALVTGGEECALG

SEQ ID NO: 15482 - protein, 380 aa, Chlorella protothecoides
  MOD_RES (140)..(143): Any amino acid
MADAAPAERGGFERGFGGRGRGGDRGRGGDRGRGRGRGRRDDGEEKWTPVTKLGRLVQQVLGCYTDAGSVLMYIKGTRKHDSCCSLVLRLVDVRRLAWHVGIACEDCPWLVKSHPAMLFRHTPIVRSPSPHLGRTPPPSXXXXCHAVSPHSDWSVSFSSPKSHTPCLGPMQGKIKSLEQIFLFSLPIKEYQIVDTFLGSALKDEVMKIMPVQKQTRAGQRTRFKAFVVVGDYNGHVGLGVKCAKEVATAIRGAIILAKMAIVPVRRGYWGNKIGPVHTVPGKVTGTCGSVSVRLIPAPRGAGIVAARTPKKVLQMAGIVDCYTSSRGTTRTLGNTVKATYAALAATYGFLTPELWKETVFQKGPFQEFTDFLAKPVIKGH

SEQ ID NO: 15483 - protein, 331 aa, Chlorella protothecoides
APAAAPPRRPATSSADPVLRALAAAKQGHVFATDELVATLMASPRSVYPWDMVVTRRGDLLFLDKRPGSSLDYVTNGETSPDPIPEDRKLLDGLQQLSAEATAVHAAFRAQVLRADGERAALEGPAPPPGSAPPAPVAGEAYRYRRWALGDIDLVVRCGVDGALGSTEGGAAAAAAPALLAVHAFNEFDPKWSGIDWRSKLENQRGAALATELKNNAAKVAKWTAAALMAGVDVIKLGYVTRASPKSSEAHLLLGTQSVKPADFAAQMNLSMDNAWGIVRALLELCYDTMEEDGGFPVWLLCSVWEGARWSPPRCDDGHECEASYSIPPPL

SEQ ID NO: 15484 - protein, 134 aa, Chlorella protothecoides
APPPGARPLFPAAAASQPLGNGTVPAAAAAGPGSAAPGAPPAGPPPDMGMVWGEEGVSMEERRAALPKHAALAAGSCVEALVSAWSVGRSVCMAGWRGGGQGTEGGGQGTEGGEWTRWMAPRTGTAIPGVLCSQ

SEQ ID NO: 15485 - protein, 128 aa, Chlorella protothecoides
MAAPSRDFRVAGARGVRNQNKHRRLFEGGEGALRQGDALSYQTAQGEVLLRGTAVVSAMGPSGILCDCCGAVVSCSQFEAHAGRAQRRQPYENIYTADGIPLKQLALLLPDLEEGGEDAGAEDDAGEG

SEQ ID NO: 15486 - protein, 197 aa, Chlorella protothecoides
MPRRTEVAALSVFCLAVLCVAPESPKMPHSHPPSPNPSPTTPRLLQLMVVVPFIIPIFIPLGIAFVLVYRRYVCTSREVKRFEATSRSPVYASFSALLKVGEEGSGAHMLVGEGDAGMAQSQGCRVHPWPAHPACAAPPGLKLVPPCCLLSPESTTPPTPPQVTPPPPQKTKRTGPAVHPRVRRGAALPRPLPARPL

SEQ ID NO: 15487 - protein, 271 aa, Chlorella protothecoides
MVHRALVLLGEAVQRSSRLRPRRAALELTDSAATRIKQLLEQRHKVGTRGSDDADMIRTGCPSHALRCGGAPVNRTCEADANSKAKFDELVEDPRGVKVLIDPAALLHVLGTKMDYVEDRLRSLTLACPFPQVRICVCQPQCQGDMRVWRIIHHRRQVCHGLMASCSVCCGAIACPLPWGVLCKRNLHGHAQAAMLPCTPQTPAPVQALTRRAPAHRSPSSASSSSGARQRCSVPRQPVNKRRPRVTAVPRWQTQSARSSSPGPGVITLRG

SEQ ID NO: 15488 - protein, 297 aa, Chlorella protothecoides
MLCASRRLSTMVACSGEQRDHGRRHPGGSCSLDPWPPLRPVAWGLDRMLLDWLPVPITGLQPSPSPPNSLSQGGLSCGVVGRTGSGKSSLLLTLFRLIPVTRGSIRLGGVDTARLALDALRRQIAIIPQDPVLFSGSLRGNLDPWNAFDDHRLWEVLGAVQLGPVVRALGGLEGRMQEAGDNLSVGQRQLFCLARALLQGASILALDEATANVDRATDVLIQEAVRTFSKTGAGDDGRARRTVLVIAHRIHTIMDCDRLLVLSDGHLVESGEPGLLARGRGVFSRLVRAAGAGGGRA

SEQ ID NO: 15489 - protein, 179 aa, Chlorella protothecoides
MFVGQGVYLYGDYWIAVWSSKSEAEQQEAFWIWGYAIMVSCVLAISLVRAQLFFHYTLVASSAMHHAMIERVRGPRELGPSPGASALVGPSGPVAMLGACLVLAAVGLPWQPRQALLLFPSCSKDQGAVDDQLPTVAFDAIQAAMIVLGCFVLVGRGADWTGSCPCHSASWIKRDTASP

SEQ ID NO: 15490 - protein, 94 aa, Chlorella protothecoides
MDFLRAAAGIAGTSVYSLHKTSTRDFIQKFAVKTLGLAPGAATVVAQLRYDLPPTYAFHRWADQGLEVGQQGPKGSSSGRGLHLQGERASQPGA

SEQ ID NO: 15491 - protein, 546 aa, Chlorella protothecoides
MLTFPQGLLGRRIVRLRHATALQTDERVKLTSEALSGVLAAKMLGWEDGLLARIHAVRGREQGFVRAQARIRALNMGLAFAISPVAALITFATARGTGHVLTVANVFYTIALLQLPKLYMADFFVKSVEALSELRVSMARIGKFLCLAEPPPPYHHVSTAPPGTLLVPGLDFDWEVLPWAQGSGAYGGVGPGDAGEKTGQKEDAQGGQGERVDAQPSRDPGELTLRGIRLESAPGRLIGVIGEVGSGKSSLLSVLLGELQPTAGGGVDVGGRVAYVSQVPWTVAGTVKVVVGGAVGWGCFLFRRGRASMLGHEVTIPAPAGMDGAPLDALAQRCAPPCTVRLRAPTPSHPRENILFGSEEDPDSYARVIQACALGDDLAMLPGGDAAELGERGVNLSGGQRARLSLARAAYSRAEVQLLDDPLSAVDPRVGRTLFEACIGPGGVMAGATRMLATHQTQHLAACDEVLVMRGGAIAERGTMAQLAARGVPEAAAMHGGFGRGGGWAAVDAGRGKVRVVRGEEEGGQQEGGSLRCRQIPGMLRAPRSA

SEQ ID NO: 15492 - protein, 549 aa, Chlorella protothecoides
  MOD_RES (107)..(110): Any amino acid
  MOD_RES (167)..(170): Any amino acid
MYRGTHNSAHMCAKAALHDASKARRVGSVTRAMCACAPGKRHHQRRSIGPNPAAHHMAALQRSNVLLAISRTLAWPSCISTFRGAALTYKAARYIAALRMGQCRVHXXXXCRAHDGAMQGANFKEDWTRMRAQEQQLRDDVVRGLGDTEAQLILHMRAIVVHLIWRXXXXRILYPADKEKVEDGQAAEKMNLPVKRVSLLAKMARKHFPLHADSGPIEILYEDEDIIVVNKPAGITTTPSHRFKGNSVLNRLVGKLGWAPLTVHRLDMETTGVNILAKTSEAARHLHAQFRHVSCRSGMQEDTGKRMCSHHLGPASPLKVPHAVHVIIFHCRDKNIEKTYLAITLGSPPSSFEVDVPIERHATNKYMRRVDTGGLPALTSFLVIASGVIDSGACEWSEYSDYNGSPIPCTTSLVQCTPVTGRTHQIRLHLAHHGFPILGDDLYGAKCKFMARQALHATPGVKPSLYSRVRLFTPDSGEAAHVKRGAVSSLSTSCEAGTTVNSKVENGCLPSCSERTCGPALMGQGCQFGLSGATVSEKTMPVGKHTNAH

SEQ ID NO: 15493 - protein, 171 aa, Chlorella protothecoides
MLQNWVCWLCIAHAVLLRAHAEGVEQQTSKRLRTVHSQLEDRPRHRLRDLAFAMQQDAGIVASAPTEWGKGLRCCVPCQLVKTFEQFYEQGCENCPYLAMDGDRERIYDATTTDFHGLTSVVDPQSSWVSKWLHHKNHVPGCYALSVDVQQLPQHIEDILSDNGVKWKREQ

SEQ ID NO: 15494 - protein, 320 aa, Chlorella protothecoides
  MOD_RES (51)..(54): Any amino acid
MCVGVIPACALVLALDSSTTFGGLSLRPLQTLPCTAVSPCGSPPCSQCPEXXXXACALVLALDISTTCRASRPLNAIARLVTCESDATLLTFTISGAGCEVPYILEYPASQLREGKGLRQQDNTDTICSARCKTHSIGMVHDAIAIAVPALLGAGLALLSRCQAGKKSREETYKTRVLKHFSPVPQLLEGKAEANLQSGAQQGLPDDRPKLSLLGGVGAQNRRCDARMPPWYSRGNSICWNIVVHHPALNGIPLQALYHPDKMNIAAIGNVVSQLHVHITARLASDPSWPGPCYGAVPAKEMSRIEVEQAVFTLQKAIKG

SEQ ID NO: 15495 - protein, 264 aa, Chlorella protothecoides
MKYEKRGLHCSILYREPADLPKSWSKWMLDLTRTNMKQRRFPDYAQAHYEACPGWGWREREKKSELAHPSARYLVAASSVAESEENIAACNSEQGCDVKPVAFLHFRFEVEDHKPILYLYELQLDNSVQVGIACMPAGILGCKPRDAVMRKGLGQFLVRLLELVAWQSGLSQLKLTVLNTNDGAGLFYKSMGFALDQTSPSAVSLDAAPGYCPRRIPDYDIGCAGLLPSKHYVRWRQMHVICCQALDMMMPATTLLAGILRTFQ

SEQ ID NO: 15496 - protein, 405 aa, Chlorella protothecoides
  MOD_RES (334)..(337): Any amino acid
MMGGGAVHAACASPIEGSGFWECPAPFSPTLVTENETLETIRPVVLNSEVVALDAEWEPGSKFPRATLVQLAAWSHDVGLYVILLDTLSLPIASVRSMIQEMLDNPRSIVVGYGLRTDLQSIGIHRSPQSLAHAVDLNRLQNTLANRMPYHLRPAGAGLGALIEAHLGQSLDKSQQCSRWGDRPLSDAQLHYAALDSVCLLGVLQSLIVHTESSKVRDSPGTDSPALEPANADESCWPHFRREALWQVALTWPAYCWDSAKQIRKRDARRRHTTGECSPTSFSLPCCLPFRTLLHPRLPPNDAEVVTLAPIAFLPRERSWTQWLPGSATSPSGXXXXPPKFVCDVMLHGLARQLRLIGVDAEAMDTVTAGQRHVTFRSGVQNPSSFIGLTQHDEKQFPGGLNICK

SEQ ID NO: 15497 - protein, 144 aa, Chlorella protothecoides
MTGEWWEWLKIRDGGCSHGTLASSTQGRDVDQGGRPLKGQLAFMLTRVLPQLPGMELLCVVQVFLQPTGPPDPCRCAKCNGSFLPDPVGPADVESPQVPEGVLLRQKEFWVCAKCRSVYWKGSQYEAAISRLTQMTTRLSLNSC

SEQ ID NO: 15498 - protein, 130 aa, Chlorella protothecoides
MEALADYGSSDEEVEQEPTPRNTADLTPPVTTIALPPAPNLLLPEPEAHFAAGQSQTVGPWPKRAHPSTAPQLPLTAASSAAKKQKVTRRFPLSAAPGRGDSLLIPPQLRGRANIATEDLSSIFSRRRQP

SEQ ID NO: 15499 - protein, 349 aa, Chlorella protothecoides
MLVMRGVQLGRQPLLRQGYRLQNTHDPVYASQNQCQNRTGKEHLQLRHGILPEKMPFSFGSLRQVCTAAVAANITAPETTPEAWENLSVTKTDSGVDITVEKSDNTYRVSIVLTDASLHDGLLHWGINDWEVPPEAVQPPGTREAGDQAVQTPISGNKITLSFPADGCPSKVVFVLKKGETWTNNGGSGYSAFLKPPGVDELHSKIMAAEGTYEHWSLFSRFNMALSILEAADAAGQIVRAGRTAAMLAISARPDYPAAVLSPTPSISGVKRRGDGAGGHLATPQYHAPAGLVPQGQLPGQGHCSRAEAAGTAHGREGDWADCDVDLSHGQGFQPPRGYVPEEHNGARL

SEQ ID NO: 15500 - protein, 251 aa, Chlorella protothecoides
MDLRPAVPHISHLSTSHHPLQIVPVRVLRQRIRNGLQKAINFATVVTDLTRCHNTWYYHRVDRCFVATEASKRQALDMGLKEDQIRLYGLPIRPAFSRKYPPKEKLRKSLQMDPRKPAILLVGGGEGMGPVERTVEALSKGFVDNMPEFMFASDIMITKAGPGTISEALICGLPMILNAYIPCQEEANIPYVVENEVGLFERNPHKVALIVKGWLGDQAGQLRAMAQRCRKLGQPDALFNIVRELSSMVAA

SEQ ID NO: 15501 - protein, 180 aa, Chlorella protothecoides
MEGPQPPGMLPCASPIPIASLNQCIAHTRGVEPRASLGLKPWDWQFWVPTRGPPRPCRGPEAQGVGPAGGGRDLLGPPASTSERGDVFFQGKPHLPNLSMGGGSGQGIGYSSFFLIQAPRLWPFSWWSPPKKLRTEEEKKRILILMSDTGGGHRASAQALKAGFEELYGDAYKVESGVQA

SEQ ID NO: 15502 - protein, 271 aa, Chlorella protothecoides
MQAGTAPGSGVPKALACLRELIPSALAAPAGFKDELAQKLVAEGLVAEDAFTEQLWSRAWQAICTVWASKWTDRAWLSRRAQAIPDADLSMAVLLQPIVPADYAFVLHSADPLTGQRGSVHGEVVLGMGEALVGNSAGRALAFSAAAGAPGAGAEDAALLALPSKRLGLYPDPSQALLIARSDSNGEDLEAYAGAGLYESVPLAPLLPRTLDYAAEPLVWDAAFRADLLHRLTSLAAGVEAAFGGVPQDIEGVLSGDRLYVVQARPQVVQN

SEQ ID NO: 15503 - protein, 294 aa, Chlorella protothecoides
MAASDFSALCLQEYMDRIAGLVQPFANDFKAACNIEPKYTLNFGEEVVRGQPVFMLSVLLRALGPKLRGAASLGPWQVVSAAGAEGEVLLLPNLDGVQGQTMPGATIILTERLTGNEDIPEGVTAVLTSSATDVLSHIAIRARAQKVLLATCFDHGHFEGLKELAGSHAAAVVTPVGDVSLAAIDRTSVGPEAVPGSASKAPKISLAKPAMRKRGSSWVLQEPEFKASVVGGKSLNLAALRQKLDSLQDVSLPASLALPFGTFEAVLASPENAAVAKTVSLAVKELVRGQWRAV

SEQ ID NO: 15504 - protein, 519 aa, Chlorella protothecoides
MGCRRWGLMWAGGMHASQATPPAEPPHTYHPAGDNQSLGASLSTFSGHLARIQAVRKACTGRELVLLDEVGTEAGYEKYCRPIHIMHMRLLQCDAPSHSSPSIPSTSSFAPGWAPTKPSNRHGSHGGLGAGGGRAADAGARWEGRRGPCPRHDPPPVADGAQVRGPGVRERQRGDRRLHPATPVPAGLGHPRAQPRPGHRRAQRPAGRRRGRRARDPGEGQPHGRGCVSWGGDEEKGGECGVVCRGPDAAAEPQGASLLPHHTGMVAEMERLRREVETARARAGEEERAAADLRRRSAARRASTVARETAAARQAQTSRAGVIDRALAELALVQKEQQAAKAERGRKEAALREAAAIAQERAARAERRAAWRPAVGEEVRVARLGIVARVLAVDAARKKGGVVHGAGASLLDPGELASGTRLLCDALGCNTVPLFPDGNPTVFALQARGLRPLRVLKGAMEDVDGVVLHSPQLVHGTLDEMLVVGHHQHRALERRETLREEDYGEVVTLGEWPEEDLSE

SEQ ID NO: 15505 - protein, 98 aa, Chlorella protothecoides
MQESSHVPLGMDAAGWRATLAQLGWHELCDEACRRLLPTLGDAEASQGLLTLTAALTAAEQSHGAQIELGSMRSVDAARALQRADQGGQLRARDLLVS

SEQ ID NO: 15506 - protein, 268 aa, Chlorella protothecoides
MCPNVPLPNPALPRFCHSLQHKEQEYRSHLASFGMTAELAKQTMYTLSGAQPGRRKRRGVHRVDVGGLLFAGGWRPAQGALTRSFRAANLSKVTCRQSAGGQKSRVSFAKLTWTKPHMLLLDEPSNHLDLDAVEALVQVRPDGFRLSRGWRGGLSCPGNLMTGDWARLMGLGIHVPCTVVGIHLHSPSGMVVWRYLFAQIFLWPLTQSYHLPIILLTQGLAAFKGAVLMVSHDQHLIESTVDELWAVEDNTINVFHGTFEDYKKRLKS

SEQ ID NO: 15507 - protein, 150 aa, Chlorella protothecoides
LTGLSSHPHRPKCEGPHLLPHIHRWGKTVVIVSHAREFLNAVCTDIVHLHARTLTQYKGDYDIFARTFKDRVKTSQAAAAAQEEKRAHMLEFINKFRYNANRAALVQSRIKALERMTGGMVGGWGSGAGEGAALWAGGVACMLSHGDSHA

SEQ ID NO: 15508 - protein, 238 aa, Chlorella protothecoides
MSPHSHHCAEVEVIEEDPSYVFNFPTPTDLGVWALAAGGCAKIRQLESIDRVEHVPVPGSATRATHTHPQPSYPTVSPPVLGFTDVDFAYPGGPRLFRDINFGIGLESRFAIVGPNGIGKSTMLGLISGTLEPTKGFIHRNSKVPAGYWMLRGQRWCCGRADPFADRETIQHAATHVPLANQHPHPPPPACSYASASSPSITWMAWTWHSRPCSTLQSATQGWVFGLLCGFWMEKPGG

SEQ ID NO: 15509 - protein, 738 aa, Chlorella protothecoides
  MOD_RES (708)..(711): Any amino acid
MDQGKTVGVVGPGRIGFAYAKMMVEGHKMNILYNSHEPQPEIADYFNKYSDFLESQGGTRVTARQVELEELLQNSDVGADGRLLEDAWCGPACRVGLFCQQECIGCWDFIIAGGLPFLQGTSFPLSSIPHGAVPPSPVPSTPPNPSSLQVVSLHCALTPETRHLINKERLGMMKPDAILVNAARGPNVDEKALVAHLQANPGFSAGLDVYEDEPAMAPGLAECSNAVLMPHIASATLWTRSGMAKLAACNVAGVLRGYPALKSAGDVLQFVDADPGRLAPRPGRGGPSPANHFRSHAVHDILVVHAVKPPAAADLQHAGSPRFSPRPPAPRSSVANGRSGITTSRHTGGLDAGRRHQDPVQVSLDNQTPITPPETAGGTQIDAGHHGVVGIRCGASQSAHTPHHTVTGVEPLPATDQHELERVVASLKAKAPEWVGLDPPTRASLLRACLPTLLATVPGAAAAGEAAKGSYGSGRAEEALNWTPIAICLRELAEAMEAGGAPPTLGSRRRPDGQWVVDVFPSGLERLLNAGFRGSVWVTPGQEPTQGALYARKAAGVPGPDPGVALVLGAGNQVSVAACDILHKLVVDDQVVVCKMNPVNEYMGPFVAAALAPLVQAGYVAVVYGGGEVGRALCTHPDVDSIHLTGAAATYDAIVWQGKPKVLCVWVFVLGGRGGSMGGKCVQRVLHHACMVPEGMHRSGARALRIYXXXXRVLFFLGGGIDGRQMRSNGPGPCMHGA

SEQ ID NO: 15510 - protein, 225 aa, Chlorella protothecoides
  MOD_RES (59)..(62): Any amino acid
MRTFLALLNVSGGKDACILERHPALRRILQPPAFQGAHQASLLMHFSWRRASAALGGDXXXXLHPGKASSFEENCSAARISRRPLSQSAHAFLLVQSLCSPRRRPIRLTHCAGGCVTNWASGGRTLSPSSIAISMHTCVISAAHPPGAVSFICGFLRSEPELACAATVLECVIHVYQQSTQGGLGMISQYGELAKGGSRPPAINLLFHRLGHYDLLMPGQIQSKL

SEQ ID NO: 15511 - protein, 484 aa, Chlorella protothecoides
  MOD_RES (43)..(45): Any amino acid
  MOD_RES (161)..(163): Any amino acid
  MOD_RES (271)..(274): Any amino acid
MPVLLAGAPFGQGVMICPLKTIEMHSMCVQDDTQHIARIHSLXXXFCPLKANEMHSTCLQDGTQHIARIHSLVNVTAASLAGDPCEADVSQDALAGAGRGEVGASQDPWEGAAGGWLVALAQQALPWAGSGPAVRSAPGHVHSRPCLKRLLSRLLSADGAXXXGRAQSSLESLRPLQCLTTLPIEQPPTSKALHRVRMDVHGSTRGYSFQLGHIDMAPGVDWSGRIGCSEGRLKHLLHSGPGAKAIEHCQRPAHAIPALQEQLTVGIEPWXXXXPGAKAIEHSQRPAHAIPALMKQLTVGIEPWKPHRPSRMCDGWCVLQQSKKRHHATRSVTTTGVAHQHVYITCFSAVYHTSTALVIAMFACSSEQTCASPAYPPPGPNCPRQSTAVIERAGPWVPAMSNLLKGVSSLKVKEVPGFVSKYAGENLTKNKVEGRLTSWYHRYKKEVRRGALVVVQARPARQQHGQGVRPGSLRQAMPMSEAQL

SEQ ID NO: 15512 - protein, 367 aa, Chlorella protothecoides
  MOD_RES (188)..(191): Any amino acid
  MOD_RES (274)..(277): Any amino acid
MGDLGKGGDVEGGEFDAASLWWAVPGPHRWELRVSSSPPCPRLQVLDNDFFLVAAKEAFMDAARTFLFETYCRVHQQIDLAELAGQLGMDREATEKWIVNLISVSGHHHNLTKSTATLHNQERAAERQDRRQGRHGGNADRDPGRQRRAAGEGAGPVCPHLQPGKHPGRHPQGLDFERLRHVALLRLXXXXHPGRHPQGLEFERLRHVAVLRLLGGRGVWCLIDRSSTECHAGRSPSPLPSTHTHPPFLLSPSFAAAPRARDLGFSSGMPSPHXXXXMGVHRRPGSQIQFGDAIAPQGRPKSGNNQALVRGAAGQLGLLLVLVVRVLLGPGDDVGEEEDAHHQVLEGLEAAGVNVLQWVQGVGGTML

SEQ ID NO: 15513 - protein, 154 aa, Chlorella protothecoides
MMLKSTMQSTRPACGVWAVGPSPMRMWRQPARAPAAAPRMKPVRAHKSMDEAALSLLAATGFMLALPEAAHADILTGRIASLAHPVAMIALFGSSVYTAVLGFQYRRTRDLAAEIKDLKAQAPPPPKGEGEEASSAVASPEQSRIKELEQVREE

SEQ ID NO: 15514 - protein, 98 aa, Chlorella protothecoides
MDVTTRGHLHTACWVRRPVICTKGPAAQSMWTPGPDLEDHVHITFPPLHHKTRPFSPFPGCAVCWDEGDEPHTLICDGCDIERHMYCLPVPLEEVPEV

SEQ ID NO: 15515 - protein, 522 aa, Chlorella protothecoides
  MOD_RES (223)..(226): Any amino acid
MRSASRPGRCQLSAGRHLTAQQPRSRSGRRSILCFPRFTQTPVPRLTPIGVDRHWNRYWLLPQEAFAEVPSGGGAAVLGVDRPAPSDASAPAERWTAGIYPGPEDLDRLLRWLDPRGVRERALAAEARRLHAESLASQEREEVREAEARAAPAEAQQAQDGAEQGFDATAPPVADVMQPGEDGTALAPGAAPAPDAAPAPEAAPAPDAATATDALEPLRSAVXXXXTALAPDAAPAPDAAPAPEAAPAPEAATATDALEPLRSAVLALQEGWAAATLQASEEELIAWRESVVVAAQPVDLARALLRLEGWVRPEFFKVHWRFWAAITPHPRSLGELWEGWAGRGNPPGAGRMLPDDTSCCVRSRRCDPPTCPPSTSPSSATPAALWMRYEALKSAVKLRVTLKLPGNAPTAAGGTTSRPPSRGSGRYPLRERRAAVGAAGSGQKRPWWDALEDGETSDSPAASAEPAADDRASRLAKRQRAQEREAQAESERGRRMVERSAGGRSLRSKPADEVARGRLREG

SEQ ID NO: 15516 - protein, 985 aa, Chlorella protothecoides
  MOD_RES (16)..(19): Any amino acid
  MOD_RES (70)..(73): Any amino acid
MGGWRCSWESRVADGXXXXPPPLFIQAVVDPLSKQAAMLTPVCWRSRLGVVPMSHPLPSPPVPRRLLLAXXXXLQYELSGRGLWERFPTDELNTVRVGRNDSVPPPLFIQAVVDPLSKQAAMLTPVCWRSRLGVVPMSHPSPSSPVPRRLLLAWPLPAHPSPPASPPPPFPLSPQVLAYLHEALGAEVMLTLNPDRGLADLPVKGFLRYVLPRGDGAPPAARFDGLPADQTLTLGMEVPEPWLVEPVATDHDLDNIRLAELGPGQRLAATFELEALLVTGSAIDLGAARSGDPSQEVRQGGRGVKGLLWSSRGAGILNTAENTAPARETGTSGVLKASRGPAWGRSRHVHWHGTAKASPSQPQPAPLGSQTYKANPTYKSPRNTTHHPRQVHPRGVKLELGPAGKVPLVDTLVMSNLGYFQLKAAPGEWTLGLAPGRSRELFSVARDDELEADHGMEGAAAPRNQGGLTFELPVTVDSLMGGTAARAVAGAWQPSRPLRSPPIIPSSSGHHLRLFLKKDPARLDEDVLAPSPGTGPTVGAWSSLPVWGGKKDEAPAPAKEGEDARIHIFTVSSGTIPAAQLVSLPCPPPRYERLQKIMILSAVKRTSARLKFWFIKNYMSPQVHAVGGSGGWCPLIDDDAIVIPFHPPQMKAFIPVMARRYDFDYDFIARLLTFKTAHPSTRHPCHPYKQVCDIQVAYLAAQAEREATHHLGVQDPVPGRPLPAGPQEGHLLRLRPGGPGRPGPALGNRPAGGALRLHPLLRHQQGDGGLPLLEAGLLEGPPPEINGAMHAFKVKCFDVTRDSLEGWGAIDNTLVSSAPTPNPLHQILPGPALPHLGPVPGGPGSLQDAGSRGQTAHPVRAAVQGPQLPVQPRPGERLGSLRREWGEGAQGFVSKPVDQGPSAGSPPDSSRHPTSLSPCHPSPFPSMTRPPLFTHTHTKHHRTCPTMPRASCPSTAWTRSGCGARPGAARPAAPRRAPSTCATIR

SEQ ID NO: 15517 - protein, 219 aa, Chlorella protothecoides
APRGAEAGPRLRLASGRAVARLNDLESDARYARWPARLESLLVPSFSGRLPGLRRNLLTAVLLFDPASDSAADLGEAARVVLLQGWPLRLGLVPLVRNGAGDEAGARVARLFLGVHATLGPDPALAFLASLAGVDFQSGDEAAAWKQVQLAFKRHWPKWVDKASEDAEPHPALQWTAAQALEAYVDQPDAATLRTLRAGVALARSTGLAGEERGRGQSL

SEQ ID NO: 15518 - protein, 244 aa, Chlorella protothecoides
MWSPARCWAWPGSRCPDRDGLKPALHQGFRHHPRLGQPTAWIRTYIRSQVPDSLVARRQEVVNKLRTLEGQVKTITDFLSNADNVRLLKQDKTQNQAFLQSEFGIGPDQVDALYHLAKWNFECGNYSAAAEYLHHYRSLSTHPDRCVSALWGKVAADILLQDFEAAMEDLLKLKDLLDLDTFAPVVKQLQSRSWLMHWSLFVFFNHENGMNALIDLFLQDRGPWTFITAVGPRAWLCCPCTGGL

SEQ ID NO: 15519 - protein, 279 aa, Chlorella protothecoides
MEGFHQASAPDEEVPSPYTLLCMALCNLLCIDLFDGAMEALEESRPEVREADYRPSAKAQHPLPVTPESWPEAAARILRIHAAAARADRGLASRAKGTAEPLAVLGPDLLLDLLVAGLDAATAQRVGGLPPHAGPQTAASIRAAADAAGRAAAIAGDGKLGPGVRAGEGWHGSTPLLRAALLRLCSGRHARALAWHGAGAAAATRAPRELDLAGVGRRVEAGAYAMAANPLEALAVDVEAVVALHAGLAGKQSEAAVALQSQGGRGGSLRFWCLARIEW

SEQ ID NO: 15520 - protein, 110 aa, Chlorella protothecoides
MSTSIQDLAVEVRERDACAIRVPGRTTHNKGGKFRVLVTKNLPGEDWLKVLTSAGAQVDICTAKQTILDNASITKLVGNKCDGVIGQLTEVRLGGSLRLAQGCGAAMPGL

SEQ ID NO: 15521 - protein, 460 aa, Chlorella protothecoides
  MOD_RES (102)..(105): Any amino acid
  MOD_RES (181)..(184): Any amino acid
  MOD_RES (276)..(279): Any amino acid
  MOD_RES (456)..(459): Any amino acid
MGLGTRAGQGGDERGAGGEGAAGAGGRGPHRVRADTRGPPAAAHVPLQACVGGRAHRGPGSLETQRTSRVQLTILVCGGCCTTLCLINQWPPGCREDLLKAXXXXCLIHQWPPGCREDLLKAIAEHQVLIIVGETGSGKTTQIPQYLYEAGYGKAGKIGCTQPSASVARTSGPWFLSMVMXXXXGPGEGFLRGLCGNSCTPAVSWCDAAQAWRTGGPWFLSMVMPAHASQRQLPWKRLGSNASWERPLRLSSCCCGVELEPLNLIVPCSVLPSRPXXXXSVAARVAVEVGVKLGAEVGYSIRFEDCTSDKTVLNGNRRGSAWAAMPPGRGRCVFHYAAAGWNLEPLNLILPCSVLPSRPCSCMMVDEAHERTLHTDVLFGLVKVRRAGFLNYVCRIRSAMLGSVRLECNLDGHSHHHIIRASPDVQPLSILIPVTSGVVAGHCTLPAGAEAAHLLXXXXG

SEQ ID NO: 15522 - protein, 151 aa, Chlorella protothecoides
MQYVIDPGFCKQNSYNPRTGMESLQVTPISKASALQRAGPKFSPPSLPQGARGAPRRASASGCTQPGRISTNWRTPRCRRSRGLIWGMWYSCSSRWASTTSSTLTSWTRRPPVGGERAGGPLAAAGAGGGRIARGSRVTPSAVLPPDDCWT

SEQ ID NO: 15523 - protein, 126 aa, Chlorella protothecoides
  MOD_RES (73)..(76): Any amino acid
  MOD_RES (107)..(110): Any amino acid
MLRALEQLYALGALNDKGELTTMVRGSFGDKIASGTTAPLSPGRACCMLGTSVRHLASLSFVPLSIPWHPVAXXXXCGWGGCTSAVHAALMPAWVWEADLAERTGFXXXXRGCVAGVVVHRRCMLP

SEQ ID NO: 15524 - protein, 133 aa, Chlorella protothecoides
MAPCRHAGRKMAEFPVDPMLAKMIINSEKHGVSGAQGGMESRAARCRVHMRGFPLIWMPCASPILIAAACWPLPLNTEEVATIAAMVSIGGSVFYRPKDKQVHADNAHKAFYRGNVGGCRGWMMWKGVPSATH

SEQ ID NO: 15525 - protein, 149 aa, Chlorella protothecoides
MSGDKALRGWVEERLHALLGFAERALVDYVVSIARRAKHPDALCTTLEAQGLPASQATRSFAIDLLSRCSGAGTSGASAAVSAQRQAHAEAVAAARRNQAYSLIVADDDAPGEQPRTAPSPGGPLEGRDGGSDRGSKSSKRRSTRKVGC

SEQ ID NO: 15526 - protein, 90 aa, Chlorella protothecoides
MSRQEYLKKREEAKLQELKDALEDEKFLFQGKKMTEKERRDLAYKEEVYRLAVERKKQLGEAGGFGVHSSSKDGRGSSEDGRGLGGLEVP

SEQ ID NO: 15527 - protein, 139 aa, Chlorella protothecoides
MGTLTTILYGPLQTSSPSAYSSPSHPAWSQDIARFRPELKLLISSATLDAEKFSEYFDNAPIFRIPGRRYPVDILYTKAPEADYLHAAAVTTLQIHVTQPPGDVLIFLTGQEEIEACEELLRQVGACVHFGESGLGGWP

SEQ ID NO: 15528 - protein, 510 aa, Chlorella protothecoides
MAQLPCRVISCVPRAQHTPYPWATPPDAKRHARVTTLALWAAAEALLDAGWRPQSEAERDATGVAIGVGMSFSTDLAEAGVLMCCTPRVTFSTVLDPLLSATRAPSLKQPPPPLPPQSQGRLRRLSPHFVPRILTNSPAGAVSLAHGLRGPNHAASTACATGAHALGDAARMVALGDADAMLAGGAEACIDAGPRHPVSPSPSRTHARHQGGGVVLGQQDPLHAGQCLALHGLVGVHHEAHDQFLATQLRDDATAVRVGGHEARHVVAADGQRGGVARRLHQLEQDAQQLAVALGQALRVLRPEVVGGVQRAPGQLAQQQLAPVALKGGELADAALQRGAQRRQQLRHVAVEGKHAHEHTTPQAPLTGVGQEVGRRLVEGQLPGSEHGLVQELGVLDHAAGRHANQCAQQPRRAGARGQWPDAGVAQEHAQAVRRGRHAQQRVGGAPQLRAQPVHKGGEGGGGRAGRRHVQRLCRGAGPQLAGQDGGQQARRFLLREPVGALQQPGVGVG

SEQ ID NO: 15529 - protein, 366 aa, Chlorella protothecoides
  MOD_RES (220)..(223): Any amino acid
  MOD_RES (279)..(282): Any amino acid
MWTCVPLTIELRGANSGVLRWGNEISGRILPRATSQQAEPTGTHGPTMIRTPKHFVELYNTLSLLVPACEPIMAPSNYTVLCSKALTHSDVTTEIAKSGRLVLPRAQVVSCLPRLLHLGGAAPASAKARPGGPTPAIPLFMYDMTGKMWRFQMKTWHNVVACGGRATYVLENTGEGPGIDSMPRAGGVVPPSQCGDACCCWNLDLRPFVGLWCMSALAAXXXXNLDLRPFVGLWCMSALAACPWIEVLHHCRGHPDVVRHLRPPVPQSYANLQHPSPPXXXXLDRGTAPLPGPFQMLSDTCDLPSHNLTQISSTPLPLSPRHPPAGFVQEFGLQPGAWLAICEQEGRLVLRTDLGGVRTSARAPPA

SEQ ID NO: 15530 - protein, 958 aa, Chlorella protothecoides
  MOD_RES (154)..(157): Any amino acid
  MOD_RES (493)..(496): Any amino acid
MRRGVPGSLRLEAETLDQCPAACVQIQAPGSQRRQVMPGKTVATSHPLPPPPEARKPAHAETLISAPRHAFRSRLLVRTEAASDAGQDGRHFNTPFLPLPKLSSQPMYVTCLQADQHVLGGGGLGVGDLGHELRHRVRAGCACDCPDREPQHAXXXXGPQRTGRSGQAAHAIALTENPSMLLFPPSTIPHHRTEAGVPVVIGAAGGLLKGAQAGGEVARARQVHDEVAAGHAAGPHGLVVLSISLLHAQPDGGLAASPPPEEDVGGLCTQGMGNGSHWGRGEAMQVGVDVQGHRVQGGLLGGAIHKRIACEPKLAQEVGVIALGHPDGLKCLIASAHVPGPPTSSERLCRQCSLGLSSSDIRVTTAAVLELHEVRRCYSSVNTQQSAGEPAPVYAPLRDLLVECYRRPGYRGQGAMSEQSALAPVANTVVEILSDTDSEDDALRIRVSGRPRAEVGFLCRACTRLVLIRGCPTCPTQQRRVPGEFSGRSHGVXXXXVLIRGCPTCLTQQRRASGEFSGRSHGVSVPSTVSPPLRIRRVVPPRPSVHEVALDGSPPASQEDLVVLSSTVVPVQRPAFKRRREGSGWGPLKLPAVPRAKAAPPELQQAVLDPVQPGPKAKAAPPELQQAMLDPVQPGPKCGICMEPMGGSTGRSMASGPCGGCSDKGWNWEPQRGVAVKVSLACGLPSCTPDTKHGHHHPTPPQACILLSVSDECHQNTETVPDLSKRPQPTPNTQSICAVLGVASPLQTWERGEMSLPLSRTDTPNRFRALELVRVHQDEPVTPQESAWHDACPIQSSKTLRGNRSDAQLGAAPVPPLGVVPKRETGKERGYRPDLGPAGNNSFTRWVVPGPTSPATRLATTPPQPILRSSLVFSFLLRMQHSPDLVVGLEAEPRRNGPVLLGLLGQLLLDGERLLGRLQKGKLKSVLSQSLDALSAVRASSRVPTTPGPPSRPHGAPS

SEQ ID NO: 15531 - protein, 450 aa, Chlorella protothecoides
  MOD_RES (98)..(101): Any amino acid
  MOD_RES (189)..(192): Any amino acid
  MOD_RES (436)..(439): Any amino acid
MERWVGAARPVFMGNQLGGDPVPAHRHLLQPPGQDAEGPGLAPHPPAIQVQCRGGGARGAAACRWNWGLVEGVNSSLARLLLAASTSSLWRGFLAPDXXXXAPHPPAVPVQCRGGGARVAAACHWNWGLVEGVASSLARLLLPASTSSLWRGFLAPDGLVPMTSYIPLRPTSQLPLSCPLRHAVASALXXXXASQLSPGVPLRHAVASALRSQAGERGAGGPRPLRTSRPSPGRRQRPGRPPGHDPAGPRQACPDPGTCRRPRPGMCWGALDPGQWFPPPPKQPSTQASHSASGPGTVELVENGNGLQPGQLADVRFVVAVPGQGAERQLRAALSALSGGDVTLYDAAAGAQGEPTWGSLDDVVMGGASRSAWSWEDAGGEGGDRPAGVFSGEVTTANSGGFASVRMINMRGRRYPEQEGGVKWVACVDEPRSGLXXXXKNDKYGGQEVS

SEQ ID NO: 15532 - protein, 489 aa, Chlorella protothecoides
  MOD_RES (472)..(475): Any amino acid
MRPFVWSLHMITAGTKVLLPILTGPWEGDYCPGLQQDLVFPCRRPGTSSCWPAQLRTPIYPSTCHPAPHHHPQHRNLASLFGADRGSGGAPAPRPLAGRACAGASLDDQFDLRQLAVCVRIRPPITAGAPRWDSENCIHATSRHGLAIAPPPGSAAYAAGDRGQTYAFSAVFDEHTSQADYYAATTDALVRDCLSDPAHSSLIMAYGITAAGKTFTLEGSRRAPGLVPRALEALFAGRDARGAALRVVLSYFEIYNETIHDLLDEAGAAAPGARPSLRLKEDAEGRVFVAGLSQAEAASAEHALCLLRRGARQRARAETGLNYASSRSHSVFQVGKTLAYEWRWCGDEVGSDSGSVRNKRCILCAGEAHEHQIRPCDPNKLCPPPCTDHAVPACAAGGAGQERPRRAAGDHVLCRPGRLGARAAHRQRRAAPQVGGGWGGRVCGERWKPHRRRWLFPQAPALMSIAFHHPRXXXXLAEQEVHLLCRRST

SEQ ID NO: 15533 - protein, 212 aa, Chlorella protothecoides
  MOD_RES (118)..(121): Any amino acid
MEFEVRAEVAAEMGALMEEMERNYSARLAAEAGRGAEAGPRGGDAGAGLSAQLADARSTAAGLRAELAEACAALEETRPELAEARAELEAREMELEGCRAELHDARDQLSQKAEQLSXXXXEKRSWRGAGQSFVTRETSSRRRRSSCRVQRRRWPPSVLVFEQSWSPRKQASGRSKPSWLRKAPPGRHCGASWQKKAPPRSGAGRKSWSRPG

SEQ ID NO: 15534 - protein, 152 aa, Chlorella protothecoides
MAQGNHTDLLRQFGLARNPFVDRTAEKTSLDPVSLYVHSDLHGFTPSETTYIFFGRRGSGKTTIRLSMQKAYAQHNESVRASGVSRGHFIVDLSRPGHLTACLRTFQESTGCTDDNWDASFGALVAKVTDSKSATAQDMLVRLQAGNIHGLA

SEQ ID NO: 15535 - protein, 89 aa, Chlorella protothecoides
MTLGRCLEALRWNQQHREGPLRVLPYRESKVTHLFRDALHGWGQVVLSVNVSPCAKDYDETTHVLRVRVEGCGVARGRAQWLGGRGMGG

SEQ ID NO: 15536 - protein, 70 aa, Chlorella protothecoides
MLIPKLPFARLTREISNEMSPEPFRWTAEALLALQEASEDFIVHLLEDTNLCAIHAKRVTISELWGPNDV

SEQ ID NO: 15537 - protein, 406 aa, Chlorella protothecoides
MAEAPCASGPTAQLAASPHDAVRWKITCMYRQLERVPSILERLTSLGQGQLSAEVQEWVVGALMRDPYHASHVIDVDYHRRLCKALFAAAERSDDGVTDALADEFEKRQCAAQQSRSGWCQKVWTYGVTGPVPGHLGTTASDGASGCIALGLSHDMLAGSTGCHEWEAGFWLAEYVLSNLAAFAGGRRKHCVELGCGAGVVGVALARVGAASVLCTDGSPEAVANCDANLRLNGVGAGDNVRTALLRWEDDPAGGPMPDCILGADLLYDPRAVAPLLHAVTWLLQNTASHGGKGERRAPAAALIATVERNPDTLALFEREAERHAFLQARRVAVPRVQAVSWHEFEALEAARPRLLLHELALRAPGGQSPDCRTDPSACLRDFTALTFTTKGQRDPSVCNDPQLCD

SEQ ID NO: 15538 - protein, 181 aa, Chlorella protothecoides
MDTFNYIVPVYVRLAAPFPARHLCTALGWQSNRCGACCSQSDTHALGTYPQMGFTCASASLFGQHSAGMSPVMMHSSCRATAMPPACAGAGRPLHHHTAPLPTHAAVHRLPCGMAPQGGPHGHPSWVTSASPFRAEDQSIDLDSRIASGEFSDTGSTKERLTRPLRKALAKDPIGPGEGIM

SEQ ID NO: 15539 - protein, 218 aa, Chlorella protothecoides
  MOD_RES (168)..(171): Any amino acid
MTEFLRRGAPGMKGVTADAEYTMLTPTPLPPSPQSVKDMPIVQDGPPPGGFPAVRYARRLPNSGPAGFTLFGVGAAVMAYGFYQVGQGNIKRRDEKREKLDSRRALVPFLQAEEDRRWVAANEEFLKKQKEIMKNVSSGTLLSVHDAPLHAVLNIPCYRAAHPLIVFXXXXEEAEGDHEESPRVQGRGERVQDALGGTRPEGGLLGRGMSRPKLLRWT

SEQ ID NO: 15540 - protein, 376 aa, Chlorella protothecoides
  MOD_RES (169)..(172): Any amino acid
MGSGQIVTPVRYPIPAHLRSGGPGPPAAPRGAHSFFLPDGRHGRGVPAPPRPLPLAGRNQARHPGPHGRTAGGACLWLCRGQTPIAIRRQSAGSAQTLHYNPPEPCPPGGGQRCGGGPGAARPSVQAEPPCAACPGPHPGGGGPGRAGEQASDMNRDVYRAERARPIAXXXXWPTRRDVDRAERARPIAARYIVRRDAAPVDGSHRPCRATQGGPGGQTMAIGPLSNLERDFIQNAIAAGVREDGRGPYDSRTPSFSFFPDDSGCVVALGDTLVSAGVSATLRPPFPDRPNEGSLRVSARLTPLAAPGSDPGARSAPEAEELALALERGLRDGRAVDLEALTVLPGRKVWHLDLALTVLGAGGGLLDAAGLAALAA

SEQ ID NO: 15541 - protein, 347 aa, Chlorella protothecoides
MGQGLIPADGEVWKIRRRAIVPALHRQYLNSMLNMFGECSLHGAAVLSKAAEEGTMVEFENFFSRLALDIIGKAVFNYDFDSLTHDDPVIKAVYLTLREAEYRSTFPIPYWNSALLRQLVPRQREVQSALQLINRKLGELIENSRSLAFEEEFLSRSDPSILHFLIAAGDDVTSKQLRDDLMTMLIAGHETTAAVLTWTLHCLATHPEAMARLQREVDEVLGDRLPALADYQALRYTTRVINEAMRLYPQPPVLIRRALGDDTLQGFRLPKGSDIFISVWNLHRSPAHWDRPEAFDPDRFDLAGPTPNEITTGFAYLPFGGGRRKCIGEGRWTSGGFLLCVCVLWGV

SEQ ID NO: 15542 - protein, 71 aa, Chlorella protothecoides
MESVVALAVLARRFDVAVPPDAPEVGMTTGATIHTANGLWLNVRPRSLARQETSVGEGEVAGLDTSMLVGK

SEQ ID NO: 15543 - protein, 362 aa, Chlorella protothecoides
MTSDVSSLPLCPTLRSKLSAAGFTSAAAVAQADPARLAAVTLEDAQRAQHAADARTRSGLAGALSAKALYDRERRSQRIITFCAGLDSILGGGVGLQQITEVCGGPGLGKTQLGMQLALDVQIPDCFGGLGGEALYVDAEGGLTLERLTQMADALAAHLRRVAAARGDARRAQAAAALTRERMFDAVHLYRDHADLAARTRQLAQLGQSLMEVAVAHDVAVRQGRLAAKSWEDLAGQKRCGLHGRPDLHSPGGCAVPPHRCHSPPIKNAQVVLTNHVTTRPGEDGGVPPRLIPVLGDTWAHVATSRLMLYWEAGARRAFLYKSPSQPPASCEYLVTGEGIRGRRQPAKRGPEGECRGEAAKK

SEQ ID NO: 15544 - protein, 335 aa, Chlorella protothecoides
MRFERRAVGPKDVAFAITHCGVCHSDLHQIKNDWGGSTFPMVPGHELVGIVTEVGAEVTKVKVGDRAAVGCMVDSCRSCDACQQDLEQFCDNVTWTYNSTGKDGRATQGGYSTHTVTDEKFIVKFPDTLDLAAGAPLLCAGITTYSPLRHWGLDKPGTKLGVVGLGGLGHMAVKFGKAFGAEVTVISTSPAKEKEALEEFGADHFVVSSSEEDMKRHATTLDGIIDTVSAKHDLNQYLSLLKLNGALVMVGLPNMPLPIAAGSLIFKRRTLGGSAIGSIKETQVGCAGGGGGGGMGSWTLLPAMESDSNMQWRGMVAKALRLVPTDATPPRAGND

SEQ ID NO: 15545 - protein, 392 aa, Chlorella protothecoides
MEQALKYTSIGRAGAIRREMQAHRHGAWVGGYQRAARQGGRPVPPAGEAVRGGAGGWLMNNMPKLFDLHISPGGMRLHTEQAPDGDDAAAPRYSMMERTAAPRWQNPTYIKRSLRRDQASLGLISITPSVVSADQAVQEGAEDGRRHPQALFRAWGDAGHERAAPELPGTQGGCHGPRQTGREEQPEEPRVLACLWDHSQHLNKHIPPLPTPSLIQQSDENFDEAMKCYKNALRIDRENLTILRDLAVLQVPRELAGGAGVLWGRLCRLQQRSAVRPGCGCSTSSVPMTLNRRLGRPVCTLVLLLFVMGMPPKGAQPLHTPSPPKHDRPFADPDARPTRLPGDAPDAAGAQGHQPTELAGLCRGAPPERQPRCGSQGAGQLWGHHGRGSRGA

SEQ ID NO: 15546 - protein, 149 aa, Chlorella protothecoides
MSGRWRGTSDGREALERLQEDTPVPPRLTPRAQLHPPSLPHRDPDPDGVQLAAAADPLGEAAALVQRLTQCAGDRLQTQALAAEVQLLRGRLLLALQAVQRAERLAGPGDASVHLLVLRLALAQEAQAAAGPAAGEGAEAHVAELLREG

SEQ ID NO: 15547 - protein, 117 aa, Chlorella protothecoides
MGVLIRGKLLPDLPQPSPVRSPPRARELLGINPENHQYHAGLRTALGLDTPDVQLTAEQRQRLSDIYARLQRKFPKSTAAKRIPLDFLVGAMDWLFRCALGQGPYVVSLLGELVVFE

SEQ ID NO: 15548 - protein, 264 aa, Chlorella protothecoides
METPPIIFAPPPSPIPSLTDLRPLLADPAKSAALDALFEGLEASLVEGRGLPPLETASPASATAPSTTGPPSPEDNPLVWVRLFRAQVANLAGRSREALAAVDACLADCPGLPDALTVRAGVLGRAGDLAGAAEAADAARRADLADRFVNCAAVAAMFAAGRCADAEETAALFTREGEHTNNLYDMQATWYEVAAGRAYLARGDHGKALKRFLKVVSHFKEFRDDQFDFHNYCLRKHVRVGLGNGGAGMLWERACVPSGSMPGV

SEQ ID NO: 15549 - protein, 232 aa, Chlorella protothecoides
MSLPTSSLDRDQAGRETGATSPSPGPVDVPVLRAPPGKTLLPQDAFPNGLPPALPRAALQVHPLPLQRKARHPPGPSTCSAATSTSNSLSGGGSSLGLGRGPLSSSESPCAPGVSSPVSTADIQLVQNLIERCLQVYLAQGEVVKILSAQATIEPGFTQLVWQKLEEQNPDFFAAYNLRLKLKGQIIMFNHLLEQQVQVVQIRTDRLQEDSGGPLCGAYVQAKAGGWRLVAV

SEQ ID NO: 15550 - protein, 318 aa, Chlorella protothecoides
MEAPPGCQSPRLVCLPALLPPPLAASLCKGLSPASPYWAAHGGRGMPFSSHLFPIPRHGPDEAAMYGHPLEETVSALARCIASSPHPLAGALQQATHAEVWAHCRASDEAHQLHYDVDLGAWPCHKAAAVDPHHPPHPCPPADERWLGHGKSEYRVQHPLLSSVLFLAGEGAGATLVLEEWLGKPAAATRAWLVPPFPGSLLLFEGRLLHGVLPKPGRSGGWHAEGTGVWPVGSNIDRLSLPATLHGISVPKGYDAPDLVPDSHRNDSAHARRERVLACRATHHPHGGMVGRGGGGASGQAEGRISPWTNDDASLEAS

SEQ ID NO: 15551 - protein, 277 aa, Chlorella protothecoides
MRVALSTLAVSLNYEGAGARMLSTAAVEGFCFGLDVDARGVLSLTSRLGNAEVLDGTLPDPHPYRRACGLRGDGTASLVDVEFKMYPAGARADPRVPPGLAWAHLTARLSQLQLVFLYRLLAEHLSYVSVMLAMRLDQAGGVPLEEGRAVPAGGSGGATPRASTPRSTGSASRPATPLRGASSGPGRTASARTRGAAPPPLPLAEAQQPFVLVLDVEMDAPIIVLPRQSNSLDSLEVDLGNLSLSSKVVEVPGEECGKRGVQVLQEQAALAFSGGHW

SEQ ID NO: 15552 - protein, 467 aa, Chlorella protothecoides
MAVSVCLPRVEGVDLRPEVPTSHNRVITSANKASFLIMEVGVKERGVVEANPGMARQKLGVTLQKPELVVELSFLLATVAFVLPGLAVVGNHPIPYASQDFLLGGPDPPGPAGADLWLSPCARLLADRPGATEFEYDGGGHALILPPPSSLDEPLPLVLVGTGCTLRLRNLRLLHADSLALCLRLAPGARLLAEPRDGVELVEGAAAHAALAHALLPAPLQDNPTAAARAMGECLAAGEEAASGGGEFQGDVIQGGVGFGGEGNTSDAPTTPPPCFEVSLSAVGIGLQLAQLDVAARSVHVLAATMDLGASVRLEGAAKAGRLALHGLHVESRTLDGEGADGEGARDGDAEGGQAAAARSGSPDGKKRRRKKRRGSLDAPVLEPCHVSLDFELRGPGADPGSIVSSGTATTTTPLPAAEVTLAVSDLALTLAPDVLALAAHLAGGALEPLRAPDPGAPLLACARYER

SEQ ID NO: 15553 - protein, 163 aa, Chlorella protothecoides
LRRARWADARAAGGRSVHSPHPGRGSGATPAPWRFWVTAQADFHSGDLEGALGALGTLRGLARWDGDGIGSEGPGAASAALLRWLVPVPPDAEVDELRAGLSAVLAAKAEGNEHVAARRFDAAAEAYARALAAPTLSPAAAAVLHCNRAAAHLGAGRLALAVA

SEQ ID NO: 15554 - protein, 183 aa, Chlorella protothecoides
AAATPSTPADPGALFAAINADALEAAVARDVDYPVPDPALADRVGFIFNNLTRANLDGKLVELRRIVTPDLYPWFVTYTTVQRAAQEANQQDVYVADVYVAVVDGWGDRALAAAFVRSSIKYVRVILDSHAVIRTSERTLLRNLASFLGKQTLAKNKPVLQVGESGGEGGSKGGLIGVREGAD

SEQ ID NO: 15555 - protein, 334 aa, Chlorella protothecoides
  MOD_RES (261)..(264): Any amino acid
MANLVVAQLLYLDSVDPNHDVTLYVNSPGGSVTAGMAVFDTMRHVRPDVSTVCVGLAASMGAFLLAAGQTGKRYSLPNSRIMIHQPLGGAQGQAADIEIQVSGCGCVDGGGEDQRVAGDCAEGDGGRGAASCRAGHASWWWTQEPANEILHHKLTLNGYLAEFTGQSMETITADTDRDFFMGAQEAVEVLDDMSEWSAEAAALRLDQNFSVRRAWHAHCPAGRTGTVSVTIFASTRSTSCGICDEYAPGMPREGGVLHQVXXXXSCGLCDEHAHGMSREGGVLHQVQGKAGGTSSRSAQVQGIMTGKLSMKSASETDVQSAADRDADELQEPAA

SEQ ID NO: 15556 - protein, 557 aa, Chlorella protothecoides
  MOD_RES (183)..(186): Any amino acid
  MOD_RES (311)..(314): Any amino acid
  MOD_RES (385)..(388): Any amino acid
  MOD_RES (416)..(418): Any amino acid
MLPGSGPQNKNYPQTPSLAPPTTHTNTDEKLPVFVEGVDSLALLAYDNGDFYRWQKEVEAGVASAADAAPYPLIVQDSDFRTLLEIRPGGGNGCEEAGSGAGAAGAAAPGCGRPGPRPGSGIAVPRATLLPPALQPDVMLLAGEGPPIVEHRMGGEDATPGPASEAKGGRGDGGSGSASPPPXXXXWSTAWVAKTRPRARPPRGRGDGAMEARAPPRPRRPPQRLRRSLPSCSGTRPTHATSRWPTPDELELAIEYDLDEEDEEWLEAHNAEGARAYQVMVLGCISLLFHPCAPPPPHRFTPAGPARTEPXXXXLLPRCNHGRLHPCAPPPLIDSPLQARRARSRVARRTLAGEWMEHLIDRMEKEYTAELQVRGGVTPVESCRXXXXVARARPSSACGRLQRLEPARSSTPPCRXXXRRRGRAPARHAAVCRGSYLLAPQPPLVAPPLQRHPELWTLTPDPDRPDAPPSVGLPPIARIFPVERCLAVPGINHYEPVIRRVYEYWQRKHEARGAPLIQRLWYEPPWHRRRAAEAVGGDAAEGEEGEAGGEAAAHPFA

SEQ ID NO: 15557 - protein, 105 aa, Chlorella protothecoides
MRCLTGNARLINATAPPPQCQGVAQPKVLPTLPPPKFGWVDYAERLNSRAAMMFNRKGNLFTMGPTLHLPRQIGFFALLLVEGISGRGLLQLIGISVGGGLNIGL

SEQ ID NO: 15558 - protein, 573 aa, Chlorella protothecoides
  MOD_RES (363)..(366): Any amino acid
MPELPDPSGTDPGAGVPLESHGVTKSRGVILRVFRHRHNVEAPTQEIAPSSHGTVSPLRRGLAVVKYRAEDPAKALGPSLEDVQCDNRGLQQIDCVPVRCCICMAEGPHIGQEDSLERLGCPSMQQGHDPGPTHAVPEPPNPRYHACRACCAPELMMMRHDPPLLRLVEREVAAGAHSSQPHGICVEQANGGQSLACRQPQPASRHLASRPAPTTAKGEGMKPFDGFRKVGGQRGNMKRDVTDGTKRIKLPVGTIPFDSGERRGDNKNLKAIEVYNGRSGVFKQREVAGKASPRILGRIEQLRLLSKLESAGLLSAIERGGFTLSDIEKYGLLSTTESLGLISAAADRWAWQGYGAALRATPXXXXLGKRCGGTGSTPSAGTNTVGQHGSVLQELHSELLPIHHPNLQEHATAPVRCSCSPAGCRACPGVLCARHQQLADCWTGGGSRPPGPGWHRRLWRSCAAHRPPQMSLEALMIRADVSEYSGCRTSTCTPSKAVKGGAESLSWAFTSSDWREQMCQSIMGAEQAPALPPRLLKVGRNHYAGPLRALSGGRCIKGINVCRDGFRKPGKDT

SEQ ID NO: 15559 - protein, 371 aa, Chlorella protothecoides
  MOD_RES (52)..(55): Any amino acid
  MOD_RES (91)..(93): Any amino acid
MPCRRKAIIDAILRDRRPNIHSLEHHTRNRNCSIKQGIPVQRITIMSTAHPXXXXFDQTGDPGTTHHNYVHSTSASYSIPHATVPGPRCGXXXRAIPIPRTKPPFKNNTDHTQASMPLYLGLDVGTSGTKALLYDPDKKQVLGRGSVAYGVQSSRAGEAEQDPAIWIEAVCTASRQALQGLPADQVRGIGVSGQQHGMVVLDKDNVVLRPAKLWCDVTSAEEAEELSRVYGTTLVPSFTGGMVQDVNADLMPVFLVMWIDKGGGQLVQPSGCREWFLWRGGAPCSTHPVALERQPLGLPLTACITTLCCSHQAPLAQEARARCVCPSGHGALAPQLHQFLADWRGCNGGEGVRGDLNSFLCRARVINHTES

SEQ ID NO: 15560 - protein, 176 aa, Chlorella protothecoides
MQAYPCQAAPLSSSHTLDPTRHTLATGSQESGEDAAYELTQVSAELRSTLEREIGLDEVREDLRSVTRPRAPFKTLELDEDDRGVGEKGLASVGPPAAEEDVDIEAKRRASAELAWGKAGGQGGEVTQGAAGHPAKTRANLQELSEEELLGELRRRKAEMEAAVKKDAQPGSVDGK

SEQ ID NO: 15561 - protein, 152 aa, Chlorella protothecoides
MGQGGGFCPVARPALHSSKPTPEAPISPFPVAAAGLRVGSSRPGLVYRAALEGVTFLLAAGKERLRAHGLVPDELRVVGGGARNRLWRRIVADAFQLPLRFPLEPEAAALGGALQVRQETRDARARGWGWRVMHAVPPVPAMCAPPARGTAA

SEQ ID NO: 15562 - protein, 149 aa, Chlorella protothecoides
  MOD_RES (43)..(45): Any amino acid
MGPSIALGWHDQRALGAWGLHRHQHRPARASAVGRHDPLAPGXXXCALGVWGLHRHQHRSARASGVGRHDPLAPGPRQPDGVSRGRISMAGQSPTYLSAALPEYRAKLPAFSVWPGRAKVALQTGAYIGLAGLLLFAKPGLFPIIFETE

SEQ ID NO: 15563 - protein, 521 aa, Chlorella protothecoides
  MOD_RES (391)..(394): Any amino acid
MVSVSCQPPAAVRSPEPWCGLPPPPILLLIQALTNTPSASETSCKPLGQLMHVPLLLMSQLSSHPVPGSCTNDTRRCLDTHMPWSVWAPSANALGGQTGHSSFMVVCTPFAKMQSAIEDSRSCICDVVRLHDRIYKPLARHPENWQSRGGAGPPPTTTLPSGCAEVRGGTSDPRLRRSGIDKPWEPRIRRSLGPSSGEKGGASGDGSSHSRRAGHRALLDLRGPIPLVPRHRSYSYVVLWMSISISVILFNKWCACVRAGHPYPCTPAHPLQPSTLVCPIAPRTPLQRPQPLHLQVARLRRVPLPHCPHHVAHGFLLCGGLLLHQGPGHHQDAQPERGGVLQTRPAHRGDPPLVRPVLLPCACFSPHHHTYENPALPLPTPPLTSLPPPNXXXXHAPVSHHIITPIKTPASPSWRPPLTSLPPPNPFHLHPGMLYAASLWLSNSSYLYLSVSFIQMTKSLMPGLVYACGVALGTETFAAGSALNMLLIAAGVVVCAVGEANLVVKGLVQQLAALLFEVGSG

SEQ ID NO: 15564 - protein, 104 aa, Chlorella protothecoides
MLRPGAPPPSPHDLGLAIAVQGRQGLLLFGAYYLGAACDDAAGRPPLFMYAATVAGRGLLSAAFCWLVWSGQCAVPLLWLAGLNALSAARLLRALIRPDDAPAG

SEQ ID NO: 15565 - protein, 707 aa, Chlorella protothecoides
  MOD_RES (62)..(82): Any amino acid
  MOD_RES (318)..(321): Any amino acid
GRRRGPCTARGRRGGRGWDRRRGRRPTPAAPGLADGAEPDADPVPGRARRRAGRRGGAPPPXXXXXXXXXXXXXXXXXXXXXLRSASDARGDTTGDAQVGAADGMPGRAAGSTPAHPNETVAWLRERQGAYWARRLAEAGAHARRSPELRLVPLYRALHKHARELAHMRDQGHRRLFPLVELALCIMRLSCERFFTLLAVWAGYLAFRDPPAPARRAIVTVARLAAAFQRAVLLAFPAVCWVYDAGIVFSTFASIVFWSGWVFSCLCILFWGERGGRDCAVSPSNGGEGSAMGWRGMGVDGGVNSTTRWPMHVTPGLXXXXCAVSPTSRESLVPESQAARNLFSPVIPSEPDEPGRAALVPPPRSCHAARNPFSPVVPSEPDEPGRAALIPPPRSCHVTQCQPQTPNSTLAPSAPQAPPRRGGKGAVHRRQRGAARLAPRHRCRGGAYGWPVRRVLGHAGARGRRGGGSLCAGGRRGHCRRRGRKLRARLPPRRRACLGARAPAGPQLAVGPVRGAAPGGLRRTFRARAAGLADRGGGGQRGERGALGGGGRHGAAVRARLPRRLHPTVAAAVLQVPKEGKRGRGKGSGRENELPGHFQGLPSLGRACFNPPSDVARQGRVPTCPMCQATIALRVRYHWPFRAVPRSRLHDEPVQPQFGVEGDGGLDPGIRGIRMLTHVLRGIGDSKAYMFAVWDSIPSRHQKTIPL

SEQ ID NO: 15566 - protein, 542 aa, Chlorella protothecoides
MPWGWQPTGIDQESPWSSAAAAPKLLCHHPLPPSPRSTAKVSHVPLSSDGAPSYMLSSFLYNAWYGGPDATPCPQIDSPPLPINKGLAEAVGVSNYGAEQLARIHDYLDARGVPLASAQVQYSLLSRGGAQESVRREAEERGIALIAYSPLALAKWSSPPSRAHVLLLRHAEWKVWSGGWRGSCVPATGPSGAALQADPAWRGGPAAGAAPDRTGPREDGASSRAQLVHLPGALASPTHQDRPHHPPGHDSHPRGDQSRPVPGQPGGAGVEADTGGVWAPGGGLGRRAPGHAAKHLSDGLTQPLRGCSNAEMGRCRGVHVQFPPNYGANALVIQRRHLAWPPHRFPRPGLRRGELLVFSSFRFMMGQPILFFNCSFPTFCMLFCIGRHFQWQIVNTSHGRRRKRCMQARPEQGHLHLVCQSETSDTSCSRDGRHSLDLSVSRPISSVVPCCRAVWWITSFSAYGNEGSRASPLPGTVSRADPPCIGRITPRESTTETLFHAVDPRLTPVAVADSILAAPDDYYTILQASVGRPIIPCWQVQA

SEQ ID NO: 15567 - protein, 202 aa, Chlorella protothecoides
MLLLQLRDIQDAQNQRSAEEVAASKPLAEVLREAKEAKESAFQETWKQMKTVGSVAVSRPGSMGKNRPLDEEELEFFDAVAEAEALKRRREQEEEAAELDSFRRLRQEQEEGLRSDPPGVLIGPAAPPPETAGRAAPQQTGPRLPQKRGLGAVLKPMPRRVVRKEDDAADPPAASDPEGDTGLAGLLGGYASSGDEGAGDLA

SEQ ID NO: 15568 - protein, 583 aa, Chlorella protothecoides
  MOD_RES (129)..(132): Any amino acid
  MOD_RES (270)..(273): Any amino acid
  MOD_RES (366)..(368): Any amino acid
  MOD_RES (387)..(390): Any amino acid
  MOD_RES (455)..(458): Any amino acid
  MOD_RES (529)..(532): Any amino acid
MGEESGHAALQVSLFSGTCYLTPLLGAWLADSMWGRYKTIMVFSLIYFLVRQDLHWVVILSSRSAPGWDLSIMTGTCLHLPGAERCTGLLRRSEDAAAKCIAFGTLLITMPTAHHIWLHAAVHCHTSMXXXXAPSSSQCQQLGMLLLATTALVPALTPPPDLYPTRLQNAALFTSLYIVALGTGGIKPNVSAFGADQFDMADPQVGGRPPVWAGEGGGLDKPAVPYGQTMPHALPGLARKARRGGASLPQFSFVHRHQTPHTHLKLSSFXXXXRRGGASLPQFSCVHRHQTQHTHLKLSSFSTTRCRTARKRPPSSTGSTSLSTSDPSLPSQVQVVLCSSKPPYAECQWCLNLFPPHFTYTSNVLXXXGSLHGPGHPGVRGRFPDVXXXXSVSGVSISSQHISLTPPTPPPSLSVIVWVQENVNWGVGPITRVYNVVMSAWWEKRRGGNVSPDEXXXXGSLHGPGHPGFCGRFPNVHSRGADGEVRWGARGVGHVGVQGVEHSWARFSGRTHCLDSARLPLPMTPTNDXXXXAGGREGVPEGWVWGRWRSGAGPGGRWFGASLCATQDAPQIVHGTVCLIRCL

SEQ ID NO: 15569 - protein, 185 aa, Chlorella protothecoides
  MOD_RES (86)..(89): Any amino acid
MSQSYPTPTQGGQARYINHSCDPNCYTKVGKGGLIPAPACAKCRCCAGIAPEHLWSLQDGCPWLHGARHQHPRLRSWQRHSRTPSXXXXGARHQHPRLQSWQRRSRTPSIWHDMVQVQMGPDGRKHITIVAKTHIPRGSELCYDYLVSQAGLGARVEWTTSLVDAVACDGPGCAPMKVGDTLRAW

SEQ ID NO: 15570 - protein, 398 aa, Chlorella protothecoides
MPVLATHLGAPRLRPDSCSRLGSRKSIRAPARSGLRIRAVLDLPKPTITNGTSPDKEVEALRADVLHELRYRVAPQSINEAKLYESVAWSVHNRLVEGLDATNDHWREQDVKQVYYLSAEFLMGRTLTSAVHNLGLGGAYGAILKDYGAALETVASEERDAALGNGGLGRLAACFLDSMATLDLPGWGYGIRYRYGMFKQVIREGYQIEVPDYWLDEGNPWEVRRPDTTYRVGFAGTSDGASWTPGDEVIAEAYDVPIPGYKTTTVGSLRLWNAKPVAEFDLDAFNVGDYDGATGAKRRADDITAVLYPNDATEYGKELRLRQQFFFVSASLQDTLARYLATHSDLAGLPDKAVFQMNDTHPTIAVAELQRLLTDVHGLAWDEAWAITTKSLAYTNHT

SEQ ID NO: 15571 - protein, 377 aa, Chlorella protothecoides
  MOD_RES (346)..(349): Any amino acid
MPDFNWTGPLRPWRIGPMRSVRCGLDSHVLGLMLLIPTFHFERAPQTDPANATQIPDSIPKPEWYLTGRADVEVSSRQQHTRERRCCGWSHGIGVGAGRQGWCVEVFHLRFECQGMPCGLPAGEHAFLPKHFHHGLASVPHSHPTLRQGGRGHPRSVHLGEEGAGPGTRRRRPRRHHGRDRSRGAYGAEGGGKAAWCVWGGGRREGSVGMGGGRKGFPCSWPFDNSASRRHMPNARRGGWAHALAPLPQGRPVSDDPEAPAVCTGQGMTKTRVPQLPDARCPPFLQVHEATIAAGAYPSPYNYFNFPKSVCTSVNEVRGPVITARTCTLQSSDVHMPHSCHSKHGXXXXTALPAGTCQTRGEVAGLTLWRYCLEGAL

SEQ ID NO: 15572 - protein, 854 aa, Chlorella protothecoides
  MOD_RES (12)..(15): Any amino acid
  MOD_RES (654)..(656): Any amino acid
MSLGGGAIAKIXXXXPPTHYLPEKRRVPARENPPTSAPSTLPTELWVQGPSKFRHGSCDTCWPSRIPSDTWAPGGLGRASHKRQLQPRSRRPLRRLCARCLSFVINAAAGSRSGCPASRVRIVHLANVGLQSSGSFDPEGLVGGHQYPESGHADDIPSCQSISARSFAGRTGKLACPAGPKAGRHVRLVVRAQEKQTPAKGQPSDKPDTKSEKAEKKPEIGPKRGSQVCPGEGWGPVLQASTSDCACSAGSQHLRQWGAHSSPPRVAHHPSISPPPTGQVRIKRPESYWFREVGKVVSVDQSGIRYPVVVRFERVNYAGVTTNNYSLDEVEEVLGWFPESSSPWNDLRLPVPISWVPGWMVSFYRTPKRMVIPGPASVRPLDPPLPFPIWRQLRNTLVREECSTLLRFSCLACLEFEPWAVWVSHVSCKSSTDTTAVRQKGTGWGGGGVRGKGRGGALLEQSLTGAKGAGIREPGGQRQAPSRCLSDTVASVPVSNGQDLPCLGCQACILHLPPKGRGGGQPGCQDLATLRRDEQLVLELGGAQAVLRGSGPGEAGGGYVCWGGGEGKRRLVRRRLKHNVGSLLRPHARIRGTPGALQQGTAAPGCQRPHPLFCQTAPQHDRQQYCIPNDPIRHPPPKNKTINTNKKSKPQAAXXXSETPSPFLSDSSSALLPTVLYPKRHHKTPAPQKQNHKHQHNEYTPGHRPPAIGPGLVAVRAHADHGLDGEHLALLHHTPRLVVRVVVHIGRAVEEVADAVPAVGLDHAEAGGAGVAGDDVAHVAVPHAGPARRDGQLQALRRHGVGVGVGWRGLSLLGRAWMRRVERPGATSQTSSDHKTGNHKQNQGSKINPPRAWS

SEQ ID NO: 15573 - protein, 481 aa, Chlorella protothecoides
  MOD_RES (188)..(190): Any amino acid
  MOD_RES (266)..(269): Any amino acid
MPANLVDKAARHSSCFYRRMMLALLVCALCLLTGASGEALPSPGFDLLLLAPTLSVSLGESPRFESSPGPNLPSRSSSFTIHGLWPEYKTGGWPQFCGAHTTHQAAGPPTPAQNCLWPSLIGPSPGFWEHEWAKHGTCAAPLLGNRTAFVATVLELHEKYNLDRSPAHAREGMAHATATAATAATGAXXXGRERGGQRRGRAALRKIVLVARASGHQGELYRLRQLARPCGKPNPRRSANFPPTSWTPAFHQLAALHISASHHTFXXXXGPQRSTSSLPVTSQPPITPSPSLSHTPPSPPQNLRQVALGNAGVLPSSSGNYAAEDLQDAVRAAYGAAPLLSCTAGTLVEVWMCLDLELRVMECPPAVRPGPKCGADVRLPRGAEVPPRCRPFSPPWGAALPGARKGGDGARDGGGGGGDGDDGGEQGDRPSWRVAAVLLLVLALAYVAMYGVQRLMAERVEAEEPLLLVGSGWQQGGRADP

SEQ ID NO: 15574 - protein, 184 aa, Chlorella protothecoides
MAGLHDPCSHPAATRLALKLVEEQFGETPPSLYLVQSPLPESFAAVHLPPPLIPRSPSVPRLHQTVARALLYHGTQSLGDLRRSAGLPLPHLKAALLVLMQHNCVASWLHAEPPNLRGESRVEQLYEALPRAMLHGLHAPRYLIHVKDSLGATAEAVALKLLQHGRLRCGRGVTGGVLTCFIMR

SEQ ID NO: 15575 - protein, 160 aa, Chlorella protothecoides
MSPQCLELAIAACRPGMRYRDVGDIITRHASAAGLSVVKAYCGHGIGDLFHCAPNVHHYAHNKARGVMKEGEVFTIEPMICVGSHRDKTWPDGWWAMAWGVLIVTAATEDGLRSAQFEHQLLITPQGCEVLTARLPTSPPLWWEVEDASLAAKTGQVLSV

SEQ ID NO: 15576 - protein, 390 aa, Chlorella protothecoides
MKCSYTWGPAPPPAPPTHPTPHTHPSPPNTRSTFYDRLKEVLAYHRRFPSEDITEGDGSEALLAAAEPAVAFSGEEALGRYLDLHELHAAHSNGAFAGQPLDYHTYVLALADWSRVARPARTSRAYREYLERLAAYLESFHARTQPLADLDAQMRGAVAEFEEAWARGAVPGWEDRGAGGAAAAGGRGEAPEGALDLDAFDSVDELELLGGQGLGVGDAGKGGTRSIDGRRSLPCPPTPAIRLQPTCHPSRPRRPLGHRTHAPKASPPRPADPERIKQALRALHLKCGGTPRQRAARLFSTRGKTPDQLDPALFAKGAAPAAALSQAQRERAEAAARGAALLEARVSRLLRLLGTVQADTAGRVEKRQAQTYEELLAEQAEAEEVSAWRG

SEQ ID NO: 15577 - protein, 96 aa, Chlorella protothecoides
MWESACLPSACLPVTGSPLCPSSGPPHRALLQLEQLAMEKNTMMTEKLELRRQVNELAASVDKLNREKVALEAQVRWLGGVHGSRGSRARRWRVGW

SEQ ID NO: 15578 - protein, 190 aa, Chlorella protothecoides
MRSRLKGTTLPFHARVHGGISTQGQSSPPPSPAHHPSTPPNPLSPSTLPPQQEGDLVEEDSDEEAPIYNPLKLPLGWDGKPIPFWLYRLHGLNIEFKCEICGGASYWGRRAFERHFKEPQHQRGLKTLGVPWSREFYEITSIADALALWKSMRERQRSGAAPGTEEEFEDDAGNVYNKKTWEDLRRQGLV

SEQ ID NO: 15579 - protein, 76 aa, Chlorella protothecoides
MSGSTEPSSWAEERKALELELAAERRRCASLQEELKKEKQLAIARQLQAEAEEERLTNKLMQRLDELKTVSGGGAE

SEQ ID NO: 15580 - protein, 191 aa, Chlorella protothecoides
MMDAKDAKVKLHAMLKAGCAEGGLVCSASLGVWARDGTLVLLPACASLGPPPPGPCVVTYIALQDVPRTADRAPSRTFYLWRADVRAACAAFTIELFLAAGNLHARLAHELSQRAEREGRLQARRQRGALQRCPRQPVPLLRVLDLVNAGLAGPGALAERASDFSRIKRVTTLLEAGLLDVGASLALFLGD

SEQ ID NO: 15581 - protein, 474 aa, Chlorella protothecoides
  MOD_RES (387)..(390): Any amino acid
MAMGPAPPARAETVPLMRAMVRSWRGVALSLGMAEMEGPSQQHLHLDGPMQWDEMELHLALDELVKAESCPSPGPAPSAVPAAHPVLGSGGAPNALDPGPKLQHAAPGYPPPTPGLSSATWDEQSVDESSGGRGKARRGPRPRMFKKNTCQADNCTADLGACSFYYQRNHICPAHLKAGAYAVRGVSTRFCQRCGVGHPVEDFSGAKRSCKKALERHNQRRREKQGGSEGGQTGEDGGGPSHEGGQTGEDTGGPSQSRATPHASHANLAACSAMHPAPPACQPDAGADWEASSRFGGGAYAAAQPWNLPPDLLPLLGMSPPEGAVYGGAGPGAAAPAQGASAGEVAHLQHWLAAGQGWGEFPHQAAQQAWQQPLQQPEDASGESGAXXXXAGQGWGEFPQQAAQQAWQQPQDASGESGAFMHPAAPPPAPSSLYAALGEPSLSVGSVAMPTLDPGMLSMAPMPPEQLSWLSSQL

SEQ ID NO: 15582 - protein, 533 aa, Chlorella protothecoides
MPISTIPPPPQVPPVRQRVPQRRRGAAQARGGRPLCAPDPARGAQVLPPGRGGGVGHAHLPGELLGRPGPLPGPFLRRARRPPRPAEQRLPLALRARGTHRPVQLPPGDPCPPAHGRAVHGQQAPGPCRPQVSRLAVVFFLGGGMQQAPMAGVQEAMKRFRAAEARQRLAGDVRGWWCDRPTSAVPFPGRQGWPSSKRTHARTQTPQPPGPARVAVVLEEFVRLLHACGMPRADLDLVHGRGSTVNEILLRGEPRSTLFTGSKRVAEKLAVDLRGKVFLEDAGFDWKILGPDVQAFDHVAWQCDQDAYACSGQKCSAQSILFMHDAWAEAGLEAALAARAATRGLEDLTVGPVLSWTTEAIQAHVADLLAIPGARLAWGGEALTGHAIPPRYAAIQPTAVFVPLDQVLRPEHWPTVTREVFGPFQVLTRYGDASLPDVLAACERMDAHLTAAVVSNSIPFLQHVLANTVNGTTYAGIRGRTTGAPQNHWFGPANDPRGAGIGTPEAIKLVWSTHREIIQDVGPVPDASNQVQS

SEQ ID NO: 15583 - protein, 948 aa, Chlorella protothecoides
  MOD_RES (438)..(441): Any amino acid
  MOD_RES (495)..(497): Any amino acid
  MOD_RES (602)..(634): Any amino acid
  MOD_RES (788)..(816): Any amino acid
MTPSAPTPKCLSQALAAWEGVTRGVAEWRLSTCNYEGRWRARRLCLGGRLTASGREGGAPQAAPKATWPPYDGMLCAQEHVKSQSCHKEPVSKVLTRMKSLPRPWYLAKRRVVAGAATAGAEVQRGRHTRMTREAGRAERWKRLNPPEQCAEWVSPDMAPLSRAGIWAAMHMRARANFGRSGQLLLPRHPSTALAPVDDEEVEGPSTLHSDSAGRPRYETREGWDESADVKRGVSRQRLDLTHGFHREIVSGCGILRAGVVCGSVPNGARRVGAHLLQRLVPTHLAIQVKNQKLRSQYEQECREGMAKASDYQKRWRRSPVESRSTSRHGLASSWTHSPHRLESVAPPQDVENVTTAPRHRPETRVREGFAAYRPPPALGSQPKLDLDRNGKVWRVYLLVGVEEHVEVNAVQTVNLAHCASHPGSLPLPCDSHVPSSXXXXGRGERERRRDAAGGDEHLEARPVPRARPRPEPRPQHAERPGEAAGGVAKARERXXXVQTAERALDDQRRPPAQPHRGQAVREEARDAQSTGPPQTEPTGRQRRGRGERERRRDAAGGEEHLEARPVPRARPGPEPRPQHAERPGEAAGGVAKVRERRSVHXXXXXXXXXXXXXXXXXXXXXXXXXXXXXXXXXRGGPAPADPPSRILVVPRPKAPAQQASAPAQDVPEQESSAGGEGVDAVPAEPGAEAKPRRSRRGGRKRHPRRQEGGEAAAHERGAAGGHGDEGAAEAQTDETLASHAVADVGSEVTDSPGSAEEWLGGSAAAASGSEVGAAVSGPPPGVGAPPXXXXXXXXXXXXXXXXXXXXXXXXXXXXXGAGPAPASPRSAEAGGAAAPAAVQPRDPSQERGEAADLGAASALPGLQGVIDGTKLIDLKADEVKGQGNGWVSGCGTSYYDGKPRPPPVPMLRKWGADDISCPRSHLSPHPPRPSLQAKAGGDGRPQNCSIQ

SEQ ID NO: 15584 - protein, 216 aa, Chlorella protothecoides
MSGLTHSAHCSGGLSRFHLSARPASRVMRVCRPRCTSAPAVAAPATTLRFAKYQGLGNDFILVDNRHSATPLVTPSQAAKACDRHFGVGADGVIFALPPQAPDSDYAMRIYNSDGSEPEMCGNGIRCLARFVAELDADAPRRYRVDTLAGLIQPELLPEGRVRVDMGEPILEANAIPTTLQPTTPVRRGSGRCERVWEEGGEGGGDDGSEESGFDW

SEQ ID NO: 15585 - protein, 123 aa, Chlorella protothecoides
MAPVASKKPVSAKKPVAAKKPAGDKKKTSKKSVESYKLYIFKVLKQVHPDTGISSKAITILNSFIVDQFDKIATQAAQLSRVNKKPTLTSREIQTAVRLVLPGELAKHAVSEGTKAVTKFTSA

SEQ ID NO: 15586 - protein, 186 aa, Chlorella protothecoides
MSLLPILCFRVRSCAYPRGFLILGLPDRSAHVPEEVYYKIKFAQLEHTTLQYPAQIIRLVTMSGRGKGKTSGSKAVSKSSKAGLQFPVGRIARYLKNGRYAERIGAGAPVYLAAVLEYLAAEVLELAGNAARDNKKTRIVPRHIQLAVRNDEELSKLLAGVTIAEGGVLPNIQSVLLPKKTGKKDE

SEQ ID NO: 15587 - protein, 396 aa, Chlorella protothecoides
MGNMDAKPDPALTMSGAEARRSPGEAGGLNTSVDKYRYRLHAVVAQYRAAQHEVPGAPGHLDAQLAAVRAQQLLQLQCPPRLHHEVALTLRHHFQLAVYQVMQGGAVEGLHPSHAPPTVGTITARSPPSHRHSRPTEGDVGLGGPEGLGSRQGAAVALPLRLQRRHQGSIPRWFLCVTVVQVEQYGVGLCRGRLESLCSGNIPQNPHAPVATRSASRFFCAVVPVGKEEHLKCQREMSTPEELPPDGVKIISLLRSMSVTAYEPRVIQQLLDFQYRYTAECLQDAEAIAERSLGPRPEVTMPHVVLATELASAHTFTTPPSLKVLQQLAAEINAQALPEIKPHYGLRLPPEGDCLLAPNYQFDPRTPAISEHALDGGAAPLKQEAASSDLGAVPPT

SEQ ID NO: 15588 - protein, 643 aa, Chlorella protothecoides
MAGCLPSLGVEEVRHQAPSGLDRLVWSAPRAFPVLPARPLREGPAWVAASSPHCPRLRRAHHHRPPPGLIDWHHHLPELYTHFLWAFRVPVGTSFADPPFSFDCPKHCQVLFANELASRSECAAHAAIYMLGHGGGPPGADSALAHLEGLVGLLEQYYHPSNGGRWNSGLAHLFKTLASAFGARLLAESNAARRTAERARGPRGASAPPDAPAGDAEAEVDPGGAGAEEDASVDGDDASEASEASDDDVQASGSDSSGEDDLLPVPPGGRRRAPLTDVVVERVVGALLRLASKAQFSKVGFTFGLGGGRGKGWGNGPCEGEEDQEGGSDRRKASLRVTNARLTGAWLTVPSMILHAMLWLSHMGRVLARNPRHDKELRRSATRILGLLAEVSPRAVLPGVHAHFVAALETVTSTSVLASAIQTLSLCVRPLLVAGLVLPPEDGGGGVEVAVGMNGDGEVPGGADAARATAGASLAAALMATVPGIDANDPPKSLAVFRFYAIVLSSLAQLPVGRGGVCVRRTNPSLDDSVCFRTELPHSSTATAGYIRCRSQGTPSMHPFQEVATPGFPLETEIWVEELLSHVFAVISNLDAPEHRGASEGDRREGRRGWVRALLLRGAGAAVCECLTGRARTIDCDMERVVG

SEQ ID NO: 15589 - protein, 418 aa, Chlorella protothecoides
MSCGRVRLLTLDGDGGLLAQRCVLPPDLSPVTCLAAAAGCVAAGKADGRLHVWAAPLREAVVCGSQVAVQGPGDDAVEDLRASTERDTVGCPAAAHGHRPATGVAWGHRGMDPGALPLLVSAGLGGELCAWRVERGVHEVTLAPAPALSPAGRAKDAGWGCLGVAASGSGLLIATLRHARHPATELVKQLQVHQRVVQSVVRLYCLPDPDQRDLQQAARAWVARGAGAGGAMPLPSALWDVLCALRQPTETDGEDPPARLLSWLSAGAGEAHGQGAALRCAVAALRVLSGREPGAGAAAMELDLLLRRARGALTAALAGDGRGATANCPVEDEATEAVLGRVAAWVLASAGESGVDEELLGLAAAVPQRNELDASAPLAGGMEGATTALKTLKVRFWGGRRMVHVWGCPSLEIPGSTL

SEQ ID NO: 15590 - protein, 106 aa, Chlorella protothecoides
MAEKPWTRMLGVRRGLTPISQTICPASLTIAYPPHTPMPPQALGWLTMLLPTTALKAGDGDWGAWAEEWVALWRAVPHCSYWDALWGALFARLASHDAFGGCRAGG

SEQ ID NO: 15591 - protein, 854 aa, Chlorella protothecoides
  MOD_RES (105)..(108): Any amino acid
  MOD_RES (251)..(253): Any amino acid
  MOD_RES (281)..(284): Any amino acid
  MOD_RES (646)..(649): Any amino acid
GPSAAPPRCQRPRPRPLLPRRATPGRNEGGLGADASRALRMQRGASAPCVSIPPRSSELSFSPSPRAPLPGAPPSPMRHCSWLTCTPGPSPCASCTTSLRFDSWXXXXRPRPRPLSQRRATPGRSEGGVVADASRALQMQRGAPAPRVSIPPRSSELAFSPSSRAPLPGAPPSPMRPCSWLTCAPGPPHVLLAPHPYGLTAGSSVHTTDRVTGGDPQGEGAAWAGGVRARAAPPVGGAWDLDPGVPRAPAXXXIVQDQDEGAAGAAQDVGQRALEEGGGAXXXXAGGDPRGEGAAWARGVRARAAPPVRGAWGLDPGDQHEGATGAAQDVGERALEEGGGALLRGDLAPAVQGAVVHALAAGLHHQPAAHGVEGVGQHAGGGGDGLGDGPLAQEGGVALVLEHRALGGVVQAEAVDEARELAVAAGADISGEARARKVQGIDDEQGAGASQAAGGQVGGEELPEVGLGGVAREQALDGVLERKVEGLGGEVAHHVGQVATPEGGDALLRGHAGEAVGDARVAWDLARLDARVGVLGLQQQLHTLDGGHDGLGHRAGGAARSQVGQEGPRVALTAIWWFVGKFEFTDERGAGRGGAGQVDKAAARGASSTQTHPAGKCDTDDIGTRGRGGYHWRQASCRCTPQTPVXXXXFWDERTWRIPLETGFMQAWEDSILTARGKGDRASAWAAGMRGRTGGRANPEGEAGHIVAMQTCRVIRRKATASSQGTAALTPGAAGGRGRDGATTCPCATLRPSAPRVQGICCPAHSFKASHPLPSRTVPLSSTPRCPAPSCHTGAHLANREHLPRPIPEKPSCASTRSRKRGAPSGSRDVMSRDALLYAPAALTPGSSGPGGRR

SEQ ID NO: 15592 - protein, 192 aa, Chlorella protothecoides
MDLAPPVEWLRRPRMVLLDAGMAMSLSPKDHTNMCGLFDAFSRLDGSSVADWVLRFSGEAQTCPDPAAFRADLGARMEEARTARRLGAGSEADGAEELAVVLDMCRQHAVSLPGHICATVVTTLVLEGWSHSLDPRHSTLAEVRRLLAAKRGGLLAWLATVADSEMLERVPTFDDPLATSRFDLARVMSWRA

SEQ ID NO: 15593 - protein, 174 aa, Chlorella protothecoides
MFEGLLPEDISVFATTAANARESSWGTYCPGQSPSPPPELLTCLGDLYSVAWLEDADEANLSVETLKEQFQAVRLRTSQNFTYQQGSHAQRFGQLSMGTQSVAEYLGDAEQGPAAWRHAGAGAWVGAQVADAGAESSRRRRLGPQGAVPQRDADLAPLYAAVWREGPANSAKRA

SEQ ID NO: 15594 - protein, 138 aa, Chlorella protothecoides
MGGAGRGDEPWDFGRGVLGVGHGWHPRLTLPRRYPLAAFTHPCSPRRALTMTAKLDHRRYSSLLEFRDDVRLIFANCRQFNPPGNFVRNIGDQASEKFEKAWATRGLEAAAEAEARRCALESAALEAEASALPDALRA

SEQ ID NO: 15595 - protein, 648 aa, Chlorella protothecoides
MRLRSSRSWRFLVCPSGLVAAAIMFCARREGWRIPQLILELNWCRHGGRGSALEQLAQLRARIGQLTACLGKEGQPSLYNACRLSSFCRCLGKAAPAEDEHGGPDTLSRIRSMLSIDPNFLAGFEDSMPGCTPMHERASHIERASVMPSPMRSLNCGASSTHRILIAPASFAHAGRPSRTPLRPTSSLIKPPFNVVITGGTKGVGKALASEFLAAGDSVALCARSAEAVDAIVEELRSKGRVVGRACDVARAADVEAFTSFAQQGDMRLGARVGMPWRGLSALHCRQSMLVLRQGPGDCFPSAMACLPILLCPHLACRAGASGHVDQQCWDQRLPLWCAGGPTARGPGGHPDDKWGVEGQYGIEGDQDYDQELDRAHTAYTIRQRMQACTPLLQDVEVLVCTLAVPLGFFIWSSPPIVNIVMPQAMSVMAGQPSGGHIFLVDGAEDEVSTLHTSSLGAHQKSVCQPELVTVSESNIILPTGADGGATPRFAAYGASKRALSQLGKSLNAELRGSPRRGRITVHTMSPGMVTTELLMAGADTRVARFFINVLAETPETVAANLVPRLRQGERVHCLLGKGEVGVGARTMKEMDGAAITSDVDAEKVHVYVTNLPYAVPLTRYLTKPKAYGQILMRLLAKQRKNKFVEEE

SEQ ID NO: 15596 - protein, 227 aa, Chlorella protothecoides
  MOD_RES (84)..(87): Any amino acid
MVSPLPAPSVPEPGCHAVDLIMPANPAQCLAVEFPGVVENPDKALAMMGGLEAMSRHLQVPWGWWVVRLTTNFIPRHHRGALFXXXXATSRCLGGGGLCALLEVLYRSTTGVRFSGVAAPLLDGLSILQLPCMQENPMTLPLYFRPEDPYCHPVVGNRTRAKKLAVRLRRSADGEVSAAVIGVVKSEYRCVRFGRIEQVVRIRKEGSKSNGCGSEGPFFLNDSCLSG

SEQ ID NO: 15597 - protein, 144 aa, Chlorella protothecoides
MRHVWTFLPCCLLSCYLGNEVAWECKQAAPAAPSKARQTPPPPFPRPSPPPKVLAALPVQRLKRSTLFVDVLSVKEFPKQAMLRMLPADADILCTHPMFGPDSGQGSWSGLNFMYEVARLVPGDAARQQRMQNFIRVRRGLGKG

SEQ ID NO: 15598 - protein, 872 aa, Chlorella protothecoides
  MOD_RES (130)..(133): Any amino acid
  MOD_RES (824)..(827): Any amino acid
MDAFPEATPGTSGRSDQEALKIALINEKSSPEILMFQEDLVSRIEAQIDYQVRREEGLATSSFASRRADRAHARQPRPRALADHIHDRARQGVYGVGRVGGCRLNYGQGLESAFSHGKAVCRSNALAHAXXXXGRVGGCRLNYSQGFESASSHGKAVCSSNGLAHAWHLPPLSRVSGSASAWFHPAWAVLADRDPLLLLGMPLPANPSPLKKSQSSCHLKDPPPPFPPHSPSAGTVPAPLLLPGAAAQDRGVCHAHLGHRGGQGAAVRPGGRPCPGVLHAAGHPPQDGSGAAAPRSLLLAGAPGGGPPGEGHGAAPRPGQACLLPRAGGQRSSAGGRRRVRCTGVVRGQGEEGSHSPAGAVRPCSPSHGSCPPEHQACSSTTLFRSFSTTTPALQEHSPIQQGRRVCHPVPAAAATPGGGLRVPAVRDTCFQHMSTPSPNRQGGIALAHVLLSPHNEGQSRQGRGPVDWFAPRQAHRHPMQVTSSSPGSRPILQAGSFPAPRADELSLSLAASRQHSNSRLQGRGRRRCGRGFQERPLWAGRGGGGEELVPQLGVQPPEQLPLHAVKGVLQALQLLRRILQRGHGKGIGGWWGPGCRKCACLWGPSSKNPDRTRLDQGAPPIEIPPGPVVSGWVVPQQGLVALHRGPPTQAAATHRVVHEEAVVEIKGIVVGVAHQAEERLEPPGVDGRRFQLRAREAGGRQLVHDLRQGVPAHGTSSRAHQPCTARAQSHPRSCPSSSTPHLHLAQHAANGVGDELGGGRLPVMLLATQLHHRAALPREELWGGGGLPCDRRQSRCGTRLSVWRAGIRNGMQSLKGSVPTNAXXXXAPPSCSPPAQRTVGRRVAWHVIVGRAAVAPGSAFDGRASEMARSH

SEQ ID NO: 15599 - protein, 712 aa, Chlorella protothecoides
  MOD_RES (21)..(23): Any amino acid
  MOD_RES (70)..(72): Any amino acid
  MOD_RES (112)..(153): Any amino acid
  MOD_RES (428)..(431): Any amino acid
  MOD_RES (660)..(663): Any amino acid
MQAAVAPHPTASPPPCAPLPXXXGGHRPAGGGAVCGYNCLLHLPRSGGMQAAGAPHPTASPTPPCAPLRXXXKCCRRRRGPNPCATAHSPQVRAAYIDKVSAKVLDLFRNYXXXXXXXXXXXXXXXXXXXXXXXXXXXXXXXXXXXXXXXXXXHPAPPCDLPRPHPQPFQASLPSHSTSQPPQEKVLTEADTLGAAEASSSGGVLSFFQRPAPAPAAAASAGGRADAFSLQDRALVLSHVEGPPLVLHAAEARGARFPYEVLFRSVNKLLMDTAAHEYLFCAEFWGDAGVYAALFAPVLAFVESSLAAALAELHDPIALLLMVRLNRECGLAMARRRNPALDGFYDRINLLLWPRLKVLGLSGRGGVGRGVGLGQGGWRMWDGEGAILGAGQGTWESACAGTHGSQATGGVNDGWARMSIRTWGITCXXXXGVGVGQGGWRMWEGQGAVLGAGQGTWEWACAGTHGSQGTGDEHANGDSVIPPHLTLPPPPPHIPLGAHGRPTGVGQGDASRPGVHCRPHPRRPPAGRWGLEGRAARRPFEQYDPLQPQVQPPCQKGVLWVFEHASSAPSWQLTVHSFPHPDNDGTERYAALTSALLLLQADLPEEPLESNTERLRYAGKGSGTCLPSAGCQLGEGKQPGMDLAARGSRAHACGGLSAVXXXXERLRYAGKGSGTCLPSTGCQLGKGKHPGTDLAARCSRADACGGLSAVEV

SEQ ID NO: 15600 - protein, 202 aa, Chlorella protothecoides
MPAPRRKGMLRGAAEGQASALPCAPRMPPSTPPLLPSLPGSLAAAQAAIAPATMREAVRLEGESAPDAAGSYIINMLEGKLRRLARQARAERRAAQRAQRERQRARQAVAAGGESGAGEARDGPASTGPVPTDSDTASAADKAGLDSALVMELAPPGPPPSISLLLRDPEVVFFFVLTTVMGLGHGLIGSYLFMFIKHTGGC

SEQ ID NO: 15601 - protein, 152 aa, Chlorella protothecoides
MNALLSLSRLLPSKRAGTVFLILNFGHIVGVLRGTAARGLPRTGSLSQQAMSQAASGGGQGGAGANPALHRTSSSHGAVDASQGLGASGAALLKEIEEGLHRCTSIYVDDMLGGALPELVSGASKPRVLNPGSSGPTALGHARNRAEGRSKA

SEQ ID NO: 15602 - protein, 254 aa, Chlorella protothecoides
MAPVAGFVNGRWGIRAGIAAYTALALAALPAALNLPLEALQGSHGPASSGEALGPKDVEDLHAPLLPPGTTEQEPPSPKVDVEAPRSSALASALAIVRYIESITEMGLVAPTPGLYGFAEVSGPFMQRHLAPPELVAGFEAEEEAQREASRHVEPASPSRLPTIREAPSQRSLPLPAESLPRDERTLREAASLLSASVPAALQRQPSLPRPISLGNLRGAGRAQRHVLATSEVGGSAWRSWACCKVLSGSSQGR

SEQ ID NO: 15603 - protein, 123 aa, Chlorella protothecoides
MQGNKALLWHDPPAHNWPWRDLDGRCPLIKPGPNATQELERLEHAFDSVKRQLFRRLHAKLRDQLFPSPSAPRPEGTFLEAPAAPPAAPALEPGIGVLPRGSQREAELVSSRSRKRASLENGS

SEQ ID NO: 15604 - protein, 130 aa, Chlorella protothecoides
MAAKKAQVLNDIFEVLEIDPDGKKFDKDIYPVDLGDKLALCLATTLNTDGTPSGASYDSVRPTARRTLADDFEYVMHGKIFKFKDSSSGGQVRAEVFVSFGGLLMQLIGDPKRLADLDVDEDIFLLLKKV

SEQ ID NO: 15605 - protein, 135 aa, Chlorella protothecoides
MPVFNHHAGHLSVNWSSNYFLAAQRHPGVPALNPAHLEAIALVDALAASDALRLDAMLAPGDVQLLSNHTVFHARSAFTDSPERKRHLLRLWLAPEDDRPLPEAYREILGGSVEVGRRGGIVVEGTRLHVPLEAA

SEQ ID NO: 15606 - protein, 291 aa, Chlorella protothecoides
MVQTAVQAGVDPMDEPSSIPAGYGAENGEDLSLGLGELDLTTEHLSLAGIEKDVEALADHEGSSHTHPPHGLPSGLDPREYGRRYEDELRQAELASIEDYIAEADTLIALHTDAGDTRRAHAPTHLQIKECDDILQGVEATLAHFQTDLGSISSEIRALQAESQSMNAKLRDRRALKVKPGLLGRAGRRESLEDFVGRVSLTPDLIHGIVQSDVQSEEFLSALQTLGRKLASAARDPDLQGTVALRDVAPELEKLRIKAVVKSRDFLFAKIWDFRRPRTNVQVQGWCILLR

SEQ ID NO: 15607 - protein, 320 aa, Chlorella protothecoides
MAASFPTAVHQRHNVAPGSRSRIPGITSASNAKTGLARRGEQPLHVKQQRATQQRLHAGRQAGGVLERSVAPTEAPDTQLRPVLTAAAWTAADMRAREHEWTYHLTPNDIQELDEALVLARAMGKPIHELTQEDFPLPLLAPKLRALGSEVVHGRGFQIIKGNADGYWGHEGVGQASVLLPGVILTSATSAPRPVYDPPPSFSIPISPMTGVPVERWSREESVTAYWGMGLRWGRAVSNNAAGHLVGHIKDIGHDPLDPGTRLFATRAAQPFHNDAADVVGLLCLTLGESGGLSSWTSSVSVYNAVLAARPDLARLLTQP

SEQ ID NO: 15608 - protein, 101 aa, Chlorella protothecoides
MVELGCEEHDRQAASTQFITHTVGRMLGEMKVWCGGGGAGPGVGLADVRGMMCRVLGPLDADRGRAASPPLPVLAVGTDAHRHPGVPVAPQPGGQHQQRFL

SEQ ID NO: 15609 - protein, 393 aa, Chlorella protothecoides
ARRWPPACSSRAGRRRRSWRPAPRCAARPALHRAPERALPGPGCAGHSGVPGPPAPPVLVPGPGGPLRVGAGAQSELCGAFGRPVGGAGGGAGGPGRDAVVQPSGPRRGPAAPGGVPGPSEAPGPLLRPTPCRASTPSSQLPPRPASPCATTYPSWRPSPRTHPPPPSTCSPPRHWPRWVVGWRAGNPVAVSNCGARNAPTGMSTLHMHTMMLGQLSLMRNPSPASPASRAGPAEGAAHALSARLRGRRSGGGGIRRRHAQERAVRSAWACAEVVRLLAGKGAGLTCGWRRFAAGTLRNWLSWSVQRAQVCTLGACPECHQHPQHPTAPYLLYPRGPIRDRARLLITNPDMLHMSILPVHGQFESLLRGLRYVVLDEGHAYKGAGMGGGAGIR

SEQ ID NO: 15610 - protein, 288 aa, Chlorella protothecoides
MPAPGALQPHDCHGTSAWDRKLPKHRPSLPFPPTLPECDNPYDTRYKPERLLIYDKHPGGIGLCAAEGFCLEHHIEGCSAERPAGHLARPTPHLPGSRPLWSDPDPGPAAGGGLRMHLGHWVPMLCTARVLQPVQHRCVDEQLCLEGAAAWDRAPMLAGKQITVLACRTNKRMAPIMPFNQRSTLPVIDAPQSSPLCSAKQAWRCTGAADPHQVGGGKGCSDPPIGACKGRRSLNSADGASLVVLWWRGVNHGLGCRGDGCVVHAACGPSADGIKDLGRYFMRARPAT

SEQ ID NO: 15611 - protein, 200 aa, Chlorella protothecoides
MRVGGASGWVMLVLGPGGAAVFGIRSRNRAKRGGLVSSVVSSKSTHPPHLPSSPADYPIERLALRSDGQMLASASHDQTVKLWDLADEEESEEEGGKKEEEGAMSKCLPAEEGRGGVLEGAEASASPEADALGSGSSAEPGSDEGPAEGASEGGDSSEESSSSDEGDAWERKRRRGKGAHRIPSKQVAKKQSSGAFFADL

SEQ ID NO: 15612 - protein, 159 aa, Chlorella protothecoides
MQAVHTWTPHGDYVSGMTWHEPQQSLLSVSGDGTLARMDPRAKKVSYMQHGEIGKGCGARGGLSEGLARARGTFSSPRGDCYWRRYPAALGTCVPHSCHALPRLMQVKNKSDDDVDDELLSVVVVKSGRKVCTSFGVFFHRPFAISSSFMWRRIMGEWG

SEQ ID NO: 15613 - protein, 257 aa, Chlorella protothecoides
MHPQAQTRARHGAAGVHQENRRGSPIMELSCLLAEAVQHGLRTLAFCMTRWGLLRLGMGGGRGWEGEGDSRHIPSPYHMGPPLCQPRACSCTPPSSAFNMNSKVCELVTAYVREILQHTAPGLEESIAVYRAGYRVWEGLLLEACVGVVSILPASPPSSLAPIPPWSPPTSPLPITTPSPQERREVEQALHDGRLMAVAATNALELGVDIGSLDLTLHLGFPGSVASLWQQVGGRVAVGRGGGDCVAERGDGGAGPR

SEQ ID NO: 15614 - protein, 131 aa, Chlorella protothecoides
MSILIGWESPLDQYFMAQPARLFGRPIEHATIDPAQPMVLEAHAVCAAAELPLVLTPDLDLACFSTGSATLTSYRCALAQRPAAALRPVCENLKASGLLGRHPGSAADHSMLHYTGQFSNPAAKIRFRGWR

SEQ ID NO: 15615 - protein, 80 aa, Chlorella protothecoides
MPARRHSHIHSLRAIDPERFAIVNEAAGGTVLEEIEESKAFFEVYDGAVYMYQRRGPTLWGGMRNDTIPSSAAPTHETMM

SEQ ID NO: 15616 - protein, 292 aa, Chlorella protothecoides
  MOD_RES (42)..(45): Any amino acid
  MOD_RES (259)..(262): Any amino acid
MTVRTGDGVHWEPPSHPGKRSLTPSDCRRTTTAALRALCSTXXXXQRDRTRWGLDDSENERRRALGAAIACRQAKSNPPHTAAARQRLRCARCARPLAHVAHSPSQAPEITTESSQEAMSLAERLRAAGARMYGAFWCSHCYEQKLEFGREAMAAFPYVECYPTGWHPVRDSLGGVWGAAATWGPDSHCCSGGPPPAGHRTTWDGGIRTRHRLLDDTLPTPPLLAGHGARRGVHGSAGGPGGLPHLGHRGQEVGGRPDXXXXTALAGCGVRPPPWGRTPTAAAADPLPPAIE

SEQ ID NO: 15617 - protein, 999 aa, Chlorella protothecoides
  MOD_RES (248)..(250): Any amino acid
  MOD_RES (873)..(876): Any amino acid
MAPASRSAVCCGGGVHVLLSLLHPKLLAVLWARRGVQGWVAGAQGWVGGAEHRTPASQARLPFLWQPQPIPSFNMLQGFLAEGLQHTSAGLGSVVIDSQPLTVALLAALLYGERLTALGYAGLPLGVLGLALLEIPPSLWASSGGDSLDAAAAADAALGPALMLLAAQSMAVGTIMMRWVASKADPVVATGWHMILGGLPLAALALAREGGDLPARLIAATREGGGQDFLRGAGGCVRVVARGSGGAXXXAPRHVREGVRTLCGGQEGVSVSLREGLEVPPCTGTPLIADHGQFWHLDGQPAPDSTHQRRAAAGLRHAARLRGQLRRLLPAGLAGECHLPVLPHLPDPHVCRGGGVHLPGGDPDSAAAGGRGVDPGRRGTHQPERQGEPGVRGPGGGVAARSPVTTSPPTIDEPRGSPAPKYVAPTAYPTVALQGFKGWQAVPGHAAGVRKERESPLNGGCAGKSLAAVDRTLSTLEQNQHNQRTHVSRNTPHDTTAVKRGRLLQKGQAAAGARGGCWEQYKSASMHVSLTGGLGGLSLPSWHIIVHQRDNSRRCHLAPGLCRIGGLLRPPVLDCRLNGVLCQHAAVQLDGWQAEVLGNVAVLDGQHLVHRLAFHPVESVQGMQLSGEFVAGSPLCGHAAAGNGRPTAKRLEARVNDVSLLVDANLELHHIPTRGGADQAGAHALVALVEAAHVAGLLVVCSLPCSDRGSRKPSGSITPPTFLWYARALVEGSEEASTAVRLPTARSALEERRESIPVSDPHGSGGWTQLQFLVCALRVLGEPEPEVKARLSAEYLAAWQAGELGCTDLVSHHGHVPDRPARADEKVACFHVGLHRWSAWDLHACRVPPWVQTLTTPPSQTMSCSRCTTAVQXXXXKVACFDVGLHCWSAWDLHACMMPPWVQTLTTPPSQTMSMFKMHDGSAGAGRALIPADKPRALRTHLPPPTPPPPFSAPARRAMEAEAREGRQPGLPPGPPPLPRPHRELGRGPGLGHHRPLRP

SEQ ID NO: 15618 - protein, 280 aa, Chlorella protothecoides
MPAGSSGSQAEAAGGTPPHIPAWVTEARAYETVETWFHALIRAHFRGPLKPPFNDAARAQAGFGPEWYLPLATVGGRSSVSEKSSHERKELWEWWPWAPCRTQISSWRATQITAGDLCTVPSRGVAMADAGSLWWPPFAQVSHELRTCSAEDQLQILQKYEKYLTAGVGHFRQPSAASKALIQGTAPLKLPDGGTFPPVSEVASAVLQLSADLVRRWWGPASGSCSPDRLHHPGTFLPTLGPRSRGALAHPLTAHRRPHPVLQRAPAAAADRAGPPGGGR

SEQ ID NO: 15619 - protein, 381 aa, Chlorella protothecoides
  MOD_RES (249)..(278): Any amino acid
MTPRSPQVKAGDHTLAEKSTPCSFLRSTSPRRPLFLADQPSLCEGLWQQARSSDAPLLSYLDGLRALFPAFPSPLYRLLAALASSPVSAAAAVAYFARLPGLATLQALDGDVVSLDPGEGTRVVAGRDLRLDAAPSVHVPEGTQGADSQRHKPLVGGAIVCRACPPRLPTSPQHKPQGVPGQVLGTPPGFLELPVTWATAAGRHGAHPDLGLVGWTLACPEATGFLILIERGLAAQDALRDAPAAPAAXXXXXXXXXXXXXXXXXXXXXXXXXXXXXXELAAALALVARVVAADAGLALDLLHIAAPAAGKAARGAGWPSGGQAPGGADVLTLAIRVLAGVPLAGRARFGALAEDAATAEDGYDAMLGGCLGARGAGVHCE

SEQ ID NO: 15620 - protein, 250 aa, Chlorella protothecoides
MENTDVPTGARVETAAVASSGPQCPSDGPMVVADLKSVSAGFLKPALKDLISCELKGWGSSMSPQSIPAALGPSPSGSTPSESDPPSPRDLPGIPSADTHADSGPPNGSAAEPGVPDTLGKPPAAPAAPALGTSGEAELLALLQRLAALDSEGWFQAPVSDIQAPGYSSIIRHPMCIQAMRAKVAAHAYTCWGDFVRDFELLCSNAMRYNQKRSRIHKQVGVRVGRIEWSGRMVWGSGVDQCGLASARSL

SEQ ID NO: 15621 - protein, 170 aa, Chlorella protothecoides
MLDHLPSHPLPSPLHLPSFPSVAWAGNWEGKAPSHVLAPSPRSDSVISRRDGQAPGAEASSTMTPEGMHGEEHLAFALTDGRVGMLSVRGRRIQDLRPCAPHHLELEEGGGIGRGGRLAWWTVRTRVVAADVECIHDDHAMRLEAQARVKFAVMDSIRQVASRIPLLVQM

SEQ ID NO: 15622 - protein, 170 aa, Chlorella protothecoides
MRSPLVALLSSYGHGDAGPDLLRPGGIDVLTCRHADGGLSTWRRRPGLLTYACLGTHPTGAAQKAGPALLSHAAGLWGGLEEGEAVSGPRLALQVAAVAQDGSLWQWQQALVLGPGSSCSVPLRFLGAILSCGERRGLAAVLAAQPGSGLSSSTCRQCCLGLCSLDRDQG

SEQ ID NO: 15623 - protein, 718 aa, Chlorella protothecoides
FPRPAGPGGAESLAPPPPYASTNPPPGALRFSTAAVPASQSLRARWHLPFGAVLAPLSEAGGPVPVVDMGGAGIIRCSRCRTYVNPHMAWLDGGRSFSCNVCGTVNQTPVEYFSALDGAGRRLDLADRPELRAGAVEYVAPQEYMVRAPQPPAYVFVLDVSFAAVSSGLLASVCATIRASLDAFHGDSRTQVAFITFDATVHYYALRPGAAAAPMLVVADVEELFVPLPDELLGNLVECRGAVEALLDSLPAAWAGATGVDSATGPALQAAFLVMSHVGGKLMLFQAAAPSVGIGRVKARDNPSLYGGDREYSLRVPDDPFYKRFAAECSRCHVCVDVFAAGATYMDLPSLGAMPKYLGGQLYYYPGFSAARDGAKLRAELARNLSRETVAGPAAVVRDGRVGGEQGPTRPHPPPSPPHGQTRPHPPPSPPRVRLGPPRHPDTLTTPRRLGGGDAHPVQQGPARQLLLRPLLHPHHRPAVAAGGGRGQGLQRGDRARGERADGADGVRAVGAAVHRVQRRAPHPRAHRRAARRGRPGRPVPRAGRRRGGRPAGEGRRGAQPGLAPGGRAPGPAPQGTDGAAGVAPAGVARGHAGRPAPAQRHAAAAARPRAPRPLHGPGQDRRAARRRPRRQHRRAHRGGPRHRVRARGRAPAPALPRRLRGGGGGGGVGAAGTRWLHRPSPDRARGRGLLRPRRRLPHRQRPPVHPLARRRPGAGLL

SEQ ID NO: 15624 - protein, 332 aa, Chlorella protothecoides
  MOD_RES (4)..(7): Any amino acid
  MOD_RES (223)..(226): Any amino acid
MCIXXXXADAHAFWNASGGYGDVFPSWDSTHVPAVNLLLQLASQGAAVPGQAEYERWYTSTFQAAWLDPKGKPAAVPKGWVGLGGGAMAAGHHQSVFRGASARLPSSRRSSIGSRSVLLPLLNLPPQPLGTSPAPTASVKLTRTPLGLVYPTWSTWGILSYSTNAAFMMALRASYSANDRESALAFVRSQLNYAVGSTGRSFVVGLGVDPPRQPHHAAASCPXXXXLAFVRNQLNYALGSTGRSFVVGLGVDPPRQPHHAAASCPDLPAECGWAHFSAAGANPQVLTGALVGGPPSGDGSYVDLRSDYKTNEVAITYNAGFAGALAGAIALA

SEQ ID NO: 15625 - protein, 137 aa, Chlorella protothecoides
MGGGGCSGWWGIDDVRVTAECVRGGPPAADAADADAGFLSTPSSPCTQGVWQRGRCRPGPGPAEPGAGAPRLGAVGAHQRRAGRAARPARAGCYVVRQGTPMEAHVAPYFVEDALPSSASPGFFEFMQVLQKDILGK

SEQ ID NO: 15626 - protein, 592 aa, Chlorella protothecoides
MAGGGSRGRYFCYAIPAGGSRGVYVDLRQTVLLHIAVEEIGMRSTKWALCSWAQRAVVGGRAGEPGEATMTQRQAGLVRARGVEGGASGDWSMWASTLLGPSRGAGPTAGLPREAGARGPRLCWDHPAAQIPRQDCPARRPPALSTVADSSDSPARLTPPALLLTLPRSSPTHRLPRDIPLRMVSMEMPLPVLPEDNVGQYLVKLKEAALNLNVLHTRLARDARLALNRRDMERAVAHMRGMARRMRRSGASLVAKKASAASQRARRARLGRGSSAGRSGEEEDEQVAGGVDSTGPSFLWRESGVEVQAPARRAGRPAPGRPDDGGAGSEVQAPERGPDSRRPGGQTLPAISEGAETLSPHSPPPSLPASPFSQDAGGPATRWNQPAPTAAVVPPAGEPGAGASPPPLTRVSHPAPAATLPGVKARPLKRSTWRSLFRVGGKDALRAADSADGGATAAQPSPRPSDNTEVGTPREGPAGTPSKLPLLPRGARAGGSGAAAWRAGDEDVPLRERVARFDPGAQDAGDETGFQVVTRPAGTSGHGTHGTVSLQPLPASGAGEAGEGASAPGDSAPAAQQQLGPPPAVPWWRKLV

SEQ ID NO: 15627 - protein, 260 aa, Chlorella protothecoides
MSLAPQKYLIQNQSGLRVYYWADGPRGGVRSPVFSLPNGGSENLRVLPAPKRLHFAHNVRGGGGAGSERVGATLHLHFEGNWMPLRDVAVNVVGKYRYRMASPADGTTVPVLVDIILVGRTKVITLHSSIWVENSIDRPLSLRLHTPTTPLVPPGAGARDAREARDAASADLAVGPLRPGAGCYLPLTSVLGGLLFLAPEGFCEAARDVVRLSADLGAVLAQQGYISCDPDPAGEEEFPLHVALQTTPARVSRVCMCVVF

SEQ ID NO: 15628 - protein, 369 aa, Chlorella protothecoides
MQGTATRRPCARSQVQENSAVAAAAATATVVASSSAKLAPPPPKPDQKPVHDVVAGAMARAASQSTIHPLDTMKVRMQTGPRAGAPRGAGPRSGPRLPSSRPARGGGLARNLNEFKGLYKGVVGAATGAGLIIGTYFAFYSTTKRFLREHSTLSDGSVAFVSGATAALGSSVVKVPLAVCIRSVQAGVYTNALAAAQDIVKAAGVRGLFTDIVKAAGVRGLFTGFLPTILEDVPDMAVKFAVYETVRNLHLRLRGRHASVLEDLCIGGFAGAAAAAATTPLDVVKTVMMTTASARPTVVSASRAILREGGGARAFFRGMGPRALSNGLNSAIFFCFFEAIRQVLTKQQAARVAQAATGVKAAPPAWRAR

SEQ ID NO: 15629 - protein, 113 aa, Chlorella protothecoides
MARERGSLNVMSVPVFLNEAQRGSSGAHLRLAKALWELCDEEPARAGADLVHAFKLIMTCGEVGGVAFSDAHLSCGCPCGMMLGRTRTMPPLTLAHRPAAGPHALFQRIAHNQ

SEQ ID NO: 15630 - protein, 970 aa, Chlorella protothecoides
  MOD_RES (98)..(101): Any amino acid
  MOD_RES (472)..(475): Any amino acid
  MOD_RES (574)..(577): Any amino acid
MQVASREEARSARHQYFAHLWPKQSVTKGHCAVVPMIPQLANFSLEVWGLPLSMEHVPKCTRLVLELERPANAQICQTSAGASPGSSSQRRRMSSSKXXXXVKQVLERVLEVPLKDGERCRPRSEAQRCVRGLSNPLLCLSRGAGTCRRDKQAHWMSPSLCHNASWQPFLPCTGGRSRKLSEQLILHQLCGWTALEGNTIPVKLMGTQLQARFVSLSSALSGPSTHLSGGTHLAKIGFDTKIRLLNLDPTSGDAPSGGNYQEAPPASTWREDLQGDFSSAAIAGIERALSAGKSIRFAKPMDLGGYSEQLHTLRQMVVLPLARPDLYRRLHISPPRGVILHGPPGNEDDTPTVLTAESLSRNLQKISRGALFAARQPNFDPGHPFPHRDWQDHAGENHRSRFKCHGFRGAHYALHASLISIWVTSFPTGTGKTMLARTIAQESNATAFVVNGAEIFSEFTGDTETTLRGIFXXXXVAKLLQPSVIFFDEIDVFAGSRGDVNQGRQRNVGASGRIVSVLSQAMDSLEGRWTSIGPWCTVTRELEQCGHSWDKSTNSCFPLRWTAQASITHADPSXXXXTTLHPFLHPSGERVVVLAGTNNLENVDHSLRRPGRFDSEVEMPAPRPAEREDIMLRALSNISHCVDKDQIRAVARASHGFVGADIHALCGQAALSTLRRYHQEHAGLSREYSSLVLPRVSASDLEAARLRVKPSALREVALEIPRTRWEDIGGLEDVKVKLKEAVELPFKSGEKLHSFGAVAPKGILLHGPPGCSKTMLAQAIASEAGLGFIAVKGSELYSKYVGETEKAISTVFRRARSTQPAVVFFDELDGLAGRRTSDGAENSVGDRVISQLLQELDGISARQAIIVIGATNRLDCLDPALIRPGRFDRILHVPLPDREGRLAILKVKTRSMPLSEDVDLRQLSNAIDGFSGAEIAYLCQEAGLKAIEEDPDAQNVCAWHFQEALRSFSL

SEQ ID NO: 15631 - protein, 266 aa, Chlorella protothecoides
MPSLGYLAVVFCLLATCAAYEFDMVFQTKCVMEEVVEGTEITGSFTAFNRHQPSELVHVDIRVRRRERGCISAERWGGSPAVLGPHLHAVQLVHESCAASHRRHAHPLPPDFQTAQNTRIRVEWKSGASAHDWEQVAKKDNLNFLQTELLSLEQSVHDIHIELQRIRRKEEEMRDINGGKGGWCLDGLCAVSLIAAGHVAQVLILLNCRGNKCTCGVAGRGRPPGVPRFVWVADVIPAALLQAQEAIVSSRHRQQICHCSVLQGRC

SEQ ID NO: 15632 - protein, 517 aa, Chlorella protothecoides
  MOD_RES (384)..(387): Any amino acid
MPKKSTKSKSKRTTLKHKYKVLRKVKEHHRKKRKEAKKLGLKKREPKDPGIPNAWPYKQELIQQLTAQKERAAARMRKTKEEHFKREQQATDLRPAASLANVSQAAQERADVFDGALHGQDGVTATQDYSRRAYYKDFVKLHENQHSLPVMNGSYLLAGFSKVVEAADVILEVIDARDPEGGRCRDVERFVRKLDPKKKVTRQQHGCSARTTSLMPMSSVRPTPTQSHTQPDLVPKEALAAWLQYLRQELPTIPFKSSTQQQAKNLGQKQLHKDGTANPKVSESLGAVGPEDLCFWQSEWVSGGAVHGGSMVRPPMIHLHSLPCPAGADSLLQLLKNYARNAGLKTALTVGVVGLPNVGKSSVINSLKRSRVAQVGNTPGVTRXXXXYAWPRGLTPAGIPSPCHAEASKSRPCALHHTCAVAPSESQPLSHSAPLGGKHAGRDTLSAVHSSRQANHAARLPWRGVCRSGLRWCGGSCTEELHQGAAGSPISQTSESIFVSSQASGAVFIPLLPPRLG

SEQ ID NO: 15633 - protein, 410 aa, Chlorella protothecoides
  MOD_RES (182)..(185): Any amino acid
  MOD_RES (314)..(316): Any amino acid
MELVRRCPAKQLMVLYKAPAFKTAEEFLVHLATSRGKLKKGGTVDMEKLHNDQCMPFRLNPAYSELPHTQSVCPPASHDVPLHPLQAAARILLQDWNDGRIPYHTLPPKRASTTVTGSAAIVTEWGPMFEADSVQEEALIGALPVTAGGGFVVDTLGEVGFDPEAPELQDEEDVDMEGIVVXXXXLPGVHLWWTPWARLASTLRHQSFRRRRRWTWKVGGMGRGNWAEFQQEVTWVSQCAAVVRDRGCANLRPTTPMQQMRRVTASSLLTVIHQATTWIYPLLQSLGAPVVVDAEGATWSAIGSPAPCNVSVGXXXIVVDAKGGTWSAIDSPAPCNVSVGHLAGISQFEVLCTLLQKDRGLLTDAQNAQLYNNPGQYNPHAARAARKQKKRLSRSAEDDSDFDFEEDYSE

SEQ ID NO: 15634 - protein, 724 aa, Chlorella protothecoides
MSLPILEQQEHFTMCHRARVNYVILEKLRVDEQLQGCDGACINDRVCWGPSSCPVPRMETRRHSRGHCCRRKMFLGKGQFPKTPERLRQHDAHIVQAPPQHPFKLDIPSNRSLGCREEGLTQSQTLSPQQSSLLGFTCDSEGCGNGGAICNVAVTAIGAGKFVCAGWTDLRYMVGRVPALTERRRSECTGVPVWWELYQLDEIDAEHLVAGMLALPKAMERVGVILGFTLFGTVCLLTYFSSSIIIRYASRRGKRTYSELIEGEFGLTGARVLQTSIIIHVSGEKEMYLFTLITCRISSLASASPTREVLVLISTGVMIVYLIIIADMLVGAAPEWHGVLPTLLDRHDGVWFLSRPFVVRRWMPGGGSLQALPSCRGLIVLMFPSCRSFKLFHNYPLLPFLLAVCGPARGCHCAHADQPRAHRGGTLLAQQHHHDALPVLYHDRPRGGGALAGQGGSHPHPAHATRPQVCLRVRHAGQHVRGHPVSPLRFLPGLYLPGRERVFKHWSSGGIPASSQHCVAGQDPSRHAVHACSFGSMSAAVPAGVHVEALSHARCFCAMRSMHMLLAGMSDPLPSSSFHMQFNLLPVVRLNVPCPASSLLSLFFFACALLDASPIPLPRLQHLSLKDGRCSNMLSITRKAIALCAALYGTVAISGYIMFGKNTQGDVLRNLTIRYVSTLVHPVLASVLIDFIVLATTFNLLVSPGRVGKGVDGSSLARGCTSDG

SEQ ID NO: 15635 - protein, 357 aa, Chlorella protothecoides
MGLAVERCSSPACATSAGAPTPDLSCDEASIHCYNDEAISCEPSVRRLKSQKRRAAEARLAERACVLMGLVAPPSPAAPLPCPPLPAPHSAADDEVCVLACSDCPPVAAPLWCGMDVKLPAIDWAAAFASRHSPLISDAPKGASYLLPGALPVILVEQASALPQALEALRASMRDEVLGIDLEWRPCFTASAAEGSRVALMQLASSHLCVLVRLCCMGKTFPHCLRSFLSDPSLVIVGYAWDGADEKRMRCSYGLGRNLFQRYFDVQAVSESLGYHGLGLISLARRVLQCDASKSKRITMSNWEARKLGCSQIRYAALDAYLTGHLFRSLRLWHGSPSACITCASALGKVWYGSFPA

SEQ ID NO: 15636 - protein, 281 aa, Chlorella protothecoides
  MOD_RES (20)..(23): Any amino acid
  MOD_RES (175)..(178): Any amino acid
MWSGKERRSFRKDKRATGIXXXXVCLARSVEVGCGVGESGKVLEGARERQVSGCCVERDEACHCAPSPLALEPVVALGSAGHTGCSSTCNHSPNIKSLRSPSFPSSLPPHIQINFWLGALVEMRSEDLYRMKGVLAIQGFDRRFVCQVRDVEREALSSPDAATPVHTIGWSRVEXXXXSPDAATPVHTVGLSRVETSLCRAASSLPAQALGIPAHHISPGCPLPLLPQGVHMLFEGMPDRPWKEGEKRTSKMVFIGKDLDGALLKEGFEACRVKPDDAPAS

SEQ ID NO: 15637 - protein, 463 aa, Chlorella protothecoides
  MOD_RES (7)..(9): Any amino acid
  MOD_RES (318)..(320): Any amino acid
  MOD_RES (385)..(388): Any amino acid
MWTASSXXXGLSIGAVSAVIHLLRAPCSIPCAQFGEVDVDSELVSIREDLEPGQEQIMMLNNGCLCCTVRDDLVDMLNRLVSLGTPVCLVHHGSAVQGSGLGPAACPGDVSQTGPKPAGGCGPGMSARQGPKPARAVALSHDSQPMASADPRVRITLPSMQTHAHTCQIERRDQFDRIVIETTGLANPAPIIQTFFIEESVAINMKLDGLVTLVDAKHVEQHLNEKKQGGAVNEALEQVAYADRIVLNKTDLVSPEDIERVTERLKGINGMATILKATRAQVPTDYVLGVGGFDLERIDADVRQGPASLKWCLAPFPXXXLMGEETSKGPSAARSHSITTYYPDSSRSSGAFPLSLISQLLVEKEDDHHHHGDDHHNHDEHDHHXXXXRRRTTTIIMVMITTITTSMITTTAMMRITTMTRATIITKAMPMPTATSLATAVLRMAMPGTSANTTTTTTTMTIL

SEQ ID NO: 15638 - protein, 421 aa, Chlorella protothecoides
  MOD_RES (85)..(87): Any amino acid
  MOD_RES (313)..(315): Any amino acid
MICGSCVAREYSTPVEPGSPEKSRAGGGLPGSRLSGQQVSPCRELEQLRNDGSRTRKQSSNQHDFGMWGLFGMPRRQRLDSEGPXXXYFRMWGLFGMLRRQRLDSEGPSSGQPLVPMGFLPIPGMRSRQRERLGECLQLRGEAGEGDRMATTPSRAEEKARKEEGEEQTAALTTSRASTPLRAPPHRLGESGQTSPRTPDPKASLQRLLRSARLTDLVAQSSGLAAEVGSLDSDMQMLVYENYNKFIIATDTMRAMAGSLDGMDTKLTGLQSLLGGEHATNRQPVCPWLRNRQCAPVWSQSTVQDMLSVLGRXXXLTLRRHSKEGKHATNRQPVCPRLQNHQCAPAWSQSMVQDMLSVLGRASSPALGYSCIDLPRSMHDHLHRGCDGAQRGRQWAAGQAAAADRGAERHSPATPPPAGRV

SEQ ID NO: 15639 - protein, 278 aa, Chlorella protothecoides
  MOD_RES (27)..(30): Any amino acid
MQPRYHCWAGIGAGRALVSLPAQARAXXXXGGGGSAGRRSLGTTAGRTWDLGGRWLASQRRPGALRRVAVEIEGLARETLALVKSRMAADPGTASDCIQAMACMGQPPEELEAAFVACKRGVLERTLDIAAALLSSQAAAAGLQGPSPGTGEEGGPGPDPRRATQAAAPGLEADPPTSGARSPAGEGGAAVEAWDPAGGAPSLQQFLVQLDSRFLTELAATCAEFGILFRGRDTAPLFKVSRQRHGNWRDGGGEGVMGSCHAVLFQCHGRPPALYRGA

SEQ ID NO: 15640 - protein, 383 aa, Chlorella protothecoides
  MOD_RES (339)..(342): Any amino acid
MMKMQRVALLVLALAVVGGNCAPAGEFGIGLLGSFSWPTIHYLKVAAVSTYSTRRHAGEGILAGFEPIAEEASSAFETVGDRLSSVFGRKLLSDNKWESAVAPALEDAKEWADEAGETLQETFGRKLSEDKKDKFSLKNWQDSIAPAVEDAREKADKFGDSIKDAAEHVQDTVKEAFSGRRLSEDKKDKFSLKKWQDSVGPAVEDAREKAEEALEKFQEATEEVGDRFKEAITGRRLSEDKKDKFSLKKWQDSIAPAIEDAKENAEETLEKFRNALVTRDEELCLMACALLVCNVLRWCPSCWPQEAQKNPKSRPSNHLCPLHLQAKHPSPISCWTSHXXXXHLCPLHLQAKHHSPISCWTSHAHLVATPDAEAPMLMLTGGL

SEQ ID NO: 15641 - protein, 221 aa, Chlorella protothecoides
MTEAGGWRTGKEPRGPRELCVLLLDTLAALRQRSTASTPRPICDCGRPGHPAPGLDACIGSPCALTCPTTPPFLPALAAEVSEEVAVVTATQPLPASTPSHRASPSGSSASGAMDTESMGAAVSRMFASSLERGPGAPAGITPPAVCAAVAARGLAAMAEALHAHTLVRPAFQQIQLDVHFLRAPLQGFVAGSYEEPAVLQVGGRQSFVCPQMRHGSAKCR

SEQ ID NO: 15642 - protein, 341 aa, Chlorella protothecoides
MSTKPLLPGVERDVPLTTRLSYALKHQWAVWLGVPVAMGLIVGLSLPSNPELPAPLNIVSPIIGWTYFAAWSVSFYPQGTLELEYRSCARREFEGLALCQAVAVVDMVILVPYCLLCLPCCHPPITVWLNYTRKSVSGLSLDFQILNLLGFVCYAVYNVSLYWNAAIREAYRLVHGGNSPAVHANDVFFALHAAVLTMVTLAQSLAYPSSRTPPSRLCVAAVVATSGAVLAYAAALYWAPGLHPSCLNGCTEGTWFTWLNFLYLVSLVKLAVSLVKYIPQDWSAITGNPVKFALGFVSMVFDVIFVGQHVAFGKRRGVQDAEGEEGSGLLPVSDEAQPADV

SEQ ID NO: 15643 - protein, 104 aa, Chlorella protothecoides
GAEAVQGAALALEGVDHVEGGHGLAAGVLGVGHGIAHDVLQEHLEHAAGLLVDQAADALDTATAGQATDGGLGDALDVIAQHLPVALGTALSQALSALAASRHG

SEQ ID NO: 15644 - protein, 426 aa, Chlorella protothecoides
  MOD_RES (411)..(414): Any amino acid
MTQSNGNTFSAEKAQQFAEVFPDALKSLKEADPEVAALIEDEKRRQWCVVGQGNTLRACMPLDRCASLSDAGRAASSCTRASSLYLNMRNLPPLPAQERDRVDRLGELHQRPRAGGPGLRPDQQVQRGPARRSLLRRQRGNRQGGGPLSAARAGGLRPGPRGLGRERAALLRLPRQLCGVHRPAPAPRPHHGPGPALGGTPDPWLLHRGRKEDLRYLHLLRVTALQAERPGVTACAPPETRSLGAHQPVPSFHLPQTGYIDYDKLEEKATDYRPKLIISGGSAYPREWDYARLRAIAGEPGWAGVAREEGRMRMGSEAFGGTSLWVLLQVPQARLPSLPGCQGSLVSGSSPSRSSDEPGCVPMPCMGQHTPGKLNRHRRALTAFYHSPPNADKVGALLMVDMAHISGLVAXXXXARRPAPLSSPTS

SEQ ID NO: 15645 - protein, 386 aa, Chlorella protothecoides
MPRLPLVNMPHFPTHLPGTSLRYKPGFIHGGPGIEHDCGTSRGVGYYLEPLALLALFGRRPLSASLRGVTNGGPDPGVDVFRAVTLPLLRQLAGLEDGLELRIEARGAPPLGGGEVRLRLPCVKALPPVALTDEGMVRRVRGVAHSMRVSPQAANRLVDGARGVMNKALTQSLRHSWASRGGLVVCRRPARVSPPTEAHSILPFTAQLLADVFIFTDHMSGRASGLSPGYGVALVAETTSGRMLCAEACAELGKASQSTAEDVGRAAAAALLEEVSRGGVADSMHQALVLTLCALGPEEINEVRLGPLTPYAGALRNRNGRGPGARRQAHPTLGLPFPPFTRAVGTLRHLRDFFNVQFSIRPEEETRTIFLSCVGAGVKNLSKKIA

SEQ ID NO: 15646 - protein, 85 aa, Chlorella protothecoides
MLRFQGAEHFRQRLVFSTLSGRPIRIDGIRPHAESPGLQEHEASLLRLIEKVTNGCIIEINETGQQVLALEGMGPEECPSGCAGL

SEQ ID NO: 15647 - protein, 596 aa, Chlorella protothecoides
MDQPPPSKPQASAPEHILCDTAHGVKSGHQTRSQHPAAPVSAPGLALGGERGPTDMDQGRREHGHEDTSLPVATPMASAAYDLTTDIDLSCVPTPVPMPDKPPSSCSIEAFSPELELGKELAGDGLGKMESNLQPPATRQDERGAGAYWVSPSLHPLLPCQKEAVLAAFQDNTLVAMPEGSGQASIAAVVMLNFLRWLPQVWRVGWGACTGWVSDLGDCGNLTVAACTVFGKAARRPLASCHRDTTIPRHAPSIPCVHQGKVAFVAPARWQLKSQVEACQRVTGLDAACISDFSSASKQEARKEAWSQDHKRAFFCTPATLWSDVKRGACGERAGVERPQAVLRLSLHSQGARRASPSLSPPSLHQPGVCAYDQLACLVVADAHAASARSDAVEVVRTLTRRRLRTRVLAFSSFLPCLPPAQVQEALTGLAIRRVCCRGERHPDLGALRVPMERVDRILTPGPEASRLLDALLRTLRPLIRQLANANVGPGDEGGGTASSRGLLLAPGETAEGLTSSALDSIALPGSGPQPRATLRHAFLALRLREALEAWGPQAAQAVLLDALAADTSAHRLVASSRDFAQVCGRLKEQEWGGRG

SEQ ID NO: 15648 - protein, 281 aa, Chlorella protothecoides
MIFFRRAGFLGCVSGWVAGPLTHGALRLCSQCFLSSAAADGHAAWRRRLHHPALTAPTSFPPQHPQGPKPESALKRGEAPGSVSYDFEDRINFAVFPSLQGGPHNHQIGALAVALRAAASPAFKLYARAVVANSRALAGELVRRGYTLATGGTDNHLVLWDLRPEGLTGSKVEAAADRCHITLNKNAVVGDASALAPGGVRLGSPAMTSRGLGEADFRAIAGFLDEVVAECKDVQAAHGKQLAAFSKGLDASEKLADIRARVQAWAATFPMPGFDAALLDA

SEQ ID NO: 15649 - protein, 237 aa, Chlorella protothecoides
MPPHPLQFKAELEVAARSGAACPKLAALQSLLEAQLQVLYGSSPSLCCARIDFSRTHSRGPPPNQTTAPMHPAKTHSQEHTSSRMLVCMSHRPSFAGLAADLSQAPGVRAGTWMPKAGASGKGAGSGSARSAAPSTGPAQAVREARAALAAFRSGTLNVLVLPPDCCHEEERESLAVADLVVALDGAATPHALLHLLGLRGRARPARFLRLLTAGGEAARARAADKARGGLVSLGRV

SEQ ID NO: 15650 - protein, 113 aa, Chlorella protothecoides
  MOD_RES (90)..(93): Any amino acid
MLRCALALVPRPSVALQGWIPAVRCFAVGGNHMALIRELREASGAPISDVKAALQQADWDMDLAAQELRRKGVASAGKKATRTAAEGLVXXXXPPNIATLTPGSSRVPTHSIP

SEQ ID NO: 15651 - protein, 295 aa, Chlorella protothecoides
  MOD_RES (175)..(178): Any amino acid
  MOD_RES (198)..(201): Any amino acid
MPAGALARHPHVLLLVTPSSNFRSIRIYPSQLPITLASLEDAVANVAGTVRENVRLRRAFFLPRPTGGVVASYLHQGAGEGLGRIAALVVLAPRDPGTELAGPAAEAAADLARKLGMQVVASAPRFLDREGVDPVAVEEERQVLRSQALGSGTLGAERFSRGWGSGVVSAGGAVXXXXSAWQDPRVALAACSHPGSLXXXXGAEHFSRGWGVRGCERWRRGMEIVRPCNVLKGPGPGSCRQGVVAQPGLAWRRARRPCAWQVHESHWRPAAILAPFQNSKQHLLSTPVQASRRPS

SEQ ID NO: 15652 - protein, 256 aa, Chlorella protothecoides
MPEYDAVSKISIVPRGNAGGLTFFAPSEERLENGLYSRSYLENQMSVALGGRVAEELILGPDNVTTGASGDFQQVTRVARMMVEQMGFSDSLGQVAWSQSGGGSFLGAQMAQPANCSGETQDIIDKEVKVRGRVWVVGDVEGGGPRHSLSDWRSRSGICISEGSLAWQDDVILGLQQAQQRPPQLPRQQPQYTLLDEMKSLPDLGNTHFPLPRITHVSLPSPPTPPNRTTSELGGPGVPQGQGPDPEQHLSAAPHG

SEQ ID NO: 15653 - protein, 531 aa, Chlorella protothecoides
  MOD_RES (509)..(511): Any amino acid
MGRPTALLTSSLRCAGVPEHTQAAPGGVLLTPGASRPLAQPHPPLLSSPRIGSLVGGAQGLISASYDGAVRCVRSDGGVASVFVASARPLKALALGGLGLAAAGDDGCVGVWELGPGGAVPEAPRQLVSLRGHTDAVAALAFSPDSALLASGGWDRGLHLWRSADAAEAAASGAPAPAAAKKRRVGKAEGAEAAAPAPVLDASAAELAGHTGAVSSLSWTREGACCFFWKGAERGGRAGNRSRPVASALLAGSLARLVRPPGQSSPFLFHPRPPSKAHTASTHPAPLLSTRATHRPAGERLLGPQRAHLGRRDGGGRGHADHGQGGVRGGGGRAGRRAGGGGRGGAAPAVGPARAWGGRGAAAPARPRRLGVGAVLARRAGAPAGLRFARRHGAAVGRAGQHPAAHAGGQESLKVTGGMVSHGIRGAPCSQPNSTRHHARGGEVPWDPALRSRQGRAPAGQDHCPRSKSTMESLAGLGAGWRETAWLAGRRVCGPGAPGGVRALAWPRXXXGLGAGWRETAGLAGRWVCGP

SEQ ID NO: 15654 - protein, 722 aa, Chlorella protothecoides
  MOD_RES (46)..(49): Any amino acid
MVTQRPVSVYNALVAHNTSGDPLALPHLCDKTVGIWVRDPMGVTAXXXXRRRYPPGGPRSCRHSCVGAFSIFGVALATGRNNMVAQLPVSVYNALFGNNISGDPLALPDLCDKTVGIWARDPMGVTALWMNPVSRPESSSGARRSRAAYCKRRGLAVGGLLRNELQGALADACCQGLDNSGAPDISIQVPRQAPRQFPFTQAACLDDDHVVLGVQGVGAVCHAGMGLGIYHHHTLAPGGEQAMMDGGVLIVLPTKRQTPMQSNPKSYNHLQSLTGGRHSLHPALAVCPPAARSSRARALAGRQSGSPRATATPAPGAAEWGRRPLPCVRLGWCPQDACRLLGGMAAWQGERAAPWPSPERPDARTGIPMSFRDAQYVPGRPKALLVGNEAGPKRGSESQSTHNAAVLRMIVFACDQALGPGTPYTGALNLARAMPRHGAVGTLHRFPLSMHRDITYYRSLPFLLCILHLPYIMVDASEVADEGAQLTCKFVTKLPKELRVPEAALVRRLGEKRIYYCEVTMHAPLLTCICPACPLRPCQPTSPGMACRKSSTTCWTWVSCTGFRTASDGRRIDARGCRDEWVTLLDRGAIRVLQDHPWAIPWVMRLAHETWVHETPLEHGPTTEMAKPFDFLINHELLRGTLQEHLSARGASAEVVTEIEYIPLQLPPSPGPRTPHDDWCAGGMGRPTALLASSLRCAGAPAHFRAAPGGVLLTPSASRPLA

SEQ ID NO: 15655 - protein, 114 aa, Chlorella protothecoides
MNACRIAALPEDTFFWLGAGEVDLKVGLFVKDFVRAYGAHVVDCTYDECWPGELPDEVPFTHERCAGLGNSRMNPPSNMKDGARPYRAPLKMATNVMRVMGLTGRWRRRAVPIQ

SEQ ID NO: 15656 - protein, 154 aa, Chlorella protothecoides
MGEVLAVGEAVWVKIVEVGEDERGPRVSASIKLVSQRDGTDLDPNGLKYKPRGAGGGPMQVCGAEWELGGGGNGGLLVATGSGDGVLTLRAGRGVDDPLFSRSRDGMLSLRAGRGADDPLFSSVALPGCGVSLRSRPPRELPSPCGLTWHGVGL

SEQ ID NO: 15657 - protein, 114 aa, Chlorella protothecoides
MLWEGLPGPKQRWGASLATAPLGVALPWWPPAHEVGGSGEAGPSADGAPACAARARITLHTPNPPMADPDGGRTVQAGGLLEDAFHWIRAHYPYWNRKGGRDHIWVRGGAVPAC

SEQ ID NO: 15658 - protein, 100 aa, Chlorella protothecoides
MHKLWVALAVCALASCVQGISSGDAPFFLRSRATKNHLTKEAAADKVSSLPGWGNLQDDEFDIYSGYITVDAEAGRSLFYVFVESQDDPAADPLVLWLNG

SEQ ID NO: 15659 - protein, 286 aa, Chlorella protothecoides
MEGDAELVAALGESLWPQLAEAYIQACLRPLLPTPDCAEAEDLASFGRAAGRGSKLEAKARTLGLLGPDTASEGPIAAYIREAMAQYALSSRARWSGGEGLHGGVIGPKSTLIRLVEASAACLASWDSRDTRLVSLARPGSEDGAPPPADQPSLLVSAATARLLALARAALASACEAGSPVLAQAVAAGVVEVAALIAEFRPLEGADQLLLPWPAALRHNDCQAAYQLLAGLPHDLAPRLQALVHRAVNFANPGARVRRAGSDALAAMLAAQRAELCALAADAGVG

SEQ ID NO: 15660 - protein, 108 aa, Chlorella protothecoides
MGRLQKFYQEVCLLEQPFVMDDSKREEPPGGLCTLHPSTVLSACSNLGASPATPLAQVQDVVRELGEALGVPLHLPAFLRVKVGEGVDRDAKDFAAEVAATLAEAGKA

SEQ ID NO: 15661 - protein, 259 aa, Chlorella protothecoides
MLPYPPSDRAYGRHQGRGGPGLPQHEELPPVSSIHHARVVSVRPFGAFVELDGFRRQGLVHHTQVAEDVRFTREDDDAARVHAMEFFLPPGERVWVKVQAHAPGPGPGQTRLSCSTRAVSQEDGTDLDPEGRLLSVPGGGGTGGGGQGGAPQSDLPPELDSVHRGTVQSIRPFGVFVQLEGFRKYALVHSSQARRVAQGVGVGLSGHGGWHGAEPGGECSGAEADAVLGAGSTSQHPRVARAEARGAGHHSPHASGGRP

SEQ ID NO: 15662 - protein, 144 aa, Chlorella protothecoides
MPSDAQERIARLERTWESLCGRLAALEMATGLPAPPAMQPSPLAACMRPEDTTPAEHMGEGASPTQLRLAQELLLRGVTRFAFQRVPEPYYSWPLEGRRQALGAASVYHLNLNGDVGRSTVVETLAARIGQSALQFIPQQATHC

SEQ ID NO: 15663 - protein, 91 aa, Chlorella protothecoides
MDGPANQSWRVVGRGPLPAPTTAPWTLRCPSWPASPLPPGLEVERPWIADMVYTPATHEPAANATRLRPLIWVYEMPEDYASRMLQYRVDG

SEQ ID NO: 15664 - protein, 88 aa, Chlorella protothecoides
MSELGPFFPTTRGNLQANDYSWNTKANVLFVEAPAFVGFSYSNTTADRDVGDKRTAEDNHEFLLRWFDRFPHYRSHKFWLSGESYAGA

SEQ ID NO: 15665 - protein, 352 aa, Chlorella protothecoides
MASTTPHVPARHARCMHLTVSPPTPRPQGPQAPGPAAQQAAAAAALVSLLASASPALAATDYQTPPLPTLTNVERPGTAPSTTSLSPGDAQSAPPLYGTEVKKADQGLPEGTQWRYSDFINAVESGKIERVRFSKDGTQLQLTAIDGRRALVNAVNDPELVDRLAKNGVDISVSEGEQQVQPGDHSLNTPPPSPSPSPQGGFVSLLGNLLFPLLAFAGLFFLFRRSGDGAGGGFGGGGMGGPMDFGKSKSKFAEIPETGVKFDDVAGCDNSKLELQEVVDFLKNPDKYTKLGAKIPKGALLVGPPGVYMVWCLGCFVCWDLCRGGADAVAVDGQTCVCLPIEFLVPRISTCP

SEQ ID NO: 15666 - protein, 173 aa, Chlorella protothecoides
MARARVPAGRPGRSRSTKAGAPTTSPLDWLDDYEAVSAWMARHDLHTALEAGDGLAWVPDFLPGAVAEAALACLEAIPPSAWNATAAAEDAGANNIAHEFWSTKSAPGTALAQLLRAFPLLSPRHDFTTFSAARYDARHHIAPHDDRAYTPVLCDDGGWRHGLGLSVGGTRVR

SEQ ID NO: 15667 - protein, 69 aa, Chlorella protothecoides
MRARSGDEARGRARPRQVADTVGAGDAFTAGVLWGMLGGHSLAGAALAGCEAGGVAVEAAGAEPGVAAL

SEQ ID NO: 15668 - protein, 91 aa, Chlorella protothecoides
MAANEGALPSAWDSNRRSSNSRFLQVTDLRVKYIGTGNDDRDAAAIRSNYPVSKSLPFYYWEAQIVDKGRDGFIGVGMSAADVKLERLPGG

SEQ ID NO: 15669 - protein, 469 aa, Chlorella protothecoides
  MOD_RES (135)..(138): Any amino acid
  MOD_RES (294)..(313): Any amino acid
  MOD_RES (414)..(417): Any amino acid
MQLRPSMAHLDAEREGGKKAAPKEEEGPDAGVLMPVMVQVKKRETEAQLEARLRSFAHITAQEAAEEWVGLQYHDDMSEVIWAWPVGGVTSASWRCGTNEGPPFMSPGGPHSASRQPTSSIPWPPPPSPPQLNPXXXXGSPCQASPWPPPPSPPQLNPPSSFPGQQTSQGIAQKLAAADAQPALHPMRAGDYLAALVPDPDRDGAGVVQEMPMGAAATAAAARPTGAAPRAGPSAAAPSAHPSGPEFPPAQVAGMGRALGPLFHHSPVCNLGAIRGYLQRSTAEPGLAAAVAAXXXXXXXXXXXXXXXXXXXXARGCAGHRPGPGDPAGIRPAQPGLARAGPAARPPAGPAGGEGGAEARRHHGGGARGGHPGHRRPLLQGGARHLRVARVHLEPESHVRALLCLLAVDLPNSXXXXALGNTHEELRVSGDLPLRQGTPMPARRRPSQLLSSVPPRIAGLPALLTPFTS

SEQ ID NO: 15670 - protein, 454 aa, Chlorella protothecoides
MDGILRRTRSSGMATHLFPFPTPDAGEVPFKDVYLHSIVRDAQGRKMSKTLGNVIDPVNVIEGISLQDLHASLEGGNLEAAEVARAREGQVQNFPDGIEECGTDALRFALVAYSSQGRDVNLDIKRVVAYRHWCNKLWNAIRFAMLNLGEDYAPPEGPISHASLPFACRWVLSRLDAATAEVDRALNAYEFAAATTAVYAFWQYDLCDVFIELSKPVLAKGGAEAAEGSAELAATRTTLWTCLETGLRLLHPFMPYVTEELWQRLPRGGAPLPTPSVMLAEYPRASPDARDARAEADMAYLLAVVNRCRSLRADYGLTRERPALHVACADGARRALLAASATELATLTDSASAALLSAGEAPPAGCGVAVVDDATTLYLSLAGILDAGKEVEKLAKKEAEAAARIEALEKKMALLSYKERTPAEVKEADSERLAKAQAELESLRAAKADMQALA

SEQ ID NO: 15671 - protein, 88 aa, Chlorella protothecoides
MAKVGVVAGVGGKALLVAAQSPNIDERKYAQVLRMLGNGRLEAHCMDGVKRLCHIRGKMRKKVWVNAGDVVLVGLRDYQDEKADVILK

SEQ ID NO: 15672 - protein, 164 aa, Chlorella protothecoides
MSLKSTPSWPLPSHLPTLARYNSPSLFHPPPLHQTPGNVVGRLVFNYCTHHGLWDTASLVARDVLAGAVAVSEAQRAEQAGLRRLAAHVRAGDVDAALEESEALGPGVLAARPGIRFRLLAQKLAELVRSGCQCVCELDVGGGIVARGKEDVSARQRVGRGPGL

SEQ ID NO: 15673 - protein, 93 aa, Chlorella protothecoides
MADEARSLKAYGELPDSSAGSIRKWLSSATYSPPTTPTAAVRVNDTDTFGDEEGGENDDYIDFDDISGVCLWVGGGECLTRLPPCPALPATGD

SEQ ID NO: 15674 - protein, 84 aa, Chlorella protothecoides
MDVRLDTTIPEYNDNVEPTRLLKKLTLQSSSVECGTSLAAAFVEGDRLILLPIDEVGWDGEAGVGHALAEANAGTLCRRRPSTV

SEQ ID NO: 15675 - protein, 124 aa, Chlorella protothecoides
MEFGRAVVDPAASTAEDHELLEDVVALFAYTDPASSPSGRLLTDEHRAELAAALVRAMLAQSGKREFSALEVLHAHARALHAQLVAAGDPCTAMIPSVERFVAARGAPLEQEEDGDGDTAMPPA

SEQ ID NO: 15676 - protein, 316 aa, Chlorella protothecoides
MSEVGDAEAPTAPLLATVPDAHSGPKSFPLDLGDDGVEDITLERTTSHHSADAAGNGWKATTFILLTDMFGCVSNPAVSSCPTLALAIPQHHHSLGALAIPSVFAHLGWLAAGVALLALGLAMLFSGSLFTRLAAAHPDVSVYHRLAGAAYGRRGRWLVFGTVYTLILLSPAVIHLTSAEALGVLMGGRAGPSPGLLVTLAMLPLAQVRSMEDVGWVSVVGTGTMLAAVAVTLGKLLLEPLPERAAAATHWLPPASTTPRLALVALLDVVFAYGGQQARTWLGVVWWRPDGGSPRRAVSGVLVATAHFELGWRRNT

SEQ ID NO: 15677 - protein, 304 aa, Chlorella protothecoides
MQLLCRGCVPGRRPWPDLRGRPRPHSGRGRWSQRSSVLCRRGVRGGRGRSVGAAPGCPRGHDRRRGEDGAGRAAGTQARIPEVRGPAAPAGAQRRTPHTCLKVCRRTPRLEPHNKVPSLHSLVPRIVLQQLLQGKILDSDPEARREWAEIERSFAPPTGLRMRVVDIKRTSKGTRSGGLYRFGAMVVVGNGEGVLGWGQGKAAELQSAVKKAYARACSNLFPIPRYNGHTIPEGIEAKFGQVKLVVYPKSAGSGIIASEMIGGICKMAGIHDIGVKVHGSRNRRNAGELVHSFVVVGWEEGTVA

SEQ ID NO: 15678 - protein, 131 aa, Chlorella protothecoides
MNCRPVPAARAVININVLTHLVLTVVAKHRAPARSWRGWGAWTLVSGVGVLASWALASGIPFFSLVIALVAAVGDVAAGYLIPALLALRLLPLGRAERWLCRALVPLSVALSAAGIFSAVREIVHDSAAAP

SEQ ID NO: 15679 - protein, 124 aa, Chlorella protothecoides
  MOD_RES (98)..(101): Any amino acid
  MOD_RES (121)..(124): Any amino acid
MHGTGTPLGDPIETGALAAVFGGATLTLCAGKSSMGHTEPAAGVVGLAHAQRALSQRVVQPVLHLTKVRCSWVGKGKRGSGSAWGLEHGMITGGKGNXXXXGSGSAWGLERGMITGGSGRXXXX

SEQ ID NO: 15680 - protein, 615 aa, Chlorella protothecoides
  MOD_RES (535)..(538): Any amino acid
MECAPAGRQPLALSASKSWVGHAEPAAGLAGVAQAALTLTHAALPGILHLQDVNQYVGTSMRPTPGVAPARWALPRATFGRPQEAADAASCLAGVSAFAFQGTNAHTLIRAPTSPSVDAETSKNVSVQPVWQRGRHWVAPSPHAGLHRAAINARAMVLECALGATPALAFLWDHRVSGRAVVPGAAFMELAGVGLVTAVPGDISRALQGLEVPNPLILPEGGDRGLTIRVSLALASGAVAVASSPAAFKHAHLTAQAGAVESRNGSASARPTLHSTAIQALAGGTTPAQQPATPGPLAGLDNTGAADLAFLAHPATLDCCLQSAAAATGQEAGLKVPAGADAVLVSGTKLADAMLWAFSRELSADSATSRLDYGLAGGSGTGMSLSGMTLKSLAGTGAKATAQAADAPTSIAELLYNVAWPAAVPVEVQGPTTTFAPRFQLPRGDERAATSALEVLQGGLAASASGVGFVGLRGASARSESKGLALSGLLRAAAMETRGRVALAASALDAQNATAARAACLELAPREPEQGSAFXXXXSARRLPGAGSARARAGIRLQQRRLRHGGEWQGAARRAAAPHRARRAVLRALWPLPCAARRAAEPAPPRGGRCCASPG

SEQ ID NO: 15681 - protein, 757 aa, Chlorella protothecoides
  MOD_RES (248)..(251): Any amino acid
  MOD_RES (437)..(440): Any amino acid
MCACIYSYIWPCAVPLVPWSGAHHSPHCRPLSPTLESSPSLPASLPLRTPRHQLQPGGGGLPVGRGGAVLPIPPGLLHRAGRPAPPAQRRSRPDQRAQCAAPDVARAPRGQDRGEDGDAAAAPRRRRARHRCHYRRLWHDWLPAGRLAGQAVHRGDPAPGTLRAWRLRRGRRGTCRSRQLRPRHHAALRRGQRGRGGRRRSQPGHRIPPAGEIFGWDAVAWEMGFALWLPQEPPNIWCGALRRGAGRXXXXNLPTSGVVHSGGVLADATLANQSVAGIRTSFAPKADAVQLWQGALGSSPATLHLAFSSVAALLGSPGQANYAAANATLDAAAQTWQAQGLAGFASVQWGAWAEGGMAAAHVGTAKAVERMGLAMIDPELGLGAVAGLLLAGAAARPTTAAVPFMTRRWRWMAVTAATPPSRDRLGSSPPDPALRRXXXXVAVDGGDGGGDAEQGPAGELSPGPGAPPPSFTRRRRTLSSHPGTVSSGPKPAKKTPAQGSAEPSAEARAAVQAAVQDSVAGVLGTSVGPEDALMAAGLDSLGSVELRNALERRAGVELPGTLVFDYPTVAALTGFIAGRVAAAQGGAVEDGEEPAAAALSDSDVDDGAFWSPRGAASLASRLPPPARVIGVSEIVLRSPADALATLVPVDAPSRVPLSRWEVDAAAGLAGGLPVQYGAWLDDVDLFDAQALAVSATEAAQLDPQQRVLMEASAQALLGHVDLLADEGLRADWGVFVPFYRTTWWNDGQPCSAGEHRA

SEQ ID NO: 15682 - protein, 1183 aa, Chlorella protothecoides
  MOD_RES (629)..(632): Any amino acid
  MOD_RES (712)..(735): Any amino acid
MLGRALRLGPGSVGLECRLAGLHMEYLWDHAVGGRPLFPGAGFFELASATACLLSGGGDAPPPLLVNAAVPAPLPLQSPGPGLAAAALLCRVTTQTGAVEVVSSGARRQTHLRCGVAAANDADAPRRRRTGQGLTRRPTNLQALARGPALDAVAGSMPLALAPGIAAHFAGISASAERARDVSLSPAALDATLHLAAVPGRGASGPVALKVPAAVEMLALPAWARAPEGLAAVAACRLSSPAGDMNDYGVLPGTATITGLNSRPLGALPPMPAAGAAVSATGDVPNRSQLVYGTAWQAARAETATHISADAALSLAIAPPGRGPARVGLDGIAAIATRLAAAGRAPFSLGLRTPTVLHGALAAPAPALGPALSSATQAPALLWGVLRSVGLEVAGASVSAVDEDALAYGSSEQTSLSLSGAGAADGASERAYGAAHRSGISLQATLLPGRRRAAPLPTPSAVQSRTVITGGTGSLGTLIAGWLGATDSATAALELVGRVGRVADARSADLAHLLRTCLAPVSLVMADASVAADSRTVFGPRDYPLAAVVHSGGVLADATLANQSVRSVRASFGAKTAVVEAWAGPVRCQPVTAAALFSSVASLLGSAGQTNYAGANAALDAAAALAQAXXXXGRRGRPTTPGRTRRWTQPPRWRRPGACPPPACSGAHGQAAAWRPRISPPPCARRSGAGRRALPVGQVHAAPGRRSAHVWXXXXXXXXXXXXXXXXXXXXXXXXAPAVKPAAVAAPVGRPAARRLPPRPPSGGRAEAPTTPAAPPAAVLQGILEKVLAAAAGVLGRAVDPAEPLMAAGLDSLSSVEFRNVLEGQLAMELPTTLVFDYPSAEAIAGFVAASLQPAAGSTVAATAPAGVTPSVDPTAFLPMILAAASQLLGTDIGADDPLSAAGLDSLSSVEFRNVLEREVGTELPSTLVFDYPSAAAISAFLATATAPAASAAAPGSQVRPRSAPAPVDPDAFLSLVSAAASQLLGTQIGADDPLSAAGLDSLSSVEFRNVLERDVGVELPSTLVFDYPSARAISGFLATVVVAPGGDHGADEGEAEYDSWGAADHPSTIPAQLTQALRGGGAGFGLGDAVVSLRATTDHRPFTQGRAGDGARDAVRVIGLDRWDVEAQTARGGPLPNRFASLLDVSWVSFFGWGAQVGGAGCKGVATGQAGGCIAKAWYLEG

SEQ ID NO: 15683 - protein, 140 aa, Chlorella protothecoides
MRQCAWGVAAGVNLALHPETHYSAQKAGMLTADGRCKSLDAGADGYVRAEACCAMLLALTGADELARADEDGPALALVQGSAVNQDGRSSSLTAPNGPAQQSVVASALAVAGLHASDVSGVSMHGTGASSCSWLDGGGGC

SEQ ID NO: 15684 - protein, 381 aa, Chlorella protothecoides
MTCATPRLRSSARLAGPPAVVTGVAPARRMTCSAARPTPPAAACTSTRVPRPMPASLSSAASTVMNTRAHAAGDAERGRGPGGARFQCRRAHHDLAHVPRLRHLAQRGLHRAQAVAHGRQGCQHASGHARGYAGQARVQRGLRHEVHGHQAVGGVGALLHDAPRAPDVALADLHEAPASIQGRQGPGHHAGGGEAVEHHVHPPQLGGLRDKVGVPRPKHVPHAQAAQEGALGRPTRGGQRRRARRADDLHRSQAHAAGGGVHQHDVCGADARQLHQRGVHGDEDGGHGGRGLEAQAGRHLHQGVRRDAHRRAQAAGGQAKDPRAGGQDRGTGRGHDAGKVAARRAGVAGRMEGGAVVEDQGPSCKVTTCSTFSREPGKRHW

SEQ ID NO: 15685 - protein, 818 aa, Chlorella protothecoides
MSEDALHAALSRVASQAAAGTLAPLPHISHGMGAVTAALRQMSQARHVGKIVVRLPQGVEAPRADAPVLVTGGLGTLGRLVAGWTQRRGVRAAVLVSRSGRGDLEPGLIAARCAVTVFKADTAAGEDATALGLLGAYGAVLHAAGVLADATLGNQSVRGLRAVFAPKTASVRGSERARAPTPLHVLFSSVASLLGAPGQTNYAAANAALDAAATARAATGLPSVSVQWGAWAGGGMASRETEARVQRMGMGMVEPGPGLAALEGLLAGAAPSIAVRSANPFNWPRFVARLGGAEAARHLPLFSDWAGAAAAEASTAATATKTSSAAARPAAGLAREAVAEAVLDTVAGVLGAPVGVTASLMEAGLDSLGAVELRNGLSKRFGLDLPATLTFDYPSVSAIAEFVVESMGGGEEEVAGQEALRAAPATPVPSQHGSVVGLTGVALRLGGGIDDLAAFRAALVADRELIATDPAPRWDADALFSAGGGVGRVSTRFASFVHDTFAFDPEAFGLSLTEAALMDPQQRILLETTVDAFASAGHATATLVGSPTGVYVGCIWLEYGDLATAAGNPAGAYMVTGNGLAFMTGRVSYALGLVGPSVPTNTACSSSLVALHLAAAGLTARDCTLATAAGVNSMLLPGAASAAMTQVHALSPDGRCKAFGAEADGYGRGEGYVSVVLELAGGAGGEDGDAPTFASTLSAVLGGSAVNQDGRSSGLTAPHGPSQQALVSAAMAAARLDVLDYVSTHGTGTPLGDPIESGGLRKAVTRRGATPAQLDGHSLTLGAVKVLAGHLEGAAGLAGLLLAQVAMDSSLAHGLRYR

SEQ ID NO: 15686 - protein, 737 aa, Chlorella protothecoides
MGVPRARGRKSRYRPRCACSSRPSLLQPTPPLLSPILPPSGTALGDPIEVGALSAVLLGAAQRGDPPLTLLASKSWIGHGEPAAGVVGIAHAHAALLASTQLPILHLRALNPYLEGAMSKTAGHWAVPRGDAPWGADASAASGRRSLGVSAFAFQGTNAHALIGAAPGRELRGWAGPARQPWERERVWVHPPVHSLLETFAGTAKRNPRAVFSTLLSAPASSFLLDHVVNGMALFPGAGFFEAGAAAVACLLGPGLASLLADATIPSPLRLAIPSEARRADTYPFAELTAVVSADRGTVSLQSGAGRRAPVHLAATVATAPATRSAKAGAVVSGATSGVKAKRPARGTALLLRLVPLVGIAPSTASVAQPTHGTSGYRMSPAALDCTLQLGAAASLEAGAALRIPAGVDAFEVAAAGPSLARLPAFAAACPQEDSPGALSTGEPTWTDYLLRSDAAAAPSASVSGLEARPTGGSGSSDARRVRALKKKRAAAADGVYAKPERWMYDLAWAKVQTVGGPAAGAGAPIPSLALVLKQALGPAALATTAIALAQEAATSGAASLALTTAGAALGEETARGLTPAARGAVTTAGIWGLARTLALEAPSLQTSALDVVGPGALARPRAALSSQAPTLAPGSAYGTSLSAGVWGALQLRRSPLAPAPGPFHLFPQPRGALQNLGPLPVEESVAPGQVLVAVKAVGINFRWAVCYEYLFGGRAERLVGCLQRLDCGHAEVDAAV

SEQ ID NO: 15687 - protein, 492 aa, Chlorella protothecoides
MRVAFAMDTAHPAHAFFWDHRVNGRAVFPGAGYLEMAAAMGRTLAAPSAAPAGLALTAAAISAPLILGAPGATLVLEGAVDLASGDATLSSTDGGTVHVRLSLSRVASVGANGAMDGGASATEGLLAGTPEPVDTVYTYERLAAAGLQYGRAFRLLRGVKRGERGVAAALAPEGHCSGAPEFLLGPAALDNGLQLGGMLANQAAVQGAVFLPAGLGALVVPAPGVKPVAARAARNPQHADSAAAMSRDVLLVGSQGALVCTLDGLVSRAIGDAGGAGSAPPSVEVQDMLYDISWLAARSVAASSEETPARNGALTVRASDRGAGLAISAALAAVQAAATGGGADALHLATAGTHPAAQSSGPRPGVDTLPGAAVWGLVRAAAQELPAIGVSGADADGFAAGCAGCRSALQIGGTTGAQAPFDGYGQAVRASVLHEPRLGASTTAHSTLPAFQLLPLPRGSFGSLKPVAVSGLDALKPGQVALEVKAVGLNFR

SEQ ID NO: 15688 - protein, 750 aa, Chlorella protothecoides
MHGTGTGLGDPIEVGALAALLDRADPGSTRHPLVLTAGKSLIGHTEPAAGVMGLAHASLSLTQQAALPLLHLTSVNDYVAPSMPVGRFAANRILGPGASAAPGQACTAGVSSFAFQGTNAHTLLGSLDGAAAAEDSVDTLALPWQRQRAWVAPRPSDLFGLVGVKAKRAAFVADLAQPRLAALRTLCLRAVPLLALGLASQAIADAAALLGAGRAGLRRLTTQPAALSAGASLHVTLDGGQASVHLVTKEAGAAHVASAGLVAASAEPKSVSRGSAGNPRTKTLWWPALDSQSSAGKAVAVLDATADSALPCGLALQGLAVDAAAALREAGDLPTSAGALWSTTSVGAGDAAAHAAAAPGELTIALGTGLLAAWELDALPLERLAVSASSAGPAHATSSADTADEESKKLVYTTSWQAAEVRRAATASRNAPNFRAPTSAAAALQALQGLAGSASMPGIAGTGAADVAVAAPARSRASRLPGVALQGMLKALAAEDAAGPVLSMLWTEPSASHAAAGWSLAAQAAADSASLVGVHGGAVSARVAWAPRLLRAPEGDAPDDARVMSLSGTVYVTGGSGVLGGTVAAWLLHQPAVTSVVLLSRSGAVPVELLRASRAAASANSTTGAPPATLSSCTCDASAAADVAALAGAAGAVSLMHAGGVLADGLLAGLNAGSLRRVAAPKGAAQAALQASLLGAARVQACVAFSSVASLLGSPGQANYAAANAVLDAAAADLADQVRGDVGHGGHADA

SEQ ID NO: 15689 - protein, 1173 aa, Chlorella protothecoides
MAAGDRATEGRLARSGLALLPAERGLAVLGALLRASSVAVAAAPPPVHAAVPVQWARFPARDAFFAGLAAAPTPARGPAAVVDLTGAQALVQEAVAGVLGASVDPADPLMAAGLDSLGAVELRSALEASAGMRLPATLVFDYPTVSALAEFLGQKMARDREGEVTAAPMAVSAAWTGPAVDAPLAQSIRAPPASPVLVLGGVQRSPRDVLAISAACPLDVVGVVPYERWDVDGENPVAARFLAALRHPMTFDAAAFGVPSAEAPLLDPQQRLLLEVVGEASVAVAGATGIPASLQGTYVGELDSYEGEARGGGGGASGIASSDYGSLVSAAVEKGAFHATANALSVACGRLSFTFGFRGPALSIDTACSASLVAAHLAARGLAAGESALAYAAGAHVQATGTSTAYVWSASMLGVSGRCMALDAAADGYVRGEAVLTLVLAAAAKLGANYASVSGADRPLAMLGSAVNQDGRSSSLTAPNGPAQQEVMRSALAFAGVDPAEVNALSMHGTGTPLGDPIEMGAATAVLIDAARRSPVAFGASKSWLGHAEPAAGLVGALFGAAAAGRALAPAIMHLRAINPYVSAALDETRPGCVALPRQNLPLAGTGGRSVAGVSAFAFQGTNAHALLAPVVSGAEDGATRADPKAPLPWRGGRQSVLPQAHALLQVVTSAVRGRVILETDLTAPRHAFLWDHQVLDRALFPGAGYFEAAGAAVRAVSRAPAGALVTGAAIPAPCVLPGLGQRGGDGVVLRVTVDGADGALVIASVSIAGTTSHVLASAEAAGTASNDGQRLATGPARASALLPVRAMLSLAEHLPASAAPAATAGLRSDTGRSGLWLDPAPLDCALQLGQVFGAAPADLYVPAGLGALAIDPGAAGLPRSHEASWAACLPLPAPVGEARSDYALLPGSKGAGGPLASVSALLAKRMAGGGAAQRTVERVACLLLWRDAHASAVEGVSAALAALQRAVAAPDARNRTRAVAAPDARNRTIVFEAPAGAGFGAVAPSAASTAPPSTGVLGLSGLIRTLGQEVPGVGWTARLTDPADRSAPAAAGLRLVDASALPALHPLTSALGSAVRGGSAMAPLLLHAERVREELPPHHLMPMPRGSLGSLAPVPFDPERKLAGQDIVVAVKAVGLNFRQGVVVVFPEGDRSEGMVTSEERVVWVSQLATDC

SEQ ID NO: 15690 - protein, 145 aa, Chlorella protothecoides
MPTVFVTTDAALDQAARIAPGERVLVHAAAGGVGLAALQVIARAGAFPVATAGGPVKRALLRSLGVRDVLGSRDALFAQEAPELDPMGLSVVLNTLTSPGMVAASLAVLRLGGRFVEISKRDIWSAGRVAQGGRGLGVLCVGVRW

SEQ ID NO: 15691 - protein, 173 aa, Chlorella protothecoides
MAAGLDSLSSVEFRNSLEAKVGADLPTTLVFDYPTIAGISAFLAERVGGATAGESADAGGAVLGEPTDADDMFGTGEATVSSLAGPLVAVPAGSTVVAQRPSIWVGESVTQPPRSAFAGLQPVDAVALLPLSRWDIDTGEGGLGLCEFLGIGDWGTCKSSSCQGERVLYCCLS

SEQ ID NO: 15692 - protein, 247 aa, Chlorella protothecoides
MVRLMKPTSRGEGAADDALLRRAVGRGQAGGAAVLVHRRAEHGDGRVAPRRLAALQQQAAQPLRAHVPVGRRVQGLAASVGRQHARLGEGSRGLRGQHDIDPGVDRCSTLGQGQRGQCGVQGDEGGGAGGVHRHRRTTQAKGVGQAAGGHRQRAAGGGVGRDPRRVTRHQARIVGGGKADEGADARTVQGTAGAGQQLARALQEQALLGVHQHRLAAGHREGGRVKLVDAVQGGPEAHGDAAKQVCG

SEQ ID NO: 15693 - protein, 466 aa, Chlorella protothecoides
MTLAVLCPGRLALPASQTPSTEFCSLQDLFSRQEGGQSVDLGQRNELTAGTCGRWVGTVPVPHPGSGWACPFPEWVRGSKYGSSSHATDRAAGEVWPARAAAHFDSTPLALLVQQGADDSGADGAAALADREAQALLHGDGVHQLKGAGDVVPGHDHLSALRQRHSARDVGGAQVELGLVVGEEGRVPPALLLGQRVELAGEAGVGLDGAGAGQDLPALHVVALGAAQEQAHIVTRLPLVQLLLEHLHPRHRGPHRVADAHHLHLVPDLHHALLDAPRHHRAAALWGIGGVCVLGGRGGGVNESRGVKLESMEGVLKCAVNGRGWAPACRHPPPPSASGWRPWGGGAGRGQGGERGGAAQRGAGACDAWRMRQGVWGRSDTHQRFSGPGRVAPALNRKATDYCNVSSPRALSQQAGACAQGQHAMHSLPGHPYHSSPADGVVLALKGCQGRPTHDRDLVARKPGWL

SEQ ID NO: 15694 - protein, 238 aa, Chlorella protothecoides
MAGAVDVGVVPLVGLVLHVRGGDGDAARFLLGRLVDLVEGHGFGVAGLGQDLGEEGWVLSALGNPRARYHAGIDQSMLCHRGHVHPVSAHLGDGSREGGLAVIDVTDGANVEVWLGTTVNIVLRAVWSAAQRQVQGSGAVRGQGETGDGPGGACVSVSIEAYIKGCKEPDFPALSYKTHIRATSACVAGPACTRVAHRARAPAAARRNILARQLSVSVQAEESCRGVEARVEHPQDEA

SEQ ID NO: 15695 - protein, 164 aa, Chlorella protothecoides
MHVSSARFREHRLVDPGVVPSAGISQGRKHPPFLSQVLAEAGNSKAVAFDEIDKAPEEKARGITIATAHVEYQTDKRHYAHVDCPGHADYVKNMITGAAQMDGAILVVSATDGPMPQTREHILLARQVGVPSIVCFLNKIDMVEDEELVELVEMELRELLSFYK

SEQ ID NO: 15696 - protein, 438 aa, Chlorella protothecoides
  MOD_RES (233)..(236): Any amino acid
MISMGTSKIGRCPDLCNLGGKRHNSRTSLTSRLRLQVRAPCRALSLFVTAKNHRTQETCTRWCVAWAGTATGAPHWRRSQHHASVATLAEPGQCRDVLACDIDLLNPPKELEKRKHKLHRLVASPNSYFMDVKCQGCFNITTVFSHSQTVVVCTNCNTVLCVPTGGKARLTEGEEEIRVACGWGSDPGHSAECACLCLHTYLGPACISRAALGLHPTPLSPPLQAALSGGRLXXXXSCGAWPTSLTPVPPLQAALSGGRLTADRLCPSRLPGGHGWVCTDVCNAAALLAPVGLQAGKRSIMRVVGPGGGWELPCEASWVGTGATVACAPAPPWVPCQVASQRGGRGCRSAPGGTVGGRWDPRALHLPGPLAQNRACQRGLRPWHRARRARRARRCGPGTPRAVAPGGKGALQGGGCRSAAGQPARGLPQPMSQRQPLQ

SEQ ID NO: 15697 - protein, 636 aa, Chlorella protothecoides
  MOD_RES (429)..(432): Any amino acid
  MOD_RES (509)..(512): Any amino acid
  MOD_RES (534)..(536): Any amino acid
MAALTPSRAGLRHGAALQGHSFSRGYRCSGRSAATSPPPLVLLTRLWAAQPPPASVHCGLHARRCPGRAPGPAGEPCRCTRLQLCATPSMQGAMGCPGSCKHLFDGQLCYSCYCSSDRSAREVSYAIDLGNAMWVPGRGGGAGARAGEGEVHKPSKLAAVPNQGRPASGVQRWVLLRIQNGCPTNPTPPPLKPHASSSFPPITKLTARRRGRTWCPRSPPQTTACCSSFPPGSAECCAVMMPSGCRGQVDGVCTLSGIDVGPLQAPPLNLVATNRACRRATPSPAGRWRGRGWGATAWRDPGTWMQRQRPPSAGICWVGAVRRAVVERGRRACCGLLSSWSSPLAAGNAVTVPVARWLGERLAQPYAFKYQTAGVSNRRMDALVREGMADAGPEAGRPGYGKDFGHWRVIVVLNIPIFKHDLEIADSEXXXXSGREWQMPSRRLADLGMGQISAIGESLWYSVPPSLNTIWRLLTVKPATLVIARHIIPFSLLNTAQALPQPVELCVPXXXXGRRDRGRGRGHGGPPPRPDHGXXXDELQEAVLFPYLLSRPKPAVAGEVEAEGVEAPLPDLTTGDWLDPATNAAREATAEVILAQTDEAGRDRELEKDMFQAALVHRVRQRVACPGSWWLALLPA

SEQ ID NO: 15698 - protein, 444 aa, Chlorella protothecoides
  MOD_RES (318)..(321): Any amino acid
  MOD_RES (423)..(426): Any amino acid
MKAAALSGHAGAQLAVCREDALGARVRVWWDGDATFYSGVVAHYDAVSTEHTVCYDDGEVGMHKLWQHDERINVESGVEEWPREAEAARQKLRTAHDLLRDKKRVHHSSLPCCTILELVVEDEISGPRSSALHRGSPPSAAQLPALGLSDYEQKRAELVRRNRLMFEQTLANGGEAGLEGPGSGESGVAAPGETAVEGPASLAGGASGPSQDWSGGGQRPEAVVSVSLPAGAPVQSAPKRKHSASGKKGGSKKKKAHGGAATCPANGAKAGNALDAEQGPATPTPTQPRRSLAWRIRRTAGPRLATSRSSHTAPIAPXXXXAQHDGSGPQPNTSGSSHTAPIAPTPAVVRGVCSGGCHAAHALPLHVPRARGGAQRRGPAAGLEVPQVPRSAARAGTRACAAGARRGGPCGGLSDAVDCTSLXXXXYAAYALPLHVPRPRGGAQ

SEQ ID NO: 15699 - protein, 154 aa, Chlorella protothecoides
MQRPCLLACYRYRPSSRTQELPEEVRTALRNARVLDAAGNNLQSIPDWVLEASSLKRLLLQSNALRHLPSGMSQLRSLRVLNLASNALTHLPDLQGLVLLQVLTLSQNHLEEVDPSIGCLTALTQLDVSGELAGHAEMRRVENGAAFSTYLFCQ

SEQ ID NO: 15700 - protein, 106 aa, Chlorella protothecoides
MALTEVLASDNRLVEVPIELGRLQKLQTLNLERNSLAIIPPAVLVGCICLQTLLLQGNPLTSEQLAATEGYADYEQRRQRKYDKVLATNVLTSGFTEAIDRDVAVT

SEQ ID NO: 15701 - protein, 202 aa, Chlorella protothecoides
PCAVPAPCRHAGGDPAQRAQHACHYGPCPPCPLPCGTRLPCGHLCASEACHDAAPTAVAEYAAPRPPPAGGAAAASGSADRSVDRSGPVSAAAEATERAVRDGQAMTPCPPCMHPVAAPCLGGHEVRQLPCSASGPYACGAPCDKPLACGRHACALACHAGPCTPCTRRCGVARGACAHACPLACHPDACPVCVELVQQVRL

SEQ ID NO: 15702 - protein, 166 aa, Chlorella protothecoides
MGRAARPTLKQQHDCDAGDDTGAHTSSTPPPWQGMSDLGVGPFCQRFVDPMDEESDHVHIVALTNALQAGAAAGSLVGGAPWPVALLLIGNPPLAMPPSLQVPLRVVYLDRSASPGGHGGPGARDEAHVDMHDFVPEGLAGAAPVDPSVHLLYRPGHYDILYPRAG

SEQ ID NO: 15703 - protein, 167 aa, Chlorella protothecoides
MMLGAPIEASEVAAGTAPGGPLFPDRPSDADIIAWENTIREAGPGKQALVGQPEPLSSLAAEYAAGSPVFLSKIQTLEGAYGLIRRTRGDGNCFFRSFVFAFIERMLLMGDDAEKDRVLARLAEVKKQLTEAGYEEMGGSGHGGYGAPCRLLTLAQAVTICTGQQWL

SEQ ID NO: 15704 - protein, 958 aa, Chlorella protothecoides
  MOD_RES (616)..(619): Any amino acid
  MOD_RES (889)..(924): Any amino acid
VLTRAGLAQEADAAAREVAAVVRACDAAPGPMAEAALRAAGTLATQRPHFMPRLVPALLSVAARQATMVGETATTSGDGGTAATTESGTPAARDDGMSVALPPAARKALTAALAQVRRCTHPLAAAWARKVDRALADLAGGGGTQDGAGEACVVAGGRDGAAASKPSQAVPGRSAEDPRPPPAKRPCTEDRATGAAGPALPIESPQEDGAELATRVDELVARGDSAGLAALYASLDAESAAELVLARLHPPGGAPASLAADGAPLPAWQEDLLRRMAAPGDASAVVPPPVTDASRQPGRSAAPSPSPLVAGATAATPTPPLPAGTAGLAARFTTDPLPLSAGEAARLRALTMRRLAAAAGGFGHWLAPRLAATQADLAGPFLEELGTDFHARGGVEAVLDFLHAAFAAEGRQDLGGEDEAVTERQQGDGYRAVLSKALDLHAWQWGVHFVGGTQPCSLRLSGHSISSKHSPHANLYSVLLSAPALPAELLRDTLEGLMQTDLDHATLGLLAARDLILARPPAREVALAAVLAAAHSEDAGVRDRAVRLLTNRLWGCLGGRLQPKILREAERSLRQLVVREDGAAVKQEADGAAAARVKAEATDGAATASGDVGPDXXXXSGGHRWRGDDVRGRGGRGKGGHRGYCGEAGARRGRGAVSRGHGVRRRPRRGLRPVLRPLHPAAGPAATPVRGLWQRIWVVRTPHATCACACRCAGATPHDQASPPHPGSFWPRGHPEVRGRPGHDAGARLPGPAGRPGGPAGGAQGYQRAEPVPVLGHAWLGPMAVGMQPVMPRAPGPGTLMPEVATPLPHPHPCSLHPLHLNKNCMDLALGMLRALASALPALPEGLVRAAADLAQASCDARPLVPLLRGLGREGLLARLPLLLGLPGXXXXXXXXXXXXXXXXXXXXXXXXXXXXXXXXXXXXRCAARRPTAWSRPPSCWSRCTGWTPSPCPAECAP

SEQ ID NO: 15705 - protein, 202 aa, Chlorella protothecoides
MFQPSPAAADAHLRGVLSAAAAAGVMSPVPDLDTLIHAGEGLGRVVQQFRHRAALHWGQWQGRRPDLKSRRSSEGATRRQPIDRSQATPKPCNAAGSVSEAAPWFEVYRTEFFRMMAFGEHETMDHPVACELGRVACRTQGWRGKEWHRCPTQQHHRLACCTGIAVAWDGVVCSAGPPVCALKLLSKPKHAANPCCTPLALI

SEQ ID NO: 15706 - protein, 256 aa, Chlorella protothecoides
MPELPQEKRARFEGLGLSPYDAHVLCDDLAVAGYFDATLEAGASPKPAANWIMGDIMAHCKVGTGIKGWCMGEMVLHQRLLSSLSQSVKQEEQLQCTGTYTYPYGSAPGCKTVALLPTHSCPPRRLHTQEAHLGMDDLLLTPTTLAKLLGLIEKGTISGKIAKDLLPDLLQGKGSGDLLAYVEAKGLIQISDEGALLDIINNVLESNSKQLEQYKQGKTKLQGFFVGQVMKESRGRANPGELQRLLMQRLAEEAGQ

SEQ ID NO: 15707 - protein, 404 aa, Chlorella protothecoides
MACRVSSWLRPHHLHPPRLAVLGRFLPERVQHEAHAHARVTRRFHTCRTASSAAQLATEQQATPNSQPEVRHEPGGGVSRWMREECMPSWSTCFSAPLFNFGRPVIPCWQTDYEAVVGIECHVQLNTRTKAFCACPNQYGGEPNSHICPVCLGHPGTLPVLNAAVVDKAVLTGLALGCSIARHSIFSRKQYFYPDLPKGYQISQHDTPLAYNGSLEIDAGDGTRRRIGITRVHVEEDAGKLVYVGAQALTGAASAQADYNRAGVPLLEVVSEPDMRSGQEAAAYGAELRRLLRYIGVSNGNMAVRNIKGGRKGRGGGGCPKMRRVREWKGGMLWHGRWDGGALKFRPAQSAAHRPSTTQPRPTGGIATLRCQCVGAAPGHDCTGDQGGGEKPQLLQLRPARHTV

SEQ ID NO: 15708 - protein, 105 aa, Chlorella protothecoides
MGCQDQWKASVVHLVGHLVSPAGTQKASPLFHPPTALQVTALSSGAEHEVVVETRVWDEAAARTRTMRKKEGQADYRFFPEPDLPPLEISEETIARIQVRRCLWG

SEQ ID NO: 15709 - protein, 368 aa, Chlorella protothecoides
  MOD_RES (79)..(82): Any amino acid
  MOD_RES (227)..(240): Any amino acid
GLRPGLAPEVLQHVGQHTAGLTQRELRAVAAGAAVDALADRLPVQAVLDGRTTTSAKGVGVASTTAEQPQLAGAEARGXXXXKGVNVASTTAEESQLAGAEARGDNQSLDITREALQRAVERVRTMAASDVGAPKIPSVKWEDVGGLEDVKRAILDTGGAAGEWFKGGRWEEDGETRKVHCITMPFNAVFEHCMPLSFGDSWPSAQRQVTDVCLPSKCQWSCRSSTXXXXXXXXXXXXXXSGGLRRRSGVLLYGPPGRYQFALQAVYAVCDALDGVMKALPELVIECTAFEKPDGIMKAFPKLVIGCTALEKPVALTRHRHRIPLLQVRARLCWPRLWQQSAPSIFSLSRAQSWSTCMSERASVKSDR

SEQ ID NO: 15710 - protein, 329 aa, Chlorella protothecoides
  MOD_RES (163)..(165): Any amino acid
MSVTRGAGIVLFASLTLMGLSMSRAESNGTLFVVGQGQVSAEPNMATVSLSVSSTKDTASDARERAAELTKATLTSISGISGINRTSDIKTTDINVNPQMVSFRMSSDIQGTILPVLFKVSHVSAMSFMLHLHFSIVPRCTTPRQERAPSPAGPQPQGRTELXXXSQNLQVEALVTVRDLSSDLLSSVIDSAVRAGGNALQITSVTLSLSPTARKAALDAARRAAVSDARDTARLLASAAEVTLGRPQRIEDSNSTPAMPIAYAAAGLWFMQSIIFLMHHRHNGKERQRYRDSSGARNAADVLESSATVCIATFSRLVSDLSSVGQVTG

SEQ ID NO: 15711 - protein, 272 aa, Chlorella protothecoides
MVLEGESSLLLFLFLSGWSWAALSRLAQWVRSFPFRNCYANEDLRRAPPLKSPSVARGILQPRILRQASAAPLLPAPRGLLPQLRPQSPAGGTRAPRTAHPQPAAGRASPALPPAPEPKSIAWHIVCGETTCQSTHRASWSNTLCRHTPPPSSNQQGNASHLLQDHDLVALGGRGEPVGHKEGGPAPRQRKEAAQDLLLRGGVQGGRGLVAQQDGGVLEESAGEGDALLLSAAQLQAPLPDLGVVAVREGEDAVVYGGLRGSTGCGCSKLVS

SEQ ID NO: 15712 - protein, 727 aa, Chlorella protothecoides
  MOD_RES (75)..(77): Any amino acid
  MOD_RES (201)..(204): Any amino acid
  MOD_RES (464)..(467): Any amino acid
MPSDPSYESLKASDANMFHAVPITGCAVDHPQCGGPHLCSPAQPGPGVPSFQTDGGCVACDRPRLPRHQFRAQPXXXCSGSFCDLSCTKPHVSWPLHDGASCSPTARTYPSLQLHGLQSSANGTGGGPGGRGPGLQVRPGLCCAHRGDDSLVHRLHLCDHTGTGQGCGVWGTGMKHSCQEGLVSILHASPYSPHAHLHLSXXXXMMQAACCWDNSQLLDQCNEKGLVSILHASTYPPHAHLHLSYCCSLQWRTQFRRQMNRAESQASSRAVDSLINYETVKYFDAEEHEKRRDLTAVHHLLSCQVPLQHALIPRLQTTIHLTQALAAHLRRYDECMASYQLAAVETQQSLSFLNFGQSAIFSTSLAVAMLLSAQGVAAGTLTVGDMVMVNGLLLQVWTCGCEVLKHVGLRRFMRGSNDMGTAWCSVRVAHVQAVFGFNHTPTALAGRPPPMLAQCFATTATFPXXXXLAGRPPPMLEKCFSTTATFPSPPSAQLSMPLNFLGSVYRETKQSFIDMGAMFALLQEQTAIKDRAGEAGGGHRRWRVESSGRMSCPLTISSALPPAGAIDLPEEPSGYDLTFENVSFGYRPDQPILQARDRAMLYCAVGIAMTFLQQVAASWDQRRTGGHFGFRQVHAAPPALPLLRCAGRDGAGGRPRHQGPAPGEPEEAPGRRSPGPGALQRHRAVQHRVRQAGCQREPGGAGGAEGEALWSFGAGKHTDLPWVSLEI

SEQ ID NO: 15713 - protein, 252 aa, Chlorella protothecoides
  MOD_RES (59)..(62): Any amino acid
  MOD_RES (91)..(93): Any amino acid
MLDRMDYQQPRGRWQPFPRMAHAGQNGLPAAARAMATLPEDGKPQARPQGTQPHLTIEXXXXESVLWQPANLGQCAQGPCHPDYILTLAGXXXEKGERMSEMHIVKEIANEFGAMCPGPLPHRVYSHSRRYLNTETSPEFRRRAGIAVALLVGGKLLNIQVPFFFKYTGEPGLEGAAPRFRIVDALNADPSGLTPASVAGLMVLGPTSLVLGYGLARIGASFCSEARNAVFASVSITALERQGVALWQQLQD

SEQ ID NO: 15714 - protein, 574 aa, Chlorella protothecoides
  MOD_RES (125)..(128): Any amino acid
  MOD_RES (165)..(167): Any amino acid
  MOD_RES (227)..(242): Any amino acid
  MOD_RES (327)..(330): Any amino acid
MQVTMRFQSGVVPHRAPPRPASLRCGTGFKTASTPCRRARAPRLPVQAALHKRSSESELESAHGKALQLVADVPFREPFVRSFLLGIGSGLLLEGAHVLMQMLGSQDLGAFSYSPALVADHILAXXXXWVGNGSRRDHHVASQDYCIPHALDTSPGSGEMTLQGXXXVSRWGWKEGVQHEQMESGWPRMYLLLVLLAASGVVDRASLVILQHQLVWAVFPGGSCRPXXXXXXXXXXXXXXXXCSALSGVSCAEPWPAPHTHTQSNSCVIPSPCLQAKDLANLSTLPKRLIPRLPFFSRESRFTKPLLASASEATSTKATVTVDAEAXXXXPLLASASEATGTKATATVDAEAMVEPATKLATSTLVEPMPRGGTVVRPQGENSVVRAPPRKSVSENIAYHRNVWLAVPLLTPPPATHRLAAGHLCPPAPRALLSRGNGGGRGQTCARAAGPKRLLEEHVVRGGPLRQRRQQRAGEGAAVRARDGALPRRHIGGCAGTGQRVPPPRRPALLGLAVREGVGDVRGVPLPWLGPGWGWGAQGCASEWRRVLRGGAGVLRGASGFEGRGWRGGQEALG

SEQ ID NO: 15715 - protein, 391 aa, Chlorella protothecoides
MRLAVPYQRFAGAGVPMPNLPCKILRGSSMAPPCPRPPLLVDSLNLHTDGSQCIKQAPREHLNSTISLLHWIVSSKLRKASDAGLVCADAGRGVLAKHPAGGWCDGPGNWNLAASAQQLFCRPVQPPRPRHAGLGCDGQPSEKHRGCATAAGRAHEAVPAAEPADLRRGSGGAGLRALSCGDLLLKDQRTPLQAWRSWISGTTNSHRSWSPRGGLLRFELECAMMPHHPHIAASLKRILPDVPCSPSSSLAVQVPNFRGFFSLTTLDMSYNQFVSLEALSSLPGPRLTHLYCAANKIASMEGIAHLECGCLAQGVAVLILPRKGPCEACTPPRCMPPSFTSDITGSACQDPPTCDRDVPAGQLVAGPESDHSDQWAEQVRGQGPAGGVPTG

SEQ ID NO: 15716 - protein, 159 aa, Chlorella protothecoides
MASSTTTTSARTSPHPCLPKLPRGLHGARHRFTRHSAPLLDHCTRKRNLTRAMRATMTPSVAEASATQDPMHVIIAGAGIGGLVLAVGLLKAGFRVTVLERDLTAIRGEGKYRGPIQLQSNALAALEALDEHVGQRILDEGCITGDRINGLCDGITGDW

SEQ ID NO: 15717 - protein, 105 aa, Chlorella protothecoides
MLGTPSMSRSPILPLQPPSTPLFTAPQVLGTVKNSVVVLLGVALLGERVTLLQGVGYGGSVASFCWYQQIKMQQVHGRDPPPPEVNRTRSSQGPLASETKATLEP

SEQ ID NO: 15718 - protein, 433 aa, Chlorella protothecoides
  MOD_RES (126)..(128): Any amino acid
  MOD_RES (175)..(197): Any amino acid
MTVETSTAPWPSPPPAFSFTKASSHGEGDGSHIFGGTSPQARMVVAVAASLLWMTISSWLILVNKALLSGGFPYPMALSSLGMLFSGVCSYLACRVRWVAVRRGGPIVVVFSSASGSNAAHANPTXXXRPRWGGSDHGCRLLCVRIQYSACQPQSPWRGVPYGLVAKMVRAPTAXXXXXXXXXXXXXXXXXXXXXXXSPLCLAPGVQGGGCPAHRHSALLPHRRDAGGGADGPEPAVRKPGLPLPHRGFHPDPQGLHPCHHHARHVLGGTGNPHPPPGGRRGGDRGGHRRRGCGGGAAGRPGRGHHDAERGVRGGAPGPDAAPAPGHAVPPHRGAHVPGPLLLPLAGPGVPPPGGPAHGTRRRAGRRPSPARHLCAGGRAGLWREQPGLHRHPGLLLPDAQGDGLWVWVLVEGRRSCRGISRRPRSMRREPRC

SEQ ID NO: 15719 - protein, 554 aa, Chlorella protothecoides
  MOD_RES (83)..(86): Any amino acid
  MOD_RES (483)..(485): Any amino acid
MTRLRKLSCEETLAGMVSQRSQSVWSYWCRGDQGQRSRVLPGMMVESNCPIRRTCGCSLSHRCPLGHGGGCLTQTHQSFSFQXXXXLAMHNLTGPTALYGGLAGALCRTYVRLAMVEVALTHTHQSFSFQGYLDRGKTVIVYCDTRESPEACAHEIARIGRNASRTWQPRQGVEAIYSCQAAGAGQEILAGARRSGSARLCVLPCRTARIGVGLSGGRVTECVLALGSQPHLRPTSGLPAQERGLVEAAVTHGLISVLITTAASIHSISWAADVSIFRLASVGKGSSQERSSCAKAHRLLHSVRGAQGRECILTSASSVADSDLMGLLAADNAEVSSCLASEGNMRQALLVSIGRQFTCTALDVKTYVGCTLMSVLHGPVSAIVHPGYGALMSYIMWLLLVPYQQAAAAAAQAALCWLVKDAKLASWSEKTARYTLTRLGSTALEANLHPCQAGLLQVGWQSLSASSLCTSEQSTAWSAWVAXXXGRPPAGGLAVTECLFALHLSTVCCLECMGGDLCIKPVFERMGLMLPDTFQCRENSVLHAKASSSPPSCT

SEQ ID NO: 15720 - protein, 182 aa, Chlorella protothecoides
MDDHVGGVDEPHSPAQCPDLEVSTLSLSQGGSGEGDIFLIGATNRPDLLDAALLRPGRLDKLLYVGIAPEPSSKQKVLEALSRKFTMDADVDLAAVAEACPPQFTGADMYALCSDAWMTAFKQHISKLGGLPAGGNGNASAIMVRQADFLQAATTLQPSLGEDEIAKYEVLRDQYEGGAARH

SEQ ID NO: 15721 - protein, 165 aa, Chlorella protothecoides
MHRIADCFLVQLQRELSIHSLPRSFPHAQEILAERCCELGGPDAISNNANVVDFIDERDAAGHVTAILSDGRRVKGDLLVGADGIWSKLLTHKPLYPAVGYRVFLGNGKYFVSSDVGGGKMQWYAFHKEPAGGSDPPGQRQERLMRIFGSWSDNGETCKEAVGWE

SEQ ID NO: 15722 - protein, 259 aa, Chlorella protothecoides
MLTEQYPNGDLVYDHLAFRTLGVPGLGIDSLAPTFLELGWRARDELRFPAKKLRARWFAPPCPSLPRIFISELLVGEVDAAAREAIAAALGATPRTLLARHSLLAAAGGGTPWPAPSRAQYAAVAAKSEYGAWVLANGAALNHTTLSVHAMRDVAGLDDLIGRLQGAGFALNAEGGAAKVSPDGLLRQASTRADARLFSFSCGASALVPTSYIEFAERLVLPEFQGLAEDQVQEHHRREGFEVGNADKIFESTYSSKAA

SEQ ID NO: 15723 - protein, 284 aa, Chlorella protothecoides
MAIEDSFQMVQELRSSGSRSVAHILRQYQLRRMLRSSVVHGMAGMAAFMASTYKAYLGEGLGPLSRMTAWRIPHPGRVMGQVVMKASMPAVLGWVLGGNEASLASAERVPRCMLRDRPSGFEPGQFDTLLRDDAALLRAAKAHWVLAPMAGTGAGAGKGVSCAGNGAGSGAGSGAAGQPWTRLGADGLVMGSGRDAGIRDPAAALRHAWVQSHEGDYLVTDLGSGQGRRLVPNVPVRLQPGDLIRLGAAKDSPAFRVKLQHVSMADDVDRSAYGQETDRPLVGV

SEQ ID NO: 15724 - protein, 336 aa, Chlorella protothecoides
AQGVLAALAPHLAAIAASPAAELPGPKAAPGRGPGGAALTAVDDRLYAFEAAGLLLGQEEMEAGEQAAWLAAVLQPLTRQMPVWGGVGPSWTPPCQRGFAGRGPTPTFASQPVPAKIWNFHQDARDAARVCQLQVNGSSPFGARHNVSGPIAQLIEEALGEGQGPSNGSAALVPPALMVQQALEGITRVAKGFSLRLCTELRPALGAEFTSERQQGGGKGSRRGCAGLLCLCALTRIPWQGPFTRLGNAVPSPTDPIHPGPSQPSSHPALPLAQGLCAAPSRCRAGCPATARCARACFPFSTAWWRRWGPPPCPSCPRCCRRWCARELTPASWPTP

SEQ ID NO: 15725 - protein, 368 aa, Chlorella protothecoides
  MOD_RES (35)..(38): Any amino acid
  MOD_RES (206)..(209): Any amino acid
MTPLLPPGSAPARPPTSETATGGEPVSWGAARAWXXXXTSAASDVGDGDQGGAGELGVRQGPGLVLTWLHQGQMKQASSGVGLLEYTKHCHHRNMALPRMQEQQQQEGICATTTSPPQPLHPIATPAAPKSSPPFKRVLMFVDNAGADIVLGMIPLAREFLRLGAEVGSIPGGARGAPCIRDTSNVCHAPGPTFSRARRPRFSFTXXXXARGAPCIRDTCNVIMVANALPAINDITAAELRGVVARAAETCPIIRAARDAAVSTLAAAGGHIPPVAGALPESSMAQELPVARGQSGHATVARPVVRTNPSPRRLLPHATDFEDQPETPTTAARKGMFGESYPSLWKDPRWVMAVSMCSSLTARWGRVW

SEQ ID NO: 15726 - protein, 664 aa, Chlorella protothecoides
  MOD_RES (606)..(609): Any amino acid
MDFMEAKRLHRSNGGNEPMRVKATGGGAFKYAEVECSFRGCIEDGANLDPGTPSQIPPSYSSPTEIQGATGFDPGARRRDELPGGGLQLSTESRGPAIDQSAAYEYAPSAPRPFRALHSTPQCGTRRSFFDTELTQRAADLYPYLLVNIGSGVSMVKVDGEGKYTRVSEGRIFQHQRMPAHAASQVRISLQLPTFAGPPLLVPDPCPGTNVGGGTFWGLCRLLTGVNNFDDILTLSSQGDNSNVRTVIDAAEPAIAQGAGGLLPAIQGVDMLVGDIYGGRDYTGIGLSANTIASSFGKVINTSMVSGGSCILLLRAAGPPLLVYSAELARAGSLTSEPSDYNPADIAMSLCRMISYNIGQLAYLNAKRFTSTLSSLEYHSIRSLHVTSNCPSRFPSLSPSPPPRPTQVQPAAHLFWRLLHPGPPLHDGHNLLCHPVLVQGRDERQVPASRGLPGGRGRLPEGAHPGWPWNLHSWDALAMPHCHVHTQAHPTSSLVAVCGSVIPPFNLQNPHSCARPCRPRPASLRDSRWVRPSRAARFEVRPSAAYLTRSHGWRSSLRPHSPSRKPPKQSMSSEAAGEGEWGSEGFLPASRAQNGEHFAAEGWRGXXXXGGGARDFCRRVGHKMGNSLRPRGGGGWRLFALTSWLTVRMHLHCKQPGVLPPTIN

SEQ ID NO: 15727 - protein, 220 aa, Chlorella protothecoides
MYGSGGAYGTTGGMYGASPYGGAGMGSYGGSYGSGGMYGSSYGAGSMYGRPAGAGMYGAGGGMYGAGGGMYGGGMYGQGGGMYGQPGLLGGGPVDPNNPHAPPQPPSGWQAMLAGLGGLMHFFGRLSFLVDENAHAVHFFVSALLQLLDRAGSLYGELARFILRILGVRRAKKAGQALVAAAGPGQPPLPLGAPTAPKPLPAAASAAGGAPWDSVWKKQD

SEQ ID NO: 15728 - protein, 80 aa, Chlorella protothecoides
MDKERENAAALEALPDLLDEVDKLDGPERLLALIQGSLAANIFDWGAKACVDLYQNATILEMYRQVRGLGPSESKACIEL

SEQ ID NO: 15729 - protein, 185 aa, Chlorella protothecoides
MLRHLPRLTQGVEQAVRSDSLSRGALGWLQPSSPTLSSAWLFQGAMAPRIGQLARSGSRPGAPLRGPGWLPPDHVNRLLRCAFGVLQWLGPWALRPFLQDTLLFLPLSATMAGMALRDPGTILRVVRQLGPWEVVSWARHYLALGLATLLDALLWPLRGQLQSSYRWRRVLDAVHWGSGADYHDH

SEQ ID NO: 15730 - protein, 498 aa, Chlorella protothecoides
MSPMTCRHGLSQRPPSHAFPLCGTSPVPHLASNPRPYIMRIKCHHHRPPAALRGQDEGAAGSVRSPPTPRPARSSRHSPALQRVLSEPGLEVPGGGDPSKYLATQEAFWKAMRRRGPKPRAPTVVRTTQMQYRAPVDYDVAVAGGTLGIFLATALQVHVLTIVHSPPRPTSLLDPQLRGLRVAVVERGRVQGRTQEWNISRAEVATLVGTGVLTREELEEAIASEFNPTRVALHGAAPIEVRDVLNVGVCPATAVDRARRRFEAAGGVVLEGATVRGAVVHPNAVVLETAATRSGTVAASSGGGDPGSDHGRGAPSGAQTASDGRPADAVETSVRRPPAPAAGAPGSSPPRPVAASLLIDTMGHWSPIVAQLRRGARPDRVVMVVGGCVDGVPAAANVSGDLLATLGDAADDMQLFWEAFPARDGGRTLYAFAYLDAHPDRPSFEAMLDRYLDGIPAYQGVALEELRFKRLLLAAFPCYPDASPLKPGFDRILQVGGE

SEQ ID NO: 15731 - protein, 698 aa, Chlorella protothecoides
  MOD_RES (63)..(66): Any amino acid
  MOD_RES (110)..(113): Any amino acid
  MOD_RES (486)..(489): Any amino acid
MAAMQVMPGVKELAKHLDERAVPRWAGWGGGRPRSAAGREEVTDPLRAGRRNSAAAHGGVQGXXXXGVRKSDELIGVYTVSLSARSRGGHGGHAGHARGRGAGQAPGRAXXXXTLGGWAGKGDRPIAGWTAEPGSCSWRCAGHTYRLARTRPLVMKRPLLPPTHRALVTRNLKRAVDLFHATHFDLPPFEPVLTREFLPYKCCARAPAIASRGHLPMHVIVPQPHSFSPLSNIVQPHPAALLHIAEHWGITPQELVMVGDSAKDDVRGGALLTVILSAKGGCMSWGRGPGSYTAGPGTWPHTIVHHPARPHPLLMQVGTRILHCKARHLASHHGASPCTSPPAPHAGCEWESCGRVDHPPGHRGDAQGARPGPGRGPAAPLLCGLHAGGAADPDHRAAAAQSPGDLKGNRHQEGVEAGRAPAGHCMPAFVGETPQLQAGWEYSRTCSACRRRFSVLKSNPSWACSLCSSWIPFNYYRHPLVRTMPXXXXCLIALQQLDTVELFQTSPCPHHAMDDKHPHRYWLNPSGQGTRGRECEGQLPGSTCCDNKTSQPPGSSPPASPAWTPQICMPARAPAPHQTRWRARTCDCDVGGRARAWARERQARPRSHALAPSAAQVCGAQVLDATPAAPALPLHALPNSLGVGGCEFAGVHQLGDAFQQDRDPLAVLLHPAPDVEAPHLVAFEERGGAWSQAACSSA

SEQ ID NO: 15732 - protein, 389 aa, Chlorella protothecoides
MVLQLASLLRLRTVAVVSDDAGGDFDKTADWLKSLGASVVLPDRGNLKVGRVHAGGRDAGRSDRRCLQHCVWLHTAQAVGCLRRCAATLGSLRHLADAHFTRWGQSLHCAPCCPELSTSGRAGQAQVLRQAKAGPGCGGGTELHPPLRHAGGGGPAGGVRLHVRQVSHLDLALLGVPGHPGDWQGLGGVSGKGDWLLHGNCSWLVRGRGCCERIGTQLIIAFHAEEQAAWLQAPLTEARPSTSSHVPSHWPQTPALQTQPGAGLQHPALGAGAPQAGPCLAGKHRQAGERRQTHSRLHRVSLEGRGGGGQGPQASHPGPGRRRPALRWVPRHGSWASPGAPEPTLWPCLPHRNRRYELATEFGEALEHALERGKNTKVLLKVSDVGVQY

SEQ ID NO: 15733 - protein, 280 aa, Chlorella protothecoides
MPQTHFPPPHGNYRDKVRAAETSEASNISEQITVRQSKEAGSHGAGFEAWMRGRGSGGVQVFTADDVIDQFGVVKGSYDAVPLPRIKAHAVRCSGAGRPREVLGVEAEELPAELEWGQVLVSIRYAAVNPADLYTVATGGTYGQEHVSVPFVPGHDAVGVIVKAREGTGPGVKGLHENDWVVPLKPFLGTWRSLLVAAEKDLLRLAPDAMPMEQCAVLRETLTAYRLLEDAPGLKVGGGRWWGWKMAGAGCGGGGACPLAGTPFVRQAGTPLVHEACTLP

SEQ ID NO: 15734 - protein, 96 aa, Chlorella protothecoides
MQIFVKTLTGKTITLEVESNDTIGRVESHLCGSRGSRVTSAVAAGSCFLCKHFAGLVCVKLLESDCQSPVFAALDWPPSCCTRHLADNVKAKIQDK

SEQ ID NO: 15735 - protein, 375 aa, Chlorella protothecoides
MTTPLDDANAKLRYSVEVVNLQINLEAQQAQGRFLLAAESGLLEGLTLPHNTMSITKLTLDQVQAYVSATSVDPGATPAWLDTHGGRFAPGAEPSLRRVFNPIHIGLRHSRVTPGAHAGGGGAASAPSRVTPGPRGGEGGAHRRNSTAPGWGPASFTGAGPRGEELLLSVPQIVATMEGTEFEVLVEVVEMLLSQGPGVDTVGEEGSLLAADCAGDEVEDARQSYALLRRELAEARALTLEQRRWLGLQLLRLDRSGALSPPDSAGPGLPLQVAALELHAFAGGAAQGAASSAAGAGAPAAFDLGLGPLADPDAELDGAVRAYLYSPRAHAVPAQGLLLCWAEEQEERAATTLEAARSSLQDLKVQRMWDEEGEG

SEQ ID NO: 15736 - protein, 444 aa, Chlorella protothecoides
MACVSCPSTGDPSCPPPTAQPPTHRRAPVKVYTDALLQGSGLQILHGPGMEPALAMMALAGKRLAPSDPDKSLPRPPPIPWWDDLRYMWRGRAGLEVAGLRLTLAADRRAGPGPDSARLVLAAHRVGAELAEGVAELRLAGLAVDAFEAVGLDGPAGGLLRLPMLAVPALTLRLEAGWRLPGGRTPRQHHLFPPTPPLDGVQGPRLPGEVYKSEALDLGITADLGGSAAQSAVVYLGDHQEASTMRVGVRGGTPGSQHARAGPTPDRRQLKASGRLTHLHPPLPPPSPHSDPVPEDLDRAVENARPCRPRRGPARHFLRAQAQGPAAQEEPAQAAAGGERVWLVDVLSIALVPCPNTNLTGPPSSQFPNQRHCPPPACVFLITRAQMKIQVSASPLEIVHFTCDTTDPSHNVCISAVGVEFGASWLFNQPIPSFLKPPPHAAKR

SEQ ID NO: 15737 - protein, 149 aa, Chlorella protothecoides
MCHAPTPFPTERAPALHSSRPEAEVQALPDQPHALPGHLRRGAHGAALCTNTIASTTLARPASSPRAGATTRACPLPPPPHSHIPALTCRTFTDLKLVLDNRTYENFEGGWRDLLARIKWDTVKSVAKSVTGLQGRKFKVWLGLQRGKW

SEQ ID NO: 15738 - protein, 220 aa, Chlorella protothecoides
  MOD_RES (114)..(116): Any amino acid
MDRQAGERSILVATDVASRGLDIPSVDFVLNYDVPVNGKDYVHRVGRTARAGRSGRAVTLVTQPAPRSSWEAPCIRIFFPPVRPLHMPFARPLGSLMLGHSCMHPCPAARTPPXXXSGIPERSLASGSSFPRAAPAHALRYDVELYQKIEALIDMKLEAYPAEQEAVLVLLERVSEAQRIATMQMKETDSRKRGRKSAVDDDERDAEGVARGGKPPPRKR

SEQ ID NO: 15739 - protein, 175 aa, Chlorella protothecoides
MLQHQQVVAGQTASLALKKVKRSGVRRGMILADPGLHCSAGWEFEAEIAVLTHSTTIQTRYQGGSGLRVQPCRILLCKTANYWSPGAFESRNLPGAPSTLPPCTLAPPPKGRHPLRGGAPVGPGRGHGQGPAAVWGPSHRALPLPAAPRILDPGGPFRVPGGQDQGRGPGGGLRG

SEQ ID NO: 15740 - protein, 241 aa, Chlorella protothecoides
MAAELANERGDARQAAAVKAFEALGICTQLAESAAGLGWKEPSEIQTQAVPLVLKGQDVIGLAQTGSGKTGAFALPILQQLLDTPQPFFALVLSPTRELAIQISEQFEALGAGIGVRAAVLVGGIDMMAQAIALARRPHVVVGTPGRVVDHLTNTKGFSLRALKHLVLDEADRLLNMDFEQEIDTILKAIPRDSELKEVRHGVRRQSLATELIGSSSSRLLCSRHYSCALVPGTGTQQGET

SEQ ID NO: 15741 - protein, 156 aa, Chlorella protothecoides
MTSKVAKLQRACLRNPVKVEVAAKNTTVATLRQEYMFVPAKYKDCYLVFLLTGGNPYAVPMAPPRLPLPPSVACRPPAPPIPPHPRQPTPQHRACRCEHHHLHADLRHHAAHRADAAQPGLRRRAHPRPDEPAQAPGGHEQVQGVGRGGGGAEFEG

SEQ ID NO: 15742 - protein, 213 aa, Chlorella protothecoides
MSLPRKRWVAYVAVLIQADGKGLLRPQYSSGASRKFCLPVPPFPAQIITLVDLAGHAKYFKTTASGLTGHLPDYAAVVIGANAGVIGMCKEHLGVALALQIPTFFVVTKVSHVIPWDRWWQLVSPRSPAELHPANLPMFFQGHQHRSAMVRGECLAALASTCLRCKDHPPATLLDTKVDLAPAHVAKHSLETLTTILKHPSIRKKPFMVRDER

SEQ ID NO: 15743 - protein, 124 aa, Chlorella protothecoides
MVELNGTTLGEESPSQASMDAALSSLHDAMQAVGAEARVLRSRPATRDSRASTDVWVRCRPGEGEVLEVHVAVIGNVDSGKSTLVGVLTHAALDDGRGSARARVFTHGHEQSTGGQGDFCWRCI

SEQ ID NO: 15744 - protein, 699 aa, Chlorella protothecoides
MLGDVALCISPQRRLVPVQALHGVWWSRQCTRFPRYAWAGRRLSGTKVAPCHRVTVPPKARSPAPLPAPQARLLREGAVGWVASSSPAWGWCSVSRWVEKGRDTWVLPRSESGGPADGDQGWRIGTSISSQTSTVLGWPTPGTLPPNDGTACEGIPFTPKKLMRGCARADACNDAGPGVEQRREYHVKLELGWITSECKPDWQNQVVEGEYALPCYRHQAACHSLNVCGAGKLDWAIRDGWPSSALPSSHPRYRRRRVCMKVKGLSSTMRSHELTSHTLSIAPQCGAMSCQATLCPSPVQDAWDVHAAHTEWPPLHLRRRAAIAEVVLAGSLTIATSQNGVAVAFSEGGCGKAEPEHGSKEGCVLNLAADEHIHGISAVSGRPSITVISSFLSDGGQSLRCRVVSLAGVSRGTPHDWMPLWTNEPLHNPGFIELSDGGVHALVFDPAKGCAGEGGAYLCIDQEARGSVHSSTSPGGKTPSPHPGACRQYSVWDVGSRSVIFGFASAGVVDAVFASEDAVLCIRPSPAGGTQRLTLLALVDGSSMHVGGAGRGGARGNGAVLDARPAAAAYAWDRRSTVMTFTPAFQCYCLVCDRKALPRSVTFSMRREPGPALLGATAALDTSSLPCAPPPPQDTVVPGPACPTRRHEVNGPWLFMHGADGVLRTQCILRQGAPRPLRAAPAPDLGDPLAPPTLLHAPR

SEQ ID NO: 15745 - protein, 388 aa, Chlorella protothecoides
  MOD_RES (76)..(79): Any amino acid
  MOD_RES (132)..(135): Any amino acid
  MOD_RES (275)..(278): Any amino acid
MGRQTVQHVPRMYAYHLAIEGPRLSRGVAHLRTLLIIEYTRSGIKVQLSHLVEGGASTLSALAGTHSEAPNQPSGXXXXLCHGCCPLDLCADQQAGVPVQENELQAGHQQDQASTHPAASLKILMLGLSGSXXXXRNKKHIAVRLGDLLGCSGWRLALGQAPGSFPRNPDGFRREVADLLRAGKQGNARIRVESVIRETLLLQAFDTLEVYLELLAVRVELLAKTKEMPPDMMEGVYPLGYSLAFSNLPQITIPLVGHLQPDLRCGAHQQRPARXXXXCDHRGVFSWVQPPLLQPAQLTNPLVGHLQPDLRRGAHQQRPARDRGHPLHAGLQVRRPVQGLCAGRGFRRALPRVAGERGLGELPVGGGAGRGAEDRGAGVHLRGARHPL

SEQ ID NO: 15746 - protein, 283 aa, Chlorella protothecoides
MCTPLHPRRFDDGIRLDQEGWFSVTPEVVAQHQARVVPPGSTALDPFAGVGGNVVALAEVAAAVIAVEIDAGRVELLRHNVAVYGLEDRVRCLQGDFFQLAEELKETVTVQSVPDCSRHANAQDGVRPRRAPSQGTARVNLPLHVLPGPSTLPSPPDDPPPPSSPIPQADFVFLSPPWGGPEYSAQAVYDVERMGGLGLSLTGLLDLAFQVVGARGVVAFLPRNADLAQCARSAGGRPCVAERVVLNGYLKGTTMYYGAAALRWLELRGAEEGEGAGDDRPPG

SEQ ID NO: 15747 - protein, 220 aa, Chlorella protothecoides
MLADLRWFKSGKAIFSVFSASAQTCSSGPQYWEHTNAWVPPPSRVPQRCMARKPNGPAASAMQRTCSAARSFLQFRACTGATWVNGLTAVSSSSTLKGVRGLAEVAAEDTKETPWHSGHSVATLHEAPTTRYFSIDPRAVPEAQADFYEEAYLKKEGLTQPNYGCTGVQVRLGVQASIWGGGGVFLQLDGNLDTQGGGMRRSVAVHEEFCGPPQAASLTV

SEQ ID NO: 15748 - protein, 233 aa, Chlorella protothecoides
  MOD_RES (187)..(190): Any amino acid
MAANGIEKIGVLVVGAGPTGLGAATRLHQLGHPSWLLVDEVCTAGTSFPSPTGLTTHDRYDGIAGGVIDLHRCIACLPPCHTDEDASIPTPQAEEAGGLACTDVTPEGFLFDMGGHVIFSHYQYFDELLDTGEMLLSFPQAARGVVPGCMLLGVGPRACASAGGLPCLVYSGLCQSACSPMLRDLLXXXXGCARRRAWLHAPRCGAEGMRLGRRAALPRLRRALSECLLTHVA

SEQ ID NO: 15749 - protein, 73 aa, Chlorella protothecoides
MEQPAPANGLTVTAPTCGGRLPAALAVPLPRNSRVSVPRYNLQEVATAAAFYYDTGVITGRASTSMSGTETRP

SEQ ID NO: 15750 - protein, 463 aa, Chlorella protothecoides
MLLNDLRQSARKEIHDARVWKIIAAVSSELRHRPPLPAEGCPHNSCTGAMVSALAAALAPVAEHWAQCENANCQKWRRLPPGTVVDENAPWYCYMNPDAQRNSCSADEAVEVEVSPCAPARGPHARSSPCALGPQQRRLSTGGAFEAGTWSRRPCEDGHKERSQGVGLLPGRGRNIWPVRLFPRHSRLVWGNGLQYVRHQACLPLQTQFLPYFHRRGSAGKPRARQPRVKWEEAPGLGTGPEAAGPSGTDQDMYYADSSEEDAPPRMNWRQLSKHLVRMLESAGGAEGSGPGTSGAPPLPHPPPDVWRELGQRCPEAAEAARQALDTASAARYFPDRPSGVWEESTALANAALALAAGQVLVQNASSLPPEERERLGLGPAAPLDVTAVVERLRLGAGPGLPAVGDAVQMCKDHGRPSQTPVRTEIPPGNPSSADTVYSLAHWHSLAQTPLNYSHNHQSTREA

SEQ ID NO: 15751 - protein, 239 aa, Chlorella protothecoides
  MOD_RES (130)..(138): Any amino acid
  MOD_RES (188)..(191): Any amino acid
  MOD_RES (220)..(223): Any amino acid
MPRFEGCCSHDHDCEEEDCSTSYSLYKNIDTPRVRCLNELEEGSCQAVFKPWHARLDSSGPNLRSQEDDPELLLYVPFDGAVSLKAICVIGGPDGRGPAKLRVNRRMGGLHGARSAANGAASATHDRNIXXXXXXXXXVYVNREDLDFGMVADLQPIQEWDLVDNTAGVVDYPTQASKFNGVHSLTLXXXXQIFRDDLAAIIHNEMIEITLCPPPALAPXXXXCRFFGMTWLPSFTMRL

SEQ ID NO: 15752 - protein, 262 aa, Chlorella protothecoides
  MOD_RES (138)..(141): Any amino acid
MPRGEGGAAEAAPLSCPITSASCLLQPFSAIPGCGHIFSNKAISHMAGVCGLCSQPFDPDLVVGLLGDEVEKERLRRLLPLRPGRQRSGKRKRSSQKQASGDGGLGSVFHVWWVVVRGPTARALRKIDVSLSFDGPEXXXXNRHLETVEASLGRLPTLSARSTFHRALTVLNNINSLIELKYTMTRSTYRSSALRGHHGTAARPIIAGGPAVRRRWSCGQIRPASSYLPGPVARCSRRSCNIQQLQALHFALRLWVHGSSGS

SEQ ID NO: 15753 - protein, 76 aa, Chlorella protothecoides
MGLDGGTVISRSDVLRGASWELSQADGTRSTRGGAVSKAGTFKKPKLDKVAVRWAWAGCWDLAVSHPAYCSAQLVS

SEQ ID NO: 15754 - protein, 270 aa, Chlorella protothecoides
MQLGPVALQGSAVPGGPLQRPSPPSRAPSTNRGARPAGGDQSWTGGLHAPPGGPGDSTRRHVDPEWTEAGEETAFSDGFPFLVANEASLTDLNAHLPPDEGPLKLNRFRPNVVVAGAPAWAEDGWLRLRLGASATLHLVKPCDRCAVTTTEQETGVVGYEPLRTLRVVRSGKVLGWSEAVPCFKGAVFFAWNAVSEGPGGSIMRGDGVEVVQAREGPAVPQKVDQPAPAQAQAQPQAQRELGAGLTTLQKVALLLAAILVRYLFQYYAAK

SEQ ID NO: 15755 - protein, 163 aa, Chlorella protothecoides
MSLSVASLHVYPVKSCGGVTVEQGVITPIGFRYDRNWVVINEKGRFVTQRQKPEMALVSVSLQPQALLEDASAEEGQYPDATLVLQAPGMPTLQVPLNPGRRQGPSTKVTVWEWTGLGADEGAEAAAWWSQYLGHEARLVRYAGEGSGSGRGPHVCAASLGDG

SEQ ID NO: 15756 - protein, 273 aa, Chlorella protothecoides
MVYWLVALPAPSTGMEGAWASLQEDTTYSSDLSVNFKFAVPEFKVGTLDSLLGLSDDLVKVNGAVEGSVNKVRRQLFELQSAAPTDRSEEEEGGEVRVEGTSPPDYLQHFEWQEAKYPSKRPLKDTVAAITEVTQKLDDDLKLRTTEYTQQRTLLQAQLRKRTGSLAVRDLSDLVPPGELVETENLVTLVVVIARSNTPEFMKSYEGLTEWVVPRSARLVTEDSEYSVVSVVLFRRVVDDFKAAARAKGYQVQSGGREMDIVRGGGLIRGDGG

SEQ ID NO: 15757 - protein, 163 aa, Chlorella protothecoides
MFHCRRRAVPTPLQRKIPAGVNEPANPKEAVQGPAAKEITSDAESQKANEEGLEKLRAAVEVKRSEFEAWCLTSYSEAFSAWIHILAVRLFVESILRYGLPPQFLPVLMRPNPKAVSKLRKVGGELDLSRGCGRDALRGEGLGAETRFFHQERTRGMCVWRAA

SEQ ID NO: 15758 - protein, 479 aa, Chlorella protothecoides
  MOD_RES (179)..(182): Any amino acid
  MOD_RES (419)..(422): Any amino acid
MPCGLQTCPGVWWTCPLLKGVEAGMGQVIVLKAERPSLAFAGALPPPISASAPPSAVCCIMGDEGGGEQDRALRDSLPIVIPSSGPAQFHCAPAQHSLLSHACIEGRHLRPAGPCYGDRAILTAGRVCLAHLLALIEPLALQSVEEGCMDRNGCWVDHTDRLDFGGTTLPSLSSLHNAXXXXCWVDHTDRLDFGGTMLPSLSSLHHAHLLTLFRLLGNVQSCHRVDICAGMGVSRLIVAETRSGHPHGTQQFLCSSALQNQCCTVPLSIPRRCVTPHLLVWGVGAAVRAVQSVSRLGRSVSRLGRVKLSMTDIPTCRKWSIAHSQSPYEYLAACGLTTPLLAGLAVGAAAYAGKTALTAWQSFSKTTPRMRQFYKGGFLPEMTRREAALILGGRGLCVLVQGRYSASSRPAPQPAPLLXXXXYKGGFLPEMTRREAALILGGWGLCVPAQGRYSASSRPAPQSTPLLTKMCPICRSRHL

SEQ ID NO: 15759 - protein, 480 aa, Chlorella protothecoides
  MOD_RES (46)..(49): Any amino acid
  MOD_RES (371)..(374): Any amino acid
MGSPLRLLMRGNEILPLISPQMPCETCHARRPARIRSGATTLPHSXXXXHAMSAAEVRDIIAKTRLASKVRSGVCQGCTTAIGAVLWYCNALNHLLPSPNAFQDWKKSSFAQRRMLLKILLKFTVENQADICSGGLHPSRVTCSPARSQSVCPGLGQATGGCILWGGPGYLRKDLVARGRGREISQARASLLWLHGEEVEEGRMIARRPGIAGFCLGDPRLAGMWCLLPPRNLSLHGPGIPTTPAPTTILAQMFYKKARVEYHPVGVVGTIVPWNYPFHNILNPLTAAVFAGNGVVIKVCGSARGVGRALGYSGRDIWVRGGTPPASAAPALCMLWKERQRPAVFIGQPVTHPHPGTHTSYASSRHSNLSXXXXVFLGQPVTHPHPVTHTSHASSRHSNLSSSPKGLRARHLVGPGIPARDRRRAGGRGRAPGSGPHRDRLRRGRRRTGHRRRGQAHLRGQHCHRAQGGAAWGGRGSSGR

SEQ ID NO: 15760 - protein, 374 aa, Chlorella protothecoides
MVDKAVAESVGGLGQLTPTSTCVLIEGILSETPPGTKQKASKIVHLGTTDAAEYPLAKKKQSFEFLREKAHLRPRTNTIGAVARIRNALATATHTFFQSHGFLYVNCPIITASDCEGAGEMFQVTTLLSGADGAAASPAATPEELEALRAEVAAQGEAVKAAKAAAAADKQTSTCTKQPPTLQADKSLAAESKAQVSALLALKQRLAGAEERARLVGGVPHTPSGGIDYSKDFFGRAAFLTVSSQLNAEYYACALTSVYTFGPTFRAENSHTARHLAEFWMIEPELAFADLADDMRCAEDYVRFCCRWLLDHAAEDMAFIDAVIDKGASERLRAVAAAPFARVSYTEAVRVLEEVVASKKKKFEFPVSWGVDLQ

SEQ ID NO: 15761 - protein, 234 aa, Chlorella protothecoides
MPLPSIPSRPRVAWPGVTSTIAGFARPPPSPTPGVDRRAPAGHGEGPLLPADHHHRCRTGHAHLGGGGLWTRHVRRAVTATRGSAPCRSEQALHSSHDESACIHGHARQRSVAKRAGAPLVRRRKRAHPPRTHHPTAFPVGVPVVSFRSDAEAVTLANDCPFGLGSAVFSRDVARARRLGAQLEVGATLLRGVGVAWVWPVGSSAPGPAMEPGPQLHQTRVWICGRLCFPWPLV

SEQ ID NO: 15762 - protein, 419 aa, Chlorella protothecoides
  MOD_RES (341)..(388): Any amino acid
MGSLQAVLVTEDTEVRLGACLKELGSALAELAACAGDAPPDVAQDTARVPRQIAGATFAPRPGTDLLTWQLLRGLTLAGVGRGDRAALGAQLRAALRLVSLGREGLGVWLEREVLALRAASVAARAAGDVVLAFFCHQVLMCLLAAGTGAWDWLEEPVAGEGCAQDGAPLANPSEAAEALASARTTPAASACLGEATPPGQGTPPGAGKGSGGAEGQGVSEEPLSRADEGRASSNVMAHPVADLTDPADIVDGASPGPAPGNAPGKGEAPGTPPRAAPGRAGEGPGSPVRGAARLLGHVAAWFAGMGGGVAGPVPRSGLPLANALSLDLALGGSGALGSGXXXXXXXXXXXXXXXXXXXXXXXXXXXXXXXXXXXXXXXXXXXXXXXXPPRQRRAFPQRGGRAGLGPARRRLAGRGAGL

SEQ ID NO: 15763 - protein, 478 aa, Chlorella protothecoides
  MOD_RES (98)..(101): Any amino acid
MVFKQGQPSEVGVAPHSTICKYAEIHMQHPFLYQTMPSEAPQDLTFFLHSSASVSAPRRNCPRSRQIPGRGKHLSRLASLPFSQEVCKRTPSQPDSSXXXXQLTSKHYACSEAGQPPIQLRGLRAHTLTTRLLRSISQTLAIINLTHTQAVRSLWRLGLIPSRARRSKSLTTPTMELFWSTTGSPVIRWLTSSSSAEDMTQERGETLARQPSPLHKPLSTVVSGEHVMIPSLVMKEATLAMGLASCAGQAAQEQSQRLTLLKLRSRWCTALVDQSQAAAPPSKLTGGAADTRRRACPAGLLPTARWHAGHGFKGRVVGHAGIAQFGLSASRRYAVQKNATRHAAADWRARKKSSVPYKNGAGYSCIPISEHSTRSLLKCPRAKHFPCVPGVDMVSEEDVREAIAAHLSDAESTSYRPGSLPTNRCGTGFEVQVVAQAFEGKRLLERHKLVNAALKDIMPNIHALSITRAWTPQQAAAA

SEQ ID NO: 15764 - protein, 422 aa, Chlorella protothecoides
  MOD_RES (97)..(100): Any amino acid
  MOD_RES (178)..(181): Any amino acid
MHSVTGRQEATGPSAATPGSNGKSPGSVGEHRPRLPPPPTVHHLTEANLGRFSVRASLGGPKEAAVVLPLPTSWQQCIDQVGVLSTCARLVFRACMXXXXWQQCIDQVGVLGTCAGVVFRACIISEHDCGMDLLYSLRGLDRRTRILAGLGQWWAGRRPAVMADAEFSPAHTHPLLIXXXXAGRRPAVMAEAECSPAHTHPSLLKNLPCLTTGGGCGHQGVGGWCGQAGGTSPAPTGMRQGKHGLWRLSFTFSLVLYCSRVGHEAGRAWAAEIELYIYPGAVPLTSRLNTVEGRGWPGGIRQQCRSALPLIEALLRRLKKHPDLAGRLTPRWLDEPDCVGEEECSLKLVCLVGFNFDDPRRRAWDYGGNDRFPVPPSRVTCCYVVTACQPAQHPSYHLLLFHSAVAQPASGGGHVCDGRYAA

SEQ ID NO: 15765 - protein, 500 aa, Chlorella protothecoides
  MOD_RES (318)..(321): Any amino acid
  MOD_RES (427)..(430): Any amino acid
  MOD_RES (453)..(458): Any amino acid
MLTQHASCRVLPTGAWQGRGRTCPRQSITRTACVRDGTLFQSQNRRQWLQRGRALVPLPGTLHGGPPPPPLRGTGQYAHQARASALPGMGALHLVRSHIEPGVLGAAASVSVKLIMICSVVAWLLRTERIPADTATTLSKVPPGGLGGNESGCPRVWQLQSRSQAVSNLCMAAPATSPCAALSSLESSLPMAQHHRIPHAPGQHRRRGDAAGGPGRRLRPPAGAPGGRRLPTCLGGGRLASAPPLPPRPGDRRQPGGCRGVGSRTRRRPGGPARTRASRCVLSGTAGGVMMPKGTLHLSHPCCAPHHWLLEDPGALHXXXXLGQQGEIPELCTTDRESVAPNPQEHNHPPPFPSFCRCRFPPAPGPRLRVWQFLHPARHPAEHALLRGARGRLRRLRRALPPSPGRAGVERGPGGGARRDPGRAPPXXXXPRSTTTHPPTPSLCRCRFPPAPXXXXXXAPPLPARGAARLAQPAHAGHAGRGRGGADPPGPPPPGAARRR

SEQ ID NO: 15766 - protein, 271 aa, Chlorella protothecoides
MLDALVCSWARSPAALLGAYPSLALPQPRRRVLATHLDIALGTGACSWRSVGRQAVPGPRLAARLLAPQDAVHTCTDSPSCSHAPSLPHDTRAQSTRGHYALLLGPAGVVALAAAPGRPPLTQWEVLLLLNIVGVLGDEEALTPVCLPHADPTALLHAYVRRLGGEGSTAGASPGAGLGPLTLALLVPGAPDRASLAAAATRLAPIGHLAGASPSLAVRDLPSSLGGGPPGTTPLLHYAYRLTGGAQFVASPPVGDGRLQQVGTRDPGGGV

SEQ ID NO: 15767 - protein, 106 aa, Chlorella protothecoides
MLPRAVMSPPRHRRTSPPSPPFPPPQAIVLAYSQVRAAAYDRGSEAEGPLCGVRVERRPGLALAAVLGKEGELLAAYDALSKCEEVAAHCARLAAWLRAQHASWFS

SEQ ID NO: 15768 - protein, 292 aa, Chlorella protothecoides
  MOD_RES (17)..(20): Any amino acid
  MOD_RES (124)..(127): Any amino acid
MRPSRHSPLTTGRPADXXXXFTASPPPLMRSSLHSPLTTGRPADERAVGRLGRGRDGRRRRVHRRPRGAHRHVAAGPRRRAGGGAERADARHAPRPGGGGLRLAPLHRALWRRGAGPVCRVRGXXXXAVAFAWPRFIGRFGAAVPALFAEFAEAAARPGKAGGRRGRKGASAAADAADARAGVASAVAEAVASIVGAEVGPADPLMSAGLDSLGAVELKNGLEARFGLALPGTLVFDYPSVEALTGYIREALPEGGAGSGEDDQEDGSEVDWAAAGAAASPSAGPSPRRGAA

SEQ ID NO: 15769 - protein, 638 aa, Chlorella protothecoides
  MOD_RES (474)..(476): Any amino acid
GAHGGRRGGGDGRRHLPRAGRQCAGEAGPAPRGWRRQPPPLCLTGRGHQGLAVRALRSQEVVSWRCLPAGGFLVCACRCPDCERNMRCDVGARVRKPWGGSFATFGRAEALVDLLGTHRNTDTWGAARSSTPNRHRTLANGWSVPGASAHRAGTRHARPFAAHAPPCTDQRLRRRPAACQAERPDSGWVEPAAGPSLPSQGEMVVTGTPESIGRQLQEILRPPPDTDYLAVSAVLGVGGVHPHLALPHIQSAALIRSLPPPLSTHLHTNALCPQEFLAIQNNGPRKLGFFGTRNMGFMHQQLIEVLAYAMILTVRAFLLAPGGPRQGAEAACSPARDVRRASCQAPGTCSPQGNHIYTSGATGTNAAVIRGALRAENPELLTVGNHIYTSGATGTNAAVIRGALRAENPELLTVVLPQSLTKQPLESQELLQQVRGHWLMAWPSEHLVFVSSFLARRGSAFQLHASPDFAPPSXXXPCVCIEPPSPTRVCVSMACLARFCPPINRCMTFQRPQVPQLIEMPQNDDMQLSEASRHVGAGQQGACQGELPSQVRCPPGLLTSPEPFPTHRLCNRDIIGRVAQIICFAFHDSGLLLETCQEAKAEKKIVTMVVVIGRAVGWGSLEQGVVRTVAAGASSALF

SEQ ID NO: 15770 - protein, 138 aa, Chlorella protothecoides
MGGAGHSVVPGLQLGVAGQTSMTWLGGFVFGRQASNDTTCAALSQAPLTNPFPNTQHPPTLHADFKNVSIVGHYIKERTKNAQFVIISLRNNMFELADRLVGIYKTDNATKSVAIDPGAFVVGATGPAPAVARPVLAA

SEQ ID NO: 15771 - protein, 115 aa, Chlorella protothecoides
MAGFNAVSLKLKEMYQMITLGGDAELELVDSLDPFSEGILFSVRPPKKSWKNIANLSGGEKTLSSLSLVFALHHYKPTPLYVMDEIDAALGEWLRGWGSGESLARGDEHGMGSGG

SEQ ID NO: 15772 - protein, 235 aa, Chlorella protothecoides
MGKCQPLSHLSHTPKPAPPPYFTHTLWQEFKALDEAALEVLKGRNAAEAALAERAADLADLRAGFEAKNREVGVIRRVEQDILAEMEVQRVAAKDEAGKRRLWAGRAAAADAEMAEKWGEAPAAPTPEELAAASTEDLQYRTTLLREEMERMSIDLTAIEAWRAKDAEYGVRAAELESATAQRDEVLEGEVRRERVGYRATVAGNGRLQRHGRGSAVRKLSGMEYLPASLHDTRR

SEQ ID NO: 15773 - protein, 105 aa, Chlorella protothecoides
MLELGLRVDTPHDGAVTGKVIWGVLTCLGRPGPRQRSRPLSVCLSCACAVVDIVGTGGDGIGSVNISTGACVVAAAAGARVAKHGNRSVSSLCGSADVLEVSPGA

SEQ ID NO: 15774 - protein, 72 aa, Chlorella protothecoides
MAKDKSRSTELVSREYTINLGKKLHDISFKKRAPRALKEIKKFASKQMNTSDVRIDIKLNKAVWSQVREGGW

SEQ ID NO: 15775 - protein, 72 aa, Chlorella protothecoides
MTPMVMRPPGASPGADSQRLCAWILDAALAALPPGQECVLGIFDLKGFSLQNADLGFARFLVRCGPPSFLGV

SEQ ID NO: 15776 - protein, 119 aa, Chlorella protothecoides
MRLHPSQSRAVDNLLFFSALQPALQACAELGIGLTMVKRLSRKYGIMRWPYRKNRAERRVAGWDEQHDVANSSDLGEYEKGAHGRGPHGWWVYSMPRLCTPVSGPARRAMDPKLTGAGG

SEQ ID NO: 15777 - protein, 362 aa, Chlorella protothecoides
EHTLAPPVPCSALPAWAPPAPGAAVPGNRYYLPKVLAAGEGPGGRRSAAATAYRKPPCRWDRDPPDLPAPTPGCRSSWAGSALRAVLAGAGPWEIPLTVSGSDEGPHACFHKPLPRRGANARQRQQRLQRAAALSLGGADGARRAEAVAVFALGTHRLAVHSRAGLCVLGGAWAQAAGCSAAAERGERGDGAAEREGPGDGAAEREADDRIGAERTVGEPAAVPASALPSPDPGSTSDPVPDHTSALSAAPSTSATPSPEPCRVVLGVRVEYLPSPAREAATLDELAWLAAGLALDPEARGALVAAVHVPTARFLGTQALTREALERAGGDALAARRHAALRTLEGLLAASSKQRWAVLLCQ

SEQ ID NO: 15778 - protein, 166 aa, Chlorella protothecoides
MPGHPPPWHDAISASTCATQGQDVEEGTRCAARLPLSGVGLPDPHTVYDVHAAHAAGAAVGAGDPMDDPAVAPLWQPADPGVPQIADTLPPKIVAGGRRGGPGRGARGRKRKLSQPYAWKVGGAEGNPWQGALSWLPRACHPPCPAQRGPLHGAMWVEFRHASFPR

SEQ ID NO: 15779 - protein, 333 aa, Chlorella protothecoides
MALGMVSHSHTAGFVRPRSDGRMQRASKLGPGAVWATASTPPKPSTGVSSSTLQAGRSPSLATQLRFAMPSKGEEAGPSSVQQLATGFRPLSRVAYQGAPGAYSEMAALKALPNWEPMPCEQFEVAFQALSQVIVLRSSGRPAIQAWAEQFAAVPQPEHSPISSQWLAERAVLPVENSLGGSIHDVYDLLLRYRLHIVGEVSIVVSSGGAPLQSACCAQGQAAHSSARPCRKDDVVFLLVHAVPQGTVCLVPIYSRRSQTVYRLGWSHLWPTSKTVNPVEPCLIQHLPPFWSTGQPLSPGAARRLQDRHQTCDESSPGPGANRWLHQKAWSGT

SEQ ID NO: 15780 - protein, 294 aa, Chlorella protothecoides
  MOD_RES (160)..(163): Any amino acid
MCMWPCSETHCPWTRWGWNAGTATCLLPTLCAGSPSNHPPCRPPPQAGLLLAETPFHLQIEADIAPYKGLLMGLFFMTVGMEISMGLLVAKLRTVLAAMVLLIGGKVAVMAGVGQVFGLSLVQSLRAGLLLSPGGEFAFVLFGEAVRGVGLVVGKEGGVXXXXAGLLLSPGGEFAFVLFGEAGPTAGCSGDAGSHSHMAMLTRGIAPDLQRKGLARGYPVPQSRSPLSNIVEQLYKPLPPAVCDPALSPSSLSTGDQGHPERRDGTGAVPRGGAVHGADPLPGGVGCAPGQDPG

SEQ ID NO: 15781 - protein, 371 aa, Chlorella protothecoides
  MOD_RES (62)..(65): Any amino acid
  MOD_RES (366)..(369): Any amino acid
MLSEQLIPFVALDVDANRVAVRRLGGGGKGLMSGLSQGWMVIKSQGSSWIDFHTLTSIPGLXXXXLMSGLSQGSMVIKSQGSSWIDVHTLTSIPGLPSYVRSSHQLSRNLSPQEGRALDLPVYFGDAGSPAVLHALRAEKAACAVITLDTPGACFGWRYGEGPCRRCDVLHWSHTTAVIPAILLLLLPSRSHISLIPFPTQINPYPHATAANYRSVWALHKHFPLVKTFVRAHDVENGALHWIRAAGVGAVSRVPPPRDQVKGKARDWPQSIEHGEAWSCPHALAGAGGLRSPAGTHKAADPGMHPVALLPPVLCRAGHPRGRCGRSHPGPEADAPVGAAGGGGVEWDARAYTHGIAGRKVCGRTXXXXVE

SEQ ID NO: 15782 - protein, 326 aa, Chlorella protothecoides
  MOD_RES (203)..(206): Any amino acid
MGGDHTLERTALLKILLHAIKYPAFGVNGVLLGSIANGTVTATDAVPFVHNFTTLLPAFETALCQVRATLGIIELATCFSREAGLKYGIPVFHERGKQAACTGAFPSSSFPGAILANQLATRPTCTGGQPHENTERSPGGGLLPGQRAQQGHTAFRCRQAARHKSRDAVALRHRRCGTRGSGPFHWFAWLGETSPESAALDPXXXXLPQNLLQSNDSSCMHQELISPLRLSARSLLLQLDPEGLRQLLQSSGGESPSDARPLFTLHIKDGRNWVEYGGRLKVHTAGIPSALEQLSAEGKHRQLADFEDHMEDVSLDWLNAGLIKAS

SEQ ID NO: 15783 - protein, 300 aa, Chlorella protothecoides
  MOD_RES (164)..(167): Any amino acid
  MOD_RES (240)..(243): Any amino acid
MPFLRRRILSREAEGDPSMMEAGAIASGPSLGPDGLKKDAEEGSQDVEHRNLTLSEQHALRFAAKDKAWKDKTFWEKVEYNPVTNILLHNVRQDIHGVAETDEGVKAVHDNAELFDLKTEAMFRYLQLGEYSLQIDHPCSDRTCRALTGAHFAVIMGDLLPFAXXXXVAETDEGVKAVHDNAELFDLKTEALFRYLQVGEYSLQIDHAFSDRACWALTGAHFAVIMGDNNVEMAALAFCXXXXTDPGGEEGWKEGCLYTAVVWWMLRCAGMKTESLDRRSCSSIGMRDGGVWSTMACCTA

SEQ ID NO: 15784 - protein, 61 aa, Chlorella protothecoides
MGPFAAVYDIWNTGEVNPKVPTQTWILVIGGAGISIGLALFGWRIIQVLGVRRVERREGRG

SEQ ID NO: 15785 - protein, 656 aa, Chlorella protothecoides
  MOD_RES (147)..(150): Any amino acid
MPVRPALVAARRRVHLDAAVTALLAECGQDLEECDVEDSPELAPLKEALLRARRRRDEALGQREALEAEAQEVAQLAVNAETGLAAARKLLEAAKANLASAEAAAPIATGAPEAEPGSTTGEAGPAAAAAEDQGKAPGPAGEDPLLXXXXAPVAAGAPEAEPGSTTGEAAPAAAAAEDQGEASGPAGEDPLLEDLRSKVRELEHQAAAAAVAYESADRIAAAAMEAAEEAVRDEMECIAVFNEVESALAKTIEGLRQLDSTSDRQEEEWDRASHSSRASGGSLSVSEATEAALAAVAVSTSPDAEADDACMPGACSKTVQTHPLLTSDPFCGHILSTSKNQTHPPQLAKVAAADAKLEDGVTPVTSLPTGASAGSAAVAAAAAAKKKRQAAKRPLSVYVMAAVFVAAAAAAAQHLGMFAALAAGVQLAAERAGAALAVGRGLVAGLPWPHIHIHDSEKGLLETIWLLLSSVITVPLICKLPGGSAVLGFLAGGAIIGPYALGIIQNVSSVRHIAELGVVFLLFNIGLELSFDRLASMGKMVFGMGSAQVCLTLAAVAGASLLLSGGALGGAGAIIVGGGLALSTTAVGMQVLADRGETGSRHGRAAFSVLLFQDLAVVVLLMLIPLLTPSPENAAAGGGERRGFCGGRGGRRSSSA

SEQ ID NO: 15786 - protein, 91 aa, Chlorella protothecoides
MLFKALSVFALRDIDLTKIESRPMRENPLVLSMDYDDSSMRTFNYMFYIDFVGSLAEPKVQNALRHMEVGGGECLKGLALVAFVGGALARR

SEQ ID NO: 15787 - protein, 626 aa, Chlorella protothecoides
MPHPNHDSTPPPKWYLESLEELPELPLVLPEQGQDGVLLPLCGGGRRRRAVGCASEVSDVKYHLHPSKVYKGHHSRWAAASAKNRRCAPWARARTSGICRGGGSEVDTALAGSRNCCTSPVHAGFTLLTDRRRPVRVARASRAMIVVWWPPDKRFPGPDRPDIQSNSRVRVKTCRPPLPEWGCITGELRARGGFHWEQAVATLHRAQTWPDMVATQADQVVIHPLVLLSVVDHYNRVAKDTKKRVVGVLLGETYKGRIDATNSFAVPFEEDERDPSIWFLDHNYLENMFRMFKKRLSMVCTPCIRAASHPRLRPQLSAPCPSCAARERIIGWYHTGPRLRESDLDIHALFASYCDNPVLVITEVQIEVVGCTRQEQVHNPPEYASSHSTPPPHAPPFQPKAMGLPVHAYESVEEVREDGTQKSRRVFVNLPTEVGATDAEEIGWRPATDAIGAGTSHPPPLLQCTPALAICDQAPSTPCNAAQLPLPRQSYPSHSRVPPSLSSPPRRGAPAARRARCDGLHAFLPRRRHGDGPAHASGAAGGGAAIPGGGGGGAPAPAPRHPGRPAGCAHAAAQPGRRQPGPRPLRPGQRRAAQRLRRVPGASGDCAAQLAGEQGGAGRRRGRLHQ

SEQ ID NO: 15788 - protein, 94 aa, Chlorella protothecoides
MLTTPPAPPLSHPKALIDSRYKKVYDGRATTDQEIVGLLIALLFAGQHTSSITSTWTGLYMMAGDQKYYKVRAGGRVLGEWNGGSDPQRVAGQA

SEQ ID NO: 15789 - protein, 196 aa, Chlorella protothecoides
MAAKRVLVPIGNGSEDIESVTLVDVLRRAGAEVTLASVESGLEVTFARKVKVLADALIGDLSGQTFDLVALPVSGGSGGIGQRLRDSAELLVIMRKQKEEGRLLAAVCASPSVVLHHHGLIGDAPATAHPGFSGALSNQEAVQQRVVRSGTVITSRGPGTTLEFALRLVAELYDEKKALDVAGPMVVAAGWEKALE

SEQ ID NO: 15790 - protein, 349 aa, Chlorella protothecoides
MVATSVANLAALPLPTLIGGILVVALAAAVFVRATANLRRGNSPPVEEGVPFVGGLLKFSKDVPCAGLHACSVLDCPGSPDVHPHPSSELVPLLTPAFPASLTHATPSPPSQGPWHLMKSMHSKYGEVFTVPLAHKRMTFLLGPHASPHFFNATDERMSQTEVYSFNVPTFGEGVVFDVDQRVRSEQFRFVADALRSSKLKTYVPAFRQEAEDFFAAWGDTGVVNLAEVFGELIILTASRTLMGREVRESMFKRVADLFHDLDDGMRPLSVLFPYLPTAYHRKRDAARAALSDIFKSIIAARRASGVSEDDVLQVQQAHGPGEDARAQGAGGGHSRRGTEDIPEAYRGL

SEQ ID NO: 15791 - protein, 283 aa, Chlorella protothecoides
MLQSEMDCLKYDNASLEEQLGSARAEIASLKSLNQDMAVEIENHRMLRRGLDGDVLQLRKAAATLQAQLEPKATQQSRRGREKDEALLPAAAASEGQDTAPTKGVGEVGGASATSHSSAGADQEAQRDLQQVEEARIAAERREAECREQLSSVQEDLMQCQATLALRTQHLEKAKKDLSAAAQDHNAMASKLAEATACIQALEAGMHCRVGASRETRLLRSFDAPFPCPCRGIVQRRAAGDSAVSAGCIIGCSTSRGSRCHQQALCSAERAGAGHSWAGRVTG

SEQ ID NO: 15792 - protein, 235 aa, Chlorella protothecoides
MADLLKRLHPPQAQYRDRRFNGTQEEFEEVLRQSTTVYVGNLSFFTTEEQIYEVFSKTGDIKRIIMGLDRQKMTPCGFCFVIYYIRADAEDCIKYLNGTMLDDRPIRIDFDWGFRDGRQFGRGRSGGQRVPGAAHGRGPLHICGGACKVVARLGDCPTPTPHFPLPSSPGPSSQVRDEYRMDYDSGRGGYGTVLRGELSARQQMLSMLSGGMPGTEGGDQLHPRLAARGAEDDDY

SEQ ID NO: 15793 - protein, 574 aa, Chlorella protothecoides
MPVEIHEPIIPTGIKAAPAPTTSPSPSFSLPTPTPKAPISAVKSTVSKTIAPIKEAGKKAAKTVSQAAPSPPSKPSAPFKFSGSINKGTQGDLPEGIALPTPKGASSGGGFPSLPSLPGLTSGQEKGKSEARADQGVASKLASKIQPLKGSRLQSGVEDAAGKAADAVKDAVPSLPTLQSRAKQAAPSLPSLQSKAKQALPSLPTLQSKAKEAVPSLPTLQSKAKDAVPSLSTLQSKAKQAVTSNTPSSGDGPFSFLSKKPQLPDAVKKAASETKAALPTLKSKASGAVNQVKDAAPSGAGPFDFLTAKPQLPKEAGKAADGVASAAKSLASKAADAGQKSTGQGSSFLDALTTKPQLPAQAQKAVEGVKAAAPKLPSAPQPGGGGGLGMLFTSKPKLQQRVQSGVAKTQAAAKSALPGAPSSAKDAVRAATGAAAGLGAGLASQAGKVGDAISAPSLPSLPDAGAASKALSDAGSAASGALSSARSALTPLSPGSPLPQSVQSAAGAVAKQAKAAGSGQGVSLGQRSTQAGAVVAVEVAAVALATAIVGGVTSGGKASMPRPKTKSGTRIFRG

SEQ ID NO: 15794 - protein, 192 aa, Chlorella protothecoides
MVLPEHILVQEALHACQGISGRYVWWQPGKDGGSFALGPGAEVPPAQRQAVSRVAEVGALLRRIEELRRDPPSPLHEALGSAASREVSSLLRLLAILEARAGTRSDALTLRRLEVWLAEPRTRLRVLAGALEAAGARRGGAALDALHALSRHGDPLVRAVLVPLLEAAAAPMFRGIACWVLEGALEPGADFF

SEQ ID NO: 15795 - protein, 266 aa, Chlorella protothecoides
MLPYAREARGTDRDSSPIVHSLSEQEPLPFVIRGSSTGNERATFFGANAASGSSKTIANLNLEGLGDKTLHDVLAQVIEDFGRYQYCMLKKRRLCLSVTRPCSPPCGNNGGMNGVLHVLLHPSQFVSLSGPINPPDQLPHPKLPPTTHRAGHSLLFHGFGSKAGLLAEFAAKWTLDGACFNVNGLQPGLTSQHILAWATAAAKGSKPALYRAYKPADLMELLTSPGGKRVYVIINNIDGPGGYCQGSCVAPGQLPGTWSGLDAEPL

SEQ ID NO: 15796 - protein, 307 aa, Chlorella protothecoides
MPPAVPSPWRVPARWRRGPRLNGRVREDRSSMWVAMKCRGGRGCHMSSVVHAAGLQVVPTQRECLYFVSFTNSELDYNLTSPQVLPLPPLCQPQLIRSHGRSISGSLDSSYSSLSSVDDAFVSSEIMDIEQLKQIEEAEPDKKALNVFLAIAAALLFGLGIWGVQVGGAVHAHMHRVCRASGCLGWAHHRACSWIPPHPLDQGPNKAAEYFAGYLLEQSLSIDNLFVFVLVFEYFKTPRKAQDVVLTYGIASAAVLRLVLIGAGSSIIGRFKPLLVVFAAILMVSSFKLLTWVHPCCAWLTLDGVMS

SEQ ID NO: 15797 - protein, 546 aa, Chlorella protothecoides
  MOD_RES (40)..(43): Any amino acid
  MOD_RES (72)..(75): Any amino acid
MSCSALLLARSIYLAQQRPVKQIFLWMATVELLGPPAEFXXXXNKIHIVRNRPHPVCRESICSPDMSTVTVXXXXNAAFPTLQSRGDLNYTSSVHPIRYTSDEPLFLHPPYNSYHSDPRPESTAAAQPSEASGKRERRKVFKNGPWKCYGGHGRAVDVYQPSPLPETPTLTVPEGRADTPQSSLHDSTVNFKLGKITGRDELTEHLHNVLYRRKGALQSPQASPPKATEETTRAPPVMPGNGTGSENGCAGEAYPGGSPQADGRLRCSTRDRFQAHAAGMSAHVLTTDPLLLQSDKIAALLTFLEAPRQTRDSDLAAQAAKKRAAASKKREREAQGAPRRLWCLQKDAKVKKAEPTKSKGDEEASTLPIQVQGPEAVDQPEILKVRGWSHAYSQWAGQPRISGQASPEVSSHWSFIHVPSSSLSRDGSSQRQLVCLPQMSTEQLRADIEAILKEKSEEELSQLTSKQIQRLLGESAAQMILACVEHWPVQPCTLPEQSSTSYHLTVNATQRTGEKYGFEVRPRKAEITSIAQSYALSRLDGADGQE

SEQ ID NO: 15798 - protein, 406 aa, Chlorella protothecoides
MATPSPQNVLPDTPKSAAAITSKLFIDQMMWAPICTLIFYVYKCFLEGRPRCQAGKSQLGVKICASCIRIFICESLIAPARSSPLCFVAGTASRRSSRNGARQHTDGRLVTLRQNPVALLHPPSLPSSFPPSFLEAVDPSTHLQLCCCPHAAANTLRQCNLGEARGVAGTYILSRCAAEDHRPALKTPLQPLRVGKEGRNIEEGVVRLTVLFDGGWCAQSDNLILSGFIRRQTEVRLNDEGTEPRTAPMQATSCPPSFHFPTSSGETRLLLHGKTPIDNEAGRSSVRGAPFLSEIYYHQTSRYVADHDQKLSDLQLRVGMESTRLHILLEEGRDIATDCSARTRELANIEGQLRQGQSKLGMLQKQVEVHSQELIMMRRQMQMVEERKATALVELEHDRYETGGPE

SEQ ID NO: 15799 - protein, 204 aa, Chlorella protothecoides
MSRQGHQRESALPHSKPPRSLPAPVASSIQAIYNGSQGREGPGKENRQEGGREAQRRHEEEGREQGERTSVTSRDPCPRRLWSGCLNWPTAGSVTALSASSASPLSPQAETYKIYIYKVLKQVHPDTGISSKAMSIMNSFINVRTVGDIFDKMAGETGNLARYNKKPTVTSREIQTAVRLILPGELAKHAVSEGTKAVTKFTSG

SEQ ID NO: 15800 - protein, 163 aa, Chlorella protothecoides
  MOD_RES (100)..(103): Any amino acid
MMLGGMGGVAMEGRYVRKVSGPVVVASSMSGSAMYELVRVGADKLIGEIIRLEGDTATVQVGLGGRGAEALDDSAIDCAWSTAWVEGRCCRPCSHAEWPXXXXGLGGRGAEALDGSAVDCAWSTVWVEVRCCGPCSHAAWPRRLPTTVHLFTVFARCMRTPLA

SEQ ID NO: 15801 - protein, 333 aa, Chlorella protothecoides
  MOD_RES (278)..(281): Any amino acid
MRGIFLRHCVTAASAVAKQMSSSKRAKMVRIGTHSGSFHCDEALGCFILRQTADFKDAEIVRSRDTETLAGLDVVIDVGGVYDPGYSWAWGVCLTCGPCGSQVTYTCPSSHTATARYDHHQRDFKEVFGHGFTTKLSSAGLVYKHYGREVVAGVMGLDASHPDVETVYLAVYKKFMEAVDAIDNGAYGGRDCINQWDAEGPPKYISRTDLGSRVAGLNPFWNDEDQSGEWGQQGVLFGFGCRLLHPHAAWSGVRRFVDSGYPSARPLHSLSRYGRADXXXXINYHSKILATLAHEPCILCRDMAELTSFPLHLSTCSREADGAVPEGCRADGL

SEQ ID NO: 15802 - protein, 364 aa, Chlorella protothecoides
  MOD_RES (24)..(27): Any amino acid
  MOD_RES (77)..(80): Any amino acid
  MOD_RES (119)..(122): Any amino acid
MGIGHMADVSHSGTPLPLHTRSVXXXXLLICFATALAAVAQCRKNIPRMRWMTIDDKTHGRGVPFRNPTATAHKICXXXXLRRYVPSGARHQRLVGFLQSIGIRPLCPQRKQARSWISXXXXSDVMFLQAHSTRSLLASCKVLQSAPFVPSANRLARGFRATLIMAVQHRRVRHILLPGDQRELQERLFLDLQGGSADFAQLAADHSQCPSKGRGGDLGWISPGQTVPQFEEALQAASVGGGPAKCTTRFGLHILQVLDVRDIAAVKQLPVDDFASLMQVEEAEDVQCIDVREEWEASIASIPGFQLFPLSRWAAPSLSMGFVGFSAYVHSNEKIISSQRATALCPSVPAAQILTCVSPLKHQH

SEQ ID NO: 15803 - protein, 341 aa, Chlorella protothecoides
MDGLLLNTEEFYTVVQQNIAADYGKEFTWELKSKLLGLKAIEAARLSISELGLKGQLEPEEFLEKREAALDLLFPSSELLPGAERLIRHLHQHGIPACLATSSNIRGYAKKTTNHGALFSLFTHKVTGDEVAQGKPHPEIFLAAAARFTPPVTPSKSCLVFEDAPAGIQAASAAGMSVGCFCARCHQPKARSVASILNMPPCGLDPFMSKVQTSVSLSSQVEHYGPPPQPAKGAVRRCGSMPDQPHPLCAGGVGPSPLRQCRRKGGVVEMPRARKRLLHDSQAAQVGNLMKSRVNAVAQGTSVPYLPPAVDKRRVRMACPFTLLPLTSQCSACTACRKGPF

SEQ ID NO: 15804 - protein, 160 aa, Chlorella protothecoides
MGSDHTYVLPGAGEKKLSIAAQKRLEALRREVPSDLDVAIDPAHPALRHRHPLRDRPPQRQGHGAPPALHGAGADGGNRRRGGHHGVGPHLRPAGDGREEAELEGLSDAALRELYEGRVVEAREAAGREDFSDMVAAKAAAQKRKAADKAASKDTKKFKF

SEQ ID NO: 15805 - protein, 990 aa, Chlorella protothecoides
MKRGPTGPPKNGPSPPPRSTGPAAAPPKAATLPQAQEVQRQSPAVNAAPIPAVQQPRPVAITQPPQPAPAPESYRFGDIDPAELQPVMATRKAPEAALGQGPPPAPAAAKAEAPRDVPIPVGIAPVAVRTPGVSTAPSSGPLPSSAAAPANRERSSANSTPQSRGRAGEAAPFSRPGPIPPSPSSSAGGSSANVAMHGPNRTPPYHTGQMQAQHRAFVPGSGHRGPSPTAPRGPHQGGSPNLGMNMHYPGAMQGYGAYAYAPGPGYAQHGWQANLQQYAYYPNYGGVPPQYPNYLDQQAGPGQQGGGQQGSLPHVQHGVSTGRGGPPPQGHYAPPTGAPHAQGGSSGPAPPPPQQQQGQGQPAKHVPIKRERRVLVIKDPSTNEAVDLSDVKPAAPTPAGNGAAAVAAEKSAAAAPIAETAASRPSAPAVKVTKSAADEVPSNAPAEAAAKAAAPPAVSKPADDKTTKQAAKVDMPVAKETASPEVSPRDGRSAMEEGDPAVAACVIEYHAPPTISRQATTVPEEKAAEAPAASVNKAELAALVSKAQPTAPVSNEEPAAPAIKAEPAASADNAEAASVEEVAPAVEAKDAKPSVTPVPSAHAGFDSTVSKEEETSEEDTSDTTNEQSADEDMAPTRPHVPVPEGRKRYEAEALLSLSAFCQDPPKGFNAAQFALEITRPAHHAGGSHHERGGGGGGGGGPGGGSSWNKGPRGANAPMGGGFGHGPAAGGPRGGPPRGRAPPNMVGVDGDVWQRGQALPPMPQDHRNDRGNFGGRPGGGRSGGPNMVLHKTESAYKVGAYLSEDPEEEKAQKALKSMLNKITPDNFDKIKGQIVAQIDERKRAATLQSFIDQIFDKALTETSFSELYASLDKLPRLTDESGEVVEFRRALLNKCQDEFQEGVVAMKAVAERELRSKDGAAPDEEKDDAEEGEIEHEQGERAERAAAKAEVEARKRMLGNIIFVGQLFCRGVLTEKVMHSCIQQLLDEVRI

SEQ ID NO: 15806 - protein, 192 aa, Chlorella protothecoides
MWTCPREEDKRSTHLDAANTYVQRVRPVGCACAHGVVLAILCAQADRLTSSLAQITETQLQKAALVAANAKLEDVIAEQRRESGGPNACSKKVIQALQLETTVTQGAAAKTRARLARRKNDLLDLVADICEAHEAREKALALIAHTRGQMDREAAVLEQEWRKLTQILDLERLARVGVDVDDRGRGLMPGSG

SEQ ID NO: 15807 - protein, 121 aa, Chlorella protothecoides
MRQAYLEKAETQKLKSKARERMQPKMGKLDIDYQVLHDAFFKYQNKPRLSKLGELYYEGKEFEADIKHATPGMCSMGKSACTPRLVLPGSLPHSSSSWISVILCCHANHTAVFPQTNRRPV

SEQ ID NO: 15808 - protein, 287 aa, Chlorella protothecoides
MEHQINRMDWLTCRHLARRFLDARSSTHALLQLCPQRSRLALLMSCRMYSCPSSHAQPWHAHNLVKEPLFPPPLTPPPPFAHTQPLSVELGPGIMGTIFDGIQRPLKSIAIDSDSCFIPRGVDVPALDRTKAWQFDPLAFKVGDRITGGDIYGEVHENTLMQHKILLPPGARGTVTYIAPAGEYTITDPVIEVEFGGAKKEYSMLQLWPVRAPRPVAQKLLANTPLLTGQRVLDGLFPGVLGGTCAIPGAFGCGKTVISQVSRPRRDRRGKGGPGGLTRADGVCSRR

SEQ ID NO: 15809 - protein, 313 aa, Chlorella protothecoides
MQVANTSNMPVAAREASIYTGITLAEYFRDMGYNFSMMADSTSRWAEALREISGRLAEMPADSGYPAYLSARLASFYERAGRVKCLGSPAREGSVTIVGAVSPPGGDFSDPVTTATLSIVQVFWGLDKKLAQRKHFPSVNWLISYSKYTKGLEPFYDKFDPDFVSVRKSAREILQKEDDLNEIVQLVGKDALAEGDKITLETARLIKDDFLQQNSFTPYDKYCPFYKSVDMLRNMIAFHNAANAAVERSASSASDGSKLTFNVIKTRLSDVLYKLSSQKFEDPAEGEEALRAKFAALSDEIKDRFRTLEEEYR

SEQ ID NO: 15810 - protein, 258 aa, Chlorella protothecoides
MGAGQSLRPHGRAAPPARDARPTVKQDRPAAAAPAQETAAARPPTPPPVEPAADVKSATATILQEWESLKDLKEAELGLVELLEKRNVPAAAVVDALLNAVLFLKGVSYDSSVEFFQLDFLREKLTQRQFQEGAHILLSNLVDRLEDKPVAVTLTGELLGTLVNAGLLDFSFVTKDLLSADLEAIPEGDDSQLVDSGNAIKVIGAFLRTLSKIEGAEAAKTRLSDSGLKLADYLPAFERDNEEVLQKAVDKFELANLL

SEQ ID NO: 15811 - protein, 163 aa, Chlorella protothecoides
MAGGMYAESPSPPPQPLHHQDGDEAVAIESCEFWSALCEYGDDATVLRPFLPRLLPVLLSNMVFEEHDDEVAEAEAAEQGAAAAGVGQAAERAADIKPFVGRTGGGGGEGDPGDEDSEDEEVARWNLRRCSASALDMLSTTFGDELLPIVLPTIHQRLQVGQG

SEQ ID NO: 15812 - protein, 234 aa, Chlorella protothecoides
MNFTCHTNISQIEGVEIEYVSAPLDFELPGAAPGIKAEAGSENMPVDEPATAGLGSSSLKQEEADAGTAPSTAAEEDPAAELARIMQRFGRVEDMLGTSGAEADEAEERNGGAADGRGDGEAQEQDPGSSDEVNQGPVVLPAPCPAKLSTPLTHSPLPTVNTEGGEAQLSKKKLRAASRLKVAELKQACARPDVVEIWDVTAADPKLLVHLKEYRACAKALVAEESVPPGKARY

SEQ ID NO: 15813 - protein, 189 aa, Chlorella protothecoides
MLRHEARPLRHTAGTCVAAAVGVAGLPHWPELVPSLAGALAPEAPLAATEGALDTLFKLTEEHPRALEERGPGDAGAAPNDTLLPAALRLFAHPSPGVRAGAVAALNLAATGMPAFLCEAMDDYLQGLFGLAHDGEPTVRRDVCAGLVQALTLAPERLQSSLPQLIEYMLGSTQVGMLEESARLGESGG

SEQ ID NO: 15814 - protein, 146 aa, Chlorella protothecoides
MEMKESGVINESNIADSKVALVYGQMNEPPGARMRVGLTALTMAEYFRDVSGQDVLLFIDNIFRFVQAGSEVSALLGRMPSAVGYQPTLASEMGTLQERITSTKDGSITSIQAVYVPADDLTDPAPATTFAHLDATTVLSRGLASK

SEQ ID NO: 15815 - protein, 206 aa, Chlorella protothecoides
GRARERAAVAPDGTGAVTVGVRALSESGTVGGWAREQVELFCISKLINCVLEADEEHVAMDFHLAVSGGGIAATFQLLHLFLEAPAWEGAAAERAKQMYASHARALPKSLERATADRIMTAMMGVDRQFRDPTQEEIAALSLEGMRAAVSAQLRAGNLEVCVVGDFDPAELEDAALKYLGTVAPGDVRDATPAPDRAFALLAPPMR

SEQ ID NO: 15816 - protein, 193 aa, Chlorella protothecoides
  MOD_RES (81)..(84): Any amino acid
  MOD_RES (120)..(123): Any amino acid
MSEAADEDSGPSEDEEGPGDGGTGGTSRAAPAASAAPDGSGPGSAGAEDARSDAETPPASKRARTGEGRPASPGSGKPPSXXXXSAAARPSRSRLGRVGPDPTGPSPAGAEGAGRLAADXXXXAGRGWGGWGPTRRGRAPLARRARGDPRRSRPGCSATRATPGVPCLTPRWPPSWRRRGTTPPGTAATRPGT

SEQ ID NO: 15817 - protein, 301 aa, Chlorella protothecoides
  MOD_RES (141)..(144): Any amino acid
MGDRQGTGLREPLLPAVDHRHATGILQVLARIRRYIIELLAYILYRIQSLLLLGSDSTPQLSPTQSSRWLALKRRASIQYDAADATHLVRGSGYSPPAGIPGRMSVVLRAWPAHVHLFYTPSRHCSGGCGPQASKRRKPCXXXXSIQYDAADATHVVRGSGCGPPAGIPGRISVVASKRRKPCRGGSKLSAGRIWAGRAMIRGVISGEMRFRSSPVLDRGGGLLSLECLVYAAEEHPATFQSLMQKRDGKRSDWEYPFAAAGVNLTFMLAGEAWCWAALLVAGDILEILFQACMQYQRMGM

SEQ ID NO: 15818 - protein, 243 aa, Chlorella protothecoides
  MOD_RES (21)..(23): Any amino acid
  MOD_RES (46)..(55): Any amino acid
  MOD_RES (185)..(188): Any amino acid
MGVHQRKLDCHGDGRATFGTXXXVLWRRGIRPSSTARWIMSQPFFXXXXXXXXXXRLILRKAIRRHCDPHHQSSVMPLNGQSQSVGSAFPIVRESTMAEADQQEAIEICSAIVDKHGAEVERCTHAIRDGLAKHFGAGNWQVVMGQAFCYSISHEVSGWKVGPTCKSMHVEVVNISSAVLLAIGXXXXTDMQEYACRSGERLKRSSTCHRKDLRTVLNPRSPQVNQMICFYPAEKLAILAWKA

SEQ ID NO: 15819 - protein, 92 aa, Chlorella protothecoides
HADAASPQRPGAALRLAQLEGEVSLLRRRANELQKANDRLQQVFRRQITQFREAVYLLFGYRVEMMTDPSARWGWDVLSGGDERGEALFFGL

SEQ ID NO: 15820 - protein, 366 aa, Chlorella protothecoides
MRGFEAFSDQSITVVCVEGVEDPENPCTPGEELGAATGLVFFICIMANMMAFLLARLRVGAGGGVLSLARSARTVGWRSSQRMPGFLGTVCRAGGATAGHAPATPPHTTNPRPISLRSSVQAWFFVFETVQKERERLEGGDPYQQEEESPAAAPGLPVSRAGGGLTNGHAAGVGHAAVPTQVLLEEGRNASHLYGATEGRDADEPRTVQDRIETRDKLRLIRTFFYGVSTYVVANLFVIFLPIFVPTVVDRVILALMNGLLLIFVSVLLWTFRMRAGNAYLVLGEAVGMETTTELGVLSVPPKRVGPSQPVGGGVYDTAFTLDEEEEEEEARLARGPSSSAPRQAGLNRSAARKGVVVTDLPSTPH

SEQ ID NO: 15821 - protein, 289 aa, Chlorella protothecoides
  MOD_RES (260)..(263): Any amino acid
MRSARQRVESGEVPAFRFVEINGLRLASPQHAYCALHEVGRPGRGLACDVEGAEGWCAVLSDTRTVGRFLADWVSSPCEVIGPHTFTPSPHLQALTGERLGPSSAAAALERMFCGGAAATCRSKSAPPKRPVIVLVDELDLLVNRAQACVDRWHAPLCVLTLFVDSAAQGVDAQVPGHTSPGPAFPAHRNPPSPTTIPDGAVQFVRLALPPRLPPVHHRHRQHHGPARAPAPQDREVCAGMDRGSWSRVSWAAPARFGEXXXXGGVCWEGQGVMEQGLLGRACEIRRRG

SEQ ID NO: 15822 - protein, 383 aa, Chlorella protothecoides
  MOD_RES (103)..(106): Any amino acid
  MOD_RES (182)..(185): Any amino acid
MASDPTRRLECGLAHPFPVAIPTSHPPLTPHPPPPHSRLAGRRITFQPYNREQLEIILRARLEGIDAFDPNALVFVSRKVANCSGDIRLALEICRRCGGGGGXXXXTGTPGRRMLWRGRGHSPLRVMCALPMRTCALVHLWPPGTHSCLHGSTAPSPRAAEITELDSLEGKENSQADANAEXXXXLWPPGNSLMPAWVHWPLAQSGGDNGAGLPGGQREQPGRRQRRVLCGPRRGKPHHDEAGAGEHGARRPRHPRRAERQRGAARPAGHPPGAPPPGGGAPGDAVRGPGGGGRGRGAGAPALHALRRGAGAGGDRRGAGGGPGAGGGAPPALRRAGAPPEGQGGAQHARPGAALRADCGRGDALAGGTAGGRRRVSSLSQKG

SEQ ID NO: 15823 - protein, 253 aa, Chlorella protothecoides
MQHGELADGPRRPSRCIPQLPGIWADGATSLLHAASSPQRTHQPRPPPPRPVPGQYISTMRGRASREAASSPSTRRILTKPYEAVEGKPHDNVNSDLIVAVDDELRSQHTRYVVQDLLGQGTFGQVFRCLEMPDVGSGRGGEVVAVKVIKAQPAYFQQARVEVGILQYLNTKADPENKHHIVRMKGLRGLRWRHVGLVGGPTVPGRAQRHALILPASLRHRELPRPHGLPPPLTPRTFSCITTTSAWCSNCSA

SEQ ID NO: 15824 - protein, 233 aa, Chlorella protothecoides
  MOD_RES (111)..(114): Any amino acid
  MOD_RES (198)..(201): Any amino acid
DVRLQRALPALVSAAAEHGAGVKGAALRGIVALLAEVRRVPAGDASVVLEYVLPSLSLLPRDPAPAVQVDGGEGGKGGGCDSLGNRVSCFGQSGVGGGAHGGAPAETELWXXXXGSPGAHGGAPAETELWRVIEEGCQDHACSPRAAWAVRAVSHPSPSPHFSSPRPPFSHPPNPPHQGGACRRAGRPGPRGAGPAGXXXXHPSPSPHFSNPRSPFSLPPNPPNQGGACRRAG

SEQ ID NO: 15825 - protein, 120 aa, Chlorella protothecoides
  MOD_RES (29)..(56): Any amino acid
MAAHPRPFMRLVAGHLRGDWAGLVAARPXXXXXXXXXXXXXXXXXXXXXXXXXXXXWRETLALLLSSAPPAEFEALASALAARLAEAGDAHAAGLCVVCAGDVDAAVGGWSAGLGRMPPA

SEQ ID NO: 15826 - protein, 189 aa, Chlorella protothecoides
EGGGRAGGEGPRRVAPEQEAGQEGRRRPWRGRAVGRPAVPAAAQGLPGRVGRTPVSPDPSFPLLPREHHASQSLKIAQGVSGTVRDKGSVRRNVPFLMQAVRQGFQDFGARSVADAHAALAAGELRLRDRTGAALVEGGIHDMHSYTKQAWPAAAERALKTRKGAPKDPQSVSGRASLMPPHTLGNVRA

SEQ ID NO: 15827 - protein, 556 aa, Chlorella protothecoides
  MOD_RES (182)..(185): Any amino acid
  MOD_RES (420)..(423): Any amino acid
MSGHGGGVRTAPVRIGPPTGCGQRVRNAPNSSALSNFGASTVNEMVRAGALSPSSQSVWPSSRSVWPSSFSILRLGDAGSQSPKLWSVGSPKSVRPPPMRSAKDYMGPSEASFDSPFLPMPLKRHRTLQRLAAARCVEPLVVAPRHESSPNPSGQVHSHKIIITPSSHLVCTQGHSKPLPRXXXXSPNPSGQCGEGLDLILGVGHGIAPGDGSLRIECTESKTPLHPAPLNPPQMPNYLFFLTFLLSYLSMVRGQGSMVLASKRSGMDLILGVGHGIAPGDGSLRIECTKSNTPLHPAPPNPPQMPNYLFFLTFLLSYLSMVRGQGSVVLASKCSGHSQDQMLPQASSAASIPPHPTLPCAAQYTTFAFLYMLEPDGCITKVHQFSHAMWFSVHTSATIGYGHMWDVKAARQEFQSSLQXXXXWKALSQGKALSQRVTDVRAARQEFRSSLQDTGAALTWCQSDQSMARRLTSVITYPCRVCLSQCSFDASFHPLKPSLADMFQGAKSRLRQHQPPDPGGGVDHLPAAGCPAGRCIREIQARLLDRAWQWGMFGPR

SEQ ID NO: 15828 - protein, 99 aa, Chlorella protothecoides
MVIAGEAETGIPDDKRFAVELEFVQCLANPHYLNCEILVWGEELRSEGGGNGRWFNKEYAVLERGQSNTFSARPVTDGRVSQFHSHPLLPLQGWHSSAS

SEQ ID NO: 15829 - protein, 234 aa, Chlorella protothecoides
  MOD_RES (40)..(43): Any amino acid
  MOD_RES (113)..(116): Any amino acid
MRHAVVRCRQLESSHRPHLQPTHSHPEQVHFQDWDAARGXXXXFLTSLPSSTHPFSPPTRFVFRIGMPPEVRIELVRSLAAVEHRLAFGTSEKLQLGAVVGAFAAAKAGIVAXXXXGGAQAGLRDQREVAAGGGGGGICRRQGRHRRLRQLMRGTLSPSCWWSARRCGVFAQSSTCSPCAAGMCKRVLAVPGSFRVHTALSTPGVAEPWRGRDLDSGTEGAQGAAGVAVASPAL

SEQ ID NO: 15830 - protein, 300 aa, Chlorella protothecoides
  MOD_RES (130)..(133): Any amino acid
  MOD_RES (218)..(220): Any amino acid
  MOD_RES (285)..(288): Any amino acid
MPEVIAQYYFRQMAAGMAFLHANHVVHGDMKPDNVLLSGDSTVKIADFGQAHFFRKRDTFNRTLGTPAFLGRLGWYVAMGFGEVKTFEAWKLASAGRSCALHPRLPPSLVASPRSPRGVCRGDIPRPAGXXXXPFSPFSLCFAPQPQRCAPGRHTEAGRPTCGRWGSACTSSSTGRYPSTSVRRVMGLGGWMVDVRGCLDWGLSGSTVTYGRCGPARXXXVGAGWVDGRRKGCLDWGLSGSMVTYGRCGPARLRGTVATCPCRGCDTLNPQSAWPSQHDQAGCPXXXXTGHGGDLPLPGL

SEQ ID NO: 15831 - protein, 129 aa, Chlorella protothecoides
MIRPGALPTTHRNTPHSLQSETVLDLYDQIAGGSVPYPEHVPVSIELQDLFRRILNPDPAARLTAEEVRGRNGELRRESGSDSRVLPAALEQITGHGIPQGEAMRSLVACASMPTTCGRSQAACMSITA

SEQ ID NO: 15832 - protein, 570 aa, Chlorella protothecoides
  MOD_RES (222)..(225): Any amino acid
  MOD_RES (443)..(445): Any amino acid
MGMGMEVPGDPVSRHPHRPAAGSGVVGMIGTGGPPFVALRADMDALPIIEASGVDFASEHPGAMHACGHDAHMTMLLGAARLLKAVEHRLPGTVRLVFQPAEEGGAGGERMVQEGEGGLGAGILYAGNQCGTSATAWVPACRPSSHCALLNPSAADQHPLLPAFLCGTIATAWVPACRPSSHCPLLNPSAAAQHPLLPAFLVVCASFFNEPPFPACTHIHPXXXXPPPFPPQQQKGVFQDVGAAFGFHVWPSLPSGGVYSRPGFFMAGAIRFELVVRGRGGHAAIPELLADPVVASAAIITALQTLVSRETSPFDSAVLSIPKLVAGRGRAQAHNVVPDSVFLGGVVRATSDAAMQRLRARVAEVVAAVAAAHGCVAELDWAEDATPYYPPTINDPALHAFADGVATGWVGLGGVTSIFEGKVKLCQPGRPRHKTTAPKSTPXXXYFYLLGESKALPARTARPQDHSPQINTLLHPPKTTYRLLGAGAVGEYEGTMAAEDFSFIARAVPATFMFLGIRNETLGSVHGLHTDQFMMDESVLPVGAALHASLARKWLEREAAATAPPVQDEL

SEQ ID NO: 15833 - protein, 490 aa, Chlorella protothecoides
  MOD_RES (144)..(146): Any amino acid
  MOD_RES (362)..(365): Any amino acid
  MOD_RES (476)..(479): Any amino acid
MQYSFSLTTFSPSGKLVQIEYALAAVNGGATSLGIKASNGVVIATEKKLPSTLVDEETVKKISLLTPNLGVAYAGMGPDSRVLVRKARKAGQTYYRQYHEQMPVAQLVREVAAVMQEFTRECWGVGLGAWFAARLSLACEHSSXXXCRSSHVSAGGMALGRESGGVRPFGVSLLLAGVDENGPQLYQVDPSGSYFAWKASAIGKNAINARTFLEKRYSEDIELEDAIHTALLTLKDGFEGGFKLRPWPRLEAGRGLASSIGWRCSAWYNLRPQYKFMGAGRPYTTLSAPKPMPTLARLPSAGELTGETVEVGIVGEDRVFRVLTAAEAEGWQARLGGGAVPSTICDRSTNSWPVPPSPTSAXXXXDVESMAASRFLPLAGCSPSPYPLHQHLCLDPCACCALENRAPGQCTYNNLSMRHDIRAPGQPCSGSWPGRDMLARGTERPSHHRFHTLPRSSRKPLGESELVLHWRGGGRXXXXSTHCQGAQEIP

SEQ ID NO: 15834 - protein, 510 aa, Chlorella protothecoides
  MOD_RES (53)..(56): Any amino acid
MRPGERLALFPLTEDTGAFAMGPRSDCCGIHDVHAPRNSFTNFHSLQSDAKAXXXXCCGIHDVHAPRNSFTNVHSLQSDAKALAASPNYWFPLECLDSPATAAEEAAAHLYHTCIAAKDVKGVVGAEYWVQAGSLAPGKTAAVLKTLGIPYSPEGCRLHHPLHPNIPDNRYLRRDEVSAFTWTREFQEKTPHVDDSPGQEHPPSISLMTVKHSALSQLPSGGLHPQDEHLMANEGRLVTPLISSVLYLTGTAQNPQRQGVWLRGAPLPPVAQCRRVHAPAGRMETQVRMPCPPAPHASAGPTVILDQRFDAELGAVTPPSPAWSTLSFPLAGNYCIFDGALGHGVLDAGDEAEMRATLLINWWQHRPEAVGRAPLMPAQAEAAEGGDAGLGSDARWKLADLCLGERALPIPSIAVDAARLAGEDDMLLDRHLNCQLHISQPTPPSPHSQPDNLLAENGVALHGPGAVHAVTFHHQGLSLCPIDGGEGLSIAAALVLAQDGESSSESGDEE

SEQ ID NO: 15835 - protein, 268 aa, Chlorella protothecoides
MVKLTATMLLKFMGADRDPVLLGSATDLSSFGFFQRSTVREMLIFVSRTVARKTAIGARQSVQHEEYLAHVYNRDGLVAVVFTDATYPARAGFCVANQVIDDFTAQDGDSWRRNTSDVETGNALLEAALQKYQDRECALQDIPEHFEWLGGLRVGMELGESLVKGRLASHFWRDSCNARLHKALRQCLPPLCDSQDPTAADKLAKIQKDLDETKIILHKTIESVLDRGEKLDQVGRDASMRFSLIVKIDKPTNEQTSEEFSVRAPLSI

SEQ ID NO: 15836 - protein, 813 aa, Chlorella protothecoides
  MOD_RES (684)..(687): Any amino acid
MRPQGCNMLVDSHGLGRSAMPGDRFVGRWQAPRSGTCTSPCITWSVTPCRLTGTGWLQPHRETAILCNNAGIELAHAKVPAESATSLGACVMTMVPAHLKIQDFGPPTWPGPMARCSLFSTPAPFFAEPPISGKGSAAGGPLLKLRLTSCSNGDILSITVSHLVAGACVMGGGGGITSLPLLWSMQGQEGRDASQKHWTPLSPPQTDQRTPPLHPPSHPDGRHELHLLRRLSELYRGTLGTPLAGTTQACSYDALRPALPPPPPGWKPTGLDPRLTPAQWASLPCAFWRFVAAEQGVHTIHLPREAVERIREVAGGGPIPGPPVSSLDAVQAFLAVLVNSLGGKPLVARAPALLTVNVELLHARLGLAPRVAHQLERAMGNTIQILQVPGLTPGAPTPQHTIASLPCPPRRRGRQERPGYADGGQRSLDSGGGRPDQCPPHPPSAHRGTPGSSSTPLPGDQATTPPNPADRDAAGAARAGGDGIPAQTPAGSQLHRQGRLPEDLRPLRRHRIPIPRGGLRLPLQAPGRCPRRENGPRLGHRFLEGAGLLQAASVSAHAFPRLCLSCQAALVGLCPSNLSHASPAHPLRSTSGQGSSNTCMDSPTLGSSASPTSSQPWDLEQGCSSNWPSQQPMRPKSHCIPSASSNYNIPFPFLKPPQNLAQCAPVPRQHVNQLATVYTTCNLXXXXCAPVPRQHVTQLATVYTACNLVGDNSLAPSIPQWVQSAGLQSQMAWSVRCAKQECLRGFKAINCKSAGMCGCFALHSHRADEERSHESAAGVCLPSLLVEELTRHSKIITLLHQLLDGGGELNERS

SEQ ID NO: 15837 - protein, 1031 aa, Chlorella protothecoides
  MOD_RES (200)..(203): Any amino acid
  MOD_RES (555)..(558): Any amino acid
  MOD_RES (849)..(852): Any amino acid
  MOD_RES (984)..(987): Any amino acid
MRLAVFHQSSSTVCCIPHSPLVGAKPRIQAGNPFGPAIAGCRLTRLRCNEESWTASPTLMVLEADVGIVAYANDAQGFAATLKHRYSDFRVNEIRQDGGVVRLVDTTVPKAAEAREVPLCSAQELIQKLESATGKPASPDLLDFLERVKNGSDSEVVADLSRNPVQSVRPPPQAQVPSSERIHLGPFQDKAQRTAVHGIXXXXSEVVADLSRSPVQSARPPPQAQVPPSERIHLGPFQDKAQRTAVHGIFKAWPTLATETGAEGSIELGLGGGKGIKRRRSEWAGGDARYVKFTMYKENMESQCEGTHTDRSGGGSDAVNSTRVWQRLDLRHPYSPTGLTPTALHTQFTSNTSPQAALSLLGSKLHVSAKVFGIAGTKDKRGCTCQEVTAFRVDPGRLATAAKQLRGISVGDFSFTDEELHLGQLGGNRFELILRGLPPDAEEDVKAACTALAASGFINYFGLQRFGSGPIPTHAIGRALLAGQWDRAVASILGRAGPDVLPTSLQEVKSALRGTPGFAVAETAVLQLKRIVLDASFLVNDALWLLEATAMSSSXXXXKSALRGTPGFAVAETAVLQVPYFSVLMGLAHGCGLTGIGRSVTRQLCAHTPAHSDCFITPGHFPPQIPQALLKHGATNYLTAVQAIPRNLRTMYIHAYQSYLWNSVASFRLRQSRSALLVGDLVAQSKTGAGGPDGSQEFVGSTDQVPLHSENGVEFTEPGANAQEAAAPANMVRHWVGHGRNSTLACTFSPLPCVQTCAGRAVHIISAEDLDTRSYSMSDLLLPLPGSSVRLPENATGEVSGCSKTEQQGQRCWVHDCMTVLTMCRLWPPPQRCTHSRRAPKTPSPLRHXXXXPPQRCTHSRLAPKTPAPLCLGVCPPAGRGRPEPGDLSAWDCGVHPRGTDGGVPPRAEFPGRRRVGAAAPLCTGHGPGGGAGSRAWGRPPGPATGIQPGSLLLRHHGGEGADKAVRRCAACGPAQSRAACLNXXXXLRHHGGEGADEAVRRGAACGPAQSWAACLNPAACCAALQKVWNE

SEQ ID NO: 15838 - protein, 837 aa, Chlorella protothecoides
  MOD_RES (44)..(47): Any amino acid
  MOD_RES (517)..(520): Any amino acid
  MOD_RES (551)..(554): Any amino acid
MLPLSMLSSTCSILISTGLKQSSPSCQITLSPPLSRRGWGSVRXXXXEILPPLPFPGEDGDLYDSSFPLPLPDLVQALKRAVWWVLGGGEAARAQAQGGPGPGLQAQVVETAGRLLGQLCDRNGRRAFVAAEAFHVPASFPVDVLGDLMAADPEAEGGDAARRPQLGDGRGRAAALWVWAPCLIPFHQRVQAFQQAVAQASRAERGWGEGVKPLARMGGVRRWWACFSLGPLAEAPPLLACAQNSRGTPLLACAENSRGGGELAAAHRVLQPGLCARAAGAGADRRLPGPGGRWRHAQGPRPHPVHLGPRVPRGRRRRRGCGVVLHAPGLVTVGWQPLQCVGGVLAASHLIPRMRVSIRSFASPTPSPGPSPPSPSGLFKEFLEEVSKEGFDPGRGLFAVTSDQRLYPAPGAAALVPDAPRLLAFLGQLLGKALLEGTLVDLPLATFFLQKMAGRGCELRDLASLDPELAANLGKLRAYDAATLAGLELTFTVTDVLAGEAREVGVLWGWGGREQGXXXXGHAPRACFPSLPSHHPDVHVHSLSGPASAAXXXXVEGAQGHAGPAEQPSREAGGVVIRGMHAHLGMAHMPASHCCLPITQMFMSPACQVQPQLLACTIRTGSLHDPCLCCFRLFTPSFPSYTVGPIVTTLTQTAPNPQVELVQGGASRSVTRDNVIEYVHRMADFKLNRQLAGPVGAFLGGLHSIIPPHWLAPFSAAELQALISGGEQGLDLADLAAHARYGGGYAADHPSILLLWRALAALTAADQALFLRFVTSCPRPPLLGFKYLQPPLSIQARRWGGRGEGGVISGPGLGNQVHAPDRLRSDLAEPACTSFIV

SEQ ID NO: 15839 - protein, 1041 aa, Chlorella protothecoides
  MOD_RES (294)..(301): Any amino acid
  MOD_RES (370)..(373): Any amino acid
  MOD_RES (501)..(503): Any amino acid
MTAALQPQSGILFIAFGSRGDTQPLLVLAHSISTDPTFRSCRVGFITHAAHTDWIRNLDLSSDLQYFWANSDPFVLPHKVGSKQWIYRKPCLRVYSRLAIPSHSCISPTQRAEQDASQRQCCLSACQTLFAKVPAAARIGLSVCKQPGLIVYNLFSLEGFHLAEAFGLISVAASPCAPPSSAPPGFWDAMAAEDPEFVSSLQASRLPFMRRGGCGDLVSRAHIHEWMWPLFADYWGIWRTAALNLPASPCQFDRTAAPMLLLGEHADTTPRYVTAVQVLVASCAPSLPGHSPRXXXXXXXXPGSKPLLVDLGCSSRMLDLDQQQAFLELVGALARQSTIGIHLLGSQLRLPELDTRVLEGGSLTQDGREXXXXPPCVGLGTFTVSSCIEGPKCGGSAAIRKSTSIAILSCTVISCQAAVPSYMWEGQGRLLPLPRCGNGSWCCQRGCHAAGSQRIRLPGMLKAQTDVQRAFQMPGTVQVHPLLLNQDRHSSGCRPGPRSSXXXGVEMGRGAVKRGCHAAGNKRIRLPGMPNAQTDVQRAFQMPGTEQVHPPTQPTPPLFWMQAGTPQLVAPLHFDQEDWACCVARTGIGIRIASLLDMVHRGTDQGRLDDEAESLAHAIQRLVRDPGVAQRCREMEQTLRGEDGVRAALLQNAWRVEPQHIQFQLAPAAAMGSELETPHHPIRHSLHRCAQGIGLIHSTIRLRAAGTLPILGVVGAVGLVGAQARLPARPGAGVALAAGAGPQRLGVGGDARHAVLPLRRAGVHVGRVDLPQRGVSRAVADRRRAPRPGRPRAAPAAAAGLGPLRQQRDLTRGQRRQGQQVDVGLVPVGHHVDGGGCDELQVGRVVVEAGAPGVDLHAGDHGVVGARGVHGLGDQVLQVVGDGALRHLGHGHQVQRLHALLTHPLVAQAPRQALLQDGHLRVQRFVHAWHLAGRGQAGAPDVGQRAVQRAAGAGLPRAAGAGDGALPPARVDGDVGEGEEDVPLLAGALGDRGMGQARAHPAHAAGQHPAQAVGVEGGSKHLVDLLLQGQGHLVAAQVHHG

SEQ ID NO: 15840 - protein, 974 aa, Chlorella protothecoides
  MOD_RES (286)..(289): Any amino acid
MDCLITWTCVALGRRATLPRVGSLWLQTHHPCLCAWQVTSPACIQTAPDHFSTLSILRQCTVINLLDRAAGTFGGSSDDFDALDASVDPPRLVRSCTGSVAGSTRLSVGKICRFLLISSEQGGDLVWGGVRILDQQTVIVRQKPEVLGVVRRSVHGRASWCLKKSNLVLNARQGVSCASQRSEAIPFLDAEPSKAPSSSIADKDTQQAATHGLQSLLPAAAAHLREQSLTQPSLWGQSLFLLWQSLEQERRQGPLLGRGHRDTGKHYTWRVHSYVGTGRVCSSSSXXXXCHTVVLSVSFCIVCLNLVFTDICVHSCVGTGRVCSSSSRYTVLLPPSALQGSARRRGLTGLGNLGNTCFMNSSVQCLAHTGAGRGGPRLGMTGFSKPIRHPVVLCSLIPSLLSNLRLHVPPLNPPPPFPLSTGSARARSLPVRRVQEGLQRRQPPGPGRQAGTCLRGPGGQALAPRRLPRQPQALQVAAVQVCAPVPGVCAAGLAGAPRVPAGRPARGSEPHPRQALRRGGRRRRPPRRRAGGRGLARLPCAQRLGHRGPLPGHVQIHAGVPAVRPPVREVRPLHVPLAAPAGAQDAGLQGHRWAGAAAAWVQGLKMCTEPSLFCGGGRLTIHLYWYGVGRFRLEAGEQQDDWRAVLPFPRAGQSHSWPGFVLGGGTMASIRAACIGLGGMESAVLPRSFSILSCTLTSVSPSSHSPEHGRWGRAQAVLGHFTQDRHCRAVSGEMVCDVDGRGEFTRELMLHLDDVPGGPWQNTIRGEQRRSGLQAALAAMCQQHSTEKAGLPSSPASQPHLLLARWTPAAGGGQLELLTEAGRKLAGLVPARPAVSLSSGSRAPQLLGYLYADVDSGPAAGKRAVLVHHRSVVWPGVVLQKDASGLSGPAVESADPGCCKSDPPRSTCRINYSTVLPPAVLFLSTEDLEGLKLARIESSTIGPEGSDNVLSAALLRSLRHGIDELVDAVEGEGH

SEQ ID NO: 15841 - protein, 208 aa, Chlorella protothecoides
  MOD_RES (35)..(38): Any amino acid
  MOD_RES (77)..(80): Any amino acid
MGACVSPGGEATLWERDLPAVFEQHERTPAPPTFXXXXGWGEAGFFRLARASLKNPNGPCSIYEAPSYPVKKDEVNXXXXAGARQASSAWRARPSRIPTAPAPSTRRPPTLSRRTRSTLKSPASAATLGCRSAPLTTPARASSTSSTSSASPGAARLGSQRNFEGVAGRRKLPCDDLGRRRAGDVRATCPSVLAAHALPRLAHSASPA

SEQ ID NO: 15842 - protein, 148 aa, Chlorella protothecoides
  MOD_RES (11)..(29): Any amino acid
  MOD_RES (141)..(144): Any amino acid
MATGLSTSPAXXXXXXXXXXXXXXXXXXXPVSVAICANSALQFYSSGVAGDETCCTQLNHGVLAVGYEDGPDGSAESGHWIVKNSWGEGGRRGDAEEGGCLTVKGRVGACVSPGGEATFWERDLPAVFDRHERTPTPPTFXXXXWAEG

SEQ ID NO: 15843 - protein, 282 aa, Chlorella protothecoides
MGYYNACTTSLYVYLACKEIYLPLRYPAPPCLTNSELVDEATFLRNFWSAFNNFSDGSTPESPGMPAYFRFLTLLVVYTPIICLAGLKIFLEQNVDVVILEFVALAPLDSITWTSSDTPCPHTLSSCNPAWLPQASNHPDSMPCRSLQEIAREKAGIFKAGRPAITVPQPADAAAALEERAAVAGASLRVAPSLDTYADGTGSPLHIGLPGAHQRVNASLAIALARAWEEQRAAASPSTPVSARIEQLARCQLPSEYLRGLATVHWPGRGQASHPSSQPEWL

SEQ ID NO: 15844 - protein, 313 aa, Chlorella protothecoides
MTLRVLTAEGARHQEKSHACPSHSNCDLLGQARPRCPDWSEWTPHRIGGKHFKLVSALARPVPGLNHDSQPLLAWVVSGLGKGVTASSIGVLLKACGLRVTSLKIEAVSSSTVLHTRCDSPRRSGSRPRTLPRRPVPECGCRHDVPPGARRSVRPRRRWRGVPERAPLRWEGIFQGWPAPFLAALCRRQHCSPFSNQADLDLGNYERFLDISLSRNNNLTTGKVYQVWCRCLSAYQGCGQHSDRERRFASVRQGMSATPCAQPSPAAASMHPLASTRFTLSPSGGNREGEARRLPGEDGAGRAAHHQRDPGLD

SEQ ID NO: 15845 - protein, 83 aa, Chlorella protothecoides
MWDLYAREFIGTKVDIWALGCLFYLLCFGRLPFEGEAKLQILNGRYEIPPGTPASIRELLEGMLTINVARRWDIGQVRADFGG

SEQ ID NO: 15846 - protein, 403 aa, Chlorella protothecoides
  MOD_RES (277)..(280): Any amino acid
  MOD_RES (341)..(344): Any amino acid
MNLLKALGKRRDGGGDLCGRSLAVDGLQIKVESLIGEGGFASIYRVTEMKSRTILALKHFRLGYESGVGRGGGAAGVGRWDPERILAMGCVHFPTIPSRAPPYFTHRGDPGAVAAVYNEIGIMDELRECPAALSLIAAEFGPGNQEAFVLLEFCQHNLATHLQSLSRPMDLEGILAVFQPVCVAVEALHSLQLPTVHRRCGEMSGPCRKRWAAWDGRLHVLDLNECLSTETSRQRMYYCTATDSGCCAILGAPPLVRWYLGVFWVFANMQWCGRVTXXXXATDSGCCAISGAPPLVRWRVARGPTLPSWRTKSRGIPPQPIVPRRYTVGDRLDHGGGSACXXXXIVPRRYTVGDRSVHGGGSACSAVWPSILLFTRRHPWPLLPDAVPITVSDLSPPKRPSPT

SEQ ID NO: 15847 - protein, 1202 aa, Chlorella protothecoides
  MOD_RES (6)..(9): Any amino acid
  MOD_RES (429)..(431): Any amino acid
  MOD_RES (640)..(648): Any amino acid
MCVQDXXXXKRFIDHEIAAERRSGSHAAGTARSGQALRMTTPAEGRESVCQYISAYSDRPIRVYWYICVQRAACACLVIVQRNSPPVMTDHHPDGLESAIRIFKGLDLSSVPNKCIVQIQVAEKCVRIFRNAASTGPQNLALLRETGVLGALANVLAMRLDTTESYPLATLQLLSMQTFANAAASSPAAVHLCWTLLLEAGLLSALSNFTGMSSLRHALGPVLDALCYFLFLCCQRWKEPHLPKPDVAWIIKKILTLLPQLDHAWDNLPLLIGYAVYESGLAEELLQTSTAELPCTCMILDILCQEAASVPNSEVGTSVATNHLRAMQHLGKLARGIAEKRETLTSDNSLMLVRGVLALGRAIMARDDQGRGLSVHKAPLAEALLQAGFVELLLCFLDMVPAPRKDQAPAGELAAQHTLDIKTDVLAGXXXTGYLVARSGARVSVEFPLSPSFPSSFLIEGEFCGPCLNWKPRQRQEQPTLVFHVAFPNQSSACVLSSFAALANSLYRRKAVQEAVLDSGKLILILTQCQSDHDAPMAREWALLAVRNICEGNLRAQVRVQMKRSHRDWNQCHVAGLYPAYAPCQHPCDLSAERRGELEKGPGIRRVYPSPGRRSDCQRPGTWEESLEGSLLKLLPALLXXXXXXXXXTLQGFSVTWHERARDRRSEEAGAFAWTMQDVLDDPDKVFQLLHPLGRGSYGAVYKARVISTGEVVAVKVIPLAADDEIESIQREIAMLRDCKHPNIVKYYVSGCTACRSQPDARSTNTGPHRLNTLRNGAGKRQDAGLTLDCHGVLRRGVCQRYNARELVQSLRGVDQVHYRRNADRSGVHRDIKCGNILLTENGEVKLADFGVAAQLTNTMSKRNTFIGTPHWMAPEVIQISQYDGKVERPPPSPSQVDVWALGITVIEMAEQAPPRWKINPNRVIFMIVKDPAPRLSDSERWSLTFQDFIAQCLQKESLTRPRSRSLQDVLLRPTAKFLQQHRFISVDRASVLQLLIPMIQRTRAYMSELAAAAAAVSGDTIGAGGTIAMHASPARRQAEADTLAAAYTTTVLADKNIHSSPGENFGAGTFLRHDLFQGTSAAMQSSPAPVQRGDLAHTSGDYSAALSAMSDFDNLDLLPSVHPPWVNAHGKVSAEPSHISAPGARCRNKDTCNITPPCAVGCTKVEGATAYHIHWRIGRTPPLPASKRCVPFSTPDEVLGV

SEQ ID NO: 15848 - protein, 258 aa, Chlorella protothecoides
MQAQAVKIVLVGKYVELMDAYLSVTKALQHACLAASVKLDLEILESGDLEPVTADSPHDEAAHQAAWATLRSAKGILVPGGFGGRGTEGKIAAAQYARTHGVPYFGICLGMQVAVIEFARSVLGLAGANSTEWDPASPAPVVVFMPEISTTHKGGTMRLGMRRTLLETTDCVAAKLYQAEQWVDERYRHRYEINPEYVPQLEEAGMRFVGRDETGSRMGILELRDHPYYVAAQVRAGRGHLHDARLGRGRAHHVAPGV

SEQ ID NO: 15849 - protein, 472 aa, Chlorella protothecoides
MPLRPCNPSTPAFSPVALSVTARGQGHSHHAGARDPRQALPPKAQGRTRALPGLSPSPGTQAPAPDEEQAPIQKPRGIQTELAYLRQRTRIITHHFPSALGVDDFMQRMEIALYAFGFSGDNSIAMVNLCRDEVTLTLKQKIDQVFGSSFNTNGLGGVLTCGVSGVRAGLSHAPVSKGSGKERYVFFSFPHISIDSRGRQGTISRPGRPGQSCACGALDGALADIRRTGLAAACKVPGVHEPLDPEMTILKQRLARRLRYEGVGEEGVQALDLVAMTQVAERTITDDLEYLISQTVDPARADYAVVTGVQIHSWGTSFDDDAPNLEFVAPSTIDVVTNGYKTHVDLLALPALTPRQIALLAEGPESGGGGGGGAGPARPGRPPSVCNSAGHTTLREIDPPYMYASAAQREDRMARIAAYAQALGPGAGGEGDTCSWPGWQSRLRAHEPHRADDSSIHIDQGYRLHATVSLNE

SEQ ID NO: 15850 - protein, 86 aa, Chlorella protothecoides
MMEETYLMELIKEQLCFVSQDPQTDLVASRGKASRHRRVYVLPDGVSDKLGHMLDEAGGETMPIQKDTVRGVLGGAGILPAGQMPV

SEQ ID NO: 15851 - protein, 140 aa, Chlorella protothecoides
MEGEPIVDQGGGTTLPEPGKQAEAIKTTEAKCREASGEPPRPLSPCLHTIVRRWFTAWCQHTGFTYNEARQRVSIIRPSSPGPNPGPIDNSDLLAECQHPAQSTLDEEEAAGVTTLRSGLVEKKHFWALCEPTWELLKGW

SEQ ID NO: 15852 - protein, 70 aa, Chlorella protothecoides
MAFHPGGDKMLLAVAGKDGTAMFDKYHPWVNINFLMSACVVGLLAPPTPGPAGVEWEDDAPAQEHKPDDL

SEQ ID NO: 15853 - protein, 73 aa, Chlorella protothecoides
MDNGGCTIKVGLAGDLSSLRMIPNCTAKVKGERQGYIADTVLACKDVLSLVVRRPIDRGYVVSWDLQRDIWTR

SEQ ID NO: 15854 - protein, 405 aa, Chlorella protothecoides
MGSLSLSVTPCRVALLWTREYHGPLSPWTWAPRLPRLKVSRHPPPRRPRRMVSLGKVSAPKPVNLPSQRKENNGNDPSIDLVRKSANGGWGAASGAPESPTASSCSEQQAANLTSEPRSANGEGIPSAVAPSRVIPAGPTPAWGGLGMPEERKICWPAQPPFAFAGRFSWDGWPVTAPASLWSQHSSLQHTPHPIAQRAMEQASREQFPTLGLDVRGPHGPNSSMGWEGDERGYVAPPGDEDGGHRGYRRGYGPGPGPDGPGYREAPHGRDWYRGGEGYAHSMRPPHLNEDALPRCSGGVRERRLESQDFRRTEEYVEQYVPPPPPPPRVPQPTHPRGGEAFPPSFHQQPTAGAATAGRGPGPNAPSHGVVVPPPPPPAAPRPDRTTSGESGLSHDTSDGTAASS

SEQ ID NO: 15855 - protein, 172 aa, Chlorella protothecoides
  MOD_RES (119)..(122): Any amino acid
MASRNRKEGSAEEPVLSLQLDSSTAGLEPREVDSDSIGGFQTPCTLKGLSAGASGGALGFVFGFGTQQSVGRGSLPGLGDLPRLPAGPLHTPLSPPPMLGGYWFSQRLKGNLRGSLAEXXXXLHTPLSPPPMLGGYWFSQRLKGNLRGSLAEGWGSAKVRVLLWWAPVVVGS

SEQ ID NO: 15856 - protein, 463 aa, Chlorella protothecoides
  MOD_RES (307)..(309): Any amino acid
MRACRQPCSSGAPSSDAQAEPTPSDTLQAAPAFPDTFPHMFGERKDIRWVPVWTGRWGMGGGRYAGWGLTRWHGKRLGSSKGSWAQFPMALSRCSSVRPTQRCAGALAFSMCTAVRRRTTHVDMHQPRLLTLQSSLKPHLPPRPQVPRPLRHRPGPLLPHDEGCGPPPGSPQDGPHRVLLLPRPAGKAGLVWGESWDCRGHEGQPIAPVHLVHAHPRPHARAQGESGKMSASDTASAIFVTDTAKEIDTKVKKYAFSGGGATREEHEKNGEACGVAAVVWVAKVVQVSWHPPGRMAPTRAPLQHSVXXXVVWVAKVVQVPWHPPGSMAPSHAPLQHSGGGWASTCALLTCTLGLDPLLLLSPLPPCPFLLARGQPGRGHLLPVAPFLHAGRHAARGDRARLRRGAAADRSGQGRVGGRAGGDGAATPGRAGGGERRGGRRLHDPSRHARPVPPPGLTVLGVPH

SEQ ID NO: 15857 - protein, 333 aa, Chlorella protothecoides
  MOD_RES (47)..(50): Any amino acid
  MOD_RES (261)..(264): Any amino acid
  MOD_RES (295)..(298): Any amino acid
MPPCTAESEAAWFVTGSRLETNVTTWSSAAGMALCRWDKKPVLSDFXXXXFYPRPYTLLSNWREKIGSKCVFACSLCQVERSPCGRYVHISVKDPWRPLPTLCLSALNRPLAEHDSTSPMSEHPPAEPETSQASEQVVTPWDVTADSEGKINYNKLVEQFGCQKIDPELVARVERVTGVKAHPFLRRGIFFAHRSEGGEGGVGRKALVLSLLPGRMDLTEILDAYERGEPFYLYTGRGPSSEALHLGHLIPFMFTKWLQDXXXXHLGVAERVVWTPLALSYTIELQHRGATPTSXXXXLQGGVRVFSLDVLHCSSDGESKCPFVMLFASAVTP

SEQ ID NO: 15858 - protein, 141 aa, Chlorella protothecoides
MGGLYAAVGCFMQRLRQREDAWNGAASGCATGLALGWANGPLGALQSCAMLGAFSYFMDGMAKVPPAAAAQRTAGGRGHDGDWARTPEEQRLASFLAAPFLHPGRARSTLQAVLSPALPLAVILAPCHPAFGGCRRGGPAV

SEQ ID NO: 15859 - protein, 428 aa, Chlorella protothecoides
  MOD_RES (138)..(141): Any amino acid
  MOD_RES (175)..(178): Any amino acid
  MOD_RES (413)..(416): Any amino acid
MQAKCSPNPLRSPTDPSQMLPTSSRRDRVASKFVENEFEKVDRLVEVYLRYEQRVAAGEERWAWGNGEGQGVEAARSIPRRLGGDGRGRTPSGTHGGRVVHFAAGGGWKGRTWNGSTTGPVWQRGWRTPGYSPHCSGXXXXMDEDELLLARMEAGLFTLQQVEGGREDVEWGYEXXXXVSILPCFPPTPSGCAGAGLSLAAPGGGAEEAGAHAAAPEVALAGGRAQGAAGPSQRPGRGWLRNPGRGVDEPVAERATGQRCAMLRALGHVDAPDGAVAGGAEAATPGQNGVDAPAADGASRDDVGSASEAGRDRDPPSAVQCGAGAMPERDPHRGSARTDGPGAGEADDPAEPGSRTIKEEGRSTDAVSPSRHGRHSRDERGRSPHEKSIARRVDSSVQGRRHRSRSRDDDSPXXXXSRQCQDRWPCRG

SEQ ID NO: 15860 - protein, 430 aa, Chlorella protothecoides
  MOD_RES (317)..(320): Any amino acid
RAGDDAVRAAAAELLGILVQAGGEPREALVAGGGVDALLQAAAPYRARAAEEGEEQEYLENLVTALCALLALSAGQRAFVEGEGGGGKRRGLAAWRWHFKGECAEPGWCLEIVWGSGEGQPLGDGISGVNVRSQGGVWRLCGDREEQCILGGPMVSCSLFHFRAGRPAPGHACDPGVVSRWRGIAAPGGIRGSPTTPPCTILMPTTFSLSSCRHRTDAAHPEGQQRCQSGHPALHRLCHHQLPARLREAGGRRRPQVPLRHLHGQDQGMPVDGGRGGRGLALTGVSSVLCRLPGGGLEEWEVVGQIPNVNQRRAPGXXXXASSWARSRHVGVRWPWWTGSGVDWGQQCSVQVAWWKPGGVGSCRPEPRCEPEDGSWHADPPHTSLRTQTKKADEVDRQEEEERSVSIITNLFQVGRGVWLGVQAAKASIF

SEQ ID NO: 15861 - protein, 624 aa, Chlorella protothecoides
MPNLGAGVPGISATPASGAVQDMNPHHKVGVAEDALVCYCAPEEYLPTLLSSVSLAHDITPPHHTTPPTHTTQTRQLQFLLVDILREFAAAYGPLVVILEDVHYFDTASWVLFWLASKELPRSVLFLATLRPGFAQPAASLRGQDRKAVLLRKVREAYNRLLREPTTLHLQLAPLSAAETREFVAQALAGIRVPDHVTAMLWEKSSGHPAFLEQFVVFLQYYSRVAAAALATGAPAESGPSTFQLVSHGMEFIRNTVGIHSIIQDRVDRLAPEYALLLKVASVGGLTIYVDLLQARLLAAHPQSPSLESVLAGLDYLQSQRFVQQDEVDENLWRFCQVLARDVVFDMIPITQRRDWHGRLAAAMERLAPDLPLPPSTIAYHWLESCAGLEVAQWPRALKAMEYWERAGVAAVDAGTPAEALNLLQKAQDVAEVLDRYFATHTRSVWMIAGGDRGGGLPVVPRPRRIHWERCMAAMGWGAGITREGTTQCMVHCLRGLALARVALPWEEAYLSQVRWRRRLAMDWRPRSRLLRACLGYSPEPVHVAFERRVAMLDHGGNGVGGAGGSVLVGWAWQGTGGWVRRAGMAAMPCPVPRAAGFISRVHVDAGLREWASSHPCIPERGAE

SEQ ID NO: 15862 - protein, 267 aa, Chlorella protothecoides
MATASVRPTVVQGNGAAFSHSLRPPRHQAHAWRHQHGARDGERAPRTCMVAHRHTLPPLSAFHPLLATAADTGDFAAPEHKEFDVLGWGQAMVDFSAHASSEYLEELGVQSGERRLIDLGRRTSLLTQLSEGGYAVHAAGSLSNTLLALARLSDASARLHGRPPLRVGMAPLLGSDSLGAFYAASLRGAGLGLVGDPSPGSSTGTVIVLTGEDAQRTMLSYLGHVPALEVSDEFARAIRRSRLLVIEGYLWEMPGAAAAIDQVGSRR

SEQ ID NO: 15863 - protein, 185 aa, Chlorella protothecoides
QATCIAVAYSEGRLRSYLFPIFPQAGIAFDRLFQLCREQFLVSNETLLSSFLTEFRDHDLLKARYGDGQNRVGSTGIQQWSAWGIVDMCQTSSLCNPDVQENDGRVRSAAPPFCTRSPAAAAGRPCVSYLNSCVFNSCASSTDPMGLVTVMPKVTGMEHEESDEVRSTGLSGCQEIPQRGAAPAS

SEQ ID NO: 15864 - protein, 315 aa, Chlorella protothecoides
  MOD_RES (186)..(188): Any amino acid
GDPSAPLNLSLQDLFRYGWECVGPEGPTWLGVGVTEGVALHAVGDPLCWGCDGTPAAAAEATQDEPASDVPGVRRQLHVDLGVLLGVQAGQSPLQAEQSPLQVGPGLQFLPASCWPASSPLNALLPPATPSPLEDILGVQPGDLGWAPGPGSLAPLTNDAPVSKTHGAPLWVSSNPVPDLARRWAXXXRSKTHGAPLWASRSPVPDLARRWAALAPGLARTWPFELDVFQKEAIVHMEAGRSVFVAAHTSAGKTVVAEYALALASRHATRAVYTSPIKTISNQKFRDFGAEFDVRRDVRAGSWGAKGDVGGDFLG

SEQ ID NO: 15865 - protein, 123 aa, Chlorella protothecoides
MLPTPPLPPPNASPSTPAATQVEDMLRRSFAEFHVQRRQPELTAVLEEGQEALRKLRARSWPRSPLGTTREAVEAYHDVCAEVARLDSLVQGEVAQSRAAAAALAHGRLALVTHPGSGLVGLG

SEQ ID NO: 15866 - protein, 110 aa, Chlorella protothecoides
MGVNAPARTVVFQSLRKHDGHSFRPLLSGEYTQMAGRAGRRGLDAVGTVIVAAWDELPQEGDIRRLLTGGFGAWWSELSHATGEPVPPDLLHDFEPPARGGPQGGSEDGC

SEQ ID NO: 15867 - protein, 409 aa, Chlorella protothecoides
  MOD_RES (325)..(328): Any amino acid
MDRGEPVPVRPRRRVQMECAGRSSSHDRLMSLRHAVRSLLALHVAATTGPCTQQLLDTGTSSNLAANIDPDSPATACSMAVCTSTELGGCASAAKENLILVMSDEFNKDGRGLAVYQNDPLWTAENVGELGLRGQGRKGLGHGIWILCFGAQGDTRGTPLPKPLPPSPTVQLYYQPTSDMEVYTAQQVATGASRGARLDKRLDCARSQALGKPHSQHDIHILPQLSHSITHTACRRVAGDHHQQGGGSGHLPGAGRQFHICGHALCLRHGQLLEQVLLHRFGGALVPSLGTGQRGQPFHVLQGCCALMGEGPELTMSRCLAPYPXXXXEHAFMNEAAASLNIISGYLEVSAVMPGDDFYSGFWPATWMMGNLGRAGVRAVLFGSNARVHAVVFVTARAWGPVRPALPLV

SEQ ID NO: 15868 - protein, 405 aa, Chlorella protothecoides
MKRVRQHAGPLGVVPGLPLNNPHRQSLGAQHPVPQPSAQYPDADVLASSDVVSSTSRTEDLEGPASSRGVANIGIMLFRPKALAFAKVCHVGWRAGALGWCNRCMGGGGAMEGSAHPVGIHEEGGRGKGPKASASERAIQCHASPGAPGGRRPGSVAWTAKPLPHPMLTPGVDGGHGEGRKVLGPECLQRHPAERCPGRAGADRQPAQVRSAGGPVGGRWGQMVVVGEGEVAWRQARRCHWEVPTRTLQPSASGHWASKRISPSQHPARPAAAANPARSPAPPASPAQGLQGLTPGGHSARLHLLLGPDLQGGPVQEAGAGALRHTRHLSVLGHRREAAPPEGVGRLEGGPQGGKGGMAGRHGGGRHACRVGAPSRGGALLAPVHVAAPLLDFAHCWSYPQNVLP

SEQ ID NO: 15869 - protein, 228 aa, Chlorella protothecoides
MMLRAPPHIPPTPPLHSTTRELIEPLAQDKYIMVTWANWHYRDFVGNWVYHLKKTGCSAFVVGAMDDKLLAWLQENGIPTFLMNSGLPTSDFGWGSKSFFKMVSCCLLGWCGIARDLRAAGRHAVGCQAFRSGMGPEGCACGRRARNCEALCGSWDVLAELGEKFHHLCAKAYLWQYWRAPSTTPCNCIRLKPCHQACHTAAIRPRTSPPFPGPREGGPGECLPGNGL

SEQ ID NO: 15870 - protein, 206 aa, Chlorella protothecoides
MSILTPGSVANLKASDAFSEAVTLKVGGTASLDTGWHDGLEKDMETHPPALAHLAQVQQLQEGVNGKYKCQFSDGKENISGILTSQSAQRGPRLYSPSHCFPPPAWQVGKRHGAQLKEDDVVCITEANISSIEDSKVLIVAGMDLVGDREPSSPAPAAPKAEAIKPEVTRVWQRPGHASSWRLMRARHWRLSWIARYHPLSSLAAG

SEQ ID NO: 15871 - protein, 422 aa, Chlorella protothecoides
MTTRCTTPQAATPAPLSRPAASPYGAPASATPINHPTPPSAGWWVHQREHVGPAHAALVGPADHRVQGPPCWASNPSSSPAKPPLSPAQGAAQWGCHPPDHPAHRRPEPLQQQLGHQGQGGVQGPEAQASGPPVAGRAEAWLRTVFHGTHCRQLVPMHVYLAIDQLATPDPVPVRPRDGTRTIPRSLHPIPSALYLNPDSSPFPHHLAASPRTAQPPASSLRSWWTTAERASRPLSGARRQTAATPRWRRGGCTRWRAAPSSPPTRSSPPCATTTRCTLTPERRWSRAVSQHPMGGVEARSMPAHALAPLGGKRAALYTSPPPGPCRALPHHERPPTPPTHPHLPIPCSIAEDDIDVSQMQAKLDPVPIEQLAAFADKKMTVDLLAVVSSVGPLGSVKRKVDAAELARRDVTLVDQGCARIG

SEQ ID NO: 15872 - protein, 188 aa, Chlorella protothecoides
MLSCMSVARARWFPCPWRSCLPVQFCTSRAQTPGRIAEAEAQHPPPVAWASDGLPDGSPGPSQRYASTSADEAGDVGAVASAWKHVKAVSSRDEGRSSDLWDLLSHSLRETQYSPAPPEVMAGREGMKARRQGIRTQLHGITLWLSMCSWCSPKHTRSLLPLSPSQGYAGRRAVPPLTKGPLPCSLPL

SEQ ID NO: 15873 - protein, 147 aa, Chlorella protothecoides
MCLAATIGSACCMCAPIARRRELLQAAHEEGSLVSFAIDEAHCVSQWGHGGWMMCVCLTRYKGLATHPNNVMHGSSIWLCSKLAVHTTTDFRPAYLELVNLRTLCPGVPVIAVTATATSPVQAGIKGGGGGDASHLSLRGAWGGRCG

SEQ ID NO: 15874 - protein, 135 aa, Chlorella protothecoides
MATAGHEIGDPSDCLRAHWGHAEFRSLQREAVEATLQGRDVLVILPTGGGKSVTFQLPPLVARGVTVVITPLLALARDQVQAALDRGIEAAMWAGDTSDTARASIRSSVLAGRGDEGGLRLLYTTPESLRTPPMR

SEQ ID NO: 15875 - protein, 339 aa, Chlorella protothecoides
  MOD_RES (332)..(334): Any amino acid
MASGFVYADTSKGLYKLFHKSHFALAGLVPATLALPSDGFPAKLADVGLAAVLPLHSHVAMNSGEWNSTQRARSRSEINYVASMELVPGSGFNCGSLAVLIPGSGFNCGSLAVLIPGPHALCGCGRVCLPAVPWTRGRNPSPGPLPQTVVTDYVPKALQLPARAGVIGLSAVTFIGLMKLSLTGDGIGGTVKKIWAGNHQQNRPVHKAKCVLKMMMQYRGRGVLEPRLRCIAPIKLWTMALVAVHNMQDPVNYEHHAPASSQQGSLAFEKLIPPDYQCPMLPAYSVEGKQNILLFIQASHAAPFTAFERAVSPKSQSVNSVGNAYNDEKAPXXXEDDTS

SEQ ID NO: 15876 - protein, 466 aa, Chlorella protothecoides
  MOD_RES (11)..(14): Any amino acid
MQARPRQASTXXXXGVLLPKNAMQARPRQASTSGDSSPSSQSGPDLAAATPQRAAGKTLSSRAASYARLPASASCSEMPSAALPAATPKWYSNRVWCAAALFAVLVLCSLNVAKLMGTAHSGVEVVTAAGQGRGGDRRRSRVHSAGEKRVPVIRIWLTLPELGGWSEHAMCCMGWQACPCPMLFPRCALTSRLVHDRQVGTLAGPADAATSDGVESGKFSNGPAPTTASSLADSIVATLSQFTNSTSKSIREWMVVVPANSTNATEAKAADTQGEDCRQDGRVGCSWAGVGWEGAPVANGRAAGVGSSSGESSDLARVLRDCRSQLWCPAPLWEAPLGEGRSCQWCDEGRVHLQIPSYSHLSETADPLGIPSTQSSDSLNPLLAAPLAGEPEKKFVPAELPPAEVWSRSGDACADALKIPKVAILFLTKGDLFHHAVWRLWFQSAAGVLPRAPAHAAACAPGAAPG

SEQ ID NO: 15877 - protein, 205 aa, Chlorella protothecoides
MVGAFFATNAGSSTFYGVEGWRFAFFLVAAISLGTGFLVLHLARDPRHASGPGFGEDPVPLPRQLAVLQRTGSGGIGEPRPPRPPHDVVRYGPESLQARKAAMPEEGPDLPGYAPLRIPEGWAAVAVNGWAGVAGRVRQGAPDGLLSGLHLPVGAGTHAGQALRAAQAPAARHNPRVQLQWIQERDERGAAGTGHPLLPSHDPAR

SEQ ID NO: 15878 - protein, 218 aa, Chlorella protothecoides
MDEGILPAVYFFIGRSLDATLPQLGALTLCRAIVQVRAWGLSHHVWPSLTLSRGGAAPWSSPRGSHISPAPTPSHNPSPLHQALSSPISGILGDRCDRTRVVTAGCLIWGVSGRGYCRDGGYCTQRVVHGPAPDLPRAASRSTAIARPHPGPAHTLGAGDDGGGGGVHLPAPGHGGVRLQRHGTGPRDPQRAERGGGLPPGRAARPRVRPHVTHVQPG

SEQ ID NO: 15879 - protein, 417 aa, Chlorella protothecoides
MVGGHVGVVAVDSGAASGASVSGYTLPSYTASRVNAAKGSLTLSDTSAVALSGACSFEGWGQEGGEGGDGKPQFGRAGRVTRTGLGMRRRDHCFGDLGESHLCMPAAPFAGGPPLRGLWSSDADFKTSCSTIPHRIPPFPSHRPDGTLRATWSFPLNQTLAEAEAAETGFIYAIGPLAGAGVLGSHISGNGHPYGGLAIQLASAGAASPAVAPSPGSAASPSPSVSPSPAASPSPAAQPSPAASPSPPPAATLSCTLVGLSSGAGEEFGSCASLPSFGSGFNLFWTAREASGSNAATVTWGMNTSASDGWVAVGFPASPGEMVGANAAILSSCPTCASGVKLEGYYLAGTSQADVQPPSRIQLSDISASRLDGGGMAGAFTVTLATSGTARRRGLLALGTQPIIVASGPVGADGSIQ

SEQ ID NO: 15880 - protein, 213 aa, Chlorella protothecoides
MRVPATQQFDAPSGTWSATAETPSPVSWIVLVEDGVQVVRQAVTGSTPGRGSGVLLIVSGDKVLSRADRAGQRAPFGHTSDSSSRSSRRRLLATGDCTLDISGTAHSFTACQSVATGFTVYTALEAGVGGVAVLRIGLEAAASGGWAGFGVSANGDMVGGQVGVAATDPGVPSGATVSGFVLPSTSARRVNAANGTLALTGASAAARPGAGGV

SEQ ID NO: 15881 - protein, 172 aa, Chlorella protothecoides
  MOD_RES (107)..(131): Any amino acid
REAERLQAARDDLASRLSAAVDFRYTPPDPRFDAARVRGVVAGLVRVSDPGDATALEVAAGGKLYQVVVDGEATAKALLARGQLRQRVTIIPLDRVAGRALPEAVVXXXXXXXXXXXXXXXXXXXXXXXXXAAAAPALELVGYDADLSAAMRYVFGNAFVCKVCRVGGGDGE

SEQ ID NO: 15882 - protein, 80 aa, Chlorella protothecoides
MSNVGLRRSDYGGKTIVDHSQVCSRQDGLLTVFAPHILPQEEGDVDQEAGMLSEDVRSKGYALLCVSQPHGNVKVRIIPE

SEQ ID NO: 15883 - protein, 124 aa, Chlorella protothecoides
MAPGSSARALPRDVAWVALAGLFYALALYVRHSVYIAGEHYSAPSIVLQVLEGAGRGEAVSGCMPMHICLQGPVRAMQCATRCPPPHTCLPETLRLPLPPPLIPALTPHPPLADPAARRLHQGV

SEQ ID NO: 15884 - protein, 415 aa, Chlorella protothecoides
  MOD_RES (36)..(39): Any amino acid
  MOD_RES (310)..(313): Any amino acid
MPGLHCSALHLVQHRQADPPLLTHMLAVGRAMALPXXXXLRLVQHRQADLPLLTHMRAVGRAMALPEKASSEVFRSLDVEYVFVVFGAFIGASVEISPKGSHLGPAADLFPSTPPLPPYPSDDINKFLWMVRIGGGVFPDIKERDYLNRGQYRVDSTAPKAMLDSTMYRWVRRETWGGRGGEATRVQTACPWAGCVPPAAGMRCYALDTWLQGNGRHGDACSVAVVLSLCGDGAPVWDALRLRPRAAADHWPARLQVSCVKRGGALWGAGGCSILHTVGGTGSAMQCAADAQMILMWPVEALMAAVRPTXXXXTSSELREEGGALWGGGGCSILHTIGGTGIALQCAADGQMILMWIAEALMAAAEALRGGIHLRALDGPRLPRAAGAQPRGPPAKPKQGQGAAWCQGQTQAALW

SEQ ID NO: 15885 - protein, 594 aa, Chlorella protothecoides
MQGGQGMHAESHGKRQQGPQRQGPHRLLLLGHDRRQILRHDTHVPRQRALALGHDLSKMVPAACPPPHRNPTEAPGLDREVCGCDGPGVHKKYGGGCGVHPRGSCPPRVGPRSCAPAAGAQIPHDKHGCDGSRISDLRPRPPPLTRRPAVAGGPGSLTVVDNRTGRRYEIPISDHGTILATDLKKITAGGDGVGLRPFDNGYLNVTACKSAVSYIDGDRGVLRYRGYPIEQLAERSTFLETAHLVVYGKLPTAPEAARWEEAVMRHSALPVAVEAALAALPHDAHPMGVLLTGLAALSTCHPEQNPALAGQAIYASRDVQDKQIVRLIGKIPTLGAWAYHVASGRRPAPPNQRLGYAENFLYMLDGGARPNYRPNPRLARALDVMFLLHAEHELNCSTSAARHLASSGVDVYTVAAGAVGALYGPLHGGANEAVLRMLRRIGHVDAVPGFLEGVKNRKEKMFGFGHRVYKNYDPRAKLIQAVAEEVFDIAGRNPLIDVALALEKAARADDYFVSRKLYPNVDFFSGWVREEGGLPCAPGDTVQAGEGAVASLGHHSMCGRARDLHVRSHRALHRARSTLLEPNPPRQGLPLVAP

SEQ ID NO: 15886 - protein, 458 aa, Chlorella protothecoides
  MOD_RES (37)..(40): Any amino acid
  MOD_RES (113)..(116): Any amino acid
MHLESVTTRVAQSPLWTPSSRQQSVRFQAGSRMQRPXXXXWPLTTLVLQSTRDTRAQWPSKEPICGADVPTMPKLHAANKLQPYTRHGEWRLASKFAQISATYHSPVRSTLSXXXXALVPTAVCAQVYEVITNPSFPCEIYTVVAWEVESPILPAPPTPSQIQLMEAKHPESWVKFELGHISEQDLYDNFWRPGAAGVPFDGAALREHMVSGARCLHACMLLCSWMQMCWFITLYCCDMAGLFFGVSMPHHPQRVSILRAASTPHAPACRAEASSSRLQPHPLCNSSYRRPPGTACSQGWPSCCSVWPPPATSCTPAAITRPGGGRLKHASASATCCPGPSSAARGPCAACASPTPPPSRQPPCIWGSCRRTSFWWMTGRSMPRRHGFTACGPCALWTRAAWKKSSRPRVWNSEGTPETSRVADACCRFQGMGLVVTTPCNLAITSLCWPAAPSSCLT

SEQ ID NO: 15887 - protein, 372 aa, Chlorella protothecoides
  MOD_RES (313)..(316): Any amino acid
MNLILGRLAAGAWDRSCDGVGCLARTQVCEWRGTGGMRRVLRGPNPHQIAPAQLQSDKPAVPLEVPGPAPAVSQPRPGAGQVPDLELPPAPAAAMHGRYKGAGGAPRQTHRQRLQLPTSLSLLGAHADDVQIKFARSSGAGGQNVNKVNTKVDMRLALGRADWLHPDVGAALRRLEHGRINKEGEFVITSQLTRSQACVGVDGGCEAVHRCPYEARRSPQGRRPSSHATSFLTHALTRRDNIEDALQKLQQALDGAWESIQPIEEDPAKKKKLEKQCVLMGAQGVGVPCICLWPTARLPAIPFFSRMSTYYFXXXXEKQCVLMGARGVGVPCICSCPTARLPAIPFFSRMSTHCFESPSPLPPGSSVAMRAG

SEQ ID NO: 15888 - protein, 194 aa, Chlorella protothecoides
MSKQGHGHRRDDVMVAGSGGPVNLRRLSARVSANLGVQSPRDLFEGIDLIPASRLTKVKRLAKGSYCVVDLARLRKPGVGEEEDPGIKVAVKRLRQSAYTERDITCFAREAELLLQLEHFRGITKLIGIGCERSRSDMMWPSMFLVMDLLEAQMEDPRIVLYNYEDAIKWARQIGSGISELHAQKPRVGLSGRL

SEQ ID NO: 15889 - protein, 108 aa, Chlorella protothecoides
MAGTPQVMGPLEAILDVAAHPSDNIASMSFNFWHRLSRVLTSGLQPQPIGSGGAQEGALAPEESRRRLAVFAPVFERLVGLVRGRVRFPDLFDSWHRDEQADFKRARC

SEQ ID NO: 15890 - protein, 142 aa, Chlorella protothecoides
MGRLKRRSHISRSAYPGYEPYIVGFVKLCGNTHSALHLLSLSRTIIPGAKLSYDPEDVFSAVSDTSSYCYLPPEVLRKESYDEKVDVFGFGIILYELFMKRSLVAYFDGQNKNVSTAASEYARQVRGRAKGVWGVGTGRWLP

SEQ ID NO: 15891 - protein, 482 aa, Chlorella protothecoides
MQPQVATDFRDAVLGGDWSSALALLPSLTASEGDASQARFLLTRQKYGECVARGDLAAALATLRCELAPLGVNRRVLHGLAGALVGARGGGGAPRAAPPRDALLAELQHLLPPSLLIPEGRLEELVEQALVAQAEACQYVNAPHPQQTLFADFQAGPEQLPTRCSQALDMHGDEVWALQFSHDGRFLASASKDGCALLWRVAPSGWVTYACHLTRSSSPVNTVAFSPDDAWVLTSGADGRVRLYTLPSGRLAHECSFAASAGGEFAVTAAAWFPDSTHLLAALLDKALYVVDVRGVTQRRLKQTQHVYDCAVSPDGGTLVSVGQDKRLRFHRLADGREASVGEAGAVTCLTPSSDGAFLLANLASAAIHLWPLGDMALPASPADGEAQGEAPPGGQAAGGQGSPDAPRPGDPLDHLAQAPLQEYRVGQAQHGRFVIRSAIGGYRNNFVASGGEEGAVHIWHRESGNLLEVGCWGFRGEESLG

SEQ ID NO: 15892 - protein, 345 aa, Chlorella protothecoides
MADQLLQAVHALYQNPDPSVKEQANAWLDAWQQSPEAWAVSDAVLARPDAGLEARYLCAQTLRTKITRDYEELPPSAVPSLRDSLLRMLLATRDGHAATRTQLCLALASLAAHLPADQWAPAGGGVLAWAEAALLSGPVPAWPLAVELAGMLAAEGASFQPSLRPARRRAFLEELLAALPRALGLLGAALGRPGVDAGVTLDAFAAWLRLGATNGGVPAPALASAGALAVEATVELVYCGAARGAPRPELADLAGRIVSRVMALRPRFHVCCAAARAEAGGGVPGADDDSEEAKALARLFAEVGEAYTELIATGERIGEWGGYPLLIWGVSRIWASSGWGPERSG

SEQ ID NO: 15893 - protein, 557 aa, Chlorella protothecoides
MGGIHCIKSLFGAVFEKLSNVRIIASGTSGAEQNVAVIIWELMRKGPDSGSRGMLLNKGTAWRHPGPQKTTADTPIARQPWFLAWNQLNPPLLATEPNESLLRYVRAPVWPLHGQALSTNGVVFTGQPSEHDHRRVANTYLACMCAGSPVFGWACLLVPELGQKSGRLPRDLGRGVYEVGGRCASAHHAQMCVRTTAFPRTSVKLRHLGRLNSHLSALARTSRTFALPSTGVTSGYRVPRAWSVRPVERGASPRAASLDLALPYPARTSASTTPKVDWAGTVLAPSEDNAPSRVVQVGMGGRDGAGGEIFGGEVGHVRTTPHPPASPVLRLLTPQIHSRAEFDDLLAADPERLVVLMCKALSCRPCKVGLQAEIRPCVAQVWRRPVLRGLWGRVEGAQGETWRLGVGACEQAVMPTGRMAMPVHPSCTAVETRLGRLRRCVASLRALRPPPPHSPCSPQVALPVLQAPVPMRSALPLPNFHPLTLSHPFTGHDDGCPGARHPDLHHVQGRQRRALPRGDQGGQAASSPAGGPTSCTSLVGGCSALPRAPFCRCLDLA

SEQ ID NO: 15894 - protein, 325 aa, Chlorella protothecoides
MKSCPHLSVCIPVPQCLKWSSLSPGAGVQRPSGDSGLGGKSGSKDGTLNAYSLAWAAVDQERKARLGTAESSRSLISCLWSIDRTRDHCSIRNALGCRQVARDGLLTTLYSGSQPLSRTLFGADDRVSILPALQTASPPSPPSVDTCSIDHAWSAKADDNSIILSLRVRTSVVADYISFTFSFEGGPNYHVQIHPTATNVNVEHRAVDVSTTSKGTVVAVATFKDGTEATSKAIALAPFPPPPKKNPPPSPRMSPSSPPEKRPPPQTKKSPPPPARKAPPPPPKKKSPPPPKKKSPPPPKKKSPPPSKKKSPPPSKKKSPPPPKK

SEQ ID NO: 15895 - protein, 240 aa, Chlorella protothecoides
MHTAFTARVVAIPLPRPFRCAGPGPRSRARGGLLRGSDKRIEVPESVRPQWDACAEALEVLGLERKDADKAIGSAFGWGKKKKYWQGAKQDEVPDVQRLAEALEFLSSVGIAAPEDQGKVVKDFPQVLGLSPDLMQHNVNKLKQAYRMKGSVLASSVKRKPKVLGAITDCEGDYGWDEDGCINLVHVLSAAAPPSEAHVQSLHNNPILLYIQRMVSELTEVQLLLVRLKLPTDGSVLCRT

SEQ ID NO: 15896 - protein, 217 aa, Chlorella protothecoides
MEYEEVRSMFGRGHVCFRAWDSGTGNPEALPTWLLAGSGLKTKTKWKNSVERAADRAARLAALIEKHGPLAAAALGVQLTSPRARVPAPPRPKAPPRVKPERPGQRRRSFFPTIRSIQKCGVCAACLNPGWKKACLTRRAEMEALAQSILEADGAEEIQAGPGAEVDEGDADLAGEEEGEDLGLASEDKGEALEPLAEEEGKARDPVAMHPEDMIPA

SEQ ID NO: 15897 - protein, 281 aa, Chlorella protothecoides
MVAYGADEILLWHKRVATFQQAMRAVLGDRRRTFLWSGSVLDSVIGAFLTQNVADHLSSSAFMIMAARFPPAADLARHDHSDSVDWEAVRCADKAQVGWNGMVSWRRTVADAIKGRGMQNFLAARIHDCLNHIRRVNWARSKGQDWASVGHISAKKEAQGPGLEPLSVAADQEGANAGTDPGKALAVGLPLDLEADADELEVEGIPRPEPIMTLTSTPMPDPWDEPCPGMEAQELLSLEWVRDLPPKEAHDFLSSLHGGLSRGPQRLPQPSKHHVAPSWPL

SEQ ID NO: 15898 - protein, 326 aa, Chlorella protothecoides
MFPTIEAACVAAAVLRRETAVDAVELFDRPSIREFECNEAVAKLTPDILGADGGAAALLVECRGQTHDALHARIREIQCALKRAELPFGAKADAPMQVTDYEFWEDPAKYNVYWDVRKGLIPIVGGAREPGTTMLLEDVACPVDNLAAMTRDLIDMFQRWGYDDAYTFGHALEGNLHLVFSQGFRTPEEVQRFSDLMDEMCDIVANKHSGSLKGEHGTGRNMAPYVEMEWGTKATELMWELKALFDPDNILNPGVILNKDPHIHLKNLKPSPPVNPLVNHCIECGFCESNCPSRDLTLTPRQRIAVWKEIFRLENLELLTDEQTHR

SEQ ID NO: 15899 - protein, 96 aa, Chlorella protothecoides
MRQVLGLADVAHGVLGPSFLQSVTGLLNRWSGRLVPEWNPYMPKRAANVDMSPAQPEQLVTDRGIPRKVVYLPACVTRIMGPARGDDQQGEWIPGS

SEQ ID NO: 15900 - protein, 195 aa, Chlorella protothecoides
MELASLRSALDEAPAHPSSRPTAPFIRGDGAFIAELRAKHSHSSQPESRQLLAIASALLEVVREEGLDPTPTALFAAAMASLERPDVARSPPLLAGMATLLNSLLPRVPNPVLRAKFAPASALLRGLLAGAGTDAQLARPALGALCQVLAAADPADWPAALPSFGLVLAACADARPKVRRRAHAGLEEVLAAMGA

SEQ ID NO: 15901 - protein, 435 aa, Chlorella protothecoides
MRDEISPTPQTEEDRRPAPMSLQDNVLPSPPSNAVHGVCSTLLQPAHALLEAVASQAALPKDEDEEPGGDLGPVKEDISQLARALLGLPEDSEPLARRQRYRQLSRHVHPDRCSHPDAHEVFSALQLALEVLQEEMVPAPDIAVGEQVGCGKEDAGPRFQSVAELGRSNDEALGGVRNPARLVLHCLAVPWGMLPPRLARYGSSQRREQLPLFLPEPCEVSAQGSRTAARMFEPEVLPPVAGAEGAASPVPVRHVDMEVDAHLENPMSLAAEQGLEVHAGVETDAVLTADTSLAADDSVDQVDRCAACLEEASDGASPGTILASKEAACSPATHCRGIVLLPASTALLGRFPLNGTYFQVNEVFADHSTVTNPVEVARGSVDYGNGSCKRHVYDMPMRSLSRCKPGRGSYQAEGDYGDSTLYSQPYPPTTRLPVD

SEQ ID NO: 15902 - protein, 157 aa, Chlorella protothecoides
MLKTNKNGGVPYTPILPLLHGLKASLGLLNAEGLDNVFARHHRCGAARQWCRLVPGQWGGVFLVRGHASGLVSQGTCQMTCLTHDPSATSCTSPPAPHAGSLPPPPCRLAEGTRAAVAAWGLKLLCREPRWQSDTLTVVEVPEGVDSQKIVDTAFAK

SEQ ID NO: 15903 - protein, 263 aa, Chlorella protothecoides
MLVAAGFLAEELAHLRLMLDQAAASDLPLIPATPQLLDSRVSSLSSVKEPDWEVPLPDSFVPGGGWGGTRVLLCSGLLGEAQVQLWTLLQNSGLGTIYLAVISPGNAHERLGDAESPSSCTPTLLKQEQQGAEAAGASPPVNAGGGGWRWNSAAAPGAGSDGFDPGSDEEEDGDEDEGESDLEEESEDEDGEGAVFDVLDAEASGSDEEEDEGDLFGDEEEAGEPCAGPVVSRQQVLEASQSWGVDTEALLAEVEAKGFTLTP

SEQ ID NO: 15904 - protein, 121 aa, Chlorella protothecoides
MLVLFALGPPPPSSFPLLTILAPAALLLPTPPRPPPCPPPRFTLRYNLSLGLGLAEVQGKVFRIGHLGNMDELMLAGALGGVEMTLRDVGLPIELGSGVGAALKVWQEGTPVIPTRECLMA

SEQ ID NO: 15905 - protein, 198 aa, Chlorella protothecoides
MRTSPWDPRESLPLEYARVFAFDNFVRTQKRALAAASSGQEAAAPAGTYVQLHVVAVPADAAKRVQERVGAWSARVCCEVEGADGGCAPLQSPLLLARHLDAGPATCATSAHLSPIDQSHSQGLASPLTLFGLLQHETKLSVGHFALTLVPEAPAPLANKEELLLVTGVRAFRACPVFSSDEHGADKHKMERFLHPGR

SEQ ID NO: 15906 - protein, 198 aa, Chlorella protothecoides
MDADPAVLATAGPEERANLDRENVPDPLAGEQTWPTEEVGVGVGGRAPEVARGHRPTSPEVCCMVSSHPELPPLQHSLPLPRQPQELVEAEAERRAAAKLKKRRLPAGTSEYQAAWILDEDEGSETGSEAGAGSDEAMEEGAPAGVPLAEDDVDSLLNGGAEGTEADMDVSTGGIGGMDVAFLAFLGYEGPEAGFTGF

SEQ ID NO: 15907 - protein, 387 aa, Chlorella protothecoides
  MOD_RES (54)..(57): Any amino acid
  MOD_RES (205)..(207): Any amino acid
MGRQRPDAGGGGSPGWTLTSLETRAGFHGARLSMRCNRTHPPTPATPPHPGQVXXXXVQGFMVPASLCAATEPTLQHPATPPHPGQVFVGPPFHTMPLAAEVDYAGMALFIHIDDSSPWVDATSPRWSQNAMVRHGGGAACRGKGSFPEGGRLECPGSARGEGEERAGDSTARWNRDDAARPSAAAPVWVCHSQHAHAPPTLHLXXXGSFPEGGRLERPGNARGGGGRGPAIPRLAGTATLLRIPLPQPLCRCVTHSKLTLHPPSTCSGPHLVSPHTNMQVGSVWTLDPSVAGLVEHVPNLAAALAFLRGLAPGRVAALQAAVRRERLKFYYPPAPAGAGAVTDSGSVLADIVIGRMCERAGVARRAMAAGLSRAAEETRVLPGVAV

SEQ ID NO: 15908 - protein, 275 aa, Chlorella protothecoides
  MOD_RES (104)..(107): Any amino acid
NTPPWQVPCDQGRGLRAGLPHPRPPALLPRRRRVRGAGQRPAPRPRGRQPVRVDARRAGTQCAHPALRRQHRPGPGGCRGRAPRPAPLLPGRVWQPRAGGARPXXXXASTDLDLGAAPDARRDLHLFFQGGCGNPAPEVRGLFGAGKMLRWELVQALGSPGPGGAPAPADVHARCACDICEGHLPHADVLAAMRRAVFCPIIASNAQSSRRLSEAVLSGCIPVGRGDGCCFGRQGKRMGGGMHGVGWRSATSGAKACRWAGLGTVAALRIGQGKG

SEQ ID NO: 15909 - protein, 57 aa, Chlorella protothecoides
MVNCSVCHQRQKDVIITKCYHMFCAQCIKRNLESRHRKCPGCGTAFGQGDVAHFFFT

SEQ ID NO: 15910 - protein, 287 aa, Chlorella protothecoides
MDGGSLARWMPARTSGHQQDLVSLQCRGAAGGDLADQGGGGESAMGCQDAVPGPGPDPPSARLSLYPRPGCASPAYCSGISQNPSSPHSPPPWTQMLDRLDAEMDQEGLDAITHSGEPAGDLARPRRFEIAAAINRVVVHTSRGGWDRGNALWYRTNEGRRQAGQGYVVGVGTELLARATHFERSGALPSSPGHTGCKRFLIPLRRHGEGTTPRTVCAWGRGWDSHLRRGWGKIRVGGRHWLGSVLSADLGYVKGLGPPSTRATHPGCKGPGTWWTARGGGAGGEGG

SEQ ID NO: 15911 - protein, 212 aa, Chlorella protothecoides
  MOD_RES (59)..(62): Any amino acid
  MOD_RES (162)..(165): Any amino acid
MQHHAMHAGRGSGFMVAPIRGTGRPRTAPDPAPGCMRRLPLPARRPFLQAREAHDMAQXXXXAPGCMRRLPPPARRPFLQAREAHDMAQRLADEQGHVCLYAFGVGRGVDRAELLRIISARDASSADSRCVAGEETAAGAGSEGALRLCRAALAQQIHVEGXXXXASSADSRCVAGEETGAGEETGALRLCRVALAQQIHVECRGPMAGAPA

SEQ ID NO: 15912 - protein, 347 aa, Chlorella protothecoides
  MOD_RES (16)..(19): Any amino acid
  MOD_RES (238)..(241): Any amino acid
  MOD_RES (270)..(273): Any amino acid
  MOD_RES (303)..(306): Any amino acid
MSHRSCACSRNQPSPXXXXCMTSFVTQAIEHLDTQETATQVQTGGGAWLRMTRPGHRTPEHPGDSHPGADGWRGMAEDDPDQVSGVSRGSGGPVQQRLPIGAGTLAHRPGSNHKRPGGHGELRPRAEPGVQLQWSRACPVLRLSLCALWSEAPAELVGLPHPHPSSGTPTPFSPDHLQYRMNGGTNISLAVQRAGQLLKPMAPQMRRVLVLLTDGRIDSHQVGGGGGLYLRPRKGGGXXXXWRAIAVESCPVLCSVCYSVLCGVGPQPKXXXXGGMQHHAMHARCGSGCMAVPIRGTDRPRTXXXXPHRLAPGGRRGGSCLRLRKGGAALCQPIPGLSGCGLQRGRR

SEQ ID NO: 15913 - protein, 423 aa, Chlorella protothecoides
MPTIPRCAAAPLTSPEVRLIAQPGLAVAQQEGRGPALDAHGGDKVQYAGVPRRSKHVQDAGCEPPLLNDPLEGGAWQGVDVLRRCLHGKERNLKETLTLKRQTTRSSGTSRRLGTVVMFLAKQSNVTSNRLGTEEAPVAITFIRGNRPASEEGWAQPHPAWRRPRSARASAMSINWEDYEEPLKKPKNPLVLIGVLLGEACIYIASSRPTVRTEPGAGPPLLLNPCRTGCGVTAGVLFAGLVAFKKGNQGLSQKMMRARVIAQGATVALMVASSGGGGGGGLKVCTSAWLEARVVCGADIQEGPRRRGACWGSGQATKVMVLRVWLKDDQDCPLGLPSNLLQNSHEEGDGEEVCQATFYKTAMRKVTGKKCVGVPGMQGRQVYHKWPGRPWGGGSRPAAHRAPGWNAAAGSPMSNPHNTPLPT

SEQ ID NO: 15914 - protein, 184 aa, Chlorella protothecoides
MHTAAVLEEDAARYWDLFYQRNAGKFFKDRHYLDREFPLLLTAPCILELGCGVGNTLFPLAAANTQARLYACDFAPAAIRVLKQHPLYGGRVTAHVADITKGPLAPAVPEGQVSAATLFFALENLKPSLAPGGRVLVRDYARGDLAQSRLSEPGRVQRLADDFYVRWDGTRAFYFTQVGNLRAA

SEQ ID NO: 15915 - protein, 95 aa, Chlorella protothecoides
MYSELISVAISTGGPYAAKTSTVKLMRSVKKVTLRLIEAFVERAEDLAGLASQHVPALMDPVLGDYARNTPDARWALAGEFGGLAGTRAGEWGAR

SEQ ID NO: 15916 - protein, 447 aa, Chlorella protothecoides
MVRGGAQSRGAAAFESLLATEEVTPSTRRSKTSTSKSSKGNLTSGSNPVPGFRLRAEAPKSDGEAKVLADLCQAFAGVFPRDTVADVLHASAGDPDRAAASLLALSGHEVRASDELACGRRDTGLPSPTATAPDLEPISTSDLWSLLPGDLKKMILRQLSVRDLARAARVNREFACVSRNLSSQESRLVLPRGLSPAAVTGAVTAFHHATSVNLSQWHADFTRPEALARIIQAIAAGEGARCGAWVAVAGRWMVADELVLRKCATLGGDSVALICRGLPHLTSLDLRRCMGLGDAAVLALARYRRREAAASAGEAPAEAAHGLLGAVVGPEPGTATSAPHGAGPPLRTEPGPSSWRLGDPLLAPADALAQILAARVERGQEAGTAASGAGALASLALSDVDARALRALWSATAPTAQGLVSLSLHGARRLDLQPLLNKAVGQGRGER

SEQ ID NO: 15917 - protein, 222 aa, Chlorella protothecoides
MPTRCGGAGAWWYYLRRQLVVLDTYASPANRHTNAALAAAHCYWSWALVAPAALLAARAACFGALGVQRLATGTPLPIAAPVLPTLAALALAVSWAYAGLGLGAMTARTLSLCEALNPRLAPGGLFPVFSWGHVAAGVLLNNAAVPVCMALTFCTSHVTWAGIRYRRKGGRVVAVEHPAPAPAGGPTRRGGGHGCRPTGRGGREGKRREARGAAQQDDCDAR

SEQ ID NO: 15918 - protein, 114 aa, Chlorella protothecoides
MGTSDYTLCLDDDVQLPPRLLTWLVRDLASEPGAYMATGYPFDIPPAHPSLLSYAVLSYHLPLVIGFSLSRKTSFVWGGCMLFRSPALRSDSAGLLEVRRDMRRKKACWDEALR

SEQ ID NO: 15919 - protein, 75 aa, Chlorella protothecoides
MTAAAQGDRHIVNCLAPHPTLPHVLASSGIDSDVKVWGVQAGEPAALGAAASILMARNAEEQGSRYSRSYMVSAQ

SEQ ID NO: 15920 - protein, 328 aa, Chlorella protothecoides
MHFTEGIDSTCQQLVPDTGLRHGRKSMLMSAKLVGGHGYAAHLEAVVEDLHLLALLGRPQDIQQRQEVLAGVDGQPEVRPFLPPAHQLPLPPLPHPAPHLGVDSRGPGWGRVCAQSLPQVVHHVAGSEHQDPPVAQRAQAPAHGQRPAAVVQAPAVVQLGTCFPSNLPGQGGIPRGGVLHVVQGRGEAPEVVDGRGVGHGGHARALGLPVCGDAEDGPWPGKLLAESRPDLAALAGLQGSHGAAMCHKNGRQAGEGVRHGMDAKPDEGSDGSGGSDTFSRSAAEQEIADRRGLRQVMFNQLCRHVVMMMARLPDIARDPHCRSGSSIT

SEQ ID NO: 15921 - protein, 417 aa, Chlorella protothecoides
  MOD_RES (22)..(24): Any amino acid
  MOD_RES (83)..(86): Any amino acid
  MOD_RES (156)..(159): Any amino acid
  MOD_RES (216)..(219): Any amino acid
MPIGDKIKNVGANIKVCRNPVXXXEGEGSGIAVLPLLDLCVGRRRACAVPRSGFSEQLPMPVPKHISEGVDRHESIARGLDAXXXXDKIKNVGANIKTEGLRGASIGFGEQLPMPMPKRISEGVDRRESIARGLDSNFPHAYLNSSSYIITRAGRXXXXPGLHHRHRHRYLHREGYHRLRHHRQHHRARRHWRRLRHHRHCWNHRNHWNHWSHRQXXXXQDSTTGTGTGTYTEKGTTGHGTTGNTTGLAGTGAGYGTTGTAGTTGTTGLTGSDTNYSKTTETYGSTGGTAGAYGTEGVTSHHSGHGHSHTSGDTKTHIESAARQGKEQVLGQDYYTNTEDRSLVKERVEQIREHRPVEKEFVVETRATGNERDLVDQRSTEHLGTRERVIEGAERVFDGKTSETHTTGTGHHTSTKY

SEQ ID NO: 15922 - protein, 93 aa, Chlorella protothecoides
MAKQRKLQGEMEAALKKIAEGVDEWEDLWNKYERSHDMVSAEVTLCGGVESRGRRRAAGAVGRRDEARSEEAPGSTRDTWEGCADLRAAQPSI

SEQ ID NO: 15923 - protein, 238 aa, Chlorella protothecoides
MAALETGQSSQVWARLGKELPRPRAILCISAHWETQGTRVTSMAHPPTIHDFRGFPPALYDMQYPAPGDPALAREIARETGAQLDDGWGLDHGCWTLLHHMYPEAGIPVLQLSLDTAKTAAEHLAMGRRLRPLRDRGVLVLGSGNVVHNLRQGLGAHPPPAWATAVNSQVRSWVREGREGELVRWREKGPDFRLAINSGEHFLPLLYVLGAAQEGEQVEVFNDRLEMGSIAMTSYKFG

SEQ ID NO: 15924 - protein, 229 aa, Chlorella protothecoides
MGLGRDALDPAAGLGAAALGQASGALLLAPPSLHSCQAAVRRLAHRRHGPSADRGGWGFLSLPGPDWSPVGRPRVACSVAQLPVCLSSLCQIEACEADVENLGPAGNKAKKTRPGGARGGGGGPGRRPASCRLRLPPARPLEGTPRPGLIARHQQHVTHLEQTLRLLRNDQVEAEEVEDALKEGLEAYLDTGGEAFDPGEDEGLYASLPLEEVGCERRERGRGGGDAGG

SEQ ID NO: 15925 - protein, 124 aa, Chlorella protothecoides
MAGTTRDAVDTEFTAPDGTRYTLIDTAGVRRRTAVAASPDGAETLSVNRALRAVRRADVAVLVLDATEGIAQQDFRLAEYVAAEGRACVIVVNKWDAVAGKGAASLAEFETNVRAEVIGDVSVK

SEQ ID NO: 15926 - protein, 211 aa, Chlorella protothecoides
MADAAALLAPEHLAAAARSISAPGLPAAIERQAAAAVAEAAAVVLCVDGQEGPTAGDEEIVAWLRRTFNRLPVLLAVNKCEAPGSGDLQAAQFWGLGLEPIPVSAISGTGTGDLLDALVRRLREGEDEDEDEEAGEAAAAVGGAAASAAPGTPAAPVAVAIIGRPNVGKSSILNALIGQVGVLLCGGGGRRRQWRQRVQSEDWCLDIPACV

SEQ ID NO: 15927 - protein, 104 aa, Chlorella protothecoides
MEHLDRYETEGLDTAFIDDATMEARMDARAAAEAALARRDRQEGRLTGHRRGLIAALAGDESDVDDGDRPRRRRRLEEAQAGDDDEVGRRRAERREGVVGLGAL

SEQ ID NO: 15928 - protein, 356 aa, Chlorella protothecoides
MPWNADPPLQHTRQGVCLIDEFDKMNDADRVSIHEAMEQQSISISKAGIVTQLQARCSVLAAANPVGGRYDASKTFSENVELTDPILSRFDILCVIRDTVDAVNDERLASFVVASHARSHPDAPPEAGPEAAAGDGEVLSQEMLRKYVTYAKQTCRPRLALADHDKIAQVYADLRRESALTQGMPIAVRHLESMVRMSEARAAMHLRDHVTGDDIDAAIRVMLESFVSTQKLSVQKSLRRKFRRYIVDRADFDALILYKLQECLREARRAEAECLREARRAEAVTGTLADPAHFAVPVRPLTFIPPAPPLQNKRQLEERCKDLDILELGPFFASSTFSGAGFSLSEDGARVLLSRV

SEQ ID NO: 15929 - protein, 928 aa, Chlorella protothecoides
  MOD_RES (136)..(139): Any amino acid
  MOD_RES (178)..(181): Any amino acid
  MOD_RES (259)..(264): Any amino acid
  MOD_RES (324)..(327): Any amino acid
  MOD_RES (635)..(645): Any amino acid
  MOD_RES (830)..(833): Any amino acid
  MOD_RES (880)..(883): Any amino acid
MLTRRVAGPAQQVGLAIWARAAGTLAPPRNTEFALLQDSDLAVFDSILGSGGVITDPHEVDPYNRWGWEAGGGVGVYRRVFGGPIPGPHAARPAPMQRSHAGPRHDDFFGFLSWGREVGVGVGVFRRVFGGPIPGXXXXPRPGSVRAAPTLHGPGLGPAAPLLCAAPGGGAPGRQHWXXXXHAARPAPMQRGLDGKIPRPGSVRAAPALHGPGLGRAAPLLRAAPGGGAPGWQHGAGGRLRARARRGGAQHRPHDHAAXXXXXXAGGRRAGDPGGRGTGARPRHAPGPRGQRVLRHRRQRGHQRGRHPPAAPWAPARLGAGPGXXXXCAIGGNVATNAGGIRLLRHGPLHGSVLGLEVVLAGGQVLDLLSSLRKDNTGYDLKQLFIGSEGTLGVITAVAIQCPAASPATSLAYLAVPSFKAAQQARGVEGGNLVLGPSQGSAPAAGERRASHGWPTRSAVSAAPPLHSRVRPTTAHASPAQVLQAARQNLGELLSAFEFLDRESLEVAKQFLPGARDPLPGSDVRLWAGGRGVLVGARRDQCHGEQCFLLPRRPHPSSSWWRLLGAASSTMPQCWRPSWSRPWARGGCWTGSWRRTPARLARSGRCGRASRKPSGTEVRQGRWGGGCEKCWQWEXXXXXXXXXXXGGGQPLSLLAGGCVLPWLRRLYHDWGIPGSSGCTQGAPRMHTCLTHKGTLRRAWPPRTGAIYKYDLSFRVEEMYGVVGAARERLASAYPSGFLGGGAGSTAGSDTEHALKVVGYGHLGDGNVHLNISAPRYDAGLEALIEPWVYEFTAAHSGSISAEHGLGRMKAPCIGYSKPPEAVRLMRSIKXXXXASATPSRRRRIDIGIQACSSGNAPGGLVIGVPCPAGLADKLPRRALXXXXGPATGVMHGREFSVSHAMHHVCMFPVAGLILESKLVPLAMLKVAL

SEQ ID NO: 15930 - protein, 91 aa, Chlorella protothecoides
MHIGSSATAPSLVQAHPRRIAKVAKQIEREVLQKAICPERRRGIDASMSAVASVTEVQLTRDMQVARVFLSIFSDEEGKAIALQGLQGLEG

SEQ ID NO: 15931 - protein, 594 aa, Chlorella protothecoides
  MOD_RES (415)..(418): Any amino acid
  MOD_RES (550)..(566): Any amino acid
MSSVDDGSEDLYGNATSRLRYEAYRCMGGNSSACRLQAAAVAFGESLPIPEIVAIGGQSDGKSSLLEAFLGVSGVSFRWDERATLFRLHSRLQLAACPVTSQPPHHPWQFRFNVREVEMGTRRPLIVQMVHDSTAEEPRCRLKDEEGEEYGPVIAPPSAVADAIRDRTAEHLAKVGGAVSSVPIVMRAEYAYCPNLTIIDTPGFILKVPGTGASVVVATRSGLAFCCDRGGIPCKFLSSLQSSVVVPETGVSVVVATPSGLAFRCDTGLIPCNFLSSLQSSIVVTASPPSSPPCTLRLAGSQGRGGLHPRRHPGHGQGAVRPLQPPHSLPAAVQRGVGEQPVDACAHRCGPRLLPHRGRGLQVRQPAERVWGALGGGPVPGGSGVPAAQRAALLHRPAQGHPVWRGGEGVPWFRXXXXALPKGSGWGDGMQALIWGVEPPLKMRQRAGGQVFRGRGVTPLPRGLAWRQALHVLPGDQHRSDPGIPQHALLQDRGAVGCAGEWRASIQGVDAEVLRGLREGVAGGFDEERFGTRVGFAALRRFLEAELARXXXXXXXXXXXXXXXXXPRGGPCHAGRAGGALRRAARRLRGAGWP

SEQ ID NO: 15932 - protein, 236 aa, Chlorella protothecoides
MGSGAYPGKAASTYFTNFSVPPCSTHIPQILDLMGYDTPSVWNKINIHVGGSYGDKQATMERWAAAYNRLTPSCRLRMTVENDDRPNSYSVRDLLELHRLCGVPIVFDFHHWKFCEAVHADPGTHHPCPNFATSGDMTQEEALRAAIATWPKGIRPVVHWSESQEGRIPHAHSDYIKGPMNLYGLEAEVDVMIEAKAKERSLLCFRDGLPIPAVDIPSEDPGVGRKAAAAAPFLDD

SEQ ID NO: 15933 - protein, 511 aa, Chlorella protothecoides
  MOD_RES (139)..(142): Any amino acid
  MOD_RES (284)..(287): Any amino acid
MTALARSSNRGTLATFAEYTRGKRSLPVPAIVVPTNELVKPHEKESRFVLPVNDSKETSPTYKIKGCSPPAACTSSAHKLIPSLLDVESTDLANLGYKVDSPKVKAFQDVAAELYPRAVSTTVRISCNTLANFEMAGLXXXXMDVSDYENDPRKCVAAAHRAVSTTFREICVLGHQLLLKLKKLRATVEEAAARNITLLRLPHLLITLGDIPVSDLPQHAQIGAGFRDIKDIASHAGIRMTLHSDITTSLASPHEAVLRSSVARLEALHQVSIDGGLQQNCHAXXXXLFALPAQMMVLMGCRPGVYNKIVMHVRGFPGDKGGALDQLEKNLQWLSPGCRASIAGGSLCRGHNYSEGENDGHLRDNVHTIPHAVENDEFKGQFSIKDLLPFSHATGVPIVDDLHHHPLNPVCHSNWLLKYPPRIPFSHTDGMTEEEAFLAATDTFHRRGEVPVVHYSETDWNKRINSHAKYVKGPINLFGRRAYVMVEAGGGLTALLALRGDIPFPGGPGYT

SEQ ID NO: 15934 - protein, 1103 aa, Chlorella protothecoides
  MOD_RES (60)..(63): Any amino acid
  MOD_RES (216)..(236): Any amino acid
  MOD_RES (830)..(833): Any amino acid
  MOD_RES (1052)..(1077): Any amino acid
MVVLYADGPCLRQPGTSRADEGVRARLGQGGPAEAWQEDKVVAGIVPYTSPVQCNAPSSXXXXCGHRSLYIPPSSSMLPPRPCPPPLPSHCCRRAAVLLPERPPRGPAPLRQGPERGLQVPLQPGQRRRTALRGAGPGAAHGRLRHQPGAQQAPGGAARRKRPAGTVQGGAQDLEQLKSLCTSVTTLCVRAVLDSWRAYPCPEPNNHAHTSLQHQXXXXXXXXXXXXXXXXXXXXXLTSGLHAVKRQRLSLTPPSQDSQGGDGAGHDDDEEEEEGGEEEEQTARPGDTGRPSALGARSPVAPGLASFAMPGARSGRKAGSGAVTAAPGRAGEPAQSLPRPMRMGPLAAFGFLPTPSPPSGLARPGGTSVSDPGPMSTQDDSDGEQPADVAGVCAATLTRAAAQAPAPVHEAAQGSLGQEESQPSETDDQPAEPSRKGLHPFPQPSQAGDPATPAGLGAADTDGDLSEGDDPQVEMAEQDTEAQETGGVKGGSEDEEVPPVVTPPLSRQAGPLKMRVDLEALRRRSEEARRKSGHGEDTGKKARFRAATLQRCAVAAASDEGTDTADPAAGDLAEGRGYLLVVALLKPQLVIHGSALDPSQARPLPHYPPSPTQSVSWSVSSTRPTLRGCKSWGSSTWALSLPAWVRISSSSTSMPLVRVPDGLILLCITVPQDLHQAVWVCAIPTGMDWVTVRAEESAPCAPRPSRHTQTPLHLPDEKANFERLEASLKLNCQPLLQPRRLELAPLEELHVRENLDVFKANGFEFVDDAQGHLALSAVPFRWGACRRPWDGSHGISRMNGIDLRSCCRDDQICSDTVDQRPSPELSINNXXXXDGSHGISRMSGIDFRSCCRDDQICNDTVDQHSSPELSINNPHLCMQQGGGIRRGRHPRAHRSGGGRAACRHPFQNSWEPTPALQTCVSLHASHALAPFPQSSGRPGIQGLPVFHHDREAPLPQHHAASGEHPGWPQIALELPAWAPHNATPVAAARLMSSWIAPRTLCPEAIARPGASLKGMKHEAWIFDLDSRAMRTQEVCSIVHVIILTNDGVSGWXXXXXXXXXXXXXXXXXXXXXXXXXXNRLNSSGDLIPAWDRRDPKFCATSPT

SEQ ID NO: 15935 - protein, 360 aa, Chlorella protothecoides
  MOD_RES (313)..(318): Any amino acid
MAPSIRAIDATSVHRICSGQVILDLSTAVKELLENALDAGATAIEVKLKESGSELIEVADNGTGVSPADYEALTLKYHTSKISQFTDLQVCVNLIPAVLSIYVEQGSSQPQADAPRPTTNQSQGLSSYGFRGEALSSLCTVADVSVVTRTAGEAAGTRLEFDERGRLAGRAAVPRAVGTTVAVRNLFARLPVRLNVRAGGLCGLGFGKWGVGASTPRSSFGRSTCYPGNPRFPPFLPPTLLPRHREFKAGLRREFSKLTHCLQAYALVARGVRLIATHQQGSGPRATVVATQGSTDAWSDVIAVFGPKAAAGXXXXXXGREGGTEQTDPSFRVTGYVSRPGMGGRMQGAVDRGMVVLYAD

SEQ ID NO: 15936 - protein, 108 aa, Chlorella protothecoides
  MOD_RES (69)..(72): Any amino acid
MCDDQLVLQKGRGAHQGVAPAERDIPAVSTGCLGQRLRPWACRGKACVPVRELVADQADLILLRPQHRXXXXLQYIEFVADRLLVALGCDKLYGSVNPFDFMDQISLQ

SEQ ID NO: 15937 - protein, 303 aa, Chlorella protothecoides
  MOD_RES (60)..(62): Any amino acid
MAACAATKATNESVPSAPPVEFFARVTQQVLLQPPPLPSLGAHPCQSTNTQCHAPPHPPXXXGSMRCNQGHKNPVPSAPPFAFFARVTQQVLLQPPPLPSLGPRSCQSTDAHSVTLPPPPFPNPNTGKKAEWALRWIGSGSSFAQRLVAFACVEGILFSGSFCAIYWLKKRHLMPGLTFSNELISRDEGLHTDFACLLYRRLRHPLDQTLVHAIVAEAVTLERGFLCDALSVALVGMNAEAMGQVGAAEWGWGGGRRRALCLQWWRASWGGSCDDQLALQEGRGPCLGVAPAERGWRASDSHG

SEQ ID NO: 15938 - protein, 152 aa, Chlorella protothecoides
MQATCAPCHGGPSAPTPLSPHCNRHTDIYEFYKQAQASYWTVEEVDLSADMRDWVRLTDDERHFISYILAFFAASDGIVLENLSARFMQGGAQVDGRDCSMRAGGCQGVTFACPMMCETLVSPWRTRLVQAPPGDNVMMRTVWSIGVVGLLR

SEQ ID NO: 15939 - protein, 394 aa, Chlorella protothecoides
MTVGSPRPRLAAPSFPFPPPLALHLSCLRDAHPPLPWFTSMHSLGANYWDSAASPTKPSALRFPVRENTIPSFLKSVAAGASFIEFDVQVTGDGVPVIWHDNYVITGTPEAPINRLIADLTYAEFCALVPTSADLPLQKAGQVAGLRAEDAAAAERARRRTRLLRALGGDEPAHRDDPTLAGWECDTEERLPSLAELFAAMPPHVAFDIEVKVAVPSHRAHTPSREVDRLLGPILAGVDAAQAAARSAGQPPRRVLYSSFDPDVCAELAHRRPDDAVMFLSGGGAYRHADPRRTSFAAAVAWAAAAELAGVIFHAGRLRAEPGAVRAALDAGLQVMTYGLDNVDAEYVQEQYRAGVHGVIVDDVSRVVEALTQAGAGGPSRGASPPAVHAAPAV

SEQ ID NO: 15940 - protein, 179 aa, Chlorella protothecoides
MDPGLLSRYWESRPEAAAASRLPEPLSDRAIILHRGVDMVTVEDQFIQQKIDCLISFYILQPLWTALISVARVFGADKGLQENAPPGLGDSPYVQPDASDTGKQSSSGSESPVKSSEDLAESSQRAGPRHNWMLDRQTFRTWVKPPGAGAVEEGFGRGAWGTGESVPCQQVLWVLITLG

SEQ ID NO: 15941 - protein, 173 aa, Chlorella protothecoides
MAKDGEEPKDVPLWKRGGQVEGMDRVRGVCGWGREMLKQTMVLKRFRSVPLADLEMMLPDKTVYIPPNQYVSVGITVISGLVALLTTFLQVRPRGWRGLNHLTPSVHDSRQQGSLALHPPSPVSPQSESMGVIFSGNLLKALGGILLSRAGQVAMQLQAEKASVSQQMTQARD

SEQ ID NO: 15942 - protein, 397 aa, Chlorella protothecoides
MAGCVTFTTSRPSQALRQSRQAFRAQGRRCAVKVQAKVDLQGGPRFVKGKCYVTRDVGGRSSVLWLLSKPLPTCLQNIDTDQIIPAEYLTLVPSKPAEYEKLGSYAMIGLPEQEYPERYVPVDSMKTEYPIIIGGENFGCGSSREHAPVALGAAGAKVVLAQTFARIFFRNCVATGELYPVETDRRLCDELVTGQEVEVDMEANVLKVVETGKTYDLKDLGAAGPVIDAGGLFNFARQGEGLGVWSEGLGAWSAGLGAWGVGGRRRLLCDTRTGTLTCKQSLSPMQREMPHAGDCTETTRAHWGRRCPAWQHESSGENRGVPTPRQRPLRQSLHAGNEETASYLYDCHWAEGLARKALCSGGSYSAGARAEAAGGDPTAWAPPSEGLTTKVRRYGIV

SEQ ID NO: 15943 - protein, 338 aa, Chlorella protothecoides
  MOD_RES (216)..(218): Any amino acid
  MOD_RES (270)..(272): Any amino acid
MRADEASEARECACRCSPYPSPWVRQSPPSGQQSHVPTLPTCSTGYAPQVLPRQDRCGLECDQARRGRGDQQAGEWAVHQEAHPRAHRARRPLSLQGGLPAPRQVQRRGPASGQGRGGAQAHHQAPAGGSPSGGLHPGEREHGDHHPHPLRYPQGGRALGVFLVRGRGGHGARHAAASCVTQYIAGIVVVGARQGTGAGHLGGGGAGLHATATAGXXXRRSSATAGSVDTRKARSDKSGFDAAPAGSGRLGRGIFATHLTCTPLAAGQRXXXYARRVRIGVVLMLQRLGRADLVVGSLLLAWTCTPLAAGQRCLRHPAIRTWAPSLATSVTPPGSLSR

SEQ ID NO: 15944 - protein, 691 aa, Chlorella protothecoides
  MOD_RES (89)..(92): Any amino acid
  MOD_RES (316)..(318): Any amino acid
GAAGGASAAAGGAAPKGLVDNFDDAEGYYQFQVGEVIGPGYEVFAAHGQGVFSSVLRARDVTGRQGEGGAPPPELAIKVIDDARNQPLXXXXSRCVCSLGRGRLAGVVGVKSTGLFTLTGVLHAECQQAPSPDASRPFLVIHPTPVPTRPPPLDPPNPPNPGDPLQRDHVQGGSDGKGHPAQAGGGRPGGQAPLRGVLLDVLPGVGWGGRDEGIQLDGGRDEEIQLDVCHPPTLTPHAIPSPTLSHPLLPHNLTLIQDMNLRELTKRPAACSMLTSSRTTSCEMAGQFVSSLRECGHAWHYSVAAGSHIGGRLAAXXXPPAGLRRAPCRHQAGQHPVRRQGSLYHLCGGMGTCCTTPWLLGLTSAAGLQCRCPVGSRVRAKAPECRGSVPRPHSNDQLIPFLSHTHNRVNAKRTQVKLCDFGSAMFSGDNEITPYLVSRFYRAPEVILGLPYGVCAGVPLELIRGGRQENCPQGDSGPMRGMVPQGAEPRCRVSLPLLRDRINYHTAKKPYPPPPLVPPLLPTDHPMDMWGVGCVIFELFTGRILFPGKTNNEMLKLMMDVKGPFPKKMLRKAEFAYKHFESDANMSFTLMEEDPVTKRPVSHCGLCPPSSNADEHKSGRRADAAPDPQPDGEGRRGSAAGRPVPRPQEAGAAGGPAGPHAGTGPRQTHHAQRGAAAPLHQGAAVGPACLT

SEQ ID NO: 15945 - protein, 141 aa, Chlorella protothecoides
MAAGWNHLRVRHWTAVRLCGMPKRAVSPELVDLTSSPKRQLVDASSHAAVPEERQCVRAASSSHGWPDSPFHLMRVRGLPTWANEGSLGIKLSEVVAGPMRTVLISNYVSGVAGSEILAREGQVVSARACKTRCDPCATMY

SEQ ID NO: 15946 - protein, 394 aa, Chlorella protothecoides
  MOD_RES (183)..(186): Any amino acid
  MOD_RES (294)..(296): Any amino acid
MWRFACRPVSSWPTACTWAPAECSRVLGRVIHAHRPFVMEASPPLLHIPMISAAGDPPWGHLSLRRELARETAFQCAHASTPFLAQFSSLGSVDAKWVDAELAGSAGAGAWRGEGGGTGGMRAPPGIATLVWPTVSEVQNSLEGWLAGRSVPGPTSNVCKPFLERYWHRWGGQPVGRQRAMPXXXXAACLAPPPTSASPSWSDTGTGGGGSRWGGSGPCPTSRPTAASMQRRGRCPGTSPPRTTCQRWGGIAFAASANLAVSGAAFYSISFVLLEYLTSKLRPSLSTPQAAWGXXXVFEYLTSKIRYSLSTPQAAWGVLQKKGTQLMVRSYELGALHLPSLEAAYLASQWRGYDAVTGACTEQPMPGGAVCVCRASQLWRWRGKNGPQKSLHWG

SEQ ID NO: 15947 - protein, 159 aa, Chlorella protothecoides
MRGEVPLLSAHNDGARDQPFGPRPVDDQSVSELGPLTIAQHDGTCEVLFEERPSSCIISLRGPLGRVSLGVGSLAGCPDTPACAPPPGRRLEEAFPLLSPSIRKWLRVHGRTVRPRMTAQQLADMEMCFNMMDSDASGAIDASELSDAFGVSRRDSLLC

SEQ ID NO: 15948 - protein, 548 aa, Chlorella protothecoides
  MOD_RES (472)..(475): Any amino acid
MERYMDPSHLLKEEVYAVFREHPELLVKELEALSKEEHRELVRRCLRALLASGQSPLTLLASDPRRYFYLGELMSLVDLSLTVKMGVQYSLWGGSVLNLGSEEHRRRYFDAIDRFDLPGCFAMTELRHGSNVAALQTEAVLDVETDEWVIHTPDDGALKWWIGNAAEDGLAATVFARLKVPAASGRRELDDHGVHAFVVPLRTAPGRLAPGVDIQDCGYKVGLNGVDNGAIRFTHVRVPRGALLDRFASVDRAGRYSSPMPSAAKRFAATLGELTGGRVGLTAGSLGVLKGGLTIAIRYSAQRQQFGPGGAAPEVAVLDYPSQQLRLLPALATAYALTFAKDALVDKYVEMKRTRDEALTADVHSLSAGLKAYTTGFTAATLSVCRECCGGHGYAAVNRLGALRSDHDIFQTFEGDNTVLLQQVAGLLLKEYRDSFRGSPLAASWSYLRAALGDALPANPLLAHDTTPRHLXXXXGPTCALRWATRCPPTRCSRTTPRHATCATRASSSPRCATALRACCTPWPRVCASTRAATAPSRPGTGACSTSW

SEQ ID NO: 15949 - protein, 86 aa, Chlorella protothecoides
EQNDSAFPETVAVNLWGLDAIKTKGESVAIVLHLVGARPVKEGTGRIARFELIPLEGKADALMWVGVGGAIAHLQTCAPSQGASFI

SEQ ID NO: 15950 - protein, 320 aa, Chlorella protothecoides
MSMCTLQRAAATDEPEDANFIRKHAQEMAKEGHSQTAARLFSNPKGYHEGEAGSGPLVAPGAPWHHKRCPDANLPALWSPGDYGSMVNERVGASNWESGEELGDTWSSRNAFSYGRGGERGRARPEVLDSLLSTTDRVVQTVDSVEYGLTDIQEYYANTGALRAAAETARRRRGREGAGRVGCSVVEATGREDTPPRELEEVLRLEYRSKLLNPRWAQAMAAQGSGGAFEISQRMTALLGWGATTRFAPGWAWDQAAETYALDPDMADRLREANPEAFRNLLRRCLEAAGRGLWTPGEGVLEGLQQLDADMDAELEGVRR

SEQ ID NO: 15951 - protein, 759 aa, Chlorella protothecoides
  MOD_RES (133)..(136): Any amino acid
  MOD_RES (724)..(727): Any amino acid
MTRGPSSLASLAQVGPWTPGTTPPTLTLPAPSLLTVDAGGGVVLDAQVDVLGDAEAKVAGVGEVAAQQLVLLDLQAGLQQLERLLAAHGDVAGDLLVAAHRPLAHGVPGLAEHGLLPVPARRWAKVSPRHREXXXXGDSAGLPLGPRFRLVIGSCTAPAPGRGPCRQPSATSRPLPATRQPLCSPTYCLTIARLSHAAVQHQLRDADFPHGVGCLLVRLQGRGWGGQQGSAPIVSRAGQAGRRRHASVSVRPVHPRGSPPSCRVGPLYSLQAPERGMRSRGRPVYRARSPAGVVSAGGPCRFPATISRTSGPRAQEPCMDGKDEQAHARTSKDDQQHTQIAHSTHPRERAPYIRSNPPKYISRRLAPRICPANMSGVCSGGPASRITSTRSHLLAAVAPRLLRQQRPFSSLGATRRDKESHYAPLYHERSYSASGFHECTIRFSVGRSCTPAARRDTVVSARAIPPQHFASIIEGDTKATPIGDERWDVWRSVVLEGHVWLDGFRRGASPALRAPNRPQQTWPPGRCRSPSAEQHDTNLSSPSAPFPPFSEVEVYAEYVAAYQRTLGIPGAVEFSHGPDGVPCVRLLHPTGSSATVSLSGAGVLSWTAPQGHEMLHVRRGGRRRGAPPAGGVTLAWPQWGPGLALPTDGVLRSLPWTPIQTSCEAENEDAEEEEEEEEEGEEEEEEEEEEGEGEEEDGDEDDEDEEEEDEEEAGAVEPAPQPLXXXXGGGRAGAAAAGQQAQRGAACHLRPRGASLLPP

SEQ ID NO: 15952 - protein, 247 aa, Chlorella protothecoides
MAATLPHPQSPGPSPQAAREMRERLERALGPEAAAQPFIGTFHGLGLSMLRQASSQLPAGCRVRPGFSVADGDAATAMMQRLVKSKAGIDIRQSGARTSAEQKRTVAKQARIILSAISRMKNSVPGYAALKGEQAMLRELMQRRGTELTMQNKIMAREMGQWYEMWWDAAMLGLIPESILTHPMRCCQKPGQDQMGIDAGVSLRCALDSGDARLSAPQPPTTPSTSCAGIATAWHRAMLRTLTTCCP

SEQ ID NO: 15953 - protein, 196 aa, Chlorella protothecoides
MRTQCWDAHGCTHPHVNKNPYRYQKWADDVPNMSLHLGRGLRLDRGALVRPPSHGEMQLSMRMHGIPMQLLGGCRAYQGSVRPIHGSVAPLGSGGSDTKEHLQGLSGEQQASVAAPLGTSLVVAGPGSGKTRVLISRILHLVQAHDVAPHSIAAITFTNKVGRGRSLLCGQNCAWAMWGMHPRLDLVQVTTPRVPD

SEQ ID NO: 15954 - protein, 230 aa, Chlorella protothecoides
MPAAAQQELWPCFSRYPLLRLLDGRLNHTAVVLRRAVAGVGSTCRAFPWCRPRYNRMPPLPGIVRGWKERMHRCLGLPLDLVSNHTHPRIVFINRPLGHGRAFINMEETVQRLQVSRVARDFPTASIVVETLEDESLRSQAAKYAASDIVVQMHGAALGNVFFMPRGAVYVDVVPELNEDKHAWAYFMLKDYAALGINPIALPPQRVELMEYTINKTMRGHLNTLTKTQR

SEQ ID NO: 15955 - protein, 263 aa, Chlorella protothecoides
  MOD_RES (213)..(215): Any amino acid
MTEAAQLTDEQIRAGWGGSVWGWGRCGVFPDRVTDHQNTLSDQASHLSPPVPRTHISHPFAFFTAGDAHTMAACAGSSLIHDPVNPIFYQGTITTKELGTVMRSLGQNPTEAELKDMISEVDADKNGTIDFPEFLSLMARKMKDSDSEEELREAFKVFDKDGNGFISSAEGRSSSGHGIGIAASTLRLHLPWFFETRGLVVTTFTLATRHPSXXXPVGRGSPMAHRQSPRSLIIIICHAAPACDDQPRREAHRRGGGRDDPGG

SEQ ID NO: 15956 - protein, 623 aa, Chlorella protothecoides
  MOD_RES (96)..(98): Any amino acid
  MOD_RES (178)..(181): Any amino acid
MYDDAPETSEPAKEPASGAAEEPSAAPTAAQPDEGDPLSLPPHGADVFVGGVPRTATSDQIRDWASKIGEVGASAEVGMFFSPSINSNRCRQGRAXXXRWVCTSYQAKTPTDAGRGALVRGGLHDLVSEGSQGGGLDSAPQHSMQPAARRLPELTAMRYRTAMLRCGETSDTDTPNPXXXXSRVDGHAIPHANAPMWGDQRYRHAKPTLTPPRCPSQPHALPPSSPPHGLQSSHRRPGPAPQHGAAGPPRVQGEQGFCEDYEFQWLLSDGRGGGRGWESNELARVASVAALDPGRGARLPSPAPEFDCWMGPPPNRPHPAPPPYLPPIQYTPQVRVQPSQSKHRLFLGGLPNSLTQAELRAVLEPALRGLEGVELMMSRENPESNRGFAFLDMYNAAAAKAARAVLSAPDFRVGGRGVTVDFAEPSARGPGADRSAAAKPAPSRNVFVGGLPAGAGEDALREAFARFGAVDRVHVPRPRDGEPASKFGFVTFAEREAATAAVEAGDEVEVAGEHVTVRYGRSEPGGARGRGRGGGGGRYGAAGYADMGMGAGQGGMVPLVPVQLANGQVHRKGGGTASWRPCVSDAGGFSRARRAPCYCSSGTASVSSSMTPSMGRSGQPPTQ

SEQ ID NO: 15957 - protein, 180 aa, Chlorella protothecoides
MGSMTLLCWNVAALVSVQDTFDSCGIQKLHPGKFPGTHTTFMQAPTLKNIALKYGSLSDLFGELELDIACFQVLVLVMVVVQINDRETKLVEAQLTKEIVCVDDCEVNAVKMVLFLATSLVGDSYWAVSREKKGYSGVVTYARGQWRAAHAEVDCLASGESDIDREGEAGGRVRCSSACV

SEQ ID NO: 15958 - protein, 305 aa, Chlorella protothecoides
MASFENFDDDRDQIYISGLPRDVTEDQLASHFGQIGTIKLDKKKRPPTPKARIGVLDVAGNGARWLRARHPQPSRIEVQGFAHPPGTHPVRPLRGLTAKNSWASDGCPGCPVVFGGWVARLWTAWPAPRPTPAARTTTKAGKTLHVSLAEKPRAAAGGEAYGRGGGGGGYGAAPGGGYGDRGGYGGGGGGGDRGGYGGGGGGYGGGGGGYGGGGERGGFAALSPPTVPPLLNAAPAPPDTWLSHTLAGGGRGRGGGGAREGDWLCPGCGNNCFGWRDVCNRCNTPKGDAGAGGGGGGGRGDFGGG

SEQ ID NO: 15959 - protein, 261 aa, Chlorella protothecoides
MGLDYHTALRLNDTLTSPAVAWLPPGLRRSALEAGLALGQAAAPALGTLRSRNIRAALEGGETLRLQYPKEDLGFVYRSPDAALAPSAADLAEVDLAARPRPRHAPYTPATLVGGRLPHAAVDAVISRGWLAGGAAGPASTVDLSCLAASPTPLLLLLPSGYKALERRAWLAAAERLGPQRVLPVVLHLGRAPVGAAAERTNALELQCDPASGAWATTGGARVLLVRPDGHIGAKWSEQVADAGRAQGALEQALAAVMHCA

SEQ ID NO: 15960 - protein, 140 aa, Chlorella protothecoides
MLGDLLGSVDHFPGQASPHLPLLSPEPVTHLSQHKLVPLLWQAALADPLVGAALADPLVQVLAGCSVRSVRPGEGHVEVDIQERAAGTLRTLRGAYVVAADGARGGLRQAAGVELQGSAGLQHLINIHFVSPEVRGLVEG

SEQ ID NO: 15961 - protein, 111 aa, Chlorella protothecoides
MEDCIITEREAQQIREQLKNRRKSPGKSKLAGSSGPLARPIAPREPPPVKKAFRTFKERWLSCAGDLDTSQQLKAVEQGIEIFSLLPKESKYAQHRLKLLRKVQLLLTSTE

SEQ ID NO: 15962 - protein, 208 aa, Chlorella protothecoides
MPQRHARCLLRARRPGGCASVGNPRPRFVIPAPLSSPDTGDRPVDDAALPAPALEEMKQADKGQVYSMADKPWWGWLEDKQVGRQLGGQGSRVAQKGRGKRRHAGVGLDPRRPGQPAARRRRGGRVEDRAKAPVGAGARAAGVCLRHLQEDGGGPGVHALRCVARRQGRQRGGAGWCSKAAGTIHGRARSTSAWPGASAAEFARMAGY

SEQ ID NO: 15963 - protein, 93 aa, Chlorella protothecoides
MRMLRALRFAPKPGKLWPRGVSTSPCPGLDAEVVIAGGGPTGLITALLLARWGVRSVVAERSTALTQHPQAHLINHRSMEVMRAVPGGPTSCT

SEQ ID NO: 15964 - protein, 94 aa, Chlorella protothecoides
MQFSAKFCANPRINTALTMAIRAFKIGTVNPSSKPFERINDADRPDEAFTTDRAVRAGRANAARWALSSGVVWRRRSLFECSRMLPFAPWLVPL

SEQ ID NO: 15965 - protein, 438 aa, Chlorella protothecoides
MLGGLFGALPPPKQASSNPAQAITEDTKRTSTHDVGVPGPALIKRPRVEAASPPHSRISVEAASSEDAGCRPSMEERDPGIDASSAFPACSDLIITPPTPERVHPPPHPTTSRRPGFYAVFDGHGGVNVARLASTLLHEAVLAAGLARLSGEAGLGPGAMDRARAARAAVIEGYRAADAAILARCGEEGWRDGAAAVTLWTLGGTVVVANVGDARAVLARRPSKGEGSTAAAEAGDGSADTNGVPTDVLVEAPDASPAPADTDVGAADASAAPAVAGTAADTDEEEPARAGATPLALHHAAPHDAHDRGMPGGQRDAGPGSGPPTPTRTTLRALMLTREHRAVLPAERARIERAGGWVGPDGRLLGRIELSRSLGDAAFKRRGMSAAPDVAVFEAGGRDVFLLLGCDGFWGEEGRGGAMHQQEDHVGIARACGGHCAG

SEQ ID NO: 15966 - protein, 430 aa, Chlorella protothecoides
VRQPLPLKPGTGAVCIDAARPPAAGFRLEVGPALPCLELALEGLSPTCLAGQVALATLRLRNAGGVPLAGLRLAGGAGWHLAGAVPAPGIDGHALSLGQRLLVSSEAGDWAAGGVTEGAEPVQAPGPPALRGQFALKNLAWTLVPGTPARLYSAPEVQLAPGEELSLPCVIRYRTMVHAGRARGLARPWVGMPVWELLSLAGLKPPGPGAWGAVGRARQGIQRRGAVGHPCGRATGSNFPAEDRSMLIPCQTPLHLQNNNNTLRLTRPGPRLLCIAASYRVAGGAVQGAAQRSTRCAFETVVQPSLQLSAAVAAGTCEPGAALLQLGVVNLQGLEAFELHRPRCPGWTSSDMGGGLEGGAHGDAGDSPAAPPPRVDELAAGGAVTRHAWLRRRDPARPLPADCDVVLPWLAAKRAGAGARRGLSAVPRQL

SEQ ID NO: 15967 - protein, 278 aa, Chlorella protothecoides
MTHELAHLTHCPFQPLVLVQPGVLPVALCMGPHPTPTPTHPRPTPNPPLPNDFPHRRPALTPPSRLPPRLFIGGFLMFICGFMEFLRRNTSGATMFTLFGAFWFTLTIYNLLLFAGVATFMLTAMPKTVACLAGTLGFITAVMAIVVANLTLAVATAQGLLALFLILLAAAQMNPANHTLLKVGGAFGIITAIAAFYVAMALSCEEVLGQEILPMLYSKKFKMHAGNLYPRISLSDPLALSAGVPYEGRYEIHKGDNVAAMQQPSLVDLNRIQADQRV

SEQ ID NO: 15968 - protein, 430 aa, Chlorella protothecoides
  MOD_RES (120)..(122): Any amino acid
MTTPQTLPSLPSGDRVCGPAVPHLWRDGGHGGGELPGPLRPCAGPVQRPRARVQHRAAGQAGPAPGGAALRGQGHGRVLQRHPVLRGNCGAHAARQAGRNSAPPSMKCTTRTLCLAPLTXXXDAARQGGAGCGGGTGGDWGVESGGSRGQPGDGLLLGGVSAGPNSAPPSMKCITRTLCLAPLTSHALKALCMPPPPRNLMSDHQTCHPQGRSPMVPHSAPSLPPTQGEATPADLCFSLQETIFAMLVEITERAMAHCATADALVVGGVGCNLRLQAMLATMCEERGGRLYATDDRYCIDNGAMIAWPGVLALRGGQTCAVAESACTQRFRTDELRSYMSCIHSLHTCAIPDAGEGVRVGCSAGQTSLAEGLERQRGASGNEGKSRRVAAFEPWGIKAEQRGLQSGERLHTPGGKAGEDLEQPQRAPCSS

SEQ ID NO: 15969 - protein, 497 aa, Chlorella protothecoides
MGRDFYKILGVSKDAKDDELKKAYRKLAMKWHPDKNPGDKQRTLRSWILPCAPFDQAAASEKFKEVSEAYDTLSDPQKRQIFDTYGEEGLQGMPPPGTEGAAGPGGMPGGFPGGVPAGGFPGMGVRFQSTPAGFSEDTARRIFEEFMGGDLGGMFGGGGLGGGARRVPSFQGIFAESRKRPQREACGGAWMCCPDIMHAFHSSFHLRSHRAGSQGGRLGPELFGRRSSRGFQGMGDDMGEGPAPRPQKIEVQLSCTLEEVGTMKAVVFGLGMGWLTVRSSNILYIALAGAGWLPSALASCVLSVHLTTTAPPHDWIDTTFIPNPPLPQLFNGATKKLKVTRNVTDAAGKTSKVEETLEIKLKPGWKEGTKVTFEGKGDSRPGAPRQDLVFVIKQLPHARFSRHGDDLHYPVTLSLVQALHPDSLDVPTLDNRVLRVRPRDTVVLPGSQKVIPNEGMPKAREPGKRGSLVLKYDVKFPRKALDATEAAQLAALLEGKE

SEQ ID NO: 15970 - protein, 662 aa, Chlorella protothecoides
  MOD_RES (169)..(172): Any amino acid
  MOD_RES (623)..(646): Any amino acid
MSDPVIGPSPSDATPSPPVPLPHPCSYALQIQSVPLVPTPFGLCHSLTLRGRSVVRPTPPPQTWILKVDEHASSRRLRQGRWRVTASGEGQPTPPRPCAHEVFSGVGARGEALAAQRMKLEGRERGLRAGRVQGRNLTAVVMQMLRARSGVLLHRHAWACLPQSWRGGXXXXAQRMKLEGRGKGIEGWEGAGQETHGRRYGDAQGQGTSVSRPRQASHIRAPHGAGAHPSRPHALLEHGPVVSQGPWVHDGDASSHAPRGHVHHAHARGGHVVAHAVGQQGRLRRRGGGDVVDAGAPLVLARLAVEPDEVLLRVAGHLGGRARDDKVAGDAAPVALAVLGQAHEEEAVLLLRPGDALTPLRLLGLDLLLQVRLDWRGGQGFRSPTKRGTTAGNIDCTQEQQTHHGEGLPRHSIVGEQDPPLLDAHDISLNGGKEQTARSCLLLTRTKQGGPITDRIFPRLGGVAQPQQRKHHAPPAAPAAASQTAHPAERVGWRSAHIDRPDPRRAPGRPQKSCPPPYCETGSGAWCDDNLSPCALDCASPPASTSSHLHGSSTMPDGVDDPAPPSMGADKRATSSAQSRITNHSTDCQSTSKGTGDHRSPGQCLVCKLRPRLGMPWPYRFAXXXXXXXXXXXXXXXXXXXXXXXXHEPRDGSRGKERSAKY

SEQ ID NO: 15971 - protein, 164 aa, Chlorella protothecoides
MSVEEGRVLLPNYAVPGESLSVAHLQKKVKSQETERRKGIPWTEEEHRLFLMGLAKYGKGDWRSISRNFVITRTPTQVASHAQKYFIRLNSQSRKDKRRASIHDITSPAPPEPSLLAYGMGHHMAAPGMGMMHVTPGGVAAGVPVMHPGALAHHRAMLQQRMGS

SEQ ID NO: 15972 - protein, 81 aa, Chlorella protothecoides
MARDYRHTRPRSLSRSKEEDKIFEDALAHVWDRVDRCERCATQLARRDVQSVRQRLEQLEVRGVSFVGVERRRPGVGIFCR

SEQ ID NO: 15973 - protein, 164 aa, Chlorella protothecoides
MPPGGRPGRLHPRVLDRLEDLYRNGAVQRRDLDERALDSLAQLPPTEAIESIDRLEQSVAGGRVRNPAAYLAGVLRRLPRDSGPPHSPGRGDRRDDRPDDRRDPASRLTPGAEAKLREVGVLSGPGALDDRSIAGLARLSPEMQYLVADTFSTRRLDGIRSMSG

SEQ ID NO: 15974 - protein, 133 aa, Chlorella protothecoides
MQFAGHGVDQPDPTLICRLPPAPRLKGYGGGAHVPYAYKMYEHWPFDDYRVFTMDIEALEQCIPQGAHSCQIVGMVQCMPTGVPQCQANKDGNVGTGNVGRNNYGNYNFGNSNIGKLDGRAAAPAAVDSICSH

SEQ ID NO: 15975 - protein, 306 aa, Chlorella protothecoides
  MOD_RES (65)..(68): Any amino acid
  MOD_RES (133)..(135): Any amino acid
MPGQVAGRLPLALAPRMHGPERSLGFTHGSSPSPRRHSSKSPVLRAVKDKTDTEEVGSGVEGEGXXXXMPGQVAGRLPLALALQLHGPGRSLRRKDVRPKSASHQPASFLPAPPRMSSLRSPWTRRPPPKSTXXXKLGRVLRCSQAQGCASQEYITPAGLILASAPTNALPAQPVDPSATTEKYGLEAGLWKALTSRERRPDAPSRADEAKALLKQYGSAYLLTSISFALVSFGACYLAVSAGVDVGALLTRVGLAPGATSERVGTVAIAYAAHKALSPVRFPPTVALTPVVARWLGKRGKEGSSP

SEQ ID NO: 15976 - protein, 484 aa, Chlorella protothecoides
  MOD_RES (78)..(81): Any amino acid
  MOD_RES (143)..(146): Any amino acid
MPRCCLDEDSDGTLLQQQRYAHLAAYFSLLLPPCPPAQLSTCGGGHPQRNQSRSSRPPRWGPPDKARTLGGTGTALAXXXXVHLPGVHLKRLILWVGLGRHLPQGRARVAGGAMTAASSTWPERKASWRSSRVVCRHRILQVXXXXGRRRQLPQRGPERKASWRSSRVVCRHRILQVSFLGSKSGRCNANPRREESDLRTGACGGQRFGLHREYFCFSLRGEPAWWSDDGRGSRSARSRLHTLTTRPCPPSDRRSPCPVTSECVNVNSFQTDITCICRKPGGRRVVPCTVSTPVPRAAWWTPSPSGPSPARHRLSEYGVPAHVCYQLIKDVRALDATPNFSCPYAPPPCTLRSRLNLASFVTTWMEPEARDLMQDALDVNYVDTDEYPRCSDLFPCKPQPVFPLAQAMALYTPARPIQHGTDQHQASPRQPLILAVPRRSRIAASPSWPSCTTRPPWPGRRVAATPWAPPRSGPRRPSCWARWH

SEQ ID NO: 15977 - protein, 345 aa, Chlorella protothecoides
  MOD_RES (333)..(336): Any amino acid
MLSLLLVGRTRVQQGVECCDLSLSGPESMPYAWLRLCSPSPPAPNARTNRYGLVYPGVGWVLWRDADHLPPELVRIVLWPSGFWGKVTFLGNRTRSVGQRLRVMHAPRTLREYREGKGDVLGENWTRDVGQAWRVMYAPRTLKVYREYGTPGQARLLQSWYLWCKEPCHPASRLLLSPTTLSQVFMENYLGSTERSITLNFSKGASQIIGQYYQFLRLGFGGYRKIFLNLEVVRKRLRRAIQLTEHFEILSPEVGVPVVAFRLSTVTGSDGKPHHRCAGPAECKPRKTVEPDDIFAGGASLCPLTPKDVVPCSPPSPLPGCTTSLTWLIVYEXXXXRFIMPLDSK

SEQ ID NO: 15978 - protein, 453 aa, Chlorella protothecoides
  MOD_RES (44)..(47): Any amino acid
  MOD_RES (93)..(96): Any amino acid
  MOD_RES (147)..(149): Any amino acid
  MOD_RES (260)..(263): Any amino acid
  MOD_RES (355)..(358): Any amino acid
MVSAGTVGLGIPGHRRQRARSSLGLPRTGFPEHRVWAPPGQHAXXXXEGMVRAGTVGLGIPGHQRQRARSSLGLPRTGFPEYASLGSPGAACXXXXRGGVNTDDVAVLNLWNGVTEGMRVGKGTGWLAGRAGAERDRAGAHASAVPXXXALVPSQTQRGNLPTRPPPGPLLLGDVQDVHDAGGGVDTDDVAVLNLWNGVTEGMRLGTGSGWLAGRAGAGRSRAGAHASAVPALAGAVIPQPPHKSPHQGNGAALLRLGGXXXXVIPHPPRKSPHQGDGAALLRLGGDMADHEAVGAAGEPAVGDERHVLAQTRACDWGKLRSHPHAASPAPAAWHGLGPGWHPASCRLHLVTPMXXXXDTAWVQDGTPLPAASILLHQWHHHQPRPLTHDGRGGREHLWHAWPAAGALVPDDDDLALEGSRVGLQGRQHGLLLLEAEGRALEQQALLAGDLAH

SEQ ID NO: 15979 - protein, 53 aa, Chlorella protothecoides
MLAALEANSAAFKGKVIVIRYEGPRGGPGMPEMLTPTSAIMGEWAGLVVVPLV

SEQ ID NO: 15980 - protein, 180 aa, Chlorella protothecoides
  MOD_RES (15)..(18): Any amino acid
MGYMSRVASAWMVRXXXXCRGPRGPKRARMGYISRVASAWMVRPGAILSDKAPGTALACGRDGAGPLAGVFPTLNFPCTYSSMFPGPSPHAFPPISVAPQVADVLGMPPAETSSLSASVQQFLTDVVASVDPFGTHARGVQQSLDAVFAAPAGPGSGGARSPTAAGSTPASPAGAWGAGG

SEQ ID NO: 15981 - protein, 433 aa, Chlorella protothecoides
  MOD_RES (296)..(299): Any amino acid
  MOD_RES (328)..(345): Any amino acid
  MOD_RES (376)..(379): Any amino acid
MALPTPSILTPLPSPISPQDQAHPVPRAGEEVVPEAPGHCPGGRPASLWLHLHRDVLCVHQLLELQGGQGGSQRMGRPELTAVARTDCCRAPWGQGTGGTAGVGAHGYPGWAHPASTLHPPPLPRSITSSRPGILCLWVLPAGVPHPDHRHHLRDHRGLLLPAQRGELPLALDLLWGGGIHMCAGSGVVAFLLSERGKGGRGCVGVCNGAVGPLLERAAWMHAGLGWRLDTVRVPLQRTLFLLEGGWSAGGTHAGADGVGSGTEIAALHGMEGIFRGRSCTSVQPDPAFLPHHTLXXXXFTACRAFPEECPAPRYSQTQLSFRTIPCXXXXXXXXXXXXXXXXXXGCDLCFASLIDPCRGGILDTLAAPGPVLPTXXXXQTKMTGFFQTAFYFGYTLMFCVGEFSEGHVPGPEAATCALPPRLNLAGEASWTP

SEQ ID NO: 15982 - protein, 250 aa, Chlorella protothecoides
MCKLGLASNTRGLPKSTDPKEGITAIQGLRNGSLGATILGTAAAQLASRTLAIMTNPEQLRQVAMFGNDDPITGGEWEGLLAQMPKEENACGFHRGAPVSKARAFAPSIIHSPHACPTRSHPTFADGQSIASPQFKLALALGTLLLSVMCLAQFVACLNSSSGRLGRLVEWCALRPLGRGEPNHHVDEHRNTPSTSSTPLLQMFVIQVVAGNPIKYSHLLKLTRVFIKRSSMYFSLGLRFLFLFLPAIMW

SEQ ID NO: 15983 - protein, 184 aa, Chlorella protothecoides
MVLSGVVKQIHVAPDGTRREYYQGIGGVVGLVLMLTGSYLPGRQMAVAEGNVLGKGPVLFHLPQHVAMTLRSQAASGLADAQRLEASLARLAGVYAIQGMEREVRDDVAQHLLRLTTARVQHSMRRQASGSGSGGGGGTARGAEAGADLARASVRPGGGVDRGLASVMQDLAAAELRALEREGA

SEQ ID NO: 15984 - protein, 122 aa, Chlorella protothecoides
  MOD_RES (103)..(106): Any amino acid
MALLRQQFTFIEELYDSGMVDHGEQKMMVDAVDKKARHLEITGPVWKPPRHRSLMRSLPFMSGLSEAYFRRIFAAGTIREFATGEAFWASSDVVADSGRREGXXXXRVCDGGGLLVQQRRCG

SEQ ID NO: 15985 - protein, 202 aa, Chlorella protothecoides
  MOD_RES (182)..(185): Any amino acid
MALLRLNKIPWEKRKMRAKAKAALVRFTSNALEALQTDTDEFLQGANWDAVLAYVDVSTALAAFDLPAKRSESFAEPHGRGLPALYHRVKSAVFGRMNDRGSAVLGNPAVEVADIIPHMVGVRTSAGGVGAVPEGDSPAKGKLVGADTSPNGYTSDSESTASSNFTMSDISDVVEELRGEIXXXXGQGQAGGGGCQPQRLHI

SEQ ID NO: 15986 - protein, 909 aa, Chlorella protothecoides
  MOD_RES (185)..(188): Any amino acid
  MOD_RES (232)..(234): Any amino acid
  MOD_RES (374)..(377): Any amino acid
MHGILGSLGPHPPPRSSRSSEMRASAQALPQRLLGCQASALSQHHHRRGFDPPPEPLLCATFRCAECIYSPFAARGLAREFIKDLEVDRGLYVESLAISVNSTIRHLLHTVSSVDPARPRAIVDLISAAEDFRIESEAMQPKSQPGSCTRCGYMSSQPDGFRHELPLKLGLEEVDPTPCRLRSAXXXXPGTRELPLNLGLEEVDPTHCRLRSASPLQREGPGTRNIKLPAPXXXQHLNITNPPSIYGYEHYEQLWLSTACLLWNVTTGHRVTVHGRIFVRGPRPPGHGDTVWETVSGVGADHRKALVSTHGELAPCLHRWCLGNNQLASEPGPHFKCHQHLVSTVPQVTMVTSSLPCVNVPKAPPCGLIVSFLXXXXFIAALCQRSRSASLWLNCLIPTTRIPPPAHHQAQHSATGSLLLCIPPALARRLSHSHRFLHVPQGESRQRSTSALELLARTCLRLARPACPAQPSSSYQSPIAPLPPCAAEPPRRDDGVCDGGPLRPHPHAPHPLRPGLPGPGLVLGARRPLCQHDCAHRCPGCGRHPETGYALCPRRQPCHREQHRISQLAHSHTTSPPKRVIATVPSSSSGGGPERLVVLMEGEALLNDASAITLFEVFMHIIEEHINPAEPYPSHDSGIPGSHEEGHPGSRGGLEGRTPDPGKPCLTPRPPFLTPRLASVGFAIGLAMSWLTFHFLHWLRWRGAKPYVENSVIIAVAYLSFYVANDPAKGSGVISVVVFGLYGNMTSKWGMLSSSEESGAFDAGERRGGGVVRGKRWACRPGRGHGHSQSRGHVGMQVGLGLCKSALARLVICNPPTLIFAAVWDAITFSANGLVFLWSGDSQPFPLNPLSPFGNPPSSVAILNNTAWSYAAIPLIWVFMFFIRAGCLVLFNPIFKWVGEGGQLVTGWQ

SEQ ID NO: 15987 - protein, 151 aa, Chlorella protothecoides
MSGASGPQLHINGDRTSGQDVRTQNTTAVLAVANILKSSLGPVGLDKVRGGPSGVIKGSSGTYSPTHYLASQPHILCGSPFCAQMLVDDIGDVTISNDGATILKLLEVEHPAAKVTTCVGGWYAGYDYLDEVADSSSQAARKYHAPGPIRA

SEQ ID NO: 15988 - protein, 96 aa, Chlorella protothecoides
MDEIVAQIGTKNNCTFCGVFRRQVRQLLRARGNSGLPFVAGMSGHPPSHTTFTQALDRGAAMMKADKIATGHNADDIAETVLLNFLRADLARWARD

SEQ ID NO: 15989 - protein, 272 aa, Chlorella protothecoides
MGIGFHPTYEPTNEPVVPSFCPEFGLTTSQMRVLGLTQQPEIGTSIDPDTLTAKAFYVGDHVSETSRQATRMARDTRAPGRAPPDLPSLLLDGRICYIGMPTAAGESVGFETEATAILDTMAYIRPDIYTLVIGQACGNAAMLLASGKKGCRYALPHARIMTCPPRLNRAFGSTSTVMIRANELEANTQVFVDFMTAATGKDAATVRKDIGRNRYFTPEAAIEYGLIDRVVQPSEAVQIERRNYELEMRSHQAARRAAQAGRQSGPGPETGM

SEQ ID NO: 15990 - protein, 99 aa, Chlorella protothecoides
MPPRRRPPASTHTGTHTLLDQILVDLADLQDQEVGDGTTSVVIFASELLKRGNDLVRSKIHPTSILSGFRLAMREVRACIQRLVPQAGMERRKWKETSS

SEQ ID NO: 15991 - protein, 97 aa, Chlorella protothecoides
MPKRVEGARIACLDMNLQKARMHMGVQVLVSDPAELEKIRERESDITRERIQKIIDAGANVILTTKGIDDMSLKYFVEAGAIACRRVPKEDLKWVME

SEQ ID NO: 15992 - protein, 159 aa, Chlorella protothecoides
MEGQESFDAANLGSAEEVAEETVSDNDVIMVRRPRNTRAVTVLLRGANDYLLDEVDRSLHDAFCIVKRVLESGRVVPGGGAVEAALNVYLENFATTLGSREQLAIAEFADALLIIPKTLAVNAAKDATELVAKLRAYHFTAQVWDGEGGGEAGGKSGVR

SEQ ID NO: 15993 - protein, 77 aa, Chlorella protothecoides
MKLCVECRTQRAAMRRPKTSEELCKECFYTAIETEVHETIMATNLFRRGERVAIGASGGKDSTVLAHILTTLNRRYE

SEQ ID NO: 15994 - protein, 361 aa, Chlorella protothecoides
MAPGGAFPAPPWPPPLPPTQPVPSPVPPALPAAHNLLQQTLRMQADSGAMAWDPSVAPAATAPPGPGSTSLNPQQLEFAALLRQAGMTGLTEDDIRHLYTVSEGYALQAASTGQPLPLVGAPPPMVPVHAPGAPGAGATSASTSASLASGSGGRTPPDVGAPEGGAKRRGRRPADTAQLTTKQLRAREAQKRFRDKQKSRMAETEGTVAELAAELRATQLSTEAAGRKQALLERLLEYKDEQVEALELHKRLDPPPGIIIPADIMDILRSRTVPGIYTQEMLLRYAPVGYREHLDERGYVKEAPPFDKVCEDWQQVVAALRRLLDGANLARRTPGAEGPGGGGGPGAAPGGGSHSGAPLGA

SEQ ID NO: 15995 - protein, 71 aa, Chlorella protothecoides
MTLFAYFLIPETKGVPVERVPIMFTRHALWSRVMGPVSLEIIERDATRTISRQAAADQRAASNGDLKKATE

SEQ ID NO: 15996 - protein, 988 aa, Chlorella protothecoides
  MOD_RES (362)..(365): Any amino acid
  MOD_RES (971)..(973): Any amino acid
AAASDALSTANSAHSLPNSPKTPESHPPLSQAPQASEWARGRPRTSLLAPGKRASKMPDQAFSHLCHVMIQPRTTACGVGHVGRQGPRSDNVVADPGSHDGVQGLQIQKETDQPPPPSHPRRHSLDTSSECNSYEMPQGVSSCQVDQRIAAAYKQSCDSNRCPLNSLYPKATCAAAAACTVPVPRPPSLHHYLIQLYITDSKRHPDRSVSALHLTLQPLWQRARPSPVLLESANGSSHSACPWMHVASCRPCVPTPGPSSRSCLHPSAPRRVVRARAGARPTRVDADLPALESKHEINGTGTGVHDAHKNGGDPEAPLAGTGHGPTRPPTPSSQPSLPSWLLNPNDPAILELTLPALLTLVXXXXTPTPSSRPSLPGWLVNPNDPAILELTLPALLTLVADPMLSMATSVFVGQTGPTPLAALGINTSLFALCFSLFNFLATATTPLVATALQAGNGEQVMGFECGGHGEGCGTPSLPPAAPSDTKAPAPPIPLSKAGRTVLQGLALAVVLGLGLALALTAGSDAALGVMGVAPEAGDLFLQSRDYLTVRALAAPAVLLESVAQGALYGMRDMRTPLEECLCVGVLSESVPEEASRADGPGLALGPAPGLGSERRRAGHSRGRGGIGGGVPHGTARPAGYVGRPGPSPAAGAPALRGPQRHAPPPGAAPRRRVAADAHGAAPGQQDSGGGRRGAAGRRPRRRAPHRAPGLAAGQLPHRCAGGGGADPGGLAPGGGGERRPAERACRVGPPAPTRRGRQRRPRPGPGRAGPGLPRRLHLRSGRADRGACHLGPGPGPAAAEWRGHGPVCTVHRGRAGAERALGGGAAGGVVGAGRTHGLQAGHAELAIRRAGGAPGCKKGAWRRVLSRWLCCERPSALAPTTLSPTRRALHQTQHGYSPQRSTPCALNPTYPEESLHPLNSLYLSCTFSAAQHQGAHQLLHSEKKFNLSHSFTGRHRPSHIPKSRGWPGAPXXXSPAPGSTPTCIFKRR

SEQ ID NO: 15997 - protein, 80 aa, Chlorella protothecoides
MAGARVGRGRLDFALQESTLSSQYLSALSAHFIYWASPDVAQFVLRATHGADVLTGEAGEGRGGGAPGSVRLVPRASPAI

SEQ ID NO: 15998 - protein, 264 aa, Chlorella protothecoides
MGEIASGTWPCASQRGAGHCSAAAPRLLASPSPSSTLSVNPLPSSTTRPSQMYIDSTFDAVRPDGDQYLAAELRRALEPLLLRHGVDATWHGHHHSYQRTCPLAGGRCLASGEDGVAAGPVHIVLGEWLGRSEFGWSWPRGACRAGLGYRMLAWRARAFRRIAHPQHGAAAAAGVCQRAAAAWVCARHCECHPAGACRRFFSGRQRHGSMGAGEACRMVRQPRRPAAGRGARGGGMAVPGIQIAAQTAGLRHLLILLNVPWTAE

SEQ ID NO: 15999 - protein, 308 aa, Chlorella protothecoides
MAKKCSWTGRGVPAGLPRYLKGGGGMRCCVGLVRRRWGRDRFACADGTAVGSSSPLNFQAADTRPSHLKGLKHCPPAGGLVSPTVGRDVWTTELESHRQGSPEASVLLAIFLGEELGQRPQWQELPPAVVQPAGPKFKEGGLHPGGGFPGSDLRGPCTTGKRAQRQPPGDHWAVGLTPNTHSPPTIQEEEILLRHGELGNRWAAIAKYLPGRTDNAIKNYWNGHLKKRLGPSRSVDEADAKRLRSLASLALDTGHRPGGGAASMVGAPGPLRRSGSVDVDTPAKHAASPPAHRHGTRAATGALRPRQL

SEQ ID NO: 16000 - protein, 123 aa, Chlorella protothecoides
MPWVNCTSLRYHCTKVPDVDLCPLAYADVLLWPCPFGPVHGEPRGGELLGCRCPQVLPPPSTKPHPFAKAEGRFPPGCTAKDFVRLEEDAAPPDPSGWTNEEQLLLLQGTLLLRLTEQLSATG

SEQ ID NO: 16001 - protein, 177 aa, Chlorella protothecoides
PQPPPPPGTPSGGTPQELHRVPACAAWFRWGAVHALERAEFPDLLGAGAPPGAGEAYLAHRDAMVSRYREDPSRELSFTEARRWLAGDVGTLRRLHAFLQSWGIINAHARVRARRGREPAPGPDSVLRLAPLVGAAEGVEAALTGPVAGRVAPLAGHANGALQPAIATGTPQSLGRV

SEQ ID NO: 16002 - protein, 314 aa, Chlorella protothecoides
MNSRHAPQRSFLPRPSCHPAAAVERHGEDWAAIAEAVGTKNAMQCCTRFLQMPIEEAIVAEAVASDGRQGWGSGARAGGCEMGMTRASSGGVGGLRCMMLWRCGGRCDGWSEEGWGSAGLHIASLSPVTIPEPGEEDGADPGAGALLPFADAGNPVMAQVAFLATMVGPRVAAAAAQRALEVLGEEDAALGEAEREEDGAGEWPKREDEGKEGAEEPIAGEGPMKAEEGSETRDGMGLGVGESSPAPSVAGDAPISAPRLRAAAATALAAAAAKAKLLADAEERELQRLVLAAVDAQYKKIKIKLQAREGLSEA

SEQ ID NO: 16003 - protein, 151 aa, Chlorella protothecoides
MISSALAAARSSAGTRFRHAFQTTCQASGFRQAGAAAYQSAAYSPPSGSRPFVSRPTNDAPDPRKVIIFTNYTVYKSKAAFSVKVIKPTWGRTGTGSGITVTRDGTLLFEFANARGERDYDWEKKEVRGLMGLETQRGLLLHPRWCRRAWL

SEQ ID NO: 16004 - protein, 78 aa, Chlorella protothecoides
MGTYRRHRYPPEAFTLVLHRRVNVTLGPREDRQFITGLHTVADIQCTSCHTVLGWKYVSLAEWEGCVAEAGSGAWGPA

SEQ ID NO: 16005 - protein, 582 aa, Chlorella protothecoides
MDRDTGKAKGTAFVEFATEEGAQTAAAAAADARCGNLHVLPGADGLPRPPQQHPPTPRLGPPRRESKGPAVVVAGRTVEIDMALDAQAARHASAKSQDDWRARDKRNLYLTKEGIISEGSVAWENMPEGDQAKRKRAAGGSGAVACLVKVKGRREMKPARRTDLSHANGLPPLETPLPRCTVERKAKLASPNFVVSSTRLSVRNIPLAWNEAKLRDVFVAAVKERASKAVPVVKQVKILKDAERPGPDGEPRSKGFGFVEFTEHEHALCALRQLNNNPTAFHKDRRPIVEFAIDNVKALKAREHRATQAQTAKAAGGPQADGPVAGEAAGPGAAREDVAAPAPEAEPKSRRQLRKERNMVARERRAAAALAKQDPDQHEKVELAEKGKRKTRAPAERPQPAPIAASVAAPRERKKGAGAAAPSAPAARAAAVAAPEPGPEAAVQPQRKAVLRSQRRRLLRQRKAGKQGGGEHEEDAAPGAGAKKGRHGREDEAWTEPRPRRAASPSNGVVTAGKGQTARKAGHWVGGEAGPNREESGALGWRGGRCEGCRPWAKGSRGGPQGQGQPNEAEGGRCRQDCHGNQ

SEQ ID NO: 16006 - protein, 120 aa, Chlorella protothecoides
MVTMNACRAGLGASRVNTLRQSRPCQGIAPSARRLRHVCRAGGRDVVVLGSRGKIAARIVQQLLSQGYGVTADADEGRSQDLLEFASKFGLLSASERKALKLVDFDATDVDSVGQALGGR

SEQ ID NO: 16007 - protein, 504 aa, Chlorella protothecoides
  MOD_RES (14)..(17): Any amino acid
  MOD_RES (284)..(287): Any amino acid
MKGSSTRGSPLATXXXXEVQQHRAGGISARLSMAYKKVDRPPMFSQRLQAPLQNWISTRSRASDTRVVFSLRLAFLLPQHARNSAMHLDHAVFKPLQHEREVTIGWAPPLDVHHAVSARLLGLNICTIQIRTSAVLRQPTVTVEATSSWTAIHSAWVRVVGHSVFGDDASHVLHPSAPASSHGRHPDSQVGMGPGPARHREEHPGNGLSVKRYHFLGMQHGTYHGSAGLAHGREYPLHELPPPSQALGPAHGDTDGPELQPAKLHLAEEKSYSYVERAHFPRAXXXXASGRGEIVLVCVAGALSSSLTQPGTTDRVTSRLASRSTHSRSLPVQSPNRARVSAVMLTLARAHRVVSSRLALQSLATRCKTTTGIVGLPVDEDARTTLGEHYAKVLEAITVIPESAVYRQSVEKTVKHRLAALQTGAEDEELEQQFGRQLEEEIKIMKDELKLIPKMAGEAGLVDELHQTGQLDWAAGWMEQLCLVGLVLPVVCGCVRHPQTCTVY

SEQ ID NO: 16008 - protein, 378 aa, Chlorella protothecoides
  MOD_RES (16)..(18): Any amino acid
  MOD_RES (338)..(341): Any amino acid
MPDTVGGLGRHCLFGXXXEQTDSLRWVPWAACLMLLGARKALPLFGKRSLQLLCHPPTQHHVLLHGYVAEDGGGWERVGEGGCAAVLDEEDLRTEACTPGAPRAHLSHACPELLCACKALLPTLSQFGALRPPNHTGMAASMLLAEAAYSVSANVILDSAMRSISSWDILSSILKCWVFGTIISSVSRLQSGLEYGIWGCGVRLAARLTCGPNVTAERIGVWDLGLWREAGSQAHTWDRRGEGLNYRRNVIGNPAGQLLVGIYHHGRSQGRWGVHHLSRRHLAGAHLHRRLCAVLPLLPGAGRRSALTCLRLLVAGLRVLVLCKEEALQETSGDACSXXXXFLQCAMQRGAVQETSGDVCPCEGPLAAQSMRHAAPPH

SEQ ID NO: 16009 - protein, 347 aa, Chlorella protothecoides
  MOD_RES (296)..(299): Any amino acid
MPQLGLELGVVSVAIDGTGQYGAASSMDSTINVWSQADYSSAARFKLPPAEAWSVAWLPPSSDGRLTLAVAGGSSNTVSLLDVSAQLAGGEAPRPVTLHMPPPPAAGAAGAAPAQPFVLSVAASPDGRLVAAGAMDGGVALFDTATGRLLSSLAGHAKAVRGLAFTPDSRHLLTACDDLHANLYDVGQAALVESFAAHESWVLSVAVHPDGSAAITGSSDAKVRLWDLSTRTLAQTVADAHADQVWSVAFRGDGARVASASDDHSVDLLGEGEGVSQGGGMGAPGGRDEMHGRRSXXXXTCLGRGKGSPREVSWGRLEVGTRFTEGGVMVMQAPATRCQVKAQARGH

SEQ ID NO: 16010 - protein, 141 aa, Chlorella protothecoides
MTFDVKIKHWHAVASWTWDAGAGQHGVHCGCPQCDALGWHAVTLEPPIPVHSHSTGDDVCGICRMPFDGCPPEARFPGDDSPVVWGTCAHAFHLQCINRWLSSQSEQRCPICRRHWEFKQAAVSDGEQEESIGVDMEDAPS

SEQ ID NO: 16011 - protein, 140 aa, Chlorella protothecoides
  MOD_RES (52)..(55): Any amino acid
MLRSLGCNPLRGHKIVPFYPNAGFRHWRSSCEALQTASRQSFASWTGNASQXXXXPGQVWPLGCKEVSGVREAFPQTVCDAWVVVLLATCLHEEDELMIKDECILVDESDAVTGHASKYDSHRPLDVPLDVMNHPSLLLT

SEQ ID NO: 16012 - protein, 98 aa, Chlorella protothecoides
MPCDAMAVLFDTCSGPAALCINPLVRPIAALAAPQGEFVDLIHRSGMVQSAEFTATGTRIKAHVPQSLARKLAPMAVGGQGAAPPLQIGLQHRDWEGP

SEQ ID NO: 16013 - protein, 235 aa, Chlorella protothecoides
MQACLVGPCALGPRLQGGAFASSHRAHGFVIHARPFQTLTRGVQLVTRASASAGTPPDARRLPSPEEMKQRVSERIEQLNNRFRPPKYLWRSFAALVIAGQSIFRIFQGLSVECGGAIHVTRCRGRNGIFPPVTHVPRQTYTRQNTLAEHPGAIEPGWAPVSGGVPPHLLLPGHGVHHPVHQGIHEAGPDEDGGWCAGARTRAGIDPGRHLHHRGGAGWQRLCRRARDHAGLGAD

SEQ ID NO: 16014 - protein, 136 aa, Chlorella protothecoides
MGCPCGLLAQGMLPMAGGIRTLGHPCTLQWEPKLAGYMQFMAESKVVYDTFEELLAAGAQPYCERSTAATLGRQQQGRVSKSHNVPAIPALTDKEFAATGLQRGAAIDHDLAYLSEKYGVPIPEAKPDGPGHTYAR

SEQ ID NO: 16015 - protein, 190 aa, Chlorella protothecoides
MYSVTPFMGYFMQMPVSQPLALPQAEKCGWCHACPFSPAPPQVRAVRPLVHTTLAPSPPPTAILPSFNPTSIPQATRVLYKVRPSEGMVAVASTATAVEYAVAAAGPGESLKALAQNLSALATTEWVALDEVLHVHALRVDSVTPDDPDFPEQWGLEAVHAPEAWATATGAPTRAAAVTVCIVDSGIDYE

SEQ ID NO: 16016 - protein, 484 aa, Chlorella protothecoides
MPWQGFPAIHRAPAPLQHPPAHRHTLTQPNLQPPPRLPPRQVVIGLRKGSPSESEARAVGFTEEAGTLGEVFDVISSSDFVILLISDAAQAKLYPRILAAMKPGATLGLSHGFLLGVMQNDGADFRPDIDVVLMAPKGMGPSVRRLYEQGKTVNGAGINASFAVHQDASGRAADVAVGWAIATGAPFAFCTTLESEYRSDIYGERCVILGGVHGVVESLFRRYVAQGMSDEDAYLNSVECITGPITQIISRSGMLGVYEALDAEGKATFDAAYSAAIGPANDVCREIYDDVACGNEIKSVVNAVSRFDRYPMGKIDETHMWRVGAAVRARRASLEVPLNPFTAGVYIATMMATVQTLQDAGHPFSEICNESIIEAVDSLNPYMHARGVAFMVDNCSYTARLGSRKWAPRFDYILTQQAYVAVDKGTPADAEALAAFKHADVHKAQETCAALRPSVDISVGGDDDSTGVGAGAARTEFRSQAVLA

SEQ ID NO: 16017 - protein, 103 aa, Chlorella protothecoides
MSGFDMSGPVRLVCRHDAGHPTSQEFRFGAPSSEKNGPRSEAPGPHEASRNQGSSGKRGRSEGDDGHPPLALGVPELLPPHPLRLIIIGHNPSAHAWRTGESG

SEQ ID NO: 16018 - protein, 256 aa, Chlorella protothecoides
MAAAVGVSMLPGSPGPMDELGHGSHVAGIVGAAGSNALLVSGVVWGNVDLLACRFIDGDGLGRTSAAVDCVNYCLAQGARVIQASWGGAAAPNAAMQAAMEAAEAADALIVVSAGNDDRDLDAEPQYPASYAADRANVLAVAAVGRAGALSSFSNRGAGTVALAAPGEAILSTLPGNATGVLSGTSMAAPFVSGAAALALSVAGPGALPAPALKRLLLESAEPTAQLRGRVGAGLLRLDRVVAAAAALAAAPTTAP

SEQ ID NO: 16019 - protein, 119 aa, Chlorella protothecoides
MTSLLHPCVRRHGYFCSLPEREYLPVFWGPEELALLQGTELGDAIHDELDCVRSDYTDQIEPLIAKHGLEGMNYSFPAFQAAASLVASRAFKVDDAVGGFGALVFPSPRCTLPAHVPGE

SEQ ID NO: 16020 - protein, 248 aa, Chlorella protothecoides
MVPLADVFNHKASVVALSDQYAVYEGEEGEDSSDDSDSDADEEEVQEGEDTEDADGDEEGAASGSEAASESLGSSEASGSGGEGSGSPGASPGAGTMLTSQLVPPSFLADAEPELHGLRSANGLSLALEICIVDDEEGAALRILTASPIGEGREVHNTYGELGNRDLLEKYGFTLPENPHDSVTLELEPLWAWGAARHGAREWEARRAFLDANTPWLRRRRYAAVVGLRVASEFGRGIPLGGLQSGVA

SEQ ID NO: 16021 - protein, 163 aa, Chlorella protothecoides
MDGRPQLEIEAAAKIGLDGGPLYYRCASCSTAVSEARRQIVWCPGCKEGLEGPERCLCHGSFQDIARCPSTVPPKNLPCQATPFCSGDCHRRLYPSHRGVCGFWPRPLLPSQVALRMGVEAHMVRGLSGGALQGAVLRQMQAVQRSYQAAAVAAAAATGVVGE

SEQ ID NO: 16022 - protein, 96 aa, Chlorella protothecoides
MAATSAAARAPCAAFARCAPTTSIVAPRLGPLTRPASLRSTRGRRSLTVQNAVKYDYNTKVFEKELLTFAGSEEYIYRYDAVPTAHARDRGHCEVR

SEQ ID NO: 16023 - protein, 109 aa, Chlorella protothecoides
MEPQAKRAKADGAALLPGLTAWLDREGVWWDDEAMQIKESKSPNGSSLSIHSRRPLPAGHHLCTIPKDACLSVRNASCSDIIMEENMCSGLGLVMAVMHERLLGPKSRW

SEQ ID NO: 16024 - protein, 185 aa, Chlorella protothecoides
MRLAFSPRGDLLASVSRDRTLALWRRRPLHGDGGEGCAPPFTLVARVKAASRLLFDVSWAPDEATLATGSRDGIVALWRAAPGSSEALTKSLELRRGSAVRALAFCPGELAQGSFLLALGHEDGTLCVLRFRVQSGNALEVVWQRATHAGPVRRLAWRRDDGEEGSFLLASCSSDGSVRIWHVAG

SEQ ID NO: 16025 - protein, 113 aa, Chlorella protothecoides
MVPRPSTRPLCKVRIQRFESRPPRFLNPQDEDLTHSLRKLLRTTRGQVTVALEVGVLVCMLPFLVIDATMAGVYRQLWIDPWRILSTITYVNQGHVFLEPWVVGDPLCEPLGV

SEQ ID NO: 16026 - protein, 77 aa, Chlorella protothecoides
MHGSDDPPAPGPGLPAPTPPDMPDHSSTLNELEAFLRQPDAIMEPSIVDRLREYVMANGHPQQAVEYLSDSYQGGHL

SEQ ID NO: 16027 - protein, 516 aa, Chlorella protothecoides
  MOD_RES (91)..(94): Any amino acid
  MOD_RES (369)..(372): Any amino acid
MPQSVTVPALRDCLASLERLLASAAAFDDLGEGDGGVILRRGGEGVERTERSSGGYCFNDDRCHAAIESRTSGIAHLLALPCPALDDVPNXXXXLRRGGEGVERAERSSGGYCFNDDQCHAAIESCASGIAHLLALPCPALDDVPVLDTPSTSRSPPLHALPLHSEPQGVLLLAALQDGGAAPAHALAPRLRKVAAAFAALRRQWAYRLAKQAVGAFRARFNPYRQDRARFASGWAAGGGPGRAASDPGGQVPDADSAWPCPTLLAAADGVHGLLRMLSSDLDPPVFADVWRAVALAINQAFYNEVATEALFSPQVRRCGWREGRRTRKRSRVVSWHPRGGYFGDGGRMYERRCCLCLPPVSYSSLTTXXXXCKLAPARWVLRRWWTVVCAKMLFMLATCELLFLDNIQSSDLSMPTWHLRARGSSTPTSGHSPASSGSGRPTRMRILRRHGRPVGEGKRVGRGGPVPDSVGFSARRVAGWVCGHWRFHHPSENLRSCHDVQPADPAAARSRRPAG

SEQ ID NO: 16028 - protein, 325 aa, Chlorella protothecoides
MGDTNRLSDRFRAVLPTNTASTAESSSPSPPRARKRDHASPEGLGLWKPPIATVLLVQDGPSILNDPPHHHRVFVSGRDAPCVPAQHPCGTCWPHETPGPGPCPYVAPFRQWGGAQWGSRLPRVAAHVRGSQEVRPCHPAGALWCAGGGPPGRLLTAHLPDGHLPAAWSHHGGCLRLHSQREPHQECGRDPVGGAGGGWAGRRPVPSLKLPACAFPNSCPVYVQPFFLITITILSLPTPTLRPPDLHPTRPFTQGAERAFLFTSGMAALATVTHLLSHGDHIVAGDDLYGGTSRLLARVCPAAGLEVTNVDTCDVECVASGGSSL

SEQ ID NO: 16029 - protein, 383 aa, Chlorella protothecoides
MSGGDLEKAAAELASLEGQREAAHAALSSLAASAYQRYSARLAGAHSGVPLPADVASLAAELETLTAAHAHLAALQAFLRQAEEACAHPAPATLGRAVDALAHAVRAAAGVADDARLAAHTNTTPSSHEVLRALSDALAADLARLSARLRRQLSAGFQAALGAAGWPPPFLSAGDEAGGAWRGLDSPDVRGAALQLTLLQRSAGEAAQNEGPWVAQELAAGVGAALRRHFASSSAPTDRADRPEWLLATTLRAARVCCAAAYQLQGVLAAGFGGDGDDARCVHYRGGIIVSNARALVGAGLGKRPTPSSVPTPTHHPPAFPKPQPGPHAGRGGGPRHPGLCAGPGADWARSASPGLAGRALPLAAPGGRAGQLPGEVRCSKAH

SEQ ID NO: 16030 - protein, 568 aa, Chlorella protothecoides
  MOD_RES (119)..(122): Any amino acid
  MOD_RES (158)..(161): Any amino acid
  MOD_RES (531)..(534): Any amino acid
MAGGALSKGLTNAERIDVLHVRHPLRISNGSNGSIRGRVCISAEEGPSAASELRGYTRRGAEPAQKHRKASLTEPLMSAHGQVSDSASLRIAGMTICVTKTVVIASIKDRKASLTEPLXXXXWPDGLPVSHASCVHSTIISMADLDKTAVVIDQGASXXXXWPDGHPVSHASCVHSTIIFMADLDKSAVVIDQGASGIRAGLAGEDFPLVELRSRSDNELGKGPVDPGVSRVPHREPPPSPNQGGCESWHSVFQALGVGAEGRRLLICEPFGTSAHQRKERLELAFEEHRVSAVFMQILRGTGSYSWFWPFPPSAPACAHALRAGPADWTGSGLRRDGVPGGEWVTHMSCTAWWVALGIQTEDSSPTSEITQCLSCKYSSSSDTSFTGPCDRRVCPAACLQEPGGGGPPRGSPPAGPAAKAGVCTEPRHFPGSRHSSQGEAVLPRCRQGGRGKGGDKDNCFLIVHTCYIPSPQRVPCPEHPWAHHSGSHNPACRWGMPYMHRTATACSATVLLSRLTLFPTPSPQLARETXXXXCTGLPLLALLLYYSAARPSSPPPPPSWPGRLRWA

SEQ ID NO: 16031 - protein, 428 aa, Chlorella protothecoides
  MOD_RES (142)..(145): Any amino acid
  MOD_RES (385)..(388): Any amino acid
MQGSMLTLNPPRHCPAFSAGARKGPRPTVRSARLAVRVRATQAADAYISPSSRTAATELQALERFSEIVPDVLLSQTLQSVEAPKAATSSRGVLAGILSSPSSFGRYKGAAQVWLPAEDYASHPIHLVNHARMPTPRKHSLXXXXGGSSGMAPCPRLRVQPHPPGESCPHAHPTQAQFAVEQARHYDRAAQAASPAEAASLRVDKALVNVGSMFLENVSGRVSTEVDPRAHDSEGAAASGQGILACAWLGALVAGAVSRACPTHSAACCTMATPSFEPLQTHVLCLRSMTFIPPLSDPRLSLAEALVARGQSLIRLYEEVGVSRDRVVLRIPATWAGIRAAAALEAEGIATHLVLVYGFTQGAAAAQAGVSVIQPNVGAVADWYXXXXPPTWSWSTALPRAPRRPRPACRSSNPTWGPWPTGTSATRA

SEQ ID NO: 16032 - protein, 162 aa, Chlorella protothecoides
MRQGPREAALAVADEYGESVNPGLVLVETLYHYVKRFHPKTRIMASGLRTKAEALRLAGCDYLVVGPRVLEALAAAATLEGYNDGLRADEDEAPGELAPALTPAAAQAHDFSDQETATLDRALFEDRLGLAARELLREGVARLIGDAERLEAYFLNLAGGQE

SEQ ID NO: 16033 - protein, 357 aa, Chlorella protothecoides
  MOD_RES (56)..(59): Any amino acid
  MOD_RES (191)..(193): Any amino acid
  MOD_RES (303)..(306): Any amino acid
MGRQAGRKRGGGPGLAHISGMCEEFSAFAQTHVLESDSSSGACPSSRFNVGGRPCXXXXLLRRRMGWKAIHLAGHARLLDSMLGDDPASTRDGMTPQRTIDLRVKAVSVLQFRDSRPGPDSVAATSCCLPTHLAPHSPQKPAIMSGKGAKGLSGKGAKGTLGGIKGGDKKKPISRSARAGFAARDRGNGTXXXAGQGTPYSDILHPSCLQFPVGRVHRLLKSRATANGRVGATAAVYAAAILEYLTAGRGAGVGRKRLQGPEVAAASQTIVYARLAASSALPGSQHPHSPPDLPQLDTLIKAXXXXACCQHPHSPPDLPQLDTLIKATIAGGGVIPHIHKSLVTNKQGKKEGLLPII

SEQ ID NO: 16034 - protein, 507 aa, Chlorella protothecoides
  MOD_RES (31)..(34): Any amino acid
  MOD_RES (169)..(172): Any amino acid
MRSSPMAALRHPASLSQLDAGARGPCVPEAXXXXNERVDRVYQKPEEWTAMSINSTAGSGFFSSDRTILEYANLSQAALASAFGVRLPESWIPGSVPYATMPPGRARAAARTSLPCHRRLKACVLDVAVDAMELEPQRVIHGGRDSDTVTAGRGEPTRVRAQGTVGNRXXXXRDGTGASAGGHYTQGVGYCQRECASTSSTGCDARLIGRAARRSVHGRGPGPARGVHGHGWGQAHEGSEHCCPCRDRHHLVLAGKEGRWPTHAFLGWLRFALTCTPSVLVPGQPTQFLLGPCAGDRPCFTQVDDLFAPCQERRPRAPGVQGAVGHAAVGGILSGPVIIGLLGQISVGAIPHVHFREDVREGPVELYHHLTLYDASGSNNAKRPVSLMPAGVGTHKPAGEEMCGADSGARGCIWRAPQHSPAPWCSQHDQHVVHEVYDEIVLWEPPEEVHRRLAAHTPAPAPQSQLAQFHTQFNPDYEYRRLQHARQRVAAITNNVKVQLAALESAA

SEQ ID NO: 16035 - protein, 228 aa, Chlorella protothecoides
MSLLVDMVRGANTAAIRRAGLVGLAAHGCGRAFLKNGGEAERLIRRMVVQGLLLERTARQEVHMAVVATLSVCEEAAARLAAGRLALVVPVLQPRPGSSGARSGSGEGRRGSGEGRGGRGSGEGGGGWGEGAAPGPRPTLALDRSLAANPLQEDWAGGAGHRKGGQRAAPVCSALAIARAGQGRARKHGAEEEDDPIDLCLDVEEVKGRGEGRGGLGKWHGFLLWAGC

SEQ ID NO: 16036 - protein, 64 aa, Chlorella protothecoides
MAEATLEGPSLSMLHVTVPSEEVGQQIAGALVEGRLAACVNIIPGGVWDSRGPAAGGLDPAFQV

SEQ ID NO: 16037 - protein, 320 aa, Chlorella protothecoides
MDDDDAFFEGIDVDGLITGQSTGLAQEALPSSWPAHNPPEQARARPAPPPPPPAPQALSEPERARRLAAVSAALAAAAEKMLDAEGDPGALATVMAESRRLREEKSALLAQPGESRSGTDAATRPQPLGGPGPASQFPEGGNPTGGPPWQQTSRASAPTVQAAPYRASSWVQGPGTAPPPLTNSYSHQGASLGWEEGGAPPQPPAWTPDKALARQAAGERVDATHDASWRGETFAWSRELRSLNTTRFGNSGFRHNQLAIMNASLAGKDVFVLMPTGTMMSVHWWMGHAGCTWRLLGCHEARASPAEAGPAAGNMSGSTR

SEQ ID NO: 16038 - protein, 181 aa, Chlorella protothecoides
MGWEEQRAVYDDMTRDPEASKVLFITPEKLAASGRLQATLDQLHQRGCLARVVIDEAHCVSQWGHGAAGGSHMTAERGWTGGKARWGGDPAKLAHEHMVPPTPPVAPADFRKDYTRLSFFKQKWEGGVLVGWAASVVSRGAFGMWQGQHQASRRAGDWDKSSVPQRAAHGSHSHGHAPGAA

SEQ ID NO: 16039 - protein, 481 aa, Chlorella protothecoides
  MOD_RES (170)..(173): Any amino acid
  MOD_RES (399)..(402): Any amino acid
MDRDSPVRNAFCAVRPPGHHAGPAGAVPSARDPHATNGFCLFNNLAVAAAYARCVYRGRGVARVALLDFDVHHGNGTGAWLGVWQGREMWSVGWATFSVKGGEEAGSLRALHVIHTADGPLLSAPGSYAEACVVRAAPSLQRVPFSTPYSEGVQARAGSACGLGARDEMXXXXLGRLAGAGDVEGGVGDVQCGGGRGGVATKGRTWDPAKPWWCLCGITNEALHPGLLSRIWPALPCTRRAGWIPPRSPCRSRRRWSPPVRSLPMRRGVCGAGGALAAEGPVLHALLRGCSGEGGELVHRGAVPPGHLGGALPDPDLPPPPSQTFPVYKPWLDADDKDNIFFARWDVGGGEWQGGPCDGMCSGAQAGGMPFWRCCGKPLRTLRHAPLDPAASKGLGPRXXXXGMPFWRFCGKPLRTLQHAHARSCSVQGFGPKAEGMNAYVYPGSGATGDNRIADDAAQSVAGRPCKGGQGCTGSAGAARN

SEQ ID NO: 16040 - protein, 356 aa, Chlorella protothecoides
  MOD_RES (53)..(55): Any amino acid
  MOD_RES (185)..(187): Any amino acid
  MOD_RES (303)..(305): Any amino acid
MGCVSTVPRACSAHVARCCIRWTAECAGPPSRVAPPEDVVATPGMVCMSLPPXXXRGSIWDCNHCGVCQDSPKGLQCICGQMLHSLDRGVRRVAILSGSSRGCCHNARDGVHVTAPYEPCAPCSSAKPVHEAPAPSSCHAGIAEDPDAEFLPTGMAPRNAETFPGRAEEFTCINIRTSVAGAPPXXXIPWVCREIYLHHHPHLCRRCTPDPTCKPCHTPPAGEDSVGAAPPSAPRVIDVGIGGPGTKVALWRRSWRDKIIPALVNFRPDFIFISAGSSPYRARQGARGCSAEWGGVLPASFAXXXKCASLSIECWGFGGARFSPYRRAKAQGGARLGGVGFCRRHLPPPALSRPAI

SEQ ID NO: 16041 - protein, 210 aa, Chlorella protothecoides
MSTGAFESVGLGPFGGPGTLAVAERVTAAVKSLSGIDTTGYCGLMLPLAEDTGLAAASRALSVQTLLFYSAVCGCGLDTVPVPGVSDETPAGEAARLVAAAAALVLDIAGMAARLGKPLTCRLLPVAGGKAGQATAWDSPYLVPGTVLELCLTAEASGPWKGGVNGQSIAGAKLTPEVNMGRGAAAKRRGHHSAYHEGRSSCRFLARMSA

SEQ ID NO: 16042 - protein, 406 aa, Chlorella protothecoides
MASDITTYPCIIRSVTYFLPEGDVGSAGWEGAMQEAAAFLATARGSLEQEGMRSTGVAGGWGTHCALHGIAAQGSGCVAPRHRGQPALQMHIRSSCLAGITVQTLRVATDILTRVESVEEALRKARVVQAAAAATGISFVSYGAFSNARLLEEGLATKLLATPGGDAYTCCTFRWQPVSWWGLWKNALDDAARLYWGCHEVGSCCWQAGRRSGPPSNHLLPSPQGMGVEEARSAARAIFSLGRATGDVGPFHFALTFAEEGFQTPFFPAASATRPGFAIATENSAQYAAALASAGEGGPAGVTPALRAAMAAGLRGVQACAVKLATATHVPYLGIDTSINPGLEGPSLAGAYGGWGLWACMSWGGGAPRAGLPARACSRPPVLVLHSAPAPRCTMPGFLDSRHRPP

SEQ ID NO: 16043 - protein, 110 aa, Chlorella protothecoides
MVVLGSGGHTAEMLRLFKNFDASVYRPRVYVAAATDALSGVKATAFEKAWAGIPGKGSDPSGPAYQQAVIPRSREVGQSWTSSALSTAHAMLYALALVFRARPDLVRVFC

SEQ ID NO: 16044 - protein, 166 aa, Chlorella protothecoides
MPGSWLLGRDACAPHQLFTHTFQALHSQPSPSRAPRKQYVEAQLAARLGRPAPGSEQPAAPRGIDDELFATSQYQRKDDLELGPSWITGITEVPLSMDQRLKNIEDTETAKKKMLTRSGMVSIHDADDDDDEEEGAGSRQALRRGQYPVFFGKQDPAMLKRVEEAQ

SEQ ID NO: 16045 - protein, 413 aa, Chlorella protothecoides
MASRLFEDLPEPSAAREREVPPSKRPRNETVDSEVREEVGEGGSSAPPSKETQATGTEPRGETVPQEAAAGSGAPQWTTDDDEVPPPPPPPPPPPVDGIALALEKIASHIPQPSKLVKASRLLRQLLEQGTLDPEAHGPLVYRALVGSLSGAAAGDETPVALELSKVFTLASKRGQLFTPSQREVLEVLALRGVLRSQLLTTDDSFQFNKVVARLKEAVAALPEEPATLPESEGASEPGIAALLEADAKGAVIAAEVLEGVRRSHLLDCLEAGRVVYRWAGGKDQVGNLRSRIDDSSTTAHLPVLSHHFGAQCLGHTNSPPQFQDTHPPPPPCNPHRLPWARTSVDLLVDHFRQHVRCFLPAEQDRVAAMIVFVKEQRAARRQVGEGLAGGRGCWDHAPHGGPSMHRLDLPAS

SEQ ID NO: 16046 - protein, 116 aa, Chlorella protothecoides
MPPRSLRKRPVTLDEAHESGEEDAAPKLSVEDTRLLQRQRQRQTCSCLGANSIDASMLQGTQGVDAAALLQGRRDDEDRELALASAAASAAPEEGGLHAAFKRERQQDEGADNPHM

SEQ ID NO: 16047 - protein, 149 aa, Chlorella protothecoides
AAGRRGAAIPAITLLSVAAATAAPRALRALVHPGEVLAGLLMQIFFAAVGASGDVAAVAAAGPALLAWSAVSVAAHVAGVLLLERTAGFTRKETVLASNANVGGPTTAAAMAAAKGWPSAVLPALLVGIFGYAIATFIGLGMVVVYARM

SEQ ID NO: 16048 - protein, 922 aa, Chlorella protothecoides
  MOD_RES (638)..(641): Any amino acid
  MOD_RES (716)..(719): Any amino acid
  MOD_RES (893)..(896): Any amino acid
VACAGPAARAAAPPRAPRPLRGVARAERGPRTSAASRPSWRPARRSARGGWGLGVGEGESLHCARGWYPGVVSCCAHPPSTKPPPVNRRGAALAECQDMVDELQVGCWLGPGGACWVWAPDCLLVRPLAARVVHLGPTPDPGVRAPAQAFAEQKKAEAAQLAEALEVRMTCATVIVGGRRCPSSIPHDLLVSWHVRLPSLPTPAFPPFPSLTPTDDPPRHPQGANAGQRELGSRLRASEALLAEAQAAAAAAASRVERAERRAAALGEELAALRQMHDALQSEHTGACGQLAATQTGHELAMRQIADLAAQLATARAEAVRRAGSSVRFLFGREGGGKEATACEALILLQPLDTQPPPARHPSPRPGERGRGGRAGGRAARSAVEAGRGAGRLPGGLPAHLHLRGAGRRPGRGPRPGAGGPARGQWACRARGASGIRRGGGGRGGRGGRAAAAVHRDARGSAAGRRRRPAAALPLTERGWHAAGAGVPDPGLRNPPLRHEPGDILVRHGQRPTVDGRDDLGGHRPCPSSGQPQDLSFDRRLPSSHPLVAVVELAPSAMQRKKSKGALHKLAKMLRGGGRSKKAKEAAAAAAAAGPTLHRLSNGQTAGFLGPQVAEWEARQEAAAVAVGDRDGQDGAEXXXXGSAGGGGGGGRGPGWPGRRRGGAGRPPPPPVHAARGGGGRGQHPAPPGLVPERPLCSAGRRPGDGRRRVAGRLAXXXXVPERPLGAAGRQPGGGHRRVAGCLAGSAADARSGAEARAAAAAHRRAAGGGGGAVGAPAGLAQGPGLAGGAAGRQLAAGGGAGVGGGPGGGARAALQQRAQQRAVHPGRPGSVTCGALARAGTWKLTRSGAVMRRVTNCQTAGRGGLRWSQATDMIGGEGRGRGVCGGRRSRDXXXXTNCQTAGRGGLRWSRATDVIGGEGRG

SEQ ID NO: 16049 - protein, 580 aa, Chlorella protothecoides
  MOD_RES (284)..(287): Any amino acid
  MOD_RES (362)..(370): Any amino acid
  MOD_RES (391)..(394): Any amino acid
MGRPPVMTRTCHPGADPEDRSPPWRPPGGPASPACCWASHHSLATPPGQRGTARSDRPCQAHSRCCSSSKAGKGDRDVGRVQHPIARRARSAQAQQRRPDSSHDGPCNASQHAPPVPYHVDGPNILPHLIPSASSDAIPGLLGAHKEEYSLHQGSRGAVGVSDWELASLEESSRLGYRARKLSHRWGKPAGPLYAIMTDRGARRSPYSWPRAAHAHSMGDSWEDWDDEEAVPVVPVPGSTLAAADINSKFAGEDEEEEAPKWKANVPKPQLHGNAIRGGSISTXXXXEDRIKKGSEESGSSQLHGNAIRGGSISTVHRPLHPRQAKAKKMSKYDESKGLRSAADEGPLDDPIAEKLRLQRLXXXXXXXXXLLCNTTPNILPQTRFCAVRDXXXXSLAQGTGQPHFLLYNITPNVLPQTRFCAVRDLDGFVPKSAKDFEEYAASIVAKYLLPHASNSNYKTLLKQLFRKALTPLTATDTKDVETSVADLHSYFGHRLKGQREASCCQVPAVTHPSKLQDRHFTQFCRSGVRSEKLKEEKAATAGKKATKKGSLNVGRSGGTAGLDDYVYDDVGVDEDYDFM

SEQ ID NO: 16050 - protein, 149 aa, Chlorella protothecoides
MQIVWGHGSAGDVRVLGNILSTQPASDSSLGLRTEAQPLPTPPPPPAVTRFNLECLGLCPCLVDIEIMDTRNGNEVQLVTAGHAACACDSPARKVGWGGSIVEGWSRSRRGKVCTEIAAQRALHDVPSFKGVNGLLRVPEVHWKRSARR

SEQ ID NO: 16051 - protein, 207 aa, Chlorella protothecoides
MEIIDGFRILRSKSEERALRSTRPVMQPCSSCTLNHPPLHLNNPHIDPPDHVDTLRLLCTLTHHVIEACRARRGAPATAGPPAPDVLPTWSEFKSRREALGRGSMSLADTWRLMLASVRGAGHEAVAAMVQRHATPAAMHAAMRAAQAGGGAAAARRLLAPLAPRPGSRAVGEGSAARIYDTLFALEDQAAGDGAVLAKVDWGMGCG

SEQ ID NO: 16052 - protein, 261 aa, Chlorella protothecoides
MFESPAPPLGQSAVSRGEAGQGKRLLVLDGDTWRVREEIPLDIGPRHFSASAFPDAQGPESAADLRSGDRLRLVLNEAQVIDGMAAIEALQQQGESSFILDKGCPGSDAGGRDWSLPMHWFVKGLQSTLPSLPRRRGGGGDPGAGPLRGSGQDPGLGGPDPPPALCRIRKVHGDAGRRGGSRPLPAAGVFSGWWTAVTSTEGMERVFGSVGVGMMNVSKPAASPPTSPVPAPGALDEPGQLSCSHGVDLWAGHPVRLPFLC

SEQ ID NO: 16053 - protein, 188 aa, Chlorella protothecoides
MDEDEGVPGSQRCPATHHPGPCASQPEALSQPLVERLAAALDRARMNGAVASLPVQPGATTCRPSPPPPPAGACVPDAAPPSPRAPAPLQAAATLAGAPPPRASSPPCAAGGCVAASERLPPLHPGAPFEAQYDIIFLLDAREVFTRAADQGRSEALAQHLARLRAMGLVVEERTLPAGDGLWIARSK

SEQ ID NO: 16054 - protein, 160 aa, Chlorella protothecoides
MTRAAEDEDEDEEGAESIPGGDPSTKPKLLPALTAFQSVSGPPAFLNPEVGMRGESIPEEGPRWARSHLLSSLPQATRPVAAPARQPRPAQPDSIASGKGKGGGRGDGSWDVSKMAPKLKEEAAAAGPGVIKASAVQYRGGEGPTPVSAAAIALLGGGGC

SEQ ID NO: 16055 - protein, 82 aa, Chlorella protothecoides
MTGGEKPDRGKPSKAMGVEEFLDKGAGGAVLPRKRGDDWRNPPLVPHRQERKDREKDKRSKGQSSHAAWKSEAEMVLRQQYD

SEQ ID NO: 16056 - protein, 534 aa, Chlorella protothecoides
MSSCLHGALSGPHSSTRLSRSIRYGAMQQCRAPRAGAIPIMHSLHKPHRLARPLHAVGSDQPEDAAESTATERELLIEQVRVISDCRANWTCVHPLELHAPMCKALCSAGYFPSSTLQMVRKKGPKKQAGSNETRSSSSQPASPQQAPPSAPASVIESVLLRLLVGIFTVAILEGLALAASHRPWLPFAPSTPLTQGFLSSEVDSTISKYVYPAFTPTILAFLGGVRQGAPAPYIVSVPTIRFASRCCTACLDGMSPHVQCQGGLSARARTYRSPGVLPATRLSPTTLLLIIARWPLPPAAPPRCRGPGSPARPWPGPAPGAARRAWCRTRCCPGPLPAAPQSSGPPTETPPPARSSAPGEGKECTGSMRAKGDNDTARGWARSRPPASGFVSLPGELAAGGALTMTRARVSRHSPKAEQGLRGERRATGRRIGRCTIRRPGPGPARARQRRLELPVCQQIAVAPDRGGDLDVAGQAKARVGQRPLHAHGAAHHARAEQRVTRQTRRQRPEFFLAGQDGGGLAAVRQRHAQSRA

SEQ ID NO: 16057 - protein, 508 aa, Chlorella protothecoides
MLAQQGLHADAHGLRLAQMVQVGAVEGRVHVDQEPGRAGAVHGRQVGGQPLRLVRVRAVVGVGAEHDHVGARQVVRVVQRRTRPGGGVGKVEAGGVGQPAGHARGALALVIALGEHPHAARRQRRHHAVPACPHKPAHPYTTHSPGSPPLVVAVGVRQVAHQHDRGGAGSHHVLQRLQRVLGLTEVADHAQPVVMHPILEIAWGWDAWQLMCTNALQTGWTGMAWGLPRGISSQEGTVAPPPRFPYTITPVRPAHAVKDLGAGWEGTWGLASRDEWYEMEDCMCLGTCKNIMSCLDLRPPLTMRHPIQLTVQPNDDLVEHPRVVVPNRVTGGDCAPGLAGVHPRLEPVLHNGGAGAQPPPQPRMPQLDGEVAAQSVQDAVRAGGLRAGGHPVHRDRPRARQGDVDLGGTGQRSDCDPGDRVTLDIGSKRGCNEHAGSRLERINARIAHLSLYPYPFRNQERCSPAPELKAQPRGAWPDECELQASAPWELSAQNAGSWRSRPVTPRRV

SEQ ID NO: 16058 - protein, 155 aa, Chlorella protothecoides
MVEKKLPIMLAPHKTAQTAAHTVTAQVWEIVRHGLIRPSSSPRASPVLLVGTKDGSQRMCVDYRALKKPVHQVIGPRRRVPILDGGLVEREVVDAHALRPVLFVDQEDGQRPKVGQEPEWCQGYTPLQWHSCAVKGSLYGIWRIWRFTSPVSGGR

SEQ ID NO: 16059 - protein, 173 aa, Chlorella protothecoides
MGSASFARQALTVVLALACVTLCAGSQGDFSNSLHFVRKAPKGHLPATHTRLARHPSAGPSAPEQIHISLAGPGAVAVNWVTPGPETSSSHSILHRLSRHLPIQLRHARLGRRLCPGTSIVQYGLESGVYTSQARGAVPTCYSVGDYDSGVLHEVVIGLDGELDRVPHCQRRS

SEQ ID NO: 16060 - protein, 248 aa, Chlorella protothecoides
MHHHRLGVIGDLGQTEDSLETLEHMVASGPASVMLVGDLSYADGDHERTRSWRVIRISSSLPPKALPTITLHPPSRRDTWNRMVSPLTSRSVWMFTEGNHERERASGVPSWLAYTSRFHLPHAASGSGSPLYYSYDLAGAHVVMLGSYTDHGADSDQAEWLAADLAAVDRARTPWLLVNMHAPFYSSNLNHLGEAEAMRVSMETLLRQHAVDVVFAGHVHAYERSYHVYDGAPDPCAPIYMWVLERRC

SEQ ID NO: 16061 - protein, 132 aa, Chlorella protothecoides
MVNAPPAASSPGRDTKPDAGGRDRAQPLAVSLSPFALIEPALKIEREVESRWVARYFEERLAEDPGSTWSGTMLSWLRQELGLAKVALDYLGLEMVVRVSRPVTPGTRFALRCTNVDRDTGVVQLEAGANVR

SEQ ID NO: 16062 - protein, 180 aa, Chlorella protothecoides
MLLECTPEQEPDMFRLHAGRSVPHPVIPLHSFALEWGDAQGHEATDSDRWESRAVADSMLLLQSSHPLRNPLPGSSPQASLARVAWRTSQGAIQFSMPEASIGLASGPDGRQRVTIQDLQSRESASRLLVAEMMIAAGEAAALLGERGGIGGGGVRHRLPSTGKCSMWCHACTPSSLSPN

SEQ ID NO: 16063 - protein, 584 aa, Chlorella protothecoides
MGSHSHFNPPEEVPQAEGAWEWFRGMGSPQFWVAPMVDQSELAFRMLCRRYGCTAAYTPMLHARLFLEGRAYRAEHFTTCDADRPLLAQFCANDPDTLLHAARLVEDQVDAVDLNLGCPQRIARRGRYGAFLMDDLPLVESLVRALAGGLTRARVTVKIRRFDEVGRTVAYAAALERAGASLVAVHARTREQKTAAAVRADWAHIAAVKAALRVPVLANGNVRSLADARACMHDTGADGVLSAEPLLADPGLFWGRRGEPGGDGGPTEGCRLLLEYLDLCDAYPAPFRMVKAHAFRMLGPWLAEHTDVRDELNRGPDLCNERVRELTMELVDRIEECGRDAPIPKISAKLGHSSVMSCLIPSAAPWVRLCSVQCILLGLHEARLVPGLDPAIERKLAAMEAEAARAAAIAEQAREAEGLAELGVHISRSAGVSIFGTSRASAPSVNNSAARHSRRHGLLCAIQPDVVQRDLTLHHAGVQVYEPCGQLRQLSNGYSSPGGDGFGHGLQLPPRDVDELRMGWGGVGRGFPALTTGPSTPPSSHQARVPTLATHLAPVVHDAGQLLLGFQALDLLDDVRDLQPKLGR

SEQ ID NO: 16064 - protein, 896 aa, Chlorella protothecoides
  MOD_RES (360)..(363): Any amino acid
  MOD_RES (396)..(398): Any amino acid
  MOD_RES (671)..(673): Any amino acid
  MOD_RES (769)..(772): Any amino acid
MLGWRCEGVHAAPRRPPCPAQLHSRYTLTRSFVSQTPITLFRAKAGGKQSTQDATGKFAKSAGSRLRRYNEAALAEDVKSALTSWTALLGQCDLIHVQAPGSNWKDLMTAAPAVLSPSDPRLRTVPFTTRRPTFSETKRVARILISVYRMPATGQPSQPSVEAPGGEAVRGKQSEAGPGSQPGAPRPGVSAEVISAADQGPAEPEAPKGLSKKQKAKARAARSKAAAKEQAAMGGESQEEEPAPKSSEPVADEGDVLSRAAALAAATASAARKGGEIGDSYDISQGLVDALGLAAATPARSGRPATQARRADGGKKGGKVSAEDIAARRVRLAAAAEARMAALASASAAQKLCTPGQPLXXXXLPTFLYSVYLPLLARRGTECSANHQSPPRPIPXXXRLWQEEDGGLIRNRGGWGPDEEYLLTQVEISNTEAASLSLSCFARSTPYLPFRISRGTAHIPLFSVLASGNLCDEALHGHHSWLLCNIQVPARQLHRPGCRSIQELQDAQAEGHTGEARLGGQVKGQRTAALGEAQPLPFVQRHPFYCLWDVVGKHLRHVSSKPAPAGQQSQQKPAPSPPLGFQPEATAWLAFKQPPRYRSDPSIHLSCRAAGPPGQQPWGPLPAHRSRRSARSAPPPRQPSLPHPAHGTRARGPRQGRRPQNPATWWLGPRXXXPSHPVLEPGDRAEGAAPEIQPLGGWVPVKRPHSGLRLAVLPGGPDRTPRQPAGEAGGHPLVPGQAISHQGRPSCGWALVCSASFVPPTLATGRHPXXXXPRLPARQPLAGRDWVWVPGRVSRVPGRQLCELVGREVLRQRSGKTEGRPWTGACMEASWALVKQLPNPAASQDPWLPLSPAHLRPRALGAPSWPPSRAHTCRTHPPHRSRPQQSRTTAACPSQP

SEQ ID NO: 16065 - protein, 235 aa, Chlorella protothecoides
MAQDAGLSGPCIASPWPPPDRPAGVRVLRWQRHHPPGPDGGARFAGGSPPGFGRGCAYWGGLPGWPRGCKALPCLSMCRVGWAWWSGPRPVAPRGLMHESRTPSIPALTLLSLPSAPTPEVYTCSACGAETRFPRYNDPLKLLETRRGRCGEWANAFALCCAAAGLRARQALDWTDHVWAEVFLPLRAGEAPGRWVHADPCEAAMDTPLLYEVEKGKGEEGGRLLSWTAVQHGRV

SEQ ID NO: 16066 - protein, 610 aa, Chlorella protothecoides
MTIKSVSRGMGGRQGPCLLQRTLNASWWHRSSVTHPLALLTADELDSEARDEDTKIAQAAEDDLGLGQVRRVATLAVEAFLAADLTTTRGRSRGGSTGSTHGRPIPHPSSTRSRACAFLQGATLLATEPSVMEEEQVVLSPGSSISGLPARGEAEDGTDDAASVGTGPASPRGASRLRESVLRADEPGGDLSGEAAELEAERADTQAQAGSLQDAEEVPPPEAGAEVDVQGSSRAGEGSRSGEPAPRADAGGGDGARREAGGVTTAGPSAEEADAASSGADGAAPPATPGPAPAPAAALTEDDSSPSSEASHEYAANESAIVRLKHSLQAEPSADSPATLAEQGRAMLSLTTAGGAPAPAAAAASQGPGNEAEAEEEEEIEDLTIYRSGESAGGVPQHGEAGGVPSTSAPPKVEAASFSMEAGPDSGAAAAPAPPSPVVLPEEFNPAWEETFRGLVYADGVDSLGRPVVVLDADRVPAGMKSSAARYVTAHLARLVEGGDYVLVLTARRATLPSMWIMGAYTTLPRPFRKNVKVIVLVRPAGFLRAVLALLRPLLSAKAARKLRQVASLAQIGEATGGEVGVEHLGAAFLASDAAREELGELAAAARGEA

SEQ ID NO: 16067 - protein, 252 aa, Chlorella protothecoides
MPLLPQPLLHSQHPHAPSLLPPLTHHHRSICSGVQLRRARAAQGSGRALHGPRAAGRPLLRHRGHLKRPHGQVLQEPGRDLEVRLPAEAAPPRGHRPGGRGVQDRWLRGLLHLLHDGGGERERDQLRFEEAQRQGLLGLAREGALASRPVPAGPEQPASHEGTAVVPTGLEFGRPGFVKYREFRFHPSLSNARRFYPHAHNLDGEAGACLPDYLENGWAGMVGSHWLMQGLTGKGGHAGGSLDAASWPPPPR

SEQ ID NO: 16068 - protein, 259 aa, Chlorella protothecoides
MAGHYMLQGASSFLPVMALAPQEGERIVDVAAAPGEEGQQEWCCCAGRGYKLMEDVFFASREQTTSPCLLLAPACCKIGRFSLRQMDAVRLMPPAVLLPKSDLTEPTLCASEGSTPAVVAWEGEEAPRCLFPLPAPPDPSLVFGTATSRLYSPHCMHLGPSLLLPPSVFPNCPIFHGTPFHTAPTPLSLLLTSTPGPPLPRRQDHVHQRPAAEHRHGLCQRDQQGPPQVPDRQPAAHGRPQHRCGVAAVLLAKEPPLSL

SEQ ID NO: 16069 - protein, 451 aa, Chlorella protothecoides
  MOD_RES (355)..(358): Any amino acid
MSIGREGRLYRRNNVHQNPYHSCVLKPMPPPLNPLYPPTHPLRYVYDVWQDIKEIRQKVVRNGVETVLSIGSEDKRYNIYPHRDRWGCWSSSLDGGGAGPTLQGAEVDSVPLKGAAQSTLRALGQEQGAKLVHGERERLIKALTFVLPDLAESRWAYRGKARLAGAEADLYVWAMHEESMAMEYRMYVDPATSAPLQLHQLGTNLLTGGHKDEYVLDYYDYAPGAVADADFNLPADSHCDTPDFAVAPNGGDLAARWAAHLPSQHWGEPAYDAFAHRHGRRHAHAEEYAARAAEFSANRAFVARWNADPNRTHDVALNRFADWSRAEYEAVVLPRATAGAAPRTLFSQAPGVARXXXXSGRGPAHAVQPGARGRAPRAHHPRTHGPGLAVLGGHTGRLPGQGPGGLRLLLDLQHRGALRGGAVPRDGGADPALRAEPPGLQLDGDQPRLLW

SEQ ID NO: 16070 - protein, 217 aa, Chlorella protothecoides
MQKASLEVLCVTLQPWMCVEGRDEWVAAHLNMSTGPIGLELNIPLQPPTHPFTLSYLALRPPGGQQVAAMDWIFANGGLAAQADYPYVGVNDWCKKDVPKKAFTGKAVLVEGGEEALKEALYTQGPLTVSVDASADSFRFYSGGVYRNEDCKTKAADLDHAVILSGYGTTEEGVDYWLIKNMWSTYWGEQGYMKIPRHPNDCGIAAEPVYVDLKVEG

SEQ ID NO: 16071 - protein, 900 aa, Chlorella protothecoides
  MOD_RES (24)..(27): Any amino acid
  MOD_RES (92)..(95): Any amino acid
  MOD_RES (193)..(196): Any amino acid
  MOD_RES (519)..(522): Any amino acid
  MOD_RES (647)..(650): Any amino acid
  MOD_RES (678)..(680): Any amino acid
MPLWGCALKRGRTGCLPANPGVLXXXXRKDALVGVRTEERQDQLPSRQPGSLAPSCPLRHDRWASVGPLFIQLVPSSQPPAGHRGEGARHRXXXXPVGPLFIQLVPSSQPSADHRGEGARHRIAMESLSREDVERYVQGQAMQERSRNGAWRGAAMQSLTPSMQAHVLRSDSRGCGAGAQGQPQGRPGLDQVXXXXTPLSQGNSSVYAPNFAHVQVLTKWGGALLELAHFRQGSDAYSMIEEAIEKFQKALGLDAGRHDALWCLGNAYTSQGFLSPDAAAANAFFAQANESFRKAVDAQPANESYKRALEMTSKAPALYLELQRQLAAAGHSTGGESASTSAGPGTVQKSSSLGYKGCPVVAIAELSEASTDGSHCQLTPWASPASFSFPEAGRRHQRLLVRRRRLGDPGRPRCLACPAFIQTPARRLCPALLASWGLAACVVLPAPAWPQAHPLTIFPVHPTCTRSSFARTSVTIKVSGSRDGLDAQRLSLRSGSISMHMDALWEFQTLLSLASINQXXXXSGSISTRMDALWESQALLSLASINQERQPCSLSKPRSVCTYSNCSACSSRHRSDRGSGSLTPSRAARFDPGPAVPSCIPTEASRLRTSSASRSGAARGAVAGPPASPPGPPASASAGAALAASSXXXXADRSSARKAWAPSSGALGPGLAPSWRRXXXRGRWRGRPPPRPIRQDRPLPARRWPPAQPAAPHHTPPRSRRCRCRCRRRARPSPLGPGPPRTHRWQSPRRRRTPPRRMSNVPGRRPCRPPSPEQTAALRGRRGPPARAHGAQDWPLPGAGAGSACREEPGAGMMFGESMCDQGLAAALPAGLFGSAATVWRSQPNSRPWLLHLRALPGERRGEPPALPPRPSARSRNPRRAAQCLPGRTVRGPPPASGAV

SEQ ID NO: 16072 - protein, 698 aa, Chlorella protothecoides
  MOD_RES (36)..(39): Any amino acid
  MOD_RES (656)..(659): Any amino acid
MWDPSLEEGTYSGYPVWAEAGVFVGPSPQISPSGSXXXXTRTFEEAGVFVGPSPQISPSGCSTGAHTAGAQRCIQGADVAHAWLYGDRKGTVPSKSDRISDDELNNKILQLQWICGVRWASTRWHRRRTQSTTSSSHTQARLTPLMCADQSSIASYLIVTSIASKAPLSCTDVDAPQLRALKTSCLESLLPWLSQHIWQRGRFDIQSSAERAVPWRQKNQRKGSKSTPALDPPRLSLWGSVCFADNVEDEWCVVWLLTQLTQSFPLDVRVDVVNRVHTHRLSMAGQCRCNAVSNLPNHRVWDNDGEFLLIEAAHSLPRGLKPEIADNRLWLSCAFKSRIISRCPNHDPLPHSRQLWPSCAFKSRIISRCPTHDTLPHPRQVWISGGRFHIVPTHLLPGSINLEQGLQALHSPSVPTAAPAGVAAALEQRLDAFPRFLAVQRHVAHAVLPLAAVRLLQTAPQLLPAAVEAFYYRDLDDAKVGGPGSWVMMSSSPDPSRSLPALQAAGRPVHFPPRDLRTTAVTFSRCLYAQLALQEFPGMAGFEVPLPSDPKVHSLMTLSGPDGCSHSIIKPPCLTTVCPPPLPQFPAASLGAKLAAGLEMLVAQRAQHANDASMSDTGCSLVATWDDSSPAGYLAVNERPRTGGVCAHTASEAGGXXXXAGYLAVNEVRRCRSMWDILGRAPLKACTTLPMMPVEPQC

SEQ ID NO: 16073 - protein, 226 aa, Chlorella protothecoides
  MOD_RES (141)..(143): Any amino acid
  MOD_RES (222)..(225): Any amino acid
MTRIMLTVVISLVYGATYFGQGRIPTDGSLNVARVQNVSGLIFSMSMFLGMFNCMSIMPFISAERTVFYRERAAAMYAPGPYTLATSIAEIPYLLIQTVIMAAISYWMGGFDPVAWKFFYFLLIFGLSLVGGEREVGRGVXXXGLEVLLLPAHVWAQPGGWEEGSGEGVQGGRDRGSYRAEQGNGWSEGTGTALIDAGEAHRMPWGLDRGRGSHEVAWQRAXXXXR

SEQ ID NO: 16074 - protein, 122 aa, Chlorella protothecoides
MTRRATQVPFTEKLKVVKIQGDGRCMFRAIGLARNKGIFLGPEVEVQEADQLRGAVTEGLCRSKKRRADFKEALVSIQTEDSLDKCARIAWDGREAWDDGWASGKLESPRYMTMQSCCDCLS

SEQ ID NO: 16075 - protein, 126 aa, Chlorella protothecoides
MAASTAVDRDDTGMAGPGADSGAATSSAGTHPRPGSTDPARLLFMARRLERTLLSYERCGWADDLPTRVLTRQELRPAAEQGPILLCLDTSGSMQGEPESVAKALALEATRAALRQRRRCLLYAFR

SEQ ID NO: 16076 - protein, 183 aa, Chlorella protothecoides
MADQERRVFLTVGTTRFDALVEAVDSTAVAAVLRRRGYTHLTMQIGAAAFQGSRLLPAGTTRGVLPDGLVVEWFDYSPSLAAHVAGAALVVSHAGAGSVFEALVAGVPVVAVPNPQLMDDHQAELARKLEGAGVLVAATLGTLEHVLATADFQGLESYVPGDPGGMVAAVDWLMGVGSAAGKK

SEQ ID NO: 16077 - protein, 385 aa, Chlorella protothecoides
MRSVCDCRCQVRAPAQGREQACTPVSRHAGGAATHIRPIGRSPGLASFLTGAVAAGILAVAPPSQAVAPFLQSQGGQGPLVEEEARLFRMREQYEGEAAESLAKARSALEEETRTQQRSSSLLCATPFGVDVVGITEAVAITGALVGGVSARRRKLELEKLNERLRTINQQLRQQARAGVMYAPGLTYAPPAGGRTDNGAGAAQGAVALPGASNLTLVPPMPVPMPGTAEGADPPGDWGGVSGGGGSPALGGMGLSVLSMDDEEGPSPESALKEGKRLLKNGSAGAAMVRFEKAHMLARSLGDRVKERRAVRGLAAASRLAGQPRQAVKHLLRVLEISRDMGDFVGDADAYGTIADIYTDIGEFEHAAEYYDKYIARMDNTGSPV

SEQ ID NO: 16078 - protein, 147 aa, Chlorella protothecoides
MQPLPATQSLEGQIIEYIQTRKTVELDALAAEFGLKVADVIKKVQGLEAEQKLTGIMDDRGKVRGEGGDASLMEPPADAAPPHTQFIYISRGELEAVAEAITSRGRIAIAELAQLSTRLIDLNPRVVEGEVSLDDVGLDGAEEAVAA

SEQ ID NO: 16079 - protein, 305 aa, Chlorella protothecoides
MARTKEVKKAATKNAVSGGKRCVVCEVVAQHAFCMAVTVLTLLPSFPLNRSAPPPKLPTPDVSEDDDPSESELNDKMELFSDMEGSDASSVLDDEFDGEASASGDEASGDRAGEGSEEEEEDDDEATSASGSEGSDYDESGGSDADGDMERASARLDRAAAGRRAAAEAETAELAGEGGAGEGLVLPDEAARAEEAIHPDLPGVRRRIKDIVRTLDAFAARRDGVHTRAEYTDQLKRDLVTYYSYNDFMIDALFNLFSASEAVELIESCEQWPDAAAGQSSEAVLAVPSVDAHGQLLAVPRHHVA

SEQ ID NO: 16080 - protein, 140 aa, Chlorella protothecoides
MRRQGTPRLLPWRASGPAAQVDGGVTSVSGRLFERQPGCGLRLETERWGGSRLLLRLLASRFAGHMPQMFSHHVPQTIEWVTLDEREGLCFPERGSALSFDLPTESCFPCVAFRLRILELLDRAAAGAVQLACWDLYVAQ

SEQ ID NO: 16081 - protein, 250 aa, Chlorella protothecoides
MAVAIATVFDLPEKTFARCTPLDAGPSTGVQLTLERLEALEIADRRTDADASGLTCTSCGLGRAQEPAFPSVESQREHFRGDWHRFNLKRRLASLPACSEADFEALVAQRDGAEVGSLSGSESSDDEDHNGGGEGKAPDRADGGPSASTSGARGPYTCFWDPGEEETLGVWRSIVGGARDAAPSEEAAWSTLRTLRTKGATWAVIMLRGGHFAASVLRLVPARIADKRIADKFDVVGNTSAHRYVTRWVL

SEQ ID NO: 16082 - protein, 209 aa, Chlorella protothecoides
MPAHVCAPHTSSRAPQPPLLSKAFEDLEPLMDSEEGFTPEGAVWQKSGWREVAELSRRLARLRPLQRLIAELGRGGGMGAMRRAPAQACVGGERKARNEWRCLPYVSRPGSSRRSEECATSCSGATAAHGRVPRPPHPLPPHRSPPDLCAPLPAGGGGERGLALPDKGPDPVRGAVTHPALRAPPAGQGRRTGARWEGWHGRVDTGGQG

SEQ ID NO: 16083 - protein, 100 aa, Chlorella protothecoides
MTVNPAPPPVDALLLDLDDTLYDVPAMKAQVAANIQAYMVKYLGVPQEEVYDLCFKCVGWGYKIDADHWHAEVHHSLPYEQYLRRDAKLRSMLQRIPLPK

SEQ ID NO: 16084 - protein, 167 aa, Chlorella protothecoides
MKNLSPRYIFTNADRKHARICLDLLGVADCFRGVVAFEDGVVAFEDVQAAAAARGWARHGRPVVCKPEHQAYLLALEATGLHPARTAWFDDSTRNVAAGKRLGMFTVLVGRIGVEGAGADVQLASIHDMPAALPWLFEDGEERGPGRGAAEAEPSEPCCTAPALAAA

SEQ ID NO: 16085 - protein, 448 aa, Chlorella protothecoides
  MOD_RES (169)..(171): Any amino acid
  MOD_RES (326)..(328): Any amino acid
PTGGGTPAGPATAVPSLDAGRAAAAAPERGGWDPATLTWVSAVFPVQPGVAEVQAFRLPRPVLCVGGCVTVELLGKTQRQEEDGLLYGAAPGVGVHFRWGVGGGGRKGGWDSSGGGQSARRPCDPCTSVAAVRRPCGPGDRMAPCRWKRPFPKSYPSPAQTPPPNPPTXXXGAMQVETPFPEVISQPCANSLPQSPITRPRSVPVVRARGGAPALQLRHGPVAARGRRGAGGAGGRPPDRPGRAPDHGEAAACRGAREWACVEGGEGSIARLCMWRRPAPEGGEGQLVAAQAAALCSWGLSQMASQQGLDSPIVHCGPSHSGNDPXXXAVHVAPSCARGVGGTARSSSSSGVVLVGSLSDGIPAGARLPDRTLRPRHSDNDLPQEVRRNCTFTGGDVACAGGQGRLARAGGGLGGLPPWSGLRGREGSGVDKAEQAFAIVVLEGPGAE

SEQ ID NO: 16086 - protein, 396 aa, Chlorella protothecoides
  MOD_RES (335)..(338): Any amino acid
  MOD_RES (358)..(361): Any amino acid
MSGKHGSSPVPVSGGHPTRAGAAEETLKGGWPRALGLAGAPAASRGWEGPPLTQVRHSPSPSHLRAGGKLELNTRVDRGLHALYAAPGEMYLCPSGTMAWITKRLGSEGRMRLRRGYVPPTQARVRVAARRGPGPWVAQQSSSQAVGGLTPMRTLPASALGEGLLPDLPGSSPAEADPHPLPAQNQGILEKEADLKAEAADAAASSTPVSHLILAVHGIGQTLSSASISTVGGSPVWRLGGSGCHSASSGHSIARTLSYLQTPQRPIIPPLFHRTPPPSGASCGRLRRTSTPWASRGAWRSCRCSGDASWTCASMRWPGGSSPPVLPPCARWAGXXXXVAGQPFQHDPGEKQPPGCRXXXXTCASMRWPGDSFPPALPPCARWAGGKEEGGPGGGA

SEQ ID NO: 16087 - protein, 975 aa, Chlorella protothecoides
  MOD_RES (7)..(10): Any amino acid
  MOD_RES (226)..(229): Any amino acid
  MOD_RES (524)..(527): Any amino acid
  MOD_RES (679)..(682): Any amino acid
  MOD_RES (742)..(744): Any amino acid
  MOD_RES (813)..(816): Any amino acid
MPAAWEXXXXQDVGKGDETGKAQRTIVGQWASWGPFGAPPAQGNGRDVDLQSLKSRVLPDRPEAGMGMESYTRAVLEGMARYRGDLGNASGAVEGDPSSALQASLILSIDRRHGAASASRVVDLAIRLRREGHPVVGIDLSGNPSLGRWEAWSPALDAARRAGLRVTLHAAEVGGGRVAGGLGVAGGFYSPGRQGMCIARPLALRSLLMNPTPKPSRCGTQRRLGXXXXAGGFHSPGRRGMCMARPSALRSLLMNSNPQASQVWNPEETRAMLEWTPDRLGHMCCLDAELEGLLVSPPTPCPACPPNQHKIQVPHSPGAVPHQQRRDPQRAQRGRSPLWLAAPCQPPHSPLHRRLGRVQDESQPGGGSGHGRLWSQSEAGQGPDARRDTRGLPGRPGARRPGGQISGPAGCPPGLNGTGSGQQPGLHHENVPCCHSEQGHYMIFDAGHRGPIDTLVTELYRHSPAGLVAGMGFSEGPYSPAGRLTHGRPAPADGALPSKPWVRMIPRGPARLHIHAILGRSASXXXXPPQAVGQDDPSRACQASCSCNLGQVCLLSILHVCSSETDPCPFSSAWLCWWHPGRNDETHGSASSRVGPCPDGATLTGHRSTLPPVPLHCPAHAPRRILCNPILTLHSGAWMIPHHPPPLLPGRDLTSPLQGGPGPLHPPTPSSRLCSRACXXXXTSPLQGDPGPSHPPTPSSRLCSRACSIGMESCRYLSMVVLLHLDIDSHVAQSPQTRPDTXXXPCQYLSMVVLLQSDLDSHAAQGPAGPDDQRRGQYLLASPFQRDSAQKQGADRSRLKPDWEAIRFCVCKXXXXQRDSACTEARSRQVPTETRLGKPSGSAFAKHAAPFQNSVAMFGQHCGVTDEAGIECWIRMGIKQWFNQRRGLGQGGTIATVGKQGCTEPGWVGTSHHEQEHRSKGGGGRGERGRGGGRAGGGRLRRRADGRLQRRGGGGGHWSQDGAGGRLGAGGGGLG

SEQ ID NO: 16088 - protein, 285 aa, Chlorella protothecoides
  MOD_RES (196)..(199): Any amino acid
  MOD_RES (269)..(272): Any amino acid
MPKSTTPASPTPGPHASREEAGPRPEAALPRRLCGLWHHRPHRGCARAVDRPGAKHGPKRHRECCRAGQLRPDQGEAAGVGWGLGKWELRGMGFGCVDERLTPILFFPSVANPGLFKDNVYCHIASGLGAGFFAVCVGSPVDVVKSRMMGESFIVCVPRSGPAVCGGGNPGTAAAHRHPPSLSPPPYRFTLSLTPXXXXQDRRTPGLLQRLWAQLCPAGNVSGQAGTICLESVPLASLGLGEGQQPHIAAHRAPPPPPLPLHTVPHATXXXXLARDPQSPRVPEG

SEQ ID NO: 16089 - protein, 81 aa, Chlorella protothecoides
MDPPIKGPGATQDLTQEFRTQTRGIHSISDALVNARLVFLLADRTLYGRALTCFYLVHKQLDISLHAAAVSTSNTGTWALE

SEQ ID NO: 16090 - protein, 66 aa, Chlorella protothecoides
MSRSELAVVYATLILNDDGVEAENINSLVQAAGIEVEPYWPSLFAKLAQKKSVDDFIMNVGAGECR

SEQ ID NO: 16091 - protein, 136 aa, Chlorella protothecoides
MLGGGQGKGLPFQVAGKSSFRAYHAHGKPSFGAFHAHGARQQCPQGHPSSLSHISAGLQRQVLFGGLRIGMYDPVKSLFVGKDHVGEVGLLTKIAAGMTTGALGIAVANPTDLVKVRSLSRRRLGLVAWTAGKCAV

SEQ ID NO: 16092 - protein, 169 aa, Chlorella protothecoides
MSGQSPLPSTTVLPHPPQTLCPLSPRTGTGFFINSFLIMTLVYLNIWVILVLALTNSMLVVDPYTLTVINALTGQAVAVSVNQAVQLGMLSIIVFAVELLLEYGIVKMLGTLLVQFVQGAWKGVPGVGGDAWTAEHVPGPEGGCAVPGGGAVATTAPALRSAGMDCGVS

SEQ ID NO: 16093 - protein, 300 aa, Chlorella protothecoides
MTRSRWRIGPALLRGSSLVYPTRAPPNRTHPGTINKYERPFPDMGHSPVVLVGFREWVFSQDSGAMGPGFGRGVGGGAALPRPACGAALEDVSCAGQLRRRDRVLLWLRGPEGDDLAGGRALPLWPPRHVEQAVCDDARRGVQGDQGSRLSAGQQGGVCVGGAAVGSPLPALPVDAGRGTPAVHLASSPHQNDARGFHISEDVFAGYNHTLRGGKTKFKEYISVGKGRDMGFDSINSFESKVCGVGRVCRSLGRPSALSGGQVCWPPDRDLPPQDSFLRLTPLPLHPVGVWREWGAGHVP

SEQ ID NO: 16094 - protein, 808 aa, Chlorella protothecoides
  MOD_RES (170)..(173): Any amino acid
  MOD_RES (429)..(432): Any amino acid
  MOD_RES (747)..(750): Any amino acid
MRHRPAMPLLQVPPRPGRCAPGNTAHAMHSLRKLRPAWQKVRPRGALWEACLKQVMCAVVPALHGEVCCGGSSFIWSTSCGLDNLTHLFRPRPFSAPAPPPSSAPSAELGPREGIRNIAIIAHVDHGTAALGGDALARCQTLCAAITFKVLGAARYGPAPHCSSSHELCXXXXKVLGKTTLVDAMLKQAKVFRTNQAVEIRIMDSNDLERERGITILSKNTAVRYKVRDYWPGRTGLTSPARDSHAVAPCTISYLDPPHLHPSGNKAPSFPHGPESLLPPPIPLIYTCAQGVKINIIDTPGHADFGGEVERVLNMADGVLLLVDAVEGPMPQTRFVLKKALALNKKVLVVVNKVDRPAARPDWVVEATFDLFVDLGANDEQCGEPWVTVPLWKDRCVRGGVAGEGGKSAGGSGACTERYADRGWQSPAXXXXVADFPVVFASGMGGVAGTDPNALAEDLGPLFESILNEVDPPQVVQQGPLQLLVTNLDYDEHKGRIAIGRVQSGAISKGAPVVFLKPGEEGGSGWSCGSLDGSAVPKPPKAGRCCRISPSFDQPPSTARLPTTSCTLTRPSHLIHRHTGSPPTSAKVTELFVYDNFARTPVDTVEAGDICAFTGLSAVSIGDTVCQPDALVPLPTIEVEEPTVRMTFSVNASPFAGHEGKFVTSRNLKDRLERELERNLALRVEPGTGAESFECVWLVGKELPHSMVAARPLPAPVFDHPLAGFPQSSLPSPTPTLLQGPAPGHPXXXXCVWSVGEELPHGMVAALPPPAPVFDHPLADFPESSLPSPNPTILQGPAPGHPDGEHAP

SEQ ID NO: 16095 - protein, 175 aa, Chlorella protothecoides
MLTATKGTAVLSTILSGYEPWAGDISTRENGSLTAHETGQVTAYAVESVQQRGRLFARPGDAVYEDQVVGIHQRAGDLKVNVCRKKALTNMRASGKDNTAVLTETIPVTLDYALEVRLVCEPVGTGCCSWAVPETRARIWGWWFQSVVWGLWVWERGRDLKFMRKNPAPAARDTS

SEQ ID NO: 16096 - protein, 345 aa, Chlorella protothecoides
METYHWPAMPTLYIESYYSPRTEACTDHEVTTKALPLPPARQVLLEKNVKLRTIVNKLGSIDNEYRVFDMEVIAGEEDTVTEVGTVKGLTLVFRVDALLDAADLWCFGEWVDDPAHECSPCTREVYWNSRLEREHTRLVTTFAPGQVILDVMAGIGPFAVPAAARGCTVRCQRGIGCQEEAGGNALVSRGRTMPACHVQRGMEERCFTVYANDLNPDSHTFLCKNIQRNRVTERAFAFNMDGAAFIREAAAGRLAPAALPPLSAAKRPVPSTAVQESKPTQRLPFHHVIMNLPASAVEFCSAFRSAFPEELWEAGSLPKVHVYAFAKGVDCEPGDRGIAGYEEDG

SEQ ID NO: 16097 - protein, 184 aa, Chlorella protothecoides
MPSGGSWRGAGVACPLGLRLSIALEPASAPLPREEWIPQGAHHSIPSTLERRKSLGALEVRVGVLDGAERCARCGRSLQGPPPLSAGPSGGAVPQVYLFPTGNAFHGSCLAAEVAALAPALQRRRIGAALAELAAGRDVARHLADLNADVASEDPYWGEAMVRQVRKPFLDGPDAAAELASWAL

SEQ ID NO: 16098 - protein, 363 aa, Chlorella protothecoides
MQKPESIPLFLYMPDGLRPCYETPRPSSRRRTSGTGADRRIHRCHRRRHADTLSIQCMRLWTSGTSCACASVSVLMWAASHAQQAATPRRHGRSHVAEPEGWVEGALRSDLKVLPPAMDLLEDWNNIVSDDVANPNAEDEPDIFDLALLRDFMSRGRGTPVAVALSGDTLVVATSRNFLLRADLSDGGQASCVEIDLQRPGDAVCRQVWLDPLGSHCLVAASAATGAPETLYVDSAWKKARILSKMKGMALTAVAWWPSLQPSHTTRWVLGRPSKHTSHARSFTVVSGKDGLKPGSVLLPATPGPGRPEEGAGAAPAQPAGPKRAQRGTDCLASHWEAARAGPDPLAHPLLSRGGQPAGLLQR

SEQ ID NO: 16099 - protein, 673 aa, Chlorella protothecoides
  MOD_RES (221)..(224): Any amino acid
  MOD_RES (327)..(329): Any amino acid
  MOD_RES (554)..(556): Any amino acid
MDRRSLRERKVSERFAVLDKADQRQAVNARLEALEEDDAQENALAPGSDDEDFTVREDSDGGELDQCAGPATVLLILYPCHGSSGEPRHPPCAESIPAAGGSSKKRKLKTGSMRKTRGMVAERARGPKLFRDWLEEVGVLAGNVGPRAWRRHFPTAASPISGVERRAAMVLMSSASAMGWHMTARASGAQSCSPGESHIRGPARRRSPLPPTHPPTPQADXXXXAHDPGPNYLTAAMGPPRSRSTRHSCTVCGDASKYSCTRCGSRFCSPSPPCRQVGFEAKVEERQASRAQCFKPDIGGATQPSTRAAPPAPVPRPQPRLPPPFAXXXGWSDPVKHTGRPACPRPPPPSHAFHPPSLHRMLCQVAERARCRAARTAASTSSTTRRAGWRSLFPGPRKTPVRTRTLVQGGPAALAPATSASGLSPTAQMAPKARSPQPSAAAWACSEAAARQAAKAPPPRRGAACAPAHSTSGLEKTTCTGSGSQVPAPGGGRVTGRAPGTARPSTTSSEVCSAQYQSEGSLSTSTARMGWAEPSPAEGPGEGVGRAAAAAAAXXXLTSNSHLGKGHGGGVRTHQLLDGHAAAQAVAGSQTVEVAPPHQQHAVVGQGGRKRLERGVALHHLPLAHPHAQLGGQAPGTLLLQPAAGVGQEDDGVAREAGGVVQQRQGPGVLGAG

SEQ ID NO: 16100 - protein, 171 aa, Chlorella protothecoides
  MOD_RES (15)..(18): Any amino acid
MPAIRRGISSPAPPXXXXRGDGFRRGCRILGHAHGLPRLMKDPLTPLTQIRMARNRENAHLSRQRKKAQLEGLEQTCSALTKQVRALSTFVGQLTAENELLRRHLAAACTAAGRPLPDLPRAPGPQLVLLPPPAPGAAPVVALSLAQPLSGATVPLAAAPACPAQGSAPEG

SEQ ID NO: 16101 - protein, 188 aa, Chlorella protothecoides
MDEMRAMLDQLMGEDRNLGATEKAKYKPRKRHHTDKDVCKFYLSGFCPYEEFRRTKNDCGDCPGIHDDGCRAQYEAEDDRTKERLGYEAELLRWLEKLLTDLRKRIDSNTVRLRAVENPLLLHEDQAKLDAMTAQMKELVARAERLGEEGEVDGAMEATNEAEKLKVRVSEEEVELPWCRWCGLGDFQ

SEQ ID NO: 16102 - protein, 134 aa, Chlorella protothecoides
MEYLRTARSPLGRPLFDPVLALRLARERGRDHAAVALYQDLGLHDDAVRLALTLDRDLAVRVAGRAGGDAGLSRRLWLDIAGHLIQASGDPKDQGIALVTSLLEESGGLLRIEDVLPLFPDFVEIDAFKDVLCT

SEQ ID NO: 16103 - protein, 114 aa, Chlorella protothecoides
MGPYAAPLRDVAELPLGLVPDTQRGGRVCLWAGDDLFELDAGSEDRDMWRTFLDAGEFGAALLHCSTAAQRSAVFLAQGEAAVEGGDWEAAGTLFGKVSLSGVGVGGELLVHGA

SEQ ID NO: 16104 - protein, 264 aa, Chlorella protothecoides
MRDGSRLLVRAFEQDPENPYTLVLLAYFSLQQGFADGAAKLAKAALDASDSEPLRLECTTVLARALHAQGRNGEAFRLYSQAATLDPRAPLPALGLGQLSLLRGELTNAASVLEGALTVVPAWTDALQVLGKLYPRLRLGPDAAGIPHFKAALKRLGERADLWEMLGDVLAPLDPGGSLAAYQHAVALWGPANAGDEVQAGADRAPSATPSSPSPHPAPSARLLNNTAVLQLRAGQAPRAAASMEAALAAAAEGRLDGLGAEAR

SEQ ID NO: 16105 - protein, 299 aa, Chlorella protothecoides
MTLALSASLGGRAPLHATTTGRSGPKPCPLAVPRLPCLIRRGTPCRLAPQAQSGSTTSFGSQPPGGDGGSGGGGGGGDGQGGEGRDSSITAALLLAGKAATDRFPEEIAAAIRAGRISQEVLARYLDMLKNPFLSWLLSFPGARARLLADPNFLFKVGIELGIGLTMKLTAEYTKRGDEFQSQLDFVLANVIMALIADFMLVWLPAPAYNLTCVAVMGCLPFWFWWEGGGVVMRIPECSRRSGFEQIVCASDDTSEEVNLRPSPADTIAWSALAGGIIPARCACTPCWCTNSEDSLLIS

SEQ ID NO: 16106 - protein, 400 aa, Chlorella protothecoides
MAAACRTLARGWALTGLVSRIGARGLATDIYEHTPGPAAFAFDIDGVLMRGGQVLPAAKRRASGGYFAGRGNQPPSPRPQHTRALALLHDASGFPRYPIVFLTNSGGWLEEERARRLSAQLGVRVGEGQVVQSHTPLKALAPSLADHRMLLVGRGDLHSLAAGYGLRRCVTVEELVRADPASVPFAEVAVGGPSAGDGSAQPIRAVLVLNDPSDWYCALQTSLDVVLGRAVPGARPVTRPPPGAGTCDPDPVHVVFSNPDVEWAGAHAAPRLGGGAFAACLQALHTEVTGAPLPRVTRFGKPHAPPYDLAAASLHAQAAALGWGDRAFGAIWAVGDNPEADVAGANAAGPPWTSVLVRTGVFRGPGNSERHPARLVVEDVEAAVRAALHRARSATWHSMR

SEQ ID NO: 16107 - protein, 86 aa, Chlorella protothecoides
MATEAGGARTLIVKSVAFGVTDEQFGSYFSDIGPVSRSFLVKQGKEGPHKGYGFVQFALASDAERAVANLNGTDLGGRKLKVESGA

SEQ ID NO: 16108 - protein, 247 aa, Chlorella protothecoides
MGLLARPSLPDQRRWRCGRCRGVGTIAAGALQAGLSRVPVADLGGKPTPQDSAEARRQPDDIADEELGDYGIPSGWKQCPAQGQPISRFIPSKVPLGAHFDDYIPAAQRYNVDQARERADAKGAALQARCATVIDLTRSTRYYDVRRWQELGVRYIKPLTRDKHRWQHPHFTLPMCPSQIPCRGRGQVPQPEAVNDFVWEVASQRAGQSTVLVHCTHGFNRTGEEGCGVGLAWSTSTSVLCRCAFLG

SEQ ID NO: 16109 - protein, 108 aa, Chlorella protothecoides
MEELERLLHWLSSSLDTRVYVAVTRGLWDLTSKDVLEYAEDLQEGGGGQRVCGVDWCREGETGRGRPYLWEVTRGDGARRCWWLVPGRDRPERRTEQARLQASLPRSV

SEQ ID NO: 16110 - protein, 85 aa, Chlorella protothecoides
MQTFTRTATSPLPALPFHLPQGAWRGRQNASVAVRGLDAFFKSMLTASMGNDLLSKDLGLPAHSDRAHKLLAENLSGINHSYDVY

SEQ ID NO: 16111 - protein, 259 aa, Chlorella protothecoides
MSTLQERYDMIKRYVMDPRKLERHVIETKQWSFPYQYGEELFHVRRKEFWPLTQADKLLHDFIPNQVSHESDGLILQEEGAPPCCLSSPRPHHASQSSPTPPFNHATLGYEDAYVPGTCQELLKWKFAHLNSVDFRLRWDPKTSTAGLELLETRAGGARPRGYHLLPGATIAFPGGEDPAALHQRIVEAAYDAEAGSWVYMRERRDKPTPNAYHVYESVARSIQDNIQEEELLESIAAALQLPLYERDRARQAAGGRAA

SEQ ID NO: 16112 - protein, 223 aa, Chlorella protothecoides
MHHWTVEKALHAFALSRPPGIYKHYYIRQLYRYYHEAVPAAAVMPALPDWKAGDAPDSGDEGGEGENGAEAPPEHMEHDDVLGEEVSPAEAATVCGSIVEMIAGPGQDHRRAWFPGSQPVSLDRSNLELLRQRSARLRDPLQPPHLDPTCSPPLPKTAQVLGDVEGRRDTLHAGHPAVGHIPGGQEAGHAPSADALAPASQAPGWGAPEGPRGTTPLPGVCGV

SEQ ID NO: 16113 - protein, 334 aa, Chlorella protothecoides
  MOD_RES (232)..(235): Any amino acid
MRPEEGMRDGNVLRMPREVEPLGRHREMHFQPSKLRSMVGICCRESAGLLNRHRGRPRPQVTEPAISPGAQARHLPFHPAPPTAMVRVEVKWQKEVFKDLEVDISAPPAVFKTQLFSLTGVAPDRQKIMGLKGGLLRDDADWGSTGIKDGSRITMLGTAGAVPVAPTQAPTFLEALPEDQQDVMGLSKYGAGLENLGNTCYMNSTLQCLYGVEELPHLTPPSTPSIPQPGTXXXXAPPGPPAWAGVPGTPHMIVHEGSSPSLLPQTPSIPQPGTICRGLADIHGPQRHAHHGDKVTVLLAVHLGPARAAHGLPPEPPQEVSPVCSAGQARHGVG

SEQ ID NO: 16114 - protein, 110 aa, Chlorella protothecoides
MRFGTPRQDAERRDFTINALFYNINSGEVEDLTGRGLADLEAGVIRTPLPPRQTLLDDPLRALRAVRFAARFGFELEESLVHAAAHPEGPHSPPAAAKVAWWPTSQPHQD

SEQ ID NO: 16115 - protein, 110 aa, Chlorella protothecoides
MCPHSPHRLLILRALHLRTLPGLLEVLPHMALVWRASPGVLYMLVLTVGICMGTAALLGRALWGTAAALTTNEMILRRRYAYLQDTQGLYRCEGPRGGLMGLGGCLRTPG

SEQ ID NO: 16116 - protein, 62 aa, Chlorella protothecoides
MEVREEADVLALAGGGDWHMAYLLVYRAMRAPQAAATAAALPEGGHRAASPVPMEEDPKAQA

SEQ ID NO: 16117 - protein, 258 aa, Chlorella protothecoides
MLRPSRHQSLNMNLAGLRRIVNGGETIHAPVSRVSDRRHATNPRLRRHPQCPEQTSNSASFLLLRWRKQKNLPSCYTELNESGCPRGRCSAEHHGEQSAALAVQKGVTLPGHPGPGASEGGRDLYSDPFQCGEKPGGLRASGAVTDRGADTDKTPVPCNQINIFVGLGLLSTPYAYRAGGYIAGVALLLLSSLFCLSGHLIVAAFQYLPVDAPRQKNTPAHSCVLPGRDQRTHPGGASVARNGLAVPSSQRTAPGFCA

SEQ ID NO: 16118 - protein, 166 aa, Chlorella protothecoides
MRMRRARQAAATCPNAKASKSRGVYAHHFTGCLSVTGDWHETLLRTGRHGIPAVSSAFKYSKELPGRGAAPLLVVGAMATPVVESLFITLKRGMAGVRHQHVRIVKAIGLTYRQQTVERTNTPAMRGAVAKIPHLLTLETNLQRAARLAAQAEARKLRPPVIVRHA

SEQ ID NO: 16119 - protein, 400 aa, Chlorella protothecoides
  MOD_RES (127)..(130): Any amino acid
  MOD_RES (191)..(195): Any amino acid
MNALLCIRYATGSPPSARCVAWARPAMTKRVGCWRPSLTPSTLSPSMSPTGDVWPSSVHPDMLPGIGLKTERSPPSPTPPSLGSGEGLKRLEYRVGSWDEVSAIPINDMALTILKPSLTIHSSHCPXXXXVHPALPDNSFLALSSQSGAAFSSFIKKLEARKPVVVCGDLNCARQSIDIHSPKTNLRSAGXXXXXRPGHHVNTPFTPHIHDKTHNSNHSQCLQEERDSFQQRYMDAGWVDAFRTRYPEHTGYTYWSYRFNLRARNKGWRLDYFLVSGRRVVKGGVGQWQPVAVCLRCFPSARCYGFRPLPPRSDRPSRRGKGRMIAIRVRSARNSLHIIRYCPFKSDHRWGHHRADMGLGLGHGGILVLFHLNQLRGVYLNARRTQQHCTFPGKVSGTIF

SEQ ID NO: 16120 - protein, 613 aa, Chlorella protothecoides
  MOD_RES (174)..(176): Any amino acid
  MOD_RES (394)..(396): Any amino acid
  MOD_RES (541)..(544): Any amino acid
MVTTRARAKRVRKGDDTGQSDPAAKAIAERSGGSHDYLEMSPEPMSTCPTVHLPAIGSSANSEGNDAGSGDQGLTKASSLDEAGPQHPSIPPAGGSPDADLQEKVGTDVASEEPAAKQAKTSHQGDASESRSSPEHTSPTGGDQSQAESPKGTTNNSSSGDVPADSKDPVESGXXXSAPLERTRARLKGETFADEILLLTGNVGLDHVGKLEDVQRFYLLLEPSQPGSKSRLIVIGKKRLPAISNHEIASHWVVSLVDCACPAQLAWPPPLRSLTPQRYFAFVEAVAEDKGTLLQVLHGVGAEAGCLVGRVSRADHHDCPPCCRTGHGGPAVPDYDDGGEGGGCLPGCRGGGLLHSGAWLGHQLCVQDWMPVASVVIIETASIPAQTPDQAGAXXXVGGALLLKLPTRLELPTEPGEAQRMCGIELEGSFGLSVKVKPGQACCEHSWCELVLDQMIAGRSMTGSTAGLAVGLKEKADLPEALEDEFQGYAWIAARDPKVRIHLQRAVGPWLLSLVARIAFRSSMWHQTPVTGPHYCSFWIXXXXIGGTQRFQMLHVAPNTSHWPPLLQLLDYERVELLFVGASKDLAAELGECVGQFLLYSRGVMGPLGIPCV

SEQ ID NO: 16121 - protein, 676 aa, Chlorella protothecoides
  MOD_RES (304)..(307): Any amino acid
  MOD_RES (480)..(483): Any amino acid
  MOD_RES (501)..(504): Any amino acid
  MOD_RES (537)..(540): Any amino acid
MSGKGYAIRTRPRHSTVQEIGLQIEPAETGEVSGFSTTPHEASRARAWHEAFAMWAFALQLLMSVSADLEGSLAYTSSRHDSYVEELKEIDIMHVSRQAFAIWAFALQLLVSVSADLEGSLAYTSSRHDSYVKELKEIVSIPSVSAQSAHLPDLLEAADWVKERLLSAGLQDGNLVIPLAQLCTCLEGRGAKYGGTRRGPPPQGEASTSALRPLLAPAVLQMTSSPRNPSTSGPPGHSTPRSGTASCTAAARPTTREASWPPCRRAAGWRPHRMRRAGGQCGACCCDVRCAEPSRRGHCDAPQXXXXQCSACCCDVRCAEPPRRGHCDAPQAVEAVLRGGGGLRALNVKVLIEGEEEVLSPHLEDFLAAHASLLAADFALSADGGQVGEGRPSLTLGYRGAAGIEVQVDALARDVHSGMYGGAVQNPVRALAQLLGSMFNADGSVAVRGFYDRVRPITQADRDDILAYNYDEDEELKGGXXXXQLPPLLPAPMQPLRSTGXXXXFSSLERLWLRPTLEIVGFTGGPTPQPGSSRTAXXXXGWVRAWGVERRVEGGEVIGIKECWWSLRKARVVEWNVYRMHVWTCMWRYGFVVYADHPHSLDHPEQQSGVCTRRCMRSRGPFDLVCPAATSAFIFTPPSLQPGLACNSILHAPPLPPFPSSSFLSSSGSAQSPSLL

SEQ ID NO: 16122 - protein, 476 aa, Chlorella protothecoides
  MOD_RES (240)..(243): Any amino acid
  MOD_RES (280)..(283): Any amino acid
MRTYTACIAISSISLIRRSPAGDSDSRALHIFLLHSSLSRECSLCVAPSTFAFISQSDFNPRVCPRAEGVKAGKDSGPQTCSRAAPGADHRRLSRSPYPTSECCGGMPSACVYRASLHAVKHRPQPLLAWTARRFRTIAPFTAFPTPARPRLHASASCEAVSGWNTSSPSSAPPSHGFSSNGGSDPDTKESAAPFAGPPVYVKAPGRIVAGELAGGFGSMSCLHSLWKRGARAWLDLASXXXXQASGQRDLRLQPSLLRGPSPPRPSMSNHNNNSSTHTXXXXGELAGGFGSMPCLHSVGKGTEIMAYQASGQRDLRLQPSLLRAPSPPSPSMSNHNNNSPSHTHNARPPPPPHIRAVGDIHGDLNKAVSSLQLAGVLGRDEEGRALWTGADTTLVQLGDVLDRGDCEIGVLLLLRELDRQARLEQGAVWMLNGNHESLNVAGDFRLARGGATRRVGERKKKRLWLGEQQYGGCGA

SEQ ID NO: 16123 - protein, 386 aa, Chlorella protothecoides
  MOD_RES (35)..(38): Any amino acid
  MOD_RES (166)..(187): Any amino acid
  MOD_RES (351)..(354): Any amino acid
MFSSRTQGGVVDRSLVRPRVEVRCDRAPCQPEHLXXXXDETLYLRRLRSGLHRRLCLPIDKPTGQPEHLFLPVQRAHPYLAFALSRLPALGDVSCCGSTWSFPITLRMHRLDIVGFGVGVRLLELLSYRERSSRRDLKLLDALRFVHTTLWRYLFGRPAKDLEQSXXXXXXXXXXXXXXXXXXXXXXPVAAMPSEPEMGRCAGIQPPPYPMDPSPLPSQAEDEYMISDVDLFITKYISVPKEMGHLNCAAFVAGIVRGALDGAGFPSSMLLRTHHFYSRLQGYSPQCGRAGAVAGQDHAADKIRCLGAAEGAAAALQLRRTGQDGAQTLTTLQQKGVESPNAPRARAPEGXXXXRTGQDGAQTFTTLQQRGVESPYAPRARAPEGA

SEQ ID NO: 16124 - protein, 1342 aa, Chlorella protothecoides
  MOD_RES (92)..(94): Any amino acid
  MOD_RES (1195)..(1197): Any amino acid
MEKGEMGAVGGTADVHPAPAGLWREGLSTPLPAQHRNMGACRIVMVLFSRQALSRPAVHTPRRVRAMWPTKASPTHAGALPLRPSWGSSPGXXXGAMWPPRPRPCTLGPSCSGLLGEVVLERDLLQGPLLEGLQRAHRRLGAGDGGDDGHLVRQRQPAQVPAVAHVGLVARGGDDHHGDVVVAQEVSRGGPALLDLEHAGDAGHARGGQVLRGVLGGQDAVAHVGQQARAGHDGVLVLVLHGDEDVARGGQALARRDGRLGERLGEADVDAHDLARAAHLRAQQRVGPRELVEGQHCLLHRHVAQDGLGGEADVGEQRARHEERRVLGQRVPHGLGHKGHCARGARVGLDDEHLPVLHRVLDVEEAHHLERLGQLGGPVADDVQALLRDGLGRDGAGGVAGVHPRLLDVLQDAADDDVALAVGQRVHVQLVGAVQVLVHQHRPRGVHLHGGGDVAVDVSGGVHDLHGAPAQDEGGAHHDRVGQPLRDGQRLLLVGRHAAGRLADGQPIQQRHPAVAVLCLVDGVGGGAPDGHVAAPAGGGDGVRLQPGRHSGGQLQRGGTHMLGSESGRELQSEKPVRAPTLPSQTSHREGLEVEAGGGVVVGGHGLRVGVHHDGLVPRVAQCVAGVAAAVVELDALADAVGPAPQDEHLGLGGGLALALAVVGGVHVGRGGLELGRAGVHALHGGHHARGHARGAHVQVAGSRAASDLGVGEAAALQLQQLRGGELGQGARLEPGLGLVQLLELGQEPGVDGGVLVHLLDAQPVLQRLLDHHHALRVGHAHVVLQLVRGLALPVGGKAPAVQPRLQRAQRLLEGLLEGAADGHGLAHRLHLGGQHGGGARELLEGEARDLGDHVVNGGLEGRGRLACDVVGNLVKGVAASQPRCHFGDGEPRGLGGQGGGARHARVHLDDHHVAVGRVDGHLHVGPAALHPHLADDGHRGVAQSLVLLVRQRLGGGHGDGVPSVHAHGVHVLDGADDDHVVCQVAHHLQLKLLPTQQGLLDLDLQAGGVGGESVCRDTSKERWSPPCEERVCTVARHGDQTDNRGQCLAPSLEHAHTHKRTTCLGGHGGGEPGVHNLLELVHVVGDAAAGAAQGEGGADDEGEGPDLVGRHHGLVHVGGDGRGGHLQVQLLHRLRGGEGRGGWGEKGGRWKRRVAVRRLCCVRPAQGGRSNVGRRRCRAAMDLATVQHTRSPTXXXVGGQGWAGHRQATGGDGFGNRAAHQEPYLGEEVAVLGLVDGLQLCANQLHIVLGQHTVLRQVLGQVERRLATHGGQDGVGALLQGWIMAGVGRWGPCKGSVQAMHSPRKQELPGCLVCRVMSWQGSHPDGAMSWHSETLWCDFNI

SEQ ID NO: 16125 - protein, 390 aa, Chlorella protothecoides
  MOD_RES (55)..(58): Any amino acid
  MOD_RES (332)..(335): Any amino acid
MAYCALGDIVEVLPNQCWKAVPCTDTSPGQHGAVFCRPWPSGRKGYHSQVRKGDXXXXTWHTARWGKSWRCFSISAGGQYRARTRHLVRMVLYFVGLGLADERDITVKGLEAVRKSERVYLEAYTSVLLVPKEQLEEFYGRPVMIADREGVEMTCTFADLQEADTILQGAQTSDVSFLVGTPTGETQYWKSSRHLLFGTLGAWTATTHTDLELRARAAGITVKTIHNASIMNAIGAAGLQLYRYGEAISIVFFTGGRRGAGNLEPHQGMMLPDSRRLSLVKTWRPDSFYDRIAANKKLGLHTLCLLDIKRHFSTCGHGGEAVGVEHSDGMTXXXXKLGLHTLCLLDIKRHFSACGHGGEAIGVEHSDGMTCMHNNSSRANVAQRLASPYT

SEQ ID NO: 16126 - protein, 109 aa, Chlorella protothecoides
MQAASPPQVKEPSLEALCRGKKIYEPPRFMTINTAVEQLLEIEANRGEGACTPESKAVGVARIGADSQQIVAGTLAELVEVDFGAPLHSLILAGEMHHIELEAWERHRL

SEQ ID NO: 16127 - protein, 347 aa, Chlorella protothecoides
  MOD_RES (215)..(218): Any amino acid
  MOD_RES (244)..(246): Any amino acid
  MOD_RES (273)..(275): Any amino acid
MDADDATVDFYAKLSARLDADLQHEDGALWLCSPVRHVPSTHEDVGWGCGWRNCQMLLSSTLTSDCQVWGTSWHSQGWAPVVQHVHKTWHLCLLTPLPLWCKHSQRSRSLPPQSTVCNQVLCQDDGSAALPDIPTLQCLLEAAWAAGFDPDGAAQLGHKVQGAKTWIGTTEIAVILRFLGVGARIIDFGVRAHSRAGAPPHASFSCDACGMAIIXXXXSEPIRVLGPLLMPVSPAMPVAWPSSXXXPGRLSVFSPHQVGGWRSMEPGHGRGLXXXQGTWYHSLVLDDYDLCARCHRQHGGGPVGPFECVQPPPGRGVAQHGAWPWQGTGPSAAKPCQLLHWRATHTC

SEQ ID NO: 16128 - protein, 183 aa, Chlorella protothecoides
  MOD_RES (35)..(38): Any amino acid
MELSARSPPAGSADRTAVQLLNWAHTYFTEGGPKXXXXAAVQLLDWARTYFTEGGPKEGQARGLLRTSRPPLYLQHQGHSRTVIGLLENAQGAAVAVWPVSLARDRALVTPAGAQALLVLDPAVTSSAMHKALTVPKYWRSGMLLQPRSLGHPQYQVLRFDSTGAGVPESDLSKVILAAEAFP

SEQ ID NO: 16129 - protein, 465 aa, Chlorella protothecoides
  MOD_RES (275)..(277): Any amino acid
  MOD_RES (446)..(448): Any amino acid
MIGDPWSGYTLRRQWFSSGQHITPGSLSRFLLLIPASAGCEGIVVGLPVISSGNLARPSSDSQQGRRCRRFAEQIADGAFPWDIRVFLIGKPAWHAAISAALYERNTTLFALNDMKASGMKKKKALQMKDSVAAALMLSAFYDAPGASVHVPPSTRLTSALMANYPETRCKWWMARVCSLLIAELLHHKLDESGRRSPMWCRNSTALDDGLNGVDIMANYLETLCKWWMARVCILLIAELFHHKLEKSDMTSPMWCRNPTALDDGPIIQSAPSLXXXTPAVSREPSHLLRPDHSISTQPEAEELNDNSDGETTHRPVDDARDASFDPAARDVPLSLARDLASLMGTIGNMTREGVRQKIASKAERMLKQLQVGHYMKCASCTATERLGWMSGAGSKRRHDWGLDSHRGKEVGMARLSNTVSGGWRTSVTMSEVLLIRGGHRLFLTXXXRDRKAWLDERRRLKAQA

SEQ ID NO: 16130 - protein, 90 aa, Chlorella protothecoides
MALWGTETEEGVQLDDAKLKAAIQKQERLEREALEQDGKKRGYNSLSADGLEVTAEDMEAYRLKRARDDDPLAAITKAKAGPAADGYDLV

SEQ ID NO: 16131 - protein, 65 aa, Chlorella protothecoides
MQFMPFIQGPRNCLGQFFALLEARVILGALCREFNFRPVHPEHQGVTHPTVIPVGPVNGMRMYVD

SEQ ID NO: 16132 - protein, 61 aa, Chlorella protothecoides
MAHKTKDCLERPRTKGARWTGKNIAADEKVQDIQLAGFDAKRDRWNGYSNDEWVKEAERCD

SEQ ID NO: 16133 - protein, 219 aa, Chlorella protothecoides
MRQDPNPDKDPSQKTFAGDNFVRQSGAVAGFSSLNAFSVTAYERGQDVHLQATPSQAEAAFQQFRTRKEALGQSSKADMLAKYGNAAAPLTEDVAALRGSEAYVEYDASGRLLRGHEVVALSKYEEDIHPGNHTSVWGSYWKDGQWGYACCHQFVKNSYCTGKVGETAAMEAAEQLHRNMQNKVQDLEAREPTSRPQGTQPNVRSGGRVCAGVHAGVVS

SEQ ID NO: 16134 - protein, 214 aa, Chlorella protothecoides
MPIPQQHPYTNRCLLTPLAPPSATQAATLDLLTGQCDRHAGNVFVDERGRLALIDNDQMLGVWWQGTGCAASSMFLPGTQKFAKHERAVDDWGPEAPATEGAPGPYPLNPLLAFDYRCHLAPGRQGLGTDFPGPLAACMRRLAAPQGAAWAEAMGFSAPTAHQLAARAGDLLRHGFEWVLEQSRQASIPRMRYPVPPPCCAVDAGGRCQYVQRR

SEQ ID NO: 16135 - protein, 73 aa, Chlorella protothecoides
MQWSSKLALTCFAPTKVDVWGRGVVDPLRFAKVEKAVRTVGGGSTGTVRNLRIREDTAKYLLNLDLDSGELGL

SEQ ID NO: 16136 - protein, 984 aa, Chlorella protothecoides
MEKLNLKMAASAIATNMDEAMVAADKIGAFPLIIRPAFTLGGTGGGIAYNMDEFKEIVNAGLTASMTTQARCALVQIEQSLLGWKEFELEVMRDLADNVVIICSIENVDPMGVHTGDSITVAPSQTLTDKEYQRLRDASVAIIREMGVECGGSNVQMAINPANGDMVIIEMNPRVSRSSALASKATGFPIAKMAARLACGNTLDQIPNDITRKTPASFEPSIDYVVTKIPRFAFEKFPGAAPVLTTQMKSVGEAMAIGRTFQESFQKALRSLETGLDGWSLPPNWKRQTPDKLQYNMRVPNPERMVVIKQALEDGLSIEEVHEYTSIDPWFLAQLQELHEAETWLKTRTLAQLSPTELLELKRRGFSDPQIGRCTGASDLDVRAARVAAGVVPSMKRVDTCAAEFEAATPYMYSSYDGECECEATTQPKVLILGGGPNRIGQGIEFDYCCCHASYALRDAGYETIMMNSNPETVSTDYDTSSRLYFEPLTVGCLGGEGWGTDRFLRLQLTPALGSQHDVLNVIEKERPEGIIVQFGGQTPLKLAAGVAAWLEAHPIPAASGRGNVSIWGTSPDAIDEAEDRDRWMALLDRLSIRQPPGGVATNEEQALAIAERLTYPVMVRPSFVLGGRAMEIVHSAADIHRYITTAVEVDPARPVLVDKYLDRADELDVDALADREGNVVICGILQHIEQAGVHSGDSACTIPPQTIPQECLDVIRDWTPKLAKALKVVGFLNIQYAVQDGKVFIIEANPRASRTVPFVAKAVGHPLAKYASLLMSGALLSDIGFTAEPVLGHVAVKEAVLPFDKFPGADTLLGPEMRSTGEVMGIDVSFAKAFAKAAIAAGQRLPASGNVFITMEDKYKDAIVPSARLLADMGYGILATKHTAEHLTAAGVPGVTSVLKIQEGRPSAADLLRNDDIAMMIITSTGDEADVRDGRDLRRLALAHKVPIITTIAGAKATVGALQALKEGALEQVPLQDYFPKKA

SEQ ID NO: 16137 - protein, 102 aa, Chlorella protothecoides
MALLVTWQQLLILLDNHGLLALSPVHTAVALSLLWLVPMLSVGGFSRLAILSKLGMLSVCIVVTVVYSLLVLDPSREDLPQVVGWRVETGACGGVTRWRGAV

SEQ ID NO: 16138 - protein, 401 aa, Chlorella protothecoides
MGPRTLPQLASWHAAPRLPSPCRKAGAHAGSEPRVSTAQVGRVAGAGVAAVWPVTAILVLPALEPCSCHMQQPLLTLPQTQRRHRAVFDGDLHAVRRLLKGVNPPLVQSLDAHGNTVCGAEKNGRGGIEGAVRPESTRRIPACGPAPVPAKSPHSLLSPWLAQPLHLAVIRGKREIVEALLEAGASVGAKNIARWNALDEAIALGNGELVHLLFLQLRKEWKQEKAQKKERLLEVLKELPDFSMKVVGWREFDILEPGRALAQMSRIVFGGARSCGRRLHIRDHPRTQLAPHTLASCALSECCPPCTRAWHGVLQDSHTHKYPPPSQLKWDLGSGMFGVILRQFAPDDTYTITKLGSRLRIDGSLMGLDRGAGGVLPRWRRGAFSLLIDAEPSPAPVSPQR

SEQ ID NO: 16139 - protein, 431 aa, Chlorella protothecoides
MVRQVIRVPYSEDRPRLTKAAPSLAGTLPCPIPRSAMHRVPSLLFDMDLDLEHSHLARVATLDETDLASTRAAILAALEPTSDAEYMVLLHVRFAREDALRRGRALTLASLAEVLHRLGYGVRIRTANGGGRCGACLRNLRHSFLAVSLAGPGTPCDLIVDPAFREQFQIAHMMERYRRVMAMVPEEVVLPPARLEKLVEVLCGEMQRAFSEKDLSLPPWRALGAMLSKWHPGQGKSKDVAVQPRSRGGGGSAASDAQRRLIQSLQPQADAQDAAAAIDTPDAGARRLLQSLQPQADAQDAAAAIDTPDAGAAPPSTRADGCPECGSRACATHACPPSFLGPRGDEEEHLLDDLEADGEAEALLGSSPGAIATPSSASDSEGDSPLVRARTARPTPSLHVSWGLGLGLASSCSGSALGDGSQASRSALQAR

SEQ ID NO: 16140 - protein, 147 aa, Chlorella protothecoides
MDPPPSQPPPGHALARWTLPQAVGIFAVSLSGHSTLPALRAGMAAPSRFPALLTAAFCVMALLYGTVGAMGYWYYGSTTSALITTDISRAGPWTDTAMDKLLACLLLVNCSTKYPALVLVLQASVVCVRAGGCLIVPRGDGKCGKEV

SEQ ID NO: 16141 - protein, 227 aa, Chlorella protothecoides
MAPGAGTRHGALVPLAGGTWPGFAWAWQGCWSGVATGSPSPRTANIHSLFLKRNGEAMRSPTDPHFLPAGDKSKAVKALKAVKKSQWKKTRKPRYSTSFHRPKTLVRTRDPKYPRVRCGLVWAGDAVVQAWMARVAPGQQKLDSFAVIKYPLTTESAMKKIEDNNTLVFIVDIRSNKRQIRDAVARLYDIQTRKINTLIRPDGEKKAYVRLTPDFDALDVANKIGII

SEQ ID NO: 16142 - protein, 244 aa, Chlorella protothecoides
MLNSGGRLPFSGAAHQTDTLNSQLHGSDSRPAIPPPALQSPSGAPSLCMSPTSPGTPNTLQILCAPSLLPRNTHTHSTPPHTHKHRYVTPGAFWECAVAAGISDAELERDPRAALRARWELYRPGGRMAVDLAANPTVLVVNDIVFAHGGLLPHHLVYGLERINAEVAAWMSGAKGGEPGAAAPLPPFLAMGDGSSIMWNRTYGREQFGHGERRGGSSFVSGVCVCEEEGLVKRGCSGVGLSVV

SEQ ID NO: 16143 - protein, 178 aa, Chlorella protothecoides
MAWNPDGSCLAVWEAPTAGHGLLVLSPVGEVLARSTSPGAGLGIRTVAWSPSGQLLAIGSYDGEVQLLSSYTWQRLASFPHPGAVQGPVGLVAYSEVEEERTVLGPRNGVAGVSGPASRIPRSPPSKDGEGGWREEEPMTSACCPQSTGEACLGGARGEDFGVAWWVVRPSHGTCLAP

SEQ ID NO: 16144 - protein, 149 aa, Chlorella protothecoides
MSTAPKAAQPLCGREAGAGFSLAPRPALARPHAGLSRPAPFRGTRLVVTSVSAPEKANSTTPAAETTKPPFTAWDTAVQRVAKRTDIKSVLVLGAGPIVIGQVRPGQGFAGDIWGPNPRSPVLTMPCLPGTQQACEFDYSGTQACKALK

SEQ ID NO: 16145 - protein, 276 aa, Chlorella protothecoides
MFPLLKDTQVSTSPRTPPPVCKDGLGNHAGSCKRLSGFTDAAQTVSRASVRRLARRAGVKRIGSEFYSDAEGSLRRFLGTLVEDIGVVTEHARRRTVTVGDVLLVLKRNGRTLYGFEEKQRKRRLVQRLPPHSLAESMARVCSTSSEAQGEATSKSASMERGAPTQHVTRPPAEVAVVAMAGSKPTSNGSEPGVPQTQLGPRTPGPMTPHRAQDIQIGLSTFRDSVLERQARSCAPVSQALEWVSAELARTGKGPCSRTEFEVGKGVWLEGCEIDP

SEQ ID NO: 16146 - protein, 156 aa, Chlorella protothecoides
MLVHRLVPPHPAPLPSPPLLHPHAGDRQAMEEQLLSTLRALRARAMVVGHTPQTRGLNCECGGRVWRVDVGMSAGVLDADPAILELSAPDERGLVTATAKKAPGRWSAAAMRGAGLDDGVQVRRWSIGPLAQQEEGAGVGGGGADEPAPDAPLSRL

SEQ ID NO: 16147 - protein, 270 aa, Chlorella protothecoides
MEGDERPLYLPLDHHLHPLVCSAWDQGGGAPERRACVQHMVGGLGSGLLCPCCFEGWGPFHHSRFYAIHDPSDATCLASTRTDFPFSPSLPLIKLPVASVARAVGNLATAWLPGLTLVLDHPTPATAEKLGTWVEALAAAWSHLSEGPAAAPATVLIPGLERGAAAHTPGVWALLSMVMGRDRAGPLPTLLFFDDLARLPPGLWLGLEHRRQRGWLFGREFPDPARHGMGGCGESACADHNLALSCGERRQAVAIQPALAEPQLHRQPMR

SEQ ID NO: 16148 - protein, 346 aa, Chlorella protothecoides
  MOD_RES (74)..(77): Any amino acid
  MOD_RES (283)..(285): Any amino acid
MSVCTWVGGGIISSALEPTDHRRQHFLHPSAARTCDCPACLVPARHRQPLARSHHPSHPPPPTPQATGSLRINXXXXEPTDHRRQHSLHPSAACTRDCPACLVPAHQCHPLARSHHPSPPPPPTPRATGSLRINGRSVGIPDLQSVVGFVPQEDLVHEDLTVRENLVYSARLRLSTSKPRQEQMDIVDDVLDVLQLRHVQHQIVGSVERRGIRRAVVGGGGALSMGVEHPLGIRVKARAGHRGSLVQDGLARCMAEERCGGGNGGVLTGLELSLPCSTAPYRXXXRGAARHQASGCGGGRGVEHGSGIPLGDSGQGLGRAQGVFGARWFGAVHGWKSAVVEGMAAA

SEQ ID NO: 16149 - protein, 271 aa, Chlorella protothecoides
MAGLGMNVIAVLHQPRFSIFALFDDIMLLGKGGRLVYLGPSWLAMPYFESLDFELPLHENPADFVMDVISGSVPQRGCDAFHPERLVGLWQTYGLSWVRTQSKLMPLDPTYGSRPPEQLRIDPEQFALLSEQFDAADADGDDALRAGDLQVLLRALGLEPSTLDIQMIMAELAIPRTGLVSKEAFMQYVQYGGRPPASAPDGPPSASGRRAVQSIYRVYSIEQYTLSAAIAELSAAALPSGLRPAGNLKELASAVVAGGELGRSRGGRGDA

SEQ ID NO: 16150 - protein, 357 aa, Chlorella protothecoides
  MOD_RES (319)..(322): Any amino acid
MQSSMQPPPDQQERHSRSLTYKTSSTAPAPRLPSARLPITSAAPPTPDYTRQNYSLKYAALRMVKKRRQPDVYHKQNLGDELENPENFGVRPHTLPRQIPPSSRPSQTKPRGQKRTKNGDNEAAGYNSADEDVEQSLPADISHRILRVAREQAEEMAAVGSGEGAGVASNAASLAALRESDSDDEGGFSPGPGSAWGDEDDLDQEEISPEDEAALAAFMRPAGAKQKTLADVVAEKLGQAGGGTGGNTIADAWPVKGRSELHDLRCAVAHVGSLNLHAVLVRTLLASPLPLPGIHIVYCALRTLALALPPCSLAMSPPXXXXLPLPGIHIVYSALRTLALALPPCSLAMSAPCLRAV

SEQ ID NO: 16151 - protein, 340 aa, Chlorella protothecoides
MGPTERDMDADDEVPMAVSLTEQAGTTRATREIPSYRQNLSLDGPLKPVPVTLITGYLGAGKSTLINRILNTQHGYRCAVLMNEFGESADVERALIKEPEGEEASPLANWVQLENGCICCSVKNDMVKALEALLQQRASFDYILIETTGLANPGPVAAALWTDAELEAGVCLDAVVTVVDARNIRRQLADPPGEGAEVCEAAAQIAFADVVLLNKVGAADGLTLDSKLGPVPRTLSGWAPVLSASRALASIQRRLPMSPRLAPSGGPGERGGTAGGARRAGRHQWLGRRPGLRSLWSGPEVHPGHRHIQRHGPAGRGGGPRRLPPRLQRPLPPPWRVTRP

SEQ ID NO: 16152 - protein, 127 aa, Chlorella protothecoides
MDNDHKTLPSFPGLTFLYPPSHLPLRLTSDPSTRVTPAGLDERLVEIFRGVGALMSRYTVGKLPKAFKVIPTLKNWEEVLALTEPEAWSPHAIYQATRIFVSNLNQRLVGCNCSFWRGGAWVQVVLA

SEQ ID NO: 16153 - protein, 80 aa, Chlorella protothecoides
MDGLLWERHPHGPDLFRVKAVLSLAGEGRRHVMQAVHDLYDVVPAAPWAEGEARASKLVLIGRRLEEGPLQRGLDECVAS

SEQ ID NO: 16154 - protein, 1252 aa, Chlorella protothecoides
  MOD_RES (80)..(83): Any amino acid
  MOD_RES (184)..(186): Any amino acid
  MOD_RES (220)..(222): Any amino acid
  MOD_RES (269)..(272): Any amino acid
  MOD_RES (446)..(449): Any amino acid
  MOD_RES (787)..(790): Any amino acid
  MOD_RES (811)..(814): Any amino acid
  MOD_RES (925)..(928): Any amino acid
  MOD_RES (1218)..(1220): Any amino acid
MPWKAARASASGSLLPASRDARVSTGPPSASVMTSRILVCPGSSITWGAGWVRGTSQGPGRGRRWGARRRRQGGASSLRXXXXVAGSRAGKEGGCSEEKARGRIVAATAPHHPSRSFPEPRGHTERHRLPMECHETFPPPWDPTSYSRGRFGWCRRAMTSISRARSAAGSLRRPERDRPPPGGXXXKRHRLPMKCSKTFPHRGIPPRTVGAGLGGAGAPXXXLSQHVHDQEHAPRHAATQEADHSVLVEEYSAREVHHLQGRCPTDGGXXXXAYWLRSTVPWRCVMSRVAVRRMAVAAPAGGLVSGAFRRELVEVLGSSLTPARGTWGSAILATAAAAAAETAIKIATGRPEGRGVGRCAVRLLESASDIPSRAPVHRSETRTDLSASGTADPGRLSGRGRSQLTHAPIPCANREQGAALDMACSVNLDPSDYRCRRSPPSLRPKXXXXSLCTDQRPAPDLSASGTADPGRLSGRGRSQLTHAPIPCANREQGAVLDMACPVNLDPPDYRSAQHVNPCGRHWGGSSLWIRAPYFKLQQPRGCLSGCVHGRVALICARSKECDGGMVADGASGPCGAHPALARHDSKMMRSIRKTKGQTGVPVARAGLGILAISIILFAYHQGKLYTGPAVIVYPSAVGLEGSTFQLYKGFPYLTTADVVVSGVSHHAVAPRDCAAKCETTPTCTWFQYCASTDRCSPRSASGEVGREGKGCREAGVGIATAMPAAAGGFEKPSPILHLHPLKTAAVLADGRQHRQTSTKTLQRSVCHGARALKPLGRAEDGWLNGIXXXXVVVRPGWGLPQLCRLLQGGLXXXXWCDLRNPAHPGHSAEDGWLNGIAISTKQHTETPKAKAASANSDTKTKAETSSGGAAKAAEVVQSSEAARSDAVAGPGATAKPEEVAAGAGVGPDETATPPVKPAEAAGGTXXXXAWRDRSAPRQACRGRGRHRGAAGDFGGRCHQPCDPGRSHRPRGRRRRRAAREGAGEHHGAGAARGRRCSGPHRQPVDHHARVRGAAQQRHPPPGLPGRRDQGRAHRTHGDRAFQRRCPAPRREHEAALLGGEGGRAQATRRRAQGVPPEGARAVLCGTCRGLYILTLIRVDAAAAGTRDRCDPACCAVAQRQQALLAAHLPLPSHFMDAPLSPLPPLLARTITQGGTFYRIVKGWINQGGANVESAFGGTFADDPGGLALKHDHKVQEGGAWHVKGRWGKLHGVHCAGAXXXGVVPGMAKGGGKSSMGYTVQELVYGNRWSRWP

SEQ ID NO: 16155 - protein, 367 aa, Chlorella protothecoides
MSALTPFVPQDKAWMLDADQAARRGEGLDWVVARRLAEYVAASYCNTSNIAAWNCTRCGDPSSEDDQSSGPEFELETLAWDAAWDLLGFVGWSNSLQATVIAFRGTDSRSIYNCQPLQGFHIGSPPPRPPSTLPSPPKISFLSPPKFPSPLYITLQGDQHAHLAHRPQPDYARRARQCVGARRLPHLLERLLPVPLGDARGSGAAAPPRPAPGARHGALAGRCAGHHMRHGAARAARPARRAADHLWQPARRQRGVRRLAATRGAGALAIHAQPRHSALRGAALHGLLASGARGMGAGPGGGGHAGGHLRCYWGGHPLPQLGVPPGAVLLRRRPPPVPGRDVHAPAHGLLRGVASKGRGGEATREAA

SEQ ID NO: 16156 - protein, 979 aa, Chlorella protothecoides
  MOD_RES (27)..(30): Any amino acid
  MOD_RES (298)..(301): Any amino acid
  MOD_RES (407)..(410): Any amino acid
  MOD_RES (971)..(974): Any amino acid
MPPPVAVSPAQDIHCQPSSLSCHRHAXXXXCHFRELNPGLHDFVLQMLNNANNAEYRMEGEFRPPFPSSYVWPRLADISIADLASTSLINYRSAEVSLSIDMYRLGFTQPADTTTCKSISSLHYHTPLLEDWPTAQGSFKHCLNPVREWRHARHSDPGGLLGAWLRADSPVVSSASLACAWPVLPAWSWRQPPPPARCTSTEAKAPEREAPQGEASPRGFLAGGHSVEDFPPSHIRNFSIIAHVDHGKSTLADRLLELTGAINPGAKQYLDKLQVRSVWVVGGLRGRPAERPSPLHPXXXXGEERVGGWGVVWEACGTAVTSAPRSAADCGVCWSIRSSAVAFRPTPLTSSASHLYPCPHQVEKERGITVKAQTASLVFKHKGEQYLLNLIDTPGHVDFSYEVSRSXXXXRRHLAGGRQPGRADGDPVGPAPGRRHSSAPRPTPLFPAPSPLDRPPHLQAQTVANFWLAFEQDLAIIPVLNKIDAPGAEPARVTAQLAEAFDLDPAAVLAISAKTGAGLDRVLPAVVERVPPPRGDLAAPLRALLFDAYHDEYRGVVCLLAVADGAVARGDRVTAAAAGQSYDVVEVGLLAPEPVPTPSLRAGQVGYVLAGMKDTRQARVGDTWHAARAPVPAFPGFKPAQSMVFAGIFPVSADGHERLAAAMARLALTDASVAVRRENSNALGAGFRCGFLGLLHLDVFRQRLEQEHGADVLVTAPTVPCRVVRSGGVGCVPCLLGGWGEGSERGHGSWVTPSALVEQRHPRPNSTISPNPTIGAARGREHRAEQPRRLPHRRAGGGGVGAHCARHGRDPGGVRGGADAAVHRRAGGAARPRGPRPRAHHAQVRRGGNGWASLLHGSHPSPAPTARLATDAQHLAASQRLPSEPACTPRHDPSSLHTSNSPPPSPTTKKLPLPPCLERYTLPLAELGGDFYDELKSASSGYASLDYEEGEARRAPMQRLDILLNGEPVDXXXXRQPGL

SEQ ID NO: 16157 - protein, 213 aa, Chlorella protothecoides
MYLSPASRYGCQYLEHGMRYIPPSRIHTGSRQTSAPLESPMAAGRPPPWRFAVSSWVTTSRPWPLLLSTQRLLPTHALVALGPPERSKIIAGREDLAQRGLLMVDELKKAQDAHGNGYLSAFPQEHFDRLESLKPVWAPYYVDYHPSSSLLPRSTTQIHKIMQGLLDQHTMVANPLALGMVEDMAKYFCNRCVELSSWPLEIPRHVLWKTTMG

SEQ ID NO: 16158 - protein, 93 aa, Chlorella protothecoides
MSVPRGPCSLPVLREAWVHGVVDENTLVWGQGLADWLPIRNVRTLVPQIRTVEVQLGTWFKKNFALRPALDRMRRARVDARSPDKSTQVENMY

SEQ ID NO: 16159 - protein, 88 aa, Chlorella protothecoides
MGPNTNEGHFSIMMGPSPHLNGGYTIFGQVVAGWEVSEAINAVSHGQPEDTAHGDAGVVIVDAGQLRKGTIVPDLRLGLPANATGYNY

SEQ ID NO: 16160 - protein, 180 aa, Chlorella protothecoides
MEHVGGHLHRPQLSHPLFPLLLLLQQLALARHVPAVALGQHVLAQRADGIPSHDAPPRRRLHGHLELLLGQGPRQRRAQSPPQRLRAVAVHDARQRIHGLAVEQDVQALHGRAPRFALLIALHGCAPRFALLIVQAGVAGGRRLELVVEIAAQLCQRQRVPFKTGRKGEFFGGGRGGGGI

SEQ ID NO: 16161 - protein, 189 aa, Chlorella protothecoides
MTLAEGGPVLTRASLEAGRRLPEAEARAAFHGMAKGSVGRWRVLHQVEQRLVRSEACVSKSPIKDPVLWDWACSSQAWCRRAGWASTWGLAELHRLGIVHGDLKPENVLLGSRVMLTDFGCSGWEGGGVGIHRPRGTPAFLAPELACAEAGPWWACVVGSVCMWEEGCRAGCQNEWEGTLCDAHNGAPE

SEQ ID NO: 16162 - protein, 76 aa, Chlorella protothecoides
MWSIWIFTVPSLRARQCSSKEKEALNYLFLAIPLVNIAIPFVVRSFPLVFTCDLLLLAGMYAWKGVKPLSQLPSSK

SEQ ID NO: 16163 - protein, 126 aa, Chlorella protothecoides
MADSSGAATASLRECRPLHAPLLPFPHPPADSVLPHIHASGYNAIQLMAIQEHAYYGSFGYHVTNPFAASSRSGTPEELKALIDAAHGLGIVVLLDVVHSHISSNCEDGLAGALGGGRMEGGRGRC

SEQ ID NO: 16164 - protein, 210 aa, Chlorella protothecoides
MPTQGYGGSSHPRPDVGHQAPSHHTPQGAKDYGIHTTDELTVYREWAPAAQAAQLIGDFNGWKPLDMSLGDNGVWFIELPHGPGGAPAIPHGALVKVRLRLPGGEWVDRIPAWIKWAVVPQGEMGAKYVGVHWAPTEAHAWVHPRPPRPATLRIYEAHVGMSSEERAVASYTYFKGGGDGVEGRCVMMFVCMCAWEDGGKWGSAFGRGRV

SEQ ID NO: 16165 - protein, 105 aa, Chlorella protothecoides
MWFTRSDVEAPRPHTPSFPLSTSPSTNIDALVYLMLANDMVHELLPSAITIAEDVSGAPTLCRPVGEGGVGGAGGGAHAGWSDQESAQKGARDWSRPRHAAAAPG

SEQ ID NO: 16166 - protein, 308 aa, Chlorella protothecoides
  MOD_RES (242)..(245): Any amino acid
MSGLRAAGGVAKRSAKKVAKGFSGTVGGDSHLPGSTHAARGIEFHKSKGQHILKNPLVVQSIVDKSGLKSTDVVLEIGPGTGNLTMKLLEKAKRVVAVELDPRMVRQGAGASWWEDANAENPSPHYLCAVLSCCSSGVGAAAKSGGDSTQRLPPDHPRRCHEGRPPIFRRVCGQHPISDLLPAHIQAAVPQVARVCHAAGGKARGPPVLQADRQHSAPLQVCCGDSLWASSSLYSLDGVLSXXXXSSSPGLLQGFVVGIVELVQPGWGTECRVCGFPKVTKAGARLECLELSFGSGFSPLLLKISHPF

SEQ ID NO: 16167 - protein, 374 aa, Chlorella protothecoides
MKWRACHAAASLPHRNLLFPCYREELDRPENKSLVPLVKRLSKVKAELDGQAEKRGQAPISWADLIVLAGAAAASLDWKAIKLGRATDAAGGEIIASQLATPIPVSLGRGDSPAPNPSPIIPIPTENASPQEVKVGPMEGEVWCVRGGVGHLTAGACNREGASSAAGERIMEHGRHAQHLPATWFCTDVCRFLSSTQHMPVVPSTTLQDFFNRLGNPSSDNGEGLFSRKPPFFPRAAFVLWTAAQPDPAAAEAKLATDPAFAEWKTSYDRSRRTVTRNMCFIATRWDAGPGRCQVAHYVTSSRSFLLQCPAPQCRAASDVPQLCLPKPLIPPKPLNPDYEVDFGTYYERLANLGAKFDRTRYLIPLKTANIPRL

SEQ ID NO: 16168 - protein, 160 aa, Chlorella protothecoides
MSTLSTNIPLLPHIHPTDPQLLFADEDACSWEWEVQRPPASVWTRVGGDPACSAGRGVQRTYIPTPEDVGALVRVRCTPGRRGKGGAAPTWGEAALAVAGGRVQPHPATQPGPAKVCIPPARLEATVPPRLRVVSYNILADQYAATERAKSVLFGHCPEK

SEQ ID NO: 16169 - protein, 205 aa, Chlorella protothecoides
MRQGPTHPTRSHQSAHRVHHLLKVGKNNFRPPPKVDSSVVRIEPRNPPPPINFLEWDGLVRLCFGRKNKTLSALFRQSTTLHQLEENYLLSNALVKGADGTTQDLASALATMAIEAPAGKEAEEGEEEGEEEDEDEEMDLEGGAQQAKAAQPRRKKRGRASEEFKQKVLGVLQGGGFSDWRAAKLSQDEFLALLAAFNRAGIHFV

SEQ ID NO: 16170 - protein, 128 aa, Chlorella protothecoides
MRLLNTHVAHLPGKKHKGRSQQATDPSSAQPASASVAVLAGLTQPSLDASSVTNEAAWVTGHILQLGEARLPILRNPPLTAKLDVYGDAFVGIPLVPVPQLDVYGDAFVGIPLVPVPQVRMEVVLWAP

SEQ ID NO: 16171 - protein, 448 aa, Chlorella protothecoides
MNSDLNDGIPGGRQRGGGSCSTHSDLGAIAVLDARQGMQRLRASPAGTTGCSHTTQSLAPLKLLATLCHCNRAGALQLLETGQLGADYWDWEAGVDFDWHRTGKNKGNSGDEIGEEDEGEPKGGPAPLPEAAAVRPDPAACGLDLSLAWPRPLRPAGDLQAPFSNYVSGYQGLLDYVWCVYDPAALECVDVMPTPSAAELGSFLPSRSLPSDHLPVVFDLSFLPSRARASGSQGPRVDGGASPESPRCVSTQGPPPTSAGGVRPAALHAVRAAAAALAGGGVVALPTDTLYGLAASARDEGGVARLYAVKGRRHAKPVAIALADTRALPRYVTAAHLPPGLVGALLPGPVTLLLERRADAPLAPGLNRGTASLGVRIPDSAFVRAVARQLGGALALTSANASGQTSSVAVTEFQVRRGILGVGWGEREADMLWSGDGGGTRLRNGVEG

SEQ ID NO: 16172 - protein, 88 aa, Chlorella protothecoides
MKEVDRDNEVNRILGAFKLNPYEQLGLRFDASMEVVPRQYRKSSLMVHPDKCAHPMAKTAFEIIGAALKDLKNEDKKATLDFFLNFAK

SEQ ID NO: 16173 - protein, 108 aa, Chlorella protothecoides
MASLQLNSSLPPVSSHLPPPPKVRLALELLFEGVHGAGDLALVSSDQCATANDREGAPVAPQILRVGEAVTVSYDPASAPGRLTLEWQGGPGADAVADAVVAVVLGAG

SEQ ID NO: 16174 - protein, 335 aa, Chlorella protothecoides
  MOD_RES (25)..(28): Any amino acid
GGGVGGWGRGRCVDGLGLDCATQTXXXXRARTAPPPRRRSARAPSAPGLRRRPRSRWAWRACPAPTASASRSPTQVTLSGGFRWVGVWSVRRWAGPPLCNSNLVRPRPSMPRKGTPPSSCLPALRPVHPLRTPIPPVSSLPSNPPPPPNEQPTGSSTSLYSDAQAGGPVPGAAQLPDAPLVGEGLGLLAPGGALPPGAGRGEVRRQQILKQQRWLLFLRHCAKCQVPERECQYGPSCTVAKQLWHHLIHCKDAACAYPRCLPSRELLKHHQKCSSPECPVCAPVKQYVSKQRALDFQRRTARLPEDQRAALMRQLKAEHAAAAARAQGSGGGGAA

SEQ ID NO: 16175 - protein, 241 aa, Chlorella protothecoides
MHILNILPRCGTTSIPLSTFSSHQSSAVTRAGPGDGGLGAAQLNLRTPAGRFDLEIIFASRLNSSNRNIPRKVQPPSRRFALCTWDRHHSQQLFQLPTPPFPPSNPSKPPIMSGSGKPISEQAQDALNAASNKAAETWDAAKNKASEDFNARAIVPANNDRSSPFNPLLNLLQLAGTAQNRAEETKNQASSRQSGTGGLIDDAKNKANEFGNRVGEKTTEAKHSLQEGADKAANRADETAR

SEQ ID NO: 16176 - protein, 662 aa, Chlorella protothecoides
  MOD_RES (532)..(535): Any amino acid
  MOD_RES (562)..(565): Any amino acid
MAAHCMVGSTMSARTRPRAWSRCAVCLRKAWALSTLIWSSSTPWVALTPGSIRACKRGLAWEGGVGGAEVSAGMGSWVGRQRTTTRTGGASARQLVSSRASPAQARANVHQHGVLVQATVLGHGGEHLLRTGAGDGAVQAFHSFPASQPVLRDAWGCVERARRVAVVPEDGVVDLGGPGALVAIVAASNGQNVRPPKLLMCLKMKKVCRLQPPRCYRNARHQRSIQNWSALYRPIYTMLYLFLLATESSAFKHPCYCHSSQLHARKTRNVSRRNTGCPSRIGQMYSSIEFNTPVSEINPNQVSLPPRDVLWGDSCSLSGGVPSWLQLGIYPGPQRRASGDSSGLDAADPIASTSGAGPSAEATPPPQGYRTLDGLPFPTTIQSKKKDRMAPIPLATALARVKASKRAKFDETVELALTLGIDPRRGDQMVRGVTQLPHGTGRSVRVAVFASGEDAIAAREAGAAGESGPALEIVAFVGGLVVQGAGEAVSTSGVEGRHGSGCDADVSATPRHADMALKSPPLHTCAGAEVVXXXXQSATPRHADMALKNPPVHTCAGAEVVXXXXVRRSRHLAGRGDIGPGGGHALHDAQGGPRGSDPGAPRPHAQPQAGYRDCQCGRGGGGAEAGEGGVQVRAGQAARGWGWGVWVRVGRGRVGGRGSTGG

SEQ ID NO: 16177 - protein, 278 aa, Chlorella protothecoides
MADDVSPPLSVQSAPSIRSSNTSPLPFQDGDETVLEAGGINILFEAEGASHPDDSPSVLYVTDVDSDLEIYLDGAELKKGKRTKVKPGAKLDFGDEASYTVGKKSMWGKKEGEAYLVAVHSADGHGTPCNLRYHSFLPRSCATSPRMPDWMPPRRGCSLFAPLASGHSVHAPNWDGAARGPESTLFFTNSLDTPEPGQMALPLRSAIGMVLHCTAPGLSSLCNLAMQRDMQSQASTHRAAQTGTHQALTWAAAAAWVREARLTGMPGPIVEESVAART

SEQ ID NO: 16178 - protein, 357 aa, Chlorella protothecoides
  MOD_RES (70)..(96): Any amino acid
  MOD_RES (119)..(122): Any amino acid
  MOD_RES (271)..(274): Any amino acid
MVYGVGPGQAAMFTAVGWHGNTTACPSKVAHTWAKQCQHEDTVARWHANALHSVQCTHIRVVPVCLEGSXXXXXXXXXXXXXXXXXXXXXXXXXXXLFPFTISPRCQTHKTASTDAKLXXXXAQLLALPRWPTPGQSIASMRKPSQGGMPMSCILCSALTFEWCQCAWKGVSSVNFLACRDCNAPALQSSRPAGGLAETMAKPVQVLASKPTCGATRRSTSWPSVYTQPPPVRQLLLALAIVVPKPACVCVFMRGHPLGPWIRFIRRLRRXXXXAEHLYAAHPGEATVVGVGHWHAQARVCVSVHAGHPLGSGIRFIRRLRRVCKVVSVDEYRTSKLCCACYISLHTHQYKWVRREV

SEQ ID NO: 16179 - protein, 578 aa, Chlorella protothecoides
  MOD_RES (52)..(55): Any amino acid
MSDPAPTSNGAFHPVEHAPEALDDGIADYTSVEALLEDNLPQDKLEAVRRLXXXXPTQSQDNLPQDKLEAVRRLLYGVNQGQLVSALALPPHLQEAVEYGGFDVQAYAFTARREQLREPRVVRLGLIQHGIQVSTSKPYAVQREVRLCTGDCPRARGRHGAALRPAARAWPESMIVSCGATVRVGLPAPSCTDGPDCMPDLFLSPSTPPRPRPSPPGHIHARGGVGEDGGPGRGQCAVPAGGLAHALCILHPRAGVVRVRRGRSHGAVHGAALLAGGAVPHGDHFSYPGARLSARRRHLEHCCEEGSQPKGQPVGRGMLGIAGRQDCRAAWPTSSALSPILLLPCSETAYGRVAVNICYGRHHPLNWLAFGLNGAEVVFNPSATIGALSEPMWGVEARNAAIANSYFVAAINRVGTELYPHAFTTGVQGQGPRQDMGPFYGSSYVAAPDASRTPGLSRDREGLLVVDADLNLCQQARGGLGVDYAVNGGQMFCKEVPSSIKWNMGRGATGHHAHPPPSPPSNPTQVRDRWGFQMTARYPLYAQLLSDFIKPGYKPQVVVDPTLDSSASRKAADCEKGR

SEQ ID NO: 16180 - protein, 140 aa, Chlorella protothecoides
MDEKTGEVQLQYDSRFSAAIPCYSPPSIHVACTLSTEGRIERGNREFKGLRLQHGHVVLVGKATIPATRHWLTDTLLQLPAQCCCVLSATLRFEEAGQHGQLQELLAYPSSTVHTLPMPKRRSLYLQFVMASSPRVEIRS

SEQ ID NO: 16181 - protein, 85 aa, Chlorella protothecoides
MQVRLDTRKDCWLAVSYMPWFQYDASAGQGRGIATPSKTPGRLRLKFSPSDLHIPSLSWRTTSVGIVPLPPGIAIHIHPQVREEG

SEQ ID NO: 16182 - protein, 149 aa, Chlorella protothecoides
MIATPTLSLFPSPNRVRFADAPSEISGKYGTSDGHSLDEGRGVVPVRCSDRKWVARITPSEVRQLESELGEEYQASLDRLKRRWGPGAGMLSRVQLVSLGLLNQSTSRMAIKADAGEVDAPKPTLPGSSIRLGSLTGSLRGSAPLKNGL

SEQ ID NO: 16183 - protein, 269 aa, Chlorella protothecoides
MPPPAPHHTQVAQLTDCTHAYSFWEGVPPPGRAAFGRLFRSSPSLRGVAVVQRAMRTDPEAAMAAMGFGPLLLRASFPVSMSGSGRSFTAYIFQRSDGGSEEQQPEAAPSTSVPEEVPTPCRSQDDAVVPAEESSGFETRDRPDGALTARQSRASARRTAAVHPSADEEGCVTGPPPLGGKTGAARCEGAPPQQTSGRQPGVRERLPSKSAAVHRVLTRQRPFPCPCRRSTPRSSAPHSSAGQQALLLHRHQRRLPHPPSSKPAARGLE

SEQ ID NO: 16184 - protein, 83 aa, Chlorella protothecoides
MSKHCGLDKDSVLVDIGAGLGRPLLHALIEPGVKATHGVELDQIKVDKAHAFLKQTAQRLQARGLVRADMVLPTMQCAAIEQV

SEQ ID NO: 16185 - protein, 458 aa, Chlorella protothecoides
MQTVYCHTEHRQFSVPEGWDGVCPSCGGGFVELQGAAPLPVSLVLVDPGLHMPTPVGLPARPSADWIAPLSPAQVPNRPRPGPRPASFQLPGGHGVVHFISSPMDAPPGFPVFEVHGQGGSLRDMLMEALVQSGIMTQEGGAGVFPGSESMDDIMTRIMDDYQPVSHPTARRAREAFPRLRVRPAGQKDPGEGEAAAAAGEPCSICHETYSPGDEVVELPCDHCFHPDCVMPWLETHNTCPVCRLELPAEEGGPAAGEAAPQPSAGRGARASGGMAQGPVAFHFPASQAGTLAARVTQALGELVRQREAQALHRPARGVVDGVGPSAAGPAQPGGRSDAGSGGGAPRVDDGGPARPGTRVQGPGALQGAARTALGGPGPSPAPLRGPPSVLADRLEPGAAGAAAGQARGRSTTAAAGPSSTPAEQPLSAMAMVAGALVAALAGTALGALLGSSRRSQR

SEQ ID NO: 16186 - protein, 174 aa, Chlorella protothecoides
MVTAGQHCRCSPISIAPFLPQEAIQYELDRRRPGQSRITTPRKESDTAEILSGLAADRQTTLGTPICVLVRNADQRSGDYAEMEAAYRPSHADATYDFKYGIRAVAGGGRSSARETIGRVAAGAIAKKLLHEVAGTEVGPGGGVTGSVVFRRGVGKKVGRWEGPWRRRERGFGM

SEQ ID NO: 16187 - protein, 145 aa, Chlorella protothecoides
MGGVEYLQYLRTLAKRVDSDWEGVRRDLETIRLALPLQRPAEPRHAVRMPSTLDVPTVLTAHHHSTPTVAPAHFSTHTPNSRCRSTLLQRDGALVNITGDESVLRATEGPLADFLSALPSLPGQRADWNQTLDPASEALVVPTQV

SEQ ID NO: 16188 - protein, 123 aa, Chlorella protothecoides
MWSEQLPAFLCCHILLKGEHHPLATATLCSSASPLPPLFSCQVNYVCKAANLYEDAGYKLSGTSYVINKFLGTSWIWDRVRVSGGAYGGFCDFDSHNGMFTFSSYRDPNLLKTVDVYDGERRG

SEQ ID NO: 16189 - protein, 78 aa, Chlorella protothecoides
MGLKGGNEDVGRAWKEKELAIVMPCLFREAVVLVPRSGSPAAHAPTLQMVLETRSGMEAGIVGSGHSFAGSRLDAQRR

SEQ ID NO: 16190 - protein, 101 aa, Chlorella protothecoides
MLYLAAFSPGLGPVPWAVNAELYPADVRGTAVGLAGLTNWLANAAVAQTFLSLLHALGPAGTWAAYAGVAALGWAWAHAFVPETKGRSLEQIQAAFEGGGP

SEQ ID NO: 16191 - protein, 231 aa, Chlorella protothecoides
MAPAKRARGHHARQRKRSEVDAEEIKQIEAALRSNAPEPGTNPLSLPAAPEGVTTWPASRTFDGLPLSRHTKEGLAAAKFTRPTAVQRAVLPHALLGRDVLGAAKTGSGKTLAFLIPVSGADGGTGWLACRCFHAPQPLGRCEAHQIPIGSRIGSAVPRIQELTNDDAFHLSPLDCQVLECLYRQQWGALDGLGALILTPTRELALQVLLVAFGIACCRAFQCLLLRLEPT

SEQ ID NO: 16192 - protein, 71 aa, Chlorella protothecoides
MVLFATDIAARGLDFPTVDWVIQVVQGLGKVGIWGSCECFARIPKRQGAAAVQGHFIGQRLAPQPPAVRSA

SEQ ID NO: 16193 - protein, 313 aa, Chlorella protothecoides
MDSDYPIFQASASRDRSLDWRRRLQVIAYAAALGVCVQCYNRGVTRVLKAIRSGPGLHASTARLPASPHTCTGRKTLTRCPDDLDDGHPHALRTPFARYAARYARSGLKSGGASPHGEEHSPTSPLAGPDSSDSGSTKFFSCLEAEDVRGLYAGTGRVTLGPHEPLFNAGDPSESGIFIVVEGRLGTYLPAPEPRGGGADPSTDRLLVNVLVYGESVGDLDVLDGAPRAASAAALAEGCTLVQVPRDLFLNFILARPATLLVYLQKGSGGWRRGRAERADQVHAQPCQQRACNLTVDPAVDLPSLPRLLGLRP

SEQ ID NO: 16194 - protein, 227 aa, Chlorella protothecoides
MAAGKSLLLLLPSESEGMLASLGEAKIPIKQLRHNPEKIQSVTPALQALLSKDAEIKGLGQRACTSYLRSVHLQPNRSVFDAAALPAGEYAASLGLAAAPKLRFLKRGAAQGPGAERRDEGEGGASDSSGEEEEAAEGRAHAREAGPSGPPPDEKDDFLVVKQRDALGVSEAVAEEPILNLAASQSTGKKKRLRIRPDRPSSSRMVFDEEGEAVDPLAQLVPEGAAR

SEQ ID NO: 16195 - protein, 164 aa, Chlorella protothecoides
MPVLGVGVWCGLLSTCRVQMAPHSPDLGSGHHPSLPSATQRSDEGHETAAQRAQHVRTQMAQRDALDKAEQRARRKEERESKRAKRLAREREEAMEGEEESASAASDGEESEEEKFGGRFRNGRGAELREEAGAEVAHMGMVPATLEDQEALALRLLSGRRGGA

SEQ ID NO: 16196 - protein, 193 aa, Chlorella protothecoides
MAESWDPSTRATVQKIPLLTVKAGPRDKDAWQARLKEEIQALIKYIEINKRGDLDWFTIKPTNKEGTHWQGKCWYIHELVKYEFNFQVPRKRWETAMLATYTAPGATYPTTAPEIELPELDGKTAKMYRGGKICLTIHFKPLWAKNRWGGMGGCSTCSGPHFGVAHALCLGLAPWLAAEVPYLVESGVVKANN

SEQ ID NO: 16197 - protein, 327 aa, Chlorella protothecoides
MCAAAYKACFSAGCMSHAHGWTWTGLTPTRRGLAKLSACRAGKSSPETRQKLELTIRDLQGPEELQAVALLRAHAFYTYPPERAFAGQLHQLMKVEEEVRELGHAIASFPLDQAGLDLRMTSLVALADASRHADLDPGYHIPSKDGVVLSTLDLYIASALPGEYLIGEEESRREASLILGGKTMPLGAVPESCLCRCGTMCSSVQHASTFTSSQDATPGTERAPPSIPAGRTRNAAYLANLATAEGVKRRGIGRSLVSAARQLAREHGVDALYVHTLAVNTVARDFYASCGFVVEREESSNTAHYRGKCLDGVEGKGRTVLLRDTQL

SEQ ID NO: 16198 - protein, 288 aa, Chlorella protothecoides
MKLLDTVPPSMTSHLVATGRQAGRDADDLVAEQLGLSSSRELSGVQERYKDRIKESLEKVRRRERLRWVCCEPRAKELQSQQAQRERGMKLGKIAYGRGRYSAAVTLFEAALEEEGPFSHLGGDIQMWLALSYQASLFWVKWPLISRACEGIILCHHSTACGREAECIDVYKRLEESHPLPSTRRRAADLRYIMEAPKLPLSDKDRVHIPVLKNMDVNRGVRAPTNRPRAPPTTASKREKTWDERFWETYEPPQYLTNKYVWFASSLLAVAVSIYGNMARHGLGRLSL

SEQ ID NO: 16199 - protein, 233 aa, Chlorella protothecoides
MFSKPFPAFSARLNAWATAVTCQWLMGPCSVVAVDDGDGQPKAGQGVKVERHVGCWHCSRRFLIRAGAGMGAFCLPQRDVTREAWQRNVLPSPGCATGQFAKMSQAIPLGCRCRYLEESGCASVCLNSCKFPTQRFFMEDMGLPLTMTPNYDDFRGTSPVLGPVHTYTSTHHHLPHFPAVSLPLGEHRQKPFAIPLWRRPALPIALPGIRPGSTNRKSGRPSNNVLAQWPERR

SEQ ID NO: 16200 - protein, 180 aa, Chlorella protothecoides
MMTSIPCLACPRIVQAGVVNAVATWFELELDEECTLSTSPHRSGKGPTWQQAVQWVREERVAPGQTRVLIASHDTYSISYALEEGAAPGPDHAGGVHFVELSDGAGELEDRATGVPLVDPVWKEAFDSLQPLNSQIVRACVQDPLEYRAIALEAVAFASRPHDYDLDASQATDFCVKMMG

SEQ ID NO: 16201 - protein, 137 aa, Chlorella protothecoides
MLRSRAVARLKSRRPGGVHVLDMGAGTGLLSMMAVRAGAASVVGAEINRHMCDVAEECLASNGCLGRVTMLDRDVRRMAAEPGPDGAPADLERRVDLLIYEVGGLARGEGRGWGEGKRSRLVSAVHGGPTSTLKIPG

SEQ ID NO: 16202 - protein, 107 aa, Chlorella protothecoides
MGWSNAGVYPPSLLKPFHPTPPPSPPPRQFFDVDEVYEALPKIKNDLLLVGGEDDVMIPSQGLRVIARRTTTPWLVVLREAGNAAWIQYLPSFVSMLDLFLDAYPDM

SEQ ID NO: 16203 - protein, 528 aa, Chlorella protothecoides
  MOD_RES (352)..(355): Any amino acid
  MOD_RES (489)..(492): Any amino acid
MTFPASPAREALEECAVQRWLPVYRRHTFETRLIPVDKDLCNWLVSDGVSASGDNRAVRASAMVVGAQENEGMGPCRSWLIPLAPRDLADPDQQGWESDSEEGDGSHSGTPPPASLPTLHASLASAIAELGGRVHPKFTWSCPKDAVWLSPGNTLACTSPDEVLLLLRASDRVAHDVAAAPADCPHAIVLRRWRALDPGREFRAFVVGGRLAGVSQRDLTQEFGWMQDPGARADLLHLVAAFFDDHLCASFPLHDYAFDVYVSSGRSTLKLLDFNPPGGTTSALLYDWEELGWGGRRDCEAEDGAGTPKADGTAAMAGPDDVASGGPAPRHATAGPPTRDAPEALLPPCVDXXXXGVASGGPAPRQATAGPPTRDAPEALLPPCVDATYLQQLRAAQGRREDSGVPRSPSSHASTTGAIPPGQPPPGQPTPGQAPLELRVVQGGLQLRPHLAAYGVPFDFVDTSEGSALNQISARGALNRYQPPDCRRXXXXDFVDTSEGSALSQLLENVGVPSDLWQELKRQGAAAS

SEQ ID NO: 16204 - protein, 496 aa, Chlorella protothecoides
  MOD_RES (429)..(432): Any amino acid
MHSSTQSHPSASQLQSILNSTNEQVAQLAMQVPFQSACEPRHHCCTPTCSWYHFIPHVNSGIIAAPRPGPGQRHAFCIHRAGSIGPASFNTTPMLQGLVPGLEGGAMRTVIPTPGYESVGHRKTSPDPCAQQLLQLHCPHTRIRASLPACIPHTSLRFVIKTSDESGNKVFLNVCADAAVPLPDGWSPGEPLPPAVKGYLEAGPEGSAPSSGDALMSLLAFPMWLSDLRRDSDHTGAACGGEGGVVIRDKAGSSLRIPCLQWTESAQLKLAVLFDCAGGWLPAFLDCVLHADILRHAAEVRPLKLYAIQLVLSEVAHKCALRLNPLYKLPRMRSGRRASRPGEGGAGRPGQGPGPPHHARPAARGAGTKRGVRGKRGSQHPAAGNTAVPWLPRGGRQRRGGADARPGGDGAACCARRARDSDGAAGEHXXXXRAVHAVHVTVTGQRVSIALPACPALEVGLPFFVRPDQGTARVTAQGLHVTLPYRPLEEVHPRTA

SEQ ID NO: 16205 - protein, 309 aa, Chlorella protothecoides
  MOD_RES (285)..(287): Any amino acid
PPAPSRWPLLHAPECLRVVAALPGARPSTAAPVTALALGPDGTLHAVHAAPRLAAYRWLAHRTEAGPFTFGQTAAEPAGAGQGLLEPCGAGLTLLDPGPGPGITPTQAPPVAFLPGTRHVALGGADATLRCAWVESGAPSAAASYHQDAITCLAADEGVVVTGSRDATLLVWEMGARGVERAPRRPRATLHGHPSPVVAVAVSTPLDLVLSASAGGTLLLHGLRDARAMGCVDSRVLWRTLSLGDDWSADHHVYLLCAWSSAPYVLECNDGSIDCKHSKIYMYLXXXLHPQGHGLRGVEGPVEGTLSGC

SEQ ID NO: 16206 - protein, 90 aa, Chlorella protothecoides
MKWTLCSKFEPVRFGPGEDILSEGDKAEKCWVMLEGEVVSLHHYVEAGSMQGPALLGSTVVLQDLVETFKSSPCTLRTLSSCICWQARLD

SEQ ID NO: 16207 - protein, 201 aa, Chlorella protothecoides
MSAASCAPARWCVCRQRAFWQEQSFRQGTGSISPRVSSYICMLLPCSPMPVQVALMGPSGSGKTTLMDILSGRKNVGKISGEVLMGGNKPSIPFLRRYTGYVEQFGAWDVEFCHACSAIWRRCLDLVGVLGVALRAAIDQGRNRRMSGVSRQHGMADEWLPLSLPGPCAADPHTLKDTKHNHCHTPHGKTPSNSQTPHFCP

SEQ ID NO: 16208 - protein, 503 aa, Chlorella protothecoides
MTTVKTLARRGLTVCTTIHSPTPYCFHLFDRLLLLLRGQVVYFGPGGEWGAGDWACMGAVHEGVAGVDQGQHSSECQGVCPGPRALRMRVTASNFLHGRWLVKRGEGLTAPQNGQEAVEYFVQNTPVMKGLMEGENEAEWIVDLTVQADRQGKAGEFAGAFAASRHKTVSDEALQSLLRDTPSMLGGWAGVWRSRRKAGEDVVGRTEDGMQRLVAPRRLSHVAARPLAEGLHKEHPDPGCGGGLVGGDLEREAHQGRHVAFMRAHRAPPPCPLPRRRGQQEGAGSAARDHHALLVGPPGHDQASALCPPRPVPLPLTGDASLSSQRRALKQYKNPEFVMPRIAGSVLFRWGGVWHRCWLSARDGMVWRFWLDKGMDSWLHPSAPPQSQRRSEIHGCCISALTHTHTPYPPPPLHSLVIFTLYWKKGDNLSTGNLYNIQAVLFMWVVLPAYNSASTMPTLVMERQLFTRCCLHRAGVWGCAGGCVGDMAVVGKQAGTALDMLLS

SEQ ID NO: 16209 - protein, 124 aa, Chlorella protothecoides
MLICARLRVDWSRLGRGITGAAALDASQVLGTCGLDPYSDAYAASAGRMDGLLSRLRADVAHAVEGGGPKAVQRHHSRGKLLPRERIQALIDPGSPFLEFSQLAGKGLYGEGWRIVAGCLRCRS

SEQ ID NO: 16210 - protein, 207 aa, Chlorella protothecoides
MQSYELKPRPEDLLAPEAAHSVGHYVERVGQALTVAGLQTSLRGTSLAFDSYMDERMEARWQQEREALFEWTAPYSLPALPLVGPGARGSAAERTPLGSVASGGAARLRGRAAQYAEVARRLNRARAAGEEFPLAAELGAACQAEPGGEIVWRESPEGCFLPKVGRTLQNRQLIVHSTTSTHAGTERRTSMARVWKVLGSLLPAAQV

SEQ ID NO: 16211 - protein, 141 aa, Chlorella protothecoides
MQLTIRNHRSKVGAVGSWLCVGGAERQLAGQQRGSWPGSREAGPMPHLAAAGRHVTGRPAALGASPSKLALINAYLRVSLGSREQLDFDEPGGMDTTWHRIYTALRAGLTAEAQQARARHRGRRCWRVVNPDSRVSMFHVT

SEQ ID NO: 16212 - protein, 361 aa, Chlorella protothecoides
  MOD_RES (201)..(204): Any amino acid
  MOD_RES (305)..(307): Any amino acid
MAATFDGGVILGADSRTSTGDYIANRVTDKITPLSDSVYICRSGSAADTQNMSRYISWFLEQHEMDLGEGPRVETAAKLAQSMAYQNKNHLQAGLIVAGWDRVAGGSVFAIPLGGAQGAGLAFTGERVWRGTACRAFTAWMGDVTRSWKDHVEAGRHPLVWVGSQGHADDVLQSRGSLYPSPPGQRAMHQPLLQANMTEEXXXXHEILEDHFETGRHPLVWVARVTRTTSCSRGAQCTHHSLLSAPSTNPLLQANMTEEECKAFVIKAVSHAMARDGSSGGCIRTVIITKEGVRRDFLPHNRIPXXXLHTHRDHHQGRREEGLPAAQPHPHNAWRATSSRATIGGCCMTVRLHVLSKLEAP

SEQ ID NO: 16213 - protein, 90 aa, Chlorella protothecoides
MPGYGEQMRAVSLRHVPTAVLSRQTAGLRGKALILNLPGKPKAIRETIDEVFASIPACIRLLGGPDIRTDDSVVKAFRMPDASLPPREGR

SEQ ID NO: 16214 - protein, 762 aa, Chlorella protothecoides
  MOD_RES (105)..(108): Any amino acid
  MOD_RES (652)..(655): Any amino acid
MLPAGVPIHKSRISLSTHTHTPRNHPRTRRHSRPKPIPGGQQAEHVPEGRAVARDVGAPRVRVHHLRAKPGKGQAGKGVGEPPPRHRCPAHTPRLPRPPCRPSPXXXXRHSRAAPGAGLLSGGGALARHEIPAAIPGPSPRLAAAVLRIRRGRLGHHAAHLQGNGAGLAGGDQRRQAQRVPRAHGVGRAQAHETGAGDGVQPRGRATGAYRRKHAVLEGPVGGRAALAAVGGAARRGALIRGGDGRLDAGQQELAGGGAGARRRGEEEEQRPLQAGVEVGAGQQGGGVVQHHRQHLVVHFFRRCACVEGEGAGGGLSGWVAWVGWGVRNHVAPQSSLPHPSRGRRAWASRRCCLTGRGPPGGTAASQAARPPPGRGAGGPGRPPPRGTGAQRGTAGAGHWPATPWRPCRPPGRPPPAGQRSAHLIGPHCSGADVARQEGVPAGAPTLGPGLRSLDRLGPGSTSHTQGLEAGAHSTCGVPIHRGSHTVMQAHTELSMSLGSSRVTSPERPQCTPRVAAIRREKIPTVRNASRDNNVGMRRDASPPAQIGLLRNLVPCLPGQNLSTRSTAGGSSTAPSCMLELVAPMGKRKSAKPPPAKSKAKLDVTFACPFCNAGMHTEFYPLALMWEQGMSAPPVLCLHRQNLHNHPCRQEXXXXGGWEPPLHHYYACTAITYTTTHADKSVTCTMDRERGVGSVSCTQCSASFAVKIHTLSEPIDVYRWDQGVHWLPVSMGRLSIGSGTPCSPCSHPTHNNAVTGSMSASA

SEQ ID NO: 16215 - protein, 436 aa, Chlorella protothecoides
  MOD_RES (292)..(294): Any amino acid
SAAAGPPAAAPAAASPATSPPPDPFALVREELGVVSERMRRSIVTDIPALGSAADYFFRLGADGKRLRSTVLLLLATRLAPAPPDPARLEVDESPARAPPGEPRRRQQRLAEITELIHIASLLHDDVIDEAGTRRGVSAANAVFGNKVAILAGDFLLARASVSLASLRDTRVIELMSACLESLVAGEILQLTADPEQALCLDHYLRKTYCKTASLMANSARSVALLGPEPGPDAAQAAWDYGRALGLAFQLVDDVLDFTASADELGKPALNDLRSGLATAPVLYAAQASEPXXXAGTPALCRAGRRRRRAGHRGRRGRPGARAAPGRRPRRPGGAGAGQAAAAGLRGGRGCSRCPAGAHRPRAQPAELMRVGGAGAGRECHVPRLYGRVLWKCVRANRWTGTRHPGRPVSSLNHTLPCAGGGTHRSLLAGGAPACH

SEQ ID NO: 16216 - protein, 387 aa, Chlorella protothecoides
  MOD_RES (69)..(72): Any amino acid
  MOD_RES (98)..(101): Any amino acid
  MOD_RES (362)..(365): Any amino acid
MPLKVRSMASQELLAGRWRQDCLALVMPGGADTPYCQVLNGHGNQLITGGAFSWDEYFSAVAESLWGCXXXXRQPADHREAIHSLWGTWSHHASESKXXXXAPEKPYTLSGEHGATLPLSPRPALIHPCCMLLSARPFTLSTPLRRLRGRAGRRLPRPVRGRLLRLGPHRVRTRLAPGGGRGARAGFLPRHGARQRGARLRLPLRGRGCRGPPLCGRRGRHRVPRLLQRRPGLPPRRGRPPAGLPRTGALRRPGGDPPGGAGLRCGRRSRRAVRDAPGAGAALAGPARERGRAGAGGGPPADRRRRPGASAPAPARPRAAWRGALGPLAAAARSCRPGRLAGRPAGRATTRGLGGRRSHMTXXXXGAWLAVQQGGPPPEGWAEGGHT

SEQ ID NO: 16217 - protein, 619 aa, Chlorella protothecoides
  MOD_RES (274)..(299): Any amino acid
MGSQQIAQFPRGPGRVARSPSCQLSLGRVSDEDGLFNAKLSDYCACIHDHSILDLAKPKAGRGIRDPHPPTMMSVSATSCRAVSHMLRQGGPRIAAPFKAAHRPCRCLHTSCMARKGLAELLRLSERCVQRTLQPEGQRTTRPHNSNRPSPPHPPPASRDDGAGLKGRAPLVPGTVSPPRPVPPHIVRPPYVSRSGTPDWDSRPQIQDAEGLVRMRAACNLAARVLRLAGSLVAPGVTTDEIDAAVHEATIAAGAYPSPLSYGEEGPGGCHFGXXXXXXXXXXXXXXXXXXXXXXXXXXWAQGPPSIWLGPLIHPSRTPALCTAGTFPKSVCTSVNECICHGIPDSRPLQEGDILNIDVTVYLDVRMAGRAWECTRWCLNCGSALPSQQASWPAPRAHSCGCGVMLSAEHRPQSPPRPRPHPRRSTPFHIHDAQPLSTSLLTSQGYHGDTSAMFTVGEVAPEARALCEATHEALHAAIALCGPGVPFKALGGAIQAVADAHGFGVVRGFCGHGVGKGEAVLWSCTGKGPCWGGACPPQGTTEHPSTTLYHNPNHRRNREGGRMVPGMTFTIEPMLTQGSAKERYWKDGWTAVTTDGGLSAQYEHSLHITHEGVEILTQL

SEQ ID NO: 16218 - protein, 757 aa, Chlorella protothecoides
  MOD_RES (7)..(9): Any amino acid
  MOD_RES (254)..(257): Any amino acid
  MOD_RES (414)..(417): Any amino acid
  MOD_RES (728)..(731): Any amino acid
MMQRTTXXXGLIPWSCASPQLLNANDAANDPSQPQTSSWLSLRNLQEVCRKWSRVSVLLQGPLARDQHYRRSWQLGFQIPALLQTHFGNGLGQGRHGGDDVCRDRRKHARPGNTVRGGCGAGQVVSVVEQRVGHVLVRLVVLAVSILRPPSARARGRGVVQVREGRHWPSHTSEHPYLLSDSSFASFLLCRRLLALHGVGTHSVTRVPLWGSSRSPFTVGRRVNWGCELTWKPAARPEAIRPPLSRQITSSLPXXXXAIHGGQTCQWGVRDWLSQSPCHIPPAASMHSPSLYDALGVPATASLSEIRAAYKALAFKCHPDINPSAGKAGHREFVAATEAFQILRDGAKRAEYDRVLAFQRATEALQAGKPWHASHGAGPTPWGWEGPPRPAGRAAQREPLDDVFEDILRRMGQXXXXAGRGRPGLRDGPLSANLWTTCLRKSCAGWGNPGAQSVVLMHLRVGRRGAVRNLTVQGEAGGAWAAEHHRAMLGAGAQLGAAVIHPPPELHPMQRFCSSIDATDPSVPSPPSPSQVPRQRRGLRAAGPQRRPAGRGGGGGLAGGEGGGGGGEGADCTPARAHGGGEGRAARPHAAHAVADARRRGAPGRGGRGGLPGGERRAGGAVEGVPGRARGAHPLTLREGGDVAPGGALDRWALLGWRGPGVDTPLGPSLYIVYTAVFFTRPSPWHSPMPCIRTTIQSGPRPMGERRREQSRGHGAVTKARSAPASGXXXXASAPPFSQALIRLESAVANRVAAMGQ

SEQ ID NO: 16219 - protein, 150 aa, Chlorella protothecoides
MPPPVAGDLAQRFGLASDLLLTQLRPHLGRDVRARLEGGYLYTQALTVRLKVRGCVTGVRSCEALAGTTIACGEGVLAAPELPGVAQVAWKQAQLRGALRGSTVPIGVPALLSSLDLGGTPFLQSLVPGLVEQLVAEGGCDGGQCWRGAG

SEQ ID NO: 16220 - protein, 88 aa, Chlorella protothecoides
MTGSIPAHSQVDLPAALGVDLLHCQEAARQAAACAGAQDILLAQDELFAREYFDDLAAEVDEVLEEQGMAPVGASSGLPKGEGRVKLG

SEQ ID NO: 16221 - protein, 154 aa, Chlorella protothecoides
MGRLEGRCDSGSSLPEHVAHSTAGRRRHRHPERQGVDAFTDTAFKGNSAAVVLLPEQDVPSDAALQSIAMENNLSETAYIRPIPPSSDVTTGDNFDLRWFTPTTEVKLCGHATLASAAALWKCELQLRPSGPWETWLIFDGTEECSVVCACAAA

SEQ ID NO: 16222 - protein, 164 aa, Chlorella protothecoides
MDFPLNRAVADVPLGTAAGSRLVRAVAGTIPVREVLHNPDINNLLIVLEGGREELLSIRPRPGELLDAHPEKLLVIVTAKGEGEHDFFYRFFAPWAGIDEDPVTGSACTVAAPYWAARLGKTELRARQLSQRTGELYVDVREDAGRVIVAGDAVVVISGQLHLQ

SEQ ID NO: 16223 - protein, 427 aa, Chlorella protothecoides
  MOD_RES (12)..(15): Any amino acid
MSTDWVHELTVXXXXSPVLGRGGTPPRGTMSTDWVHELTVAKLKDELKKRDLHVTGKKAELIERLEEFLKEAEGADAASDGKSADEGAEPQDEDMKDAAADEASQDDNADRKDGGSESRFTSSDDEAVPVESSGHGSPAKGDGSMHSEDRSGAAVAGQDGGAGAEEAVAADEESGPVANRDGAEAPAAPGSGERESKEDPVPEAASPAGKPEAPTAASLVEEVVDLDYGEEEAEAAAAAAAATSVRTKGAAAAGASPGTVPTSGKRPRGDDDAPAAAAAPLQKAPRAERPAAEGVVTASTTRALRIDGFVRPFTERAVRELLDPTGAELKALWMPSIKTHCYSVFASKAAAAAALAATAGLTWPATSPKTLAPRHVGLREAERAIGQGAGNPDFRVERLPEDGEEEAEEAEAEAEAAASPAAAAAGA

SEQ ID NO: 16224 - protein, 745 aa, Chlorella protothecoides
  MOD_RES (135)..(138): Any amino acid
  MOD_RES (169)..(171): Any amino acid
  MOD_RES (239)..(242): Any amino acid
MGIPAALGSMIQSLSTYQLAWGMIAMAGLAAALLLGGIVAPYGRYSSSAWGPLIPPRLAWLVASDQPYVPHADAGDLEPGHPGGLAGGICHPGAAGEGIRPRERGPHGHVPRALHTQGPHLSLPHCAGHDDEDEXXXXWGPIGSPCEVLILYPVASLAPAGPHSPPTRXXXACRHTPTPGPHLQAKAPHWLSGPWPQASDHTLLPRATPILHPDPLPPRGGSDGARHQPHLPAGRRALXXXXAMGRAIGPTFLLGAALWALGWGINLHSDTVLIRQRGGRRKGYSIPQGGLFALVSAANYFGEVVEWLGWALACRSLPATAFALFTTANLVPRCGGARNGRGKGEWQSSTSGMHRTGGGGVGGQRILCLSGAVLYGPHHELLNCPRSPSTRSTPSPSAQGTASPRLVPQDLQDVPKAAARHHPLPVVMSCLVGPGRSTFVDMCMSGTPQGVRRAFQAQQGLRFLLSLAHHAHTRLLLQGPTLRCAVWVRTTVLRRGTWVGRVAGLASGGRQAAMQWAQRRGEQHGLMTGERRETKNDHATDGGVVEPAGHRGRREVGQRRAAGARDRRWWGGGTGADAGRPGADAREAGAARRTAQRHQLSLRSALPLGLQRPPARSGLCAPRSSRPSPSSPAPTPSFQPPGTNMAVLRPDIRRGGVMPRAEAAAAHRSASQSSPRGKGPCGPGDSASAMPGYSGTWAGSPPPAGPASGWQARPSSTDGTEPSRLRGVPGVSAPPARCAAAISSP

SEQ ID NO: 16225 - protein, 185 aa, Chlorella protothecoides
MQIFVNTDRTHVLELGSGATVADVKAAIEARQGTLRAARLGLLFASSFKEMSTVCENVRPSSLTGVCAAEQRVLFGGHQLEDGTVLSEAGVSDDSQMYVSLRLLGGAKKRKKKTYTKPKKQKHKHKKIKLRVLKFYKVSDSGKVERLRKVCPTCGPGIFMATHFNRVYCGKCHLTYVYNKDEETA

SEQ ID NO: 16226 - protein, 54 aa, Chlorella protothecoides
MQALSGMIGRKASISGGTPKAKALCWANTNTERRKRGEQMGLDTPVVLAVNNGN

SEQ ID NO: 16227 - protein, 334 aa, Chlorella protothecoides
MDEFKQGVVGAKSNNLAGLRGRLPESIQLPASVTALESRENRELAKQIRAAVSSVAPHSPGPALARCRDLVNQVAVPSALRKELEAGMRAAGIPVPQDEERWQAALCALKVEYWLDGGECGPGERRSHPSQTHRLLPNWQTQQAVWASKYNDRAFYSCRKVGLRFDDVRMAVLCQRVVPVRYAFVIHTANPVSGDADEIYAELVIGLGEAIVSGAVPGSALAFSARKDALDAPRVLLYPSKSRALVVDDSLILRSDSNGEDLEGYAGAGLYESVTVDATRSVVADYSADDLLMDPGFRRRLMTDVCRVGLEIEQVMECGGVEGRREGIGVVCVR

SEQ ID NO: 16228 - protein, 170 aa, Chlorella protothecoides
ATAVLDRARRAVAALSDRVPGLRAAAELGAWQLVSPGAARGELVAVPSLREVQDRAFPRPTVLLAWEVTGEEEVPAGVVALLSPDAPDVLSHLAVRARNLAVLFAACHDAAPLRELEALEGRVLELDSTAAGAVTWQEADEEEVEGGGGRATPAGVAAGTKKLTRPTTPK

SEQ ID NO: 16229 - protein, 403 aa, Chlorella protothecoides
  MOD_RES (258)..(261): Any amino acid
MDALDERGAFPLVNSPSLTLDHAIRCAIHWSCRPAPRHHRTTSPLQATEQTVIIISSKKDHQSHANATAEETGAQGNATAADASKAGAGVSADEAARLAAAAKAREAAAAAATGGEGDVDRIIDSKDNEYVLSKAGEEGGMGITLDPRLVKDLTVLIAACAMMGMAMEAVGQPTINGYFIAGSVGGGRGRCSGEEAGARAAWDMHDPVSWRRGRRPSAASCAAFILPSAPNCGLFPPPPATAQSHPAPPPATACSRPXXXXVGVPALPPVRRPVPGPAGGPAPALQPGPGVLAGQAARCARRGAAGRRAAGGPPLRPVGRRGCRHRHLPLPGRLCRRAGGHEQHQHRGQVPIGPALPAQRQRADRGGHPGHPGLHGRPALCAHAAPGPGRARGGRRRGRRGAR

SEQ ID NO: 16230 - protein, 223 aa, Chlorella protothecoides
  MOD_RES (60)..(63): Any amino acid
  MOD_RES (90)..(92): Any amino acid
MDCWRSRGEGRATVVPEWTREPPGIAGRMAPCAETVGRRYSIHFIQTYKRNAGGSGERRXXXXHGSLRGGGGDSFRDLPSLLRVASFSSXXXHSETCPLYFEQSVSLHPAFSFFDTGPLRLSIPSAPVLHAGLQQDPPEGVNASPRSDNIMNWRAVIFGPEGTVWDGGEGQTWRVGAASRPLPGGASILASTVSSQDYPNKAPIVKFKTPMYHPNSEWHRGKQ

SEQ ID NO: 16231 - protein, 294 aa, Chlorella protothecoides
  MOD_RES (291)..(294): Any amino acid
MDPDSRRAFKPLHHINPAASTPSQRSHAQSHAHTQLQLGISYDVFVRTTQPAHAEVVAQVLERVWDKDVYKAAYSGWYCVGCEEYKDELELGPSEAGGLLVGVATRAQAGQGVTKAESGSLCMFEMFQCRASTHSCIPKEQAAHALPKSSLFESRRSHLHDPPDTVPAQGGGQLLLCTDFLETHPDFVQPASARNEVLAWVKSGLRDFSISRSAVSWGIPVPLDPSHTVYVWFDALVGYLTALLQTPPGGVSLGATGGAPPDTARPKGETPGSPRLDDLPRHGWPAAAHIXXXX

SEQ ID NO: 16232 - protein, 636 aa, Chlorella protothecoides
MAQHPVRRRSPHPSRTPPPLAPSKGHLDLLTDEAFLEAIQSFFASIPTADVWQDQAWQEQQRRLLAAQFGPREVESLAVNAVVPALEEENGADAALDWVIAKETQDLAVLHGQSDLSSWYFVEHGERALSLPNPHIIHTESSSTPLQPPPRAAAEIGGVLINVTVSLTSRLLTGERALATRSVQSADAFHRSLSASGFQLVNVGNVPIGLGRWVVGSDPSLRGGRFSNGFLSQRALQSNLLRHYRREALKEAHKVLSGAGPAIASVPLTVIWASGSAFSLLRAISRGATGPGAAAQQFVYVPLMGISMIVSGFSRMLAAVLAALPPARADGDAATVQRIIQRPGSSLEALFRVGQELGLGVAAGLSGIILDPVAGWRAGGWAGLSLGLAKGLVLGLLGRPLVGVLEAGSQLSGAFARAALGREGILGKLQRRVRAPGAHGDDPGDSLDERTGGEARVALRALVDAWQRVLPQFFPVLARDRVLDVVNLRPSRVLLVTDRHLAYLRARHLRAHSVYRAKWLVPLSEVQNLTGSAESMKLALTHVHRYDLWLLGVWPVAARKKMRCGSRSVYEHTVAKLSRLLQAAKAGGGRLGWGDREDALRGGAAQLTILSAPYHPPEAGAVAAGAQRPAPPADAK

SEQ ID NO: 16233 - protein, 165 aa, Chlorella protothecoides
MGKSLGNVLDPRALVDAYGADAVRFFFMREIAFGADGDFSEARFQATVNAGLANDLGNLLKRTLGMLHANVGDRLPCGAGEAGAGVRDATRLPGVAEAAAPRAAAAYAALQPHAACEAALAVSGDANLLLSELQPWTTLKKAGLWLCGLCVRKGGKGAGGGPWWI

SEQ ID NO: 16234 - protein, 135 aa, Chlorella protothecoides
MVEHIFIKGWPVARTGVLLEFPPRHTTRGTEEEKAAAITVLVAVLEAVRIVAVLLSPVTPSLSHAILRQLGQEAAAAGQPAWSDAAWGKLQAGTSLPPPELVFARIAREFVTEPAAGAAAAPTKGAKRKAQKVAS

SEQ ID NO: 16235 - protein, 400 aa, Chlorella protothecoides
  MOD_RES (304)..(307): Any amino acid
MRRQHRPLFPPTPLSKPRHAPIPPAAQVQSKEREATTRLGAALGLEGTYIPHSYIELVQIENLTTSFQTVTEDLKRRFKVSGEPLDGPGLLGSSFSHGSSPLASGSFRRTLGFELSGCGGGSGTTPFSTSGAPRGGVLGRGMQEDWRGPGAMWEVVRPWAGGCAACSARPPSPARPTVPPPRPSRSPRGRQPPAHVARQRGPGAGGVPARGPAESAHGRGWVGARLQARRAGGGGHRLLQQRGREPERGRGRTGRGHRDPGTPGAGRQRAPPGRRRGGGAAARRRGGRRPGDGRAAGGIRPQQXXXXRGAAARRPPGRGQPGRRGRPHPARPGARGRARRTWRRGWLRCWTANCCWAGSWRKSPCSCASCARPAAGGSSGAWRGLGSTALPAPHIPSPRP

SEQ ID NO: 16236 - protein, 203 aa, Chlorella protothecoides
MATTARPFHLVLWGATGFTGRLVAEHLAQSYQGKVKWAIAGRSRDRLESLRLSLSTQYGFDKEDVPILLGDLEDPQSLHAAFSQAKVVISTAGPYLRLGTPVVDAAVHAGTHYVDITGRRWDDADMFWFLAAGNTKLCGWDLELCTPCLSCEHRVVGTPRLSQVSHPLCIQILAGEIPWVTTLVDKYHESAREKGIRLIPCCA

SEQ ID NO: 16237 - protein, 441 aa, Chlorella protothecoides
MVVRAIQLLCSQNRDTILVGLAGPSGSGKTAFSAKIQSFIPDSVVLSMDMYNDGSKVIDGNFDDPRITDFDTLIQNITDLRAGRAAEVPIYDFKESRRVGTRRVEVTSSRVVILEGIYALSQRLRPMLDLRVSITGGVHFDLVKRVLRDINRSGQAAEDIIQQVSETVYPMYKAFIEPDLQAAHLRIHNRFNPFSGFMSPTYILKSASAVTEEQVLAVLAEVSSSPRCHQGWMGGCCGFVCVFGVWVHGECDLRALWRAPDRGHECLGPLPVLQSPLPASPGRPLPTRSTLPHRPAAQGGDGAAAGKQDTTESYDIYLLPPNEDAESCASWLRMRYRDGRYSLMFEEWVVDGSVIISPRVTFEVPVRILGGLMALGYDVGTIMRRTSRTFSNDRGGGRLEGALGAPGGLGHKRYLGLWVGPGLPSLNSETSRQAPRGTLST

SEQ ID NO: 16238 - protein, 919 aa, Chlorella protothecoides
  MOD_RES (99)..(102): Any amino acid
  MOD_RES (120)..(133): Any amino acid
  MOD_RES (352)..(355): Any amino acid
  MOD_RES (843)..(846): Any amino acid
MERAIPPAHPCVGGMDTDPNSVTPTTRFDSRRAPCAPWLVHEPSNVIFVEELNPAPNWGHGSLQGASPAHVGMLNCIMGGIEVAHYRQTRPIYLRDPQXXXXILVEELSTAPNWGHGSLXXXXXXXXXXXXXXDSGPVSARIRMMMVRLVVLGLLALALAPPVYSADFVKVDGLRFTSGNCTDFKPVGWNGVQWNTRASLFFPCAPASRGRWSTLSYAANKKSMPGFNDGRAFLTNMFKEAQALNFNVYRFFIQGDYSFLTTSAGEDAWAVSDPSLAVGGERAVGDGWASWNKGVTLRVLIFQGFDFVLDEAAKYNIKLTPILLNLWIDDGVPLFEKFCGSDSSNYRPTPSXXXXCSWPDPHPSSNTAAPRPPPPQFEKFCGSDSSNYRPTPSIDLRTETTLNASERLQTPYKWYTDPDCRQYVKDFITKVVTRVNTINGIAYKDDPTIFSWNMLNEVRHGEGGNNAQLGRQQGTLPQPASIPGCLGLAPAYRKAYTPNVETCPSLSEGNRGPYPSLASIPGCPGLAPAYRKAYTPNVKTCPSLCIRPTSNPAFFALPPQPRCKYCGPEAVTEWYHDIAAHLKSVDPNHLVTTGEEGAEPACLWLSGKGAVHAPLVDSGLRLPAVMMSPLTGPPPSGCPALPAPRAPAPSVHATNTCAGFFDESSSFVAADPTDGNKWGPRSGQDFVANHDSPNIDYTVIHMWPDNWGVQPNDIAFGKTWIDFHTQASTALGKPLLMEGAAWPWVGPGGYVFAGMHARGWCPQPRQSMTSSAAAEHYVKRWHVRGPQCPITNPLMPTLPSDHPSEFGKGVTDSSQITSFRDPWYSLTYDAATQSIAAGGALRXXXXSEFGKGVTDSSQITSVRDPWYSLTYDAATESIAAGGALRGALFWLWDGSTQNGGDGVVVGTADSTISVRAFGA

SEQ ID NO: 16239 - protein, 355 aa, Chlorella protothecoides
  MOD_RES (128)..(131): Any amino acid
  MOD_RES (271)..(274): Any amino acid
MDPKNIPKASPQSVARQNRIIGLAAVAGATAIYFMIKKSDETNPDVAKEKVESAGSKVKEAAGDAKDAAQEAANDAKAKASNAVDDAKAKASNAVDDAKKNISKKVDEAKQKAGDKVEDAGKSIKKLXXXXQKAGDKVEDVDFCHTWNRVICPLRRSPAWVPAVYTGSLHNTPDASYGTPCQFGAPNPLCPPCYDNCAGNEGGVRACPAGTRTDSWHRGQTPCTNGCHPVPTAVQNHVAGLNDHCFLYSRQLPILQKIVWYHKTLTDQRIXXXXYSRQLPILQRTVWYPKTLPDQRISSQTLTMARAAVLFVTLLSCLAATQGTLTLKQILNDSRFTAYVNQVCAPGERDHSASA

SEQ ID NO: 16240 - protein, 260 aa, Chlorella protothecoides
MAVILHPRRAKTEDRALSKNGSQSRKGKAPSIPAEWKVELPEEGNRGDSIFGGCRSIEAGYQREFVLGQGTYGEVYRAVDRATGDIVAAKKIKMDNEKEGFPITAIRAHNAPYSSHRNQDPVCACPVKGRDQRQDPPKPCHHFAGNRPIRKEVSPCMVTIVASHQCSSLPPCISLAGHKCNNFRGSIYMIFDYMDHDMTGLLARSQREGPPFSVPQIKCYMQQLLLGLALLETNKRRKPRPLSPWHVVVAIWMDLVRGSR

SEQ ID NO: 16241 - protein, 514 aa, Chlorella protothecoides
  MOD_RES (24)..(27): Any amino acid
  MOD_RES (179)..(181): Any amino acid
  MOD_RES (458)..(461): Any amino acid
MTDCVSLQDNCQTSGLIACSHLAXXXXVDKGRVCWVAVRKACSSKMTPCVSPQDNAKLPASLPAPTWLEVFDPPSLPARHLHVRSYQHIDFNNAKYPNNSRLRHHLQNSSIMDAQVRGEHAWLSEWDWYDDVVQTPFCILWMCSSVAAPHLSQLRPRISWSKCSCWILRNASLPRRLPXXXCDEHVRLSEWDWYDNVVQTPSCILWMCSSAAAPHLLQLRPRILWSKCSCWIPRNASLPRRLPRHPLLLELRHDDFFTLCAIHPAFSISPTFAQHPWFYTHPLPMEPHKIPKYQSSHEMSMKRSRQEGGGAGRGRHPPHPGPPSGKQARLSGPGQAPHPGQRAGPQGRGPGGAGPASAGTWQAYPPQQQVPLGGQHPGQPPLRPLVHAASGAPIPYPAAAFVQQGALPGQQPGRGQHPARAPLSVGGVPPPPPAAPMRGPPPGAAPPPPAAWQSQRRXXXXARPTTGGCPPPACRLAVAAPMMAPRAWMRAQFSFLGADMVARGMRHHGAQWSM

SEQ ID NO: 16242 - protein, 226 aa, Chlorella protothecoides
MHPVDKSRLHASHPAKRLPAPACPASSPPHCHPPWTSVCRGQWSLSGAGPVCHCSGGGRRQDRPGGGEAGARLLRGSAGPPRRGLGARCHDRWVRCSLHRPFIPLVPSAGWQITCRHWPACLPAQPNNSGKCSHQAMHCEGRPHARSAAQGNPPSSAAVKPPTLPCSAGDDVRDDVQGAQAAGLAGVLVQTGKYQLGDEGFGAPAASAPDATVPDFAAAVDWLLSQ

SEQ ID NO: 16243 - protein, 179 aa, Chlorella protothecoides
MRFKAALIDLSGTLHIDGQAIPGAVAALERLRAAQLPCRFVTNTTKDTVDRVSAAFHMQPLLDWHLPVHEGPWSPPQVFSSLSATRQLLKQRDLRPLLLLDRRALPEFDDVPQHDPNAVVVGLAREAFNYDSLNRCVAECGCYSLGHEEFGASPGRGDHLIGLGHDLWRLLCTPCWAPF

SEQ ID NO: 16244 - protein, 334 aa, Chlorella protothecoides
MEKPVSLHPDDIRDQKPPHCHAERCSASHATLPLSHWPQVQVLRCIKPPSLDNVVLGQYTAANGEDGYLEDPTVPQGSRTPTFASIVLYIDNDRWAGVPFIIKAGKALDERKAEIRIQLHETPHFIFAGESSSSRNELVVRLQPDEAIYMKFIVKKPGLRRGRAQPGGVGWHETLCVEGKQERRGFMAPRVSTGKLLGTVEGSRPYALRRNPPAPSGNLPPSSTHTGLDTEPVISELDLDYHSRYPDVIIPDAYPKLILDAIRGDQQHFVRRDELRAAWAIFTPLLHAVDAGEVPIHPYPYSSRGPEEADALRSRVGWVKNSKYDWKAKVDVPA

SEQ ID NO: 16245 - protein, 99 aa, Chlorella protothecoides
MAMGLCCTAVSVVREAGLDWVARNAQRPAVVNLSLRSTTGSSALADAATRLVNEFQLPVVVAAGNEGSQACGSSPGNATGVLTVGASTMQNAAWNLTNW

SEQ ID NO: 16246 - protein, 151 aa, Chlorella protothecoides
MLDQEDQESLRSSHGSDIQSMEDNTQLHTAELVSKSSEMTLLSYSPPRLSTRGSLWTQDGPAWPLQRINRRRWSPGMSPPADYAFSALGSGVNAYIVDTGIRLSHREFASFPDGTGASRALPAMSGASVAGPSRLAWVATGLLSGLCPVVG

SEQ ID NO: 16247 - protein, 349 aa, Chlorella protothecoides
MGLIRAYLGISPVACMHLGPYIWHVALKARLPLIISGSRDNALLVAERRKVSQQVSTPSPPVWKSRGRARSDYARSTFCVEEEITLLWALLIVVIVVTYLIQRHKLNWIPPASCAMVIGIFAGILSKVIGEEQACMLQMRSGQAAAILARGVLLRPAPPHRVCSGLHIEEEAVFPQPWADPHVCFPNRARGELHAVDRLTALQSHLDLAAPLFHPNPTVACGTGGGHLHFRPRVWVCNLPAGAPEGGQHHEHGRSAPRGVPDVWQVHWHVASASCTSSAQLSLVLCDDASSLWIIASASARHVHLALSACGPVCLTPARSGTQYPRSVGEGSSETPPRPPTLTHKSRPT

SEQ ID NO: 16248 - protein, 201 aa, Chlorella protothecoides
MIREAEKAGKITPGKTTLVEPTSGNTGIALAFIAAARGYKLILTMPASMSLERRILLRAFGAELKLTDPAKGMKGAVALAEEIAAATPNAFVLQQFENPANPKIHYETTGPEVWRDTAGKIDFFVAGVGTGGTITGTGRYLKEQNPNIKLIAVEPKESPVISGGSPAPHKIQGIGAGFVPKNLDTSILDEIIQVGFMADIR

SEQ ID NO: 16249 - protein, 185 aa, Chlorella protothecoides
MSQQAWPVMDSTPCTVHILVGACKGLGPCTIPPACHQLTSYTSVTCSTLNDPAFKGTAFVPTNAAWSNLLTALGWSQDQLLDAGSRDALNETLQYTIVPGAAQTQRALAGLTYLAPLPTVQGQPLLVSGAGAHGRHRAMALLGPGCDIPAFHECSHTADLPVYAGLQETWMRHYTALADMALVSV

SEQ ID NO: 16250 - protein, 260 aa, Chlorella protothecoides
MRASAAALRVWTRCPRSLARPVHNIYRHAVRCMVSLAEPPTIFALSTGAGRSAVAVVRLTGSKSGETHCEVGGLCIYSDGQGVCRYCGIIQGHTEGCARMCCSPGPQPPDQLSACPPTPLRTSSSCLAGEALTAMAPALVRLPAPRLLHLVEVVDPASGQLLDKALVTRFSGPRSYTGEDCVEFHLHGGPSVVRSVLAALGSLPGLRPAEPGEFTRRAFEVGKGGWFCGGTIPTGTDCCLVLYMCWAEKGAHSRGEMFWR

SEQ ID NO: 16251 - protein, 422 aa, Chlorella protothecoides
  MOD_RES (161)..(163): Any amino acid
PIPPPHLHLPLQCLCQRPESGEGRPPGTGAHPLPARGCAHESQHASGFVLGHQAGGVRDSAWKGEGVTIIQCTVDATISSAPAHPDSYRPTRSCVPWRQSMALSASCCATSAQPAKVVGGGRGGNAGRVVVVAWLGAIAAVSNVVDTTGHLPHPHRPTCTXXXERWQSGGLLPHPHRPTCISIPRPAAAGEESVMRAACAALRQLCSSDSCKAAFLDQDDVIPRLASALKRCDGYPSPEYAEVCKQALTSCSKGVPLLHAGVDHPYSHALQVLGLMTNLALRNPAASLALVGERGCLDAVLRALTAAAMERTADPRAASAMRQGCMAIRNMAVRLSATECEGQREVRRSLRCDCVCFCLACTHEMPSSKHDRCEEAKTELLALHAQDVLYSIRDSSAPGALQDAASAALRDLGMLDYLPKAR

SEQ ID NO: 16252 - protein, 98 aa, Chlorella protothecoides
MRSTAAAQDVMHLHDGSPPVPITFGCETRETGEIYWQTADGLLGMGRSPASVLNQLVAADQVANTFSLCLGSVRGDGALILGDAGIPAGVDMQVGRRR

SEQ ID NO: 16253 - protein, 353 aa, Chlorella protothecoides
MHCLPKPRCLPPIPSFFPSTRTHTHTPQAQAVIDFGEDEGIADEVAAGVLPDMRALRAELAGFLGGGQRGQLVRDGVRVALVGPPNAGKSSLLNALAGRDAAIVSPFPGTTRDVMELELELGGQRAVWAGDDAAAAQAGGLGGDSAPGELETEDPVEAEGVRRARATLATAHIVVQLRDAQAVWAGDDAAATQAGDWGGDSTLGELSEAQLTLSVWNKADLLAEGQGPRGQGLGMPAELAPRDRGPPSTAPLLISCETGEGLDDLTRLLGRAVEDILAQGGDPEAAALVTRARHAAALSRCVAALERYEGVWAALELAAEELRGATRGLGAISGVVDTEEVLDSVFSEFCIGK

SEQ ID NO: 16254 - protein, 228 aa, Chlorella protothecoides
  MOD_RES (150)..(153): Any amino acid
MAASNVPKGFQVDVQSGGFAVVTVRSEPVNTLSLDLWRGLTSILDACEQDPAVRGIIFRSGLKKDIFSAGNDIRELYAPLTSAQRYREFWVTSNKFLARLYSTRLATVAAIRGACPAGGCAISLACDYRVMTEHGHIGCTHVSLPAGLNXXXXQHSLWQRPSVCAHVSQATGLNEVALGISVPKFWAGLMGRVIGARTAERLCLVRARVHRREFDMGSEARTGFGRIA

SEQ ID NO: 16255 - protein, 294 aa, Chlorella protothecoides
  MOD_RES (193)..(196): Any amino acid
MCDSQAEAVCAGAPAPPLAKPRVIPARDPPTLQLARWYAATIPTSHGGILTRALAGPCPLTALHHVKRIRRHPQDAAALQILVCPVPDGEDLPEGVSAIVQEHSLSLSEVGVPELAPATRADWAGWGAHWPLTWRAPDPQLQPEHVALDPAEETAMRQHLAAVVVRADACGANVCAVVDPSTGMFVGRCIPGXXXXRQCLRRGRPLHRRVCGSVHSRGRSCISPRHRLALRHSSWSEYTKSATSRNVWTADPVDASYPITRQADKWRPWQRGRGPACSGRRAAQHRMGAPSARV

SEQ ID NO: 16256 - protein, 246 aa, Chlorella protothecoides
MSRRPYLAGMSWHSSLHELASVAGPIDFALPRSIPPVMETAQLPLPHPSECGSDEWARQMRLRFSPVGMCSETGDIVQDFFRPSGLALCGEEGSRWGAAQQAALYMASSEMEGTYAGHSICQMDWLLRRGTMASCVRLTPHDGVAVEARDNGIMCTPHSSWYISEAHSMIPCLAPALEQGLEKYGVGKWRDMATEHPALEAFDDAAIRTKAARLLGTQSLARHAGWKGASFLGGSNPECRGTAGMP

SEQ ID NO: 16257 - protein, 363 aa, Chlorella protothecoides
  MOD_RES (176)..(178): Any amino acid
  MOD_RES (283)..(286): Any amino acid
MKVWPRSLVPVVLEGAASQANNASVCSSSCPALPPAHSPLLSPNNLKQGIDREYAELDTVWFMAGSLFNQYPYDIPTEQFTPEVFRQAFAAVQSCVVHLQGVAWGFCQGWWKGRSGACRPGNACSLSVCNPRHRPLSHPRPSWLLPPASITHPSHPRPRARECRCLSDLRWCPWAXXXLAPPSRINHTPLSSPPPRQGVPLSQRFALVPLGPPLLTYSSTASAMLRYDPTSREVQLAADRAYRPGEPVLAWCGPQPNSRLLLNYGIVDEANPYDRLPLEGGCXXXXASWTRPTPTIAYPLKVGGCQGGQGRGVGWKGGGCGFEGDAVPGRAVSIEASESNEEISAWVLVRKWMAVPGLNNRAL

SEQ ID NO: 16258 - protein, 142 aa, Chlorella protothecoides
AALRATAPAAALDAALDPSAADGDADDEEPPEGAVRFRLSGEEIAAALAEAGGADVAPLPEVDVPEHLVPEDVLAALLEERQPAWVEVPGAGSARPAPHPASGVVQRRLSNGVALNYRVTPNEPRAAALRVTAAGGRARERG

SEQ ID NO: 16259 - protein, 233 aa, Chlorella protothecoides
  MOD_RES (202)..(205): Any amino acid
MRVWGRARGEQGRAPGRRGGMLAGGREAVAGRWWATAPQPRSHPLLISPPTPHTDLQVVGPDCLQAKNLHQGSTDHGEDGDAEADAHAREAGDGAADAPEVGFDAQVKDGDPDEDGGGVQHVDHGGGDDPGAQVAVHGGALQDEERGHLGVDGKVDGEDRHGGQQAHHALQLLHLGDGHQPAVVQAGGVDRCGRLVQPAELXXXXARRRPRPAWPPCPASGTQGCGSSWSGRG

SEQ ID NO: 16260 - protein, 433 aa, Chlorella protothecoides
  MOD_RES (6)..(32): Any amino acid
  MOD_RES (84)..(87): Any amino acid
  MOD_RES (139)..(142): Any amino acid
MGWRAXXXXXXXXXXXXXXXXXXXXXXXXXXXRGPTGLVCQAHSRVEGIVPWPRAMFIGRTTQATPFPHRPRSPVHLSPATQSXXXXRGPTGLGCRAHTRVEGIVPGPRAMFIGRTTQATPFPHPPRSAVHLSPATQSXXXXGLVGLDGLGTRWVGGVGGEMGWRAWGEQSGAAPGQDLAMAGREPQHCPPARPHPTHEPSVLWYRGPPVGKRAGNDAEPARQGAAAWRLAAVPFGAGEEDGDGNGKGDGGDQEANHPAAWRSGGGLGLLWRIKGSRAGTPFSQKDRPGCSPPDVRLDPDDERAGQEGADVDECIEPVVEAWDHGQLRRVILVKLVSAKGGHAGLDAAGADCHQVLQADEGREWEQGEGARPHQYPSRALSGLPGPISPREGGKGGWFSSIMPAPDLAASAHNSRVPGPATRRSPHARLCSSP

SEQ ID NO: 16261 - protein, 287 aa, Chlorella protothecoides
MPGVDENDIHKILNKVSSGSANLDADKRQPPPHQKLSTGSTPVEDASPSTTTESPVSMGRAFLRAVPILGELWVGSSKHSRGRSAVYRCKNMLSLRLSFRGMPIVERPLGAGTPISAPKGHTAPAPQMHRRTDQHRGLPDVYRCNNMLSLRLSFRGIPIVERPLGSDTPINAPKGHTAPAPQMHHRTDQHRGLPDVVWPTPPPTHSQVNAWSGTCYLTPLLGAWVADTFLGRFWAIFSGSIIYMLVRLMVLQAFTWRPDLPLLDVQGKWAGAWCGCQGKKQASALSL

SEQ ID NO: 16262 - protein, 752 aa, Chlorella protothecoides
  MOD_RES (367)..(370): Any amino acid
AAAAAAAAAPAPERGGCHLALHHLGKGGGLRDKGAVLGGTHIPVLRLGQRLLEGLDQGGGDVKHRPLPVAGQGHALHLLHRGLGQGLAQHAKHLPRLVHGEGGRQAQRGVVLVRCDERARAQRGVARDARQRGGQRGLRALRRRQQRACRGPEGVHHARVHLGQRVHGALARHARHVGGLGRTDALKLHARAALDDGDEPFLAPVHQRDAGAGGVGAPRAPAAVDVRLRLLGRLRLDHQLHALDVQTARRDVGGHQHRKLAGAEAGQRHLALALRDVAMQRARAHRLRQLRRQLVRVALGLGEDDGAPQRAVALDQVLGHLRALAPVAGQQQVTHRGASLLRDSWVREGGLGVMTGAGCGMRALPSXXXXQVTHRGASLSRDSWVREGGLGVMTGKGCGMRALPSVRIHRPHSPSRPYLHLLGADQVHGGVVGLQEAGGDLLDPGRQRGGEEQGLDVGGVHARVQDALHVVHEAHVEHLVALVQHAEGEVGAGQAAALDVVLDAAGGADDHVHAAAQRALLRAHGRAAVQADAGQAGGAAVRLEVCAHLLGQLAGGGQHDDGGRATVRAARALAQPLHDGQHEGKGLAAAGARAAHQVPPLQQGVQAGRLDVKQGLDALAAQHGLQGGGQREVIQGVGVGGGGLSRRRGGRVGPGTGASEGERHCNACPTEPPQRHAPHRAPSTGSATFRFFELFSFFSTPLDASAFFVFFTFATTGLASRVEAMVGRAAEGGEERREAGPISGTKMRLYIV

SEQ ID NO: 16263 - protein, 384 aa, Chlorella protothecoides
MAILAVYFAIYAQMSTLFVLQGSAMDRHLGSWVVPATMVNVLDSTSVLIWVPIFDLGIEPYFRRIGRPISRLTRMGVGFGIAILSMVCAALVEIFRLKAVRANNLQGRSPTTCQPQPPDHLPACHHDGPGPSPAPLSPCPTPSCPPSPRQNVDPTDNSVPVSVWWQIPQYFLVGMSEVFASVGSLEFFYSQSPEAMRSIASALSLVAAAAGSYLAVSLVAAITSVLVAGAAGSYLAVGLVAAVTSVSTRGGAAGWVADNLNQGHIDDFFWLLAVLMGVALLAYIPICYTYRYRQDPAVGFALAAAADRERDLGIAAAGVDDLRSSGASHPLHTQTLTQAKVSSRVVVDRALKRSSFVPPVHAFEIAPVSLGVKGGSLSTKPSEN

SEQ ID NO: 16264 - protein, 240 aa, Chlorella protothecoides
MEFQYCLAMTPPQGLTGVTISAGLPSLRPAPGEQPTAHQLSFFWGFMVSCKAWHEGFCGPRDSAVVRRCSQIWSRHDGTEPAPLSPFPGGNGSRQPAKSPGRVLVGSCSLPLFPLPSLVCLQYLVAIGTGGIKPCVSTFGADQFDEDDPAELAMIPRFYNWFYAFINIGAFLACTLIVWVQTDVRWAAPGAVLLGEGGSCSAPFDSPEQSAWCPSHAGPAHTQAHRPPAPSARASPQSSP

SEQ ID NO: 16265 - protein, 270 aa, Chlorella protothecoides
MRDVEELAELGQVGAGVHQALAEVARVAGGEADARDAGHVVHGAQQVGQRVRAPAGAVRRGPGQIPAVGVHVLSQQRDLAVPGLAQGRHLGADRGGGPALLPPARGGHDAVGAALVAAVDQVDPGGEGGVAARHAHVLRPVQLLGGHHLGAGAHLLQQGGQAVDVVRPHHQVDLGDAAQQRRALLRRDTPRHDDGQVGAQAPLARRVHAQRAVQLVLRLLADGARVVHQHVGRARVGRPRVPCGVQRAGQPLRGVRFGGDPPQCKNARRN

SEQ ID NO: 16266 - protein, 669 aa, Chlorella protothecoides
MASTRDASPVVAKVKKTKKAEASNGVEKKEKSSKKRKVADPVLDAPVASPEIVEKKKKKKEAASPAPSITDSPAPSTAETPAPHPHALDNFALSAPLKSMLRSKGIESLFDIQAACLNPLLEGRDLVGRARTGCGKTLAFVLPIVERLSQRPRGAHGRAPSVIVLAPTRELAKQVGADFETYGRSAGLTCVCLYGGTPMSPQEGALRRGVDVVIGTPGRVKDHIERGSLSCANLAFRVLDECDEMLNMGFVDDVERILNTGVDTTDIQTLLFSATLPPWVKQITTRFLKPNHATVDLVGTEKMKVGAGWGVWAVNADRRQCPHPASLTSHDAQPALPHPRIPRQASTSASTSVRHLLLPCHWSQRAEVTQDLVKCYGALGRTIIFTETKRDADELAAQLSETVGARPLHGDIAQSQREVTLAGFRSGKFAVLVATDVAARGLDIKCVELVVQSEPPKEPETYIHRSGRTGRANSTGTCITLVDRRKEGLIPVIERRAGMKFERIGAPQPADMARVAGERAVDALAEVDAGVVDAFRPAARTLLAASESAEAALAAALARITGYTALRPRSLITAHEDYTTLRLAAAFPVDKPGQVFGVLRKALPEASVEEVKSMTLTSDGKGAVFDVPAALVQAFKQALPEPEDGDVGAAKNGAFVSQPSTLPEVVERE

SEQ ID NO: 16267 - protein, 551 aa, Chlorella protothecoides
  MOD_RES (266)..(269): Any amino acid
  MOD_RES (540)..(543): Any amino acid
MWAACVVRDLHRPACLFRAALGSQKYVKICWIRRHWNVPASSACDASGRGRLSPWRHKPSCTLPHSLASEPPHCHATGPFFTWPAVFLKGSTGAAAFALINSVGSMGGFAGPYLIGTLSQRLEGEPQPHSRRARGRGGRSHPATPADTLLGCRREPRPAARQLQQRAAVSRLTGSSCWTTTSVAESRPCSTANKTCCRDTHLPRVLPHTPDPFAPLADFVVAQFGGGGITTGVDKGSDTDCWYLCIEWAKGGWSHRGPPRGSLRVXXXXPASYHTLPTLLPRWQTGLLHSQGEEALQGAWTRDTTRVAGICVLNGPRVAGPSAGLLAGHSAFGVVSRAQKPLLAVAARRSMAGSAAAAARCAVSPAPWQSLRARSESPYSVLDEGGVGLGRSMRGRPAPGPQEDPRPLLGIFVHPHEARRSPAPRPVRPRARVALSQPPVRSSPSPERGVPHLHRTVFPAPLRSRQRVCGGRARTTAATRRAVSWTSGSTPPAAAAAQAVAQPSLSEKSRARASRPCRSATSLSEAKTKCWGGGPRALGXXXXAPAARPRR

SEQ ID NO: 16268 - protein, 283 aa, Chlorella protothecoides
MAAGMFQRGAPGCGSCAMHQPGSRGHRHLPRVLHPLGVGGAAGAAGGDHVAHGAGGCLAHPDRRGQGHQHRRVQRGQRRLGEAAGRAARRRAAQRPLPLLEVDGGERGGGGGGGHLQPHGATLTPGAEGQPGQPGAGGAAMEGLPAQEEEPGLPHAAGPVGGGVEGGRSAQILAPCPIPLLAAHASCRILCRRRRTAGDADAASSSEGACRASAPDIVAEGSRFLLVPCTTSHLQRATLFGVQVETCGMCCPAVPFSPLLFPVDVFSPESHEKIICTSSPQET

SEQ ID NO: 16269 - protein, 107 aa, Chlorella protothecoides
MFVIMCAGPCHPFPPTTHKPYGGAETLMDPEKRAEYDAISGFQLGGTNPFRDVHAERDQVFVDEFSCIGCRNCNNVCPRTFEMEDEYGRARVVDQGLDTGEQIALLI

SEQ ID NO: 16270 - protein, 134 aa, Chlorella protothecoides
MAPLSGVPCQRHQPSRGVHGVDSSCAAPLQLHQIAHRGVPGCSQHRSGARGPKLHPVSHWRTHAVRMADSDTETQDDYYSVLGISSAASVKDIKRAFRVIVKDHHPDISMDEEATDFQIFLNDVYGGRGCSGAG

SEQ ID NO: 16271 - protein, 166 aa, Chlorella protothecoides
MCNQCTSSQVFISEGARIPLRPARKKLWAVNVPAAGGTLLRHQAGATHILLGDEPFNRICKKLESQAGVAPALVHYNWLSQTLRLGGRQNEDDYAPPALLAHRESAGSTPVPSLSVHEVPRGTTLPDVQSLILHLCLGSPAPKNFAIVVRRGMGLVVAFEERCIGG

SEQ ID NO: 16272 - protein, 207 aa, Chlorella protothecoides
MPGPGPLSAEQSDDGLSEAGTDWSDGVATAHKARLAALPSGFAALLRQREVWAICVAQFAGALRGGKGGSRDGDERQELRIAIVSDLVGTAGRGAPCAARQARLLPSAPRLHSFWPRLPAALCVPCGGASTSSFNPPPYPHTHNNYRFLGRVWPAELAALLLPRRLRRGAGAPGPLRGAALRGAGLRRPGRRRGGRPPAGARLGHGQ

SEQ ID NO: 16273 - protein, 358 aa, Chlorella protothecoides
MGWREGTGLGRNRKEGAEPAQPKDLKRRPARLGLGASAAPVPTHKRHIKPGETRAAAAEGPVDNKGAAHIPLAERNPAELGAGEVRGRGGKGGAQRMRRGPPAALWRVAPKALELSVRHGCLVQALASACTPPDHQPCQHTGCVGGRWDPLWSGLHLCRAGGQARGALRAMHPNLAPRPMRRASQGAPAAQQRGGGGAGLRPQPGGPLQAAQQGQVRWPWPGGGGGEEPAGARWTAARRWLTEKAIRQQGRGGPGRRLIPMAPAKHTRWRVLDSPAFVQGQVMCVPGSSMPPRTQILAGRCRRVKVVDKRAEGGRVYLKKGTVVDVAMPRVCDVHLDDLARTVQVGGGGGGRRTLAVA

SEQ ID NO: 16274 - protein, 270 aa, Chlorella protothecoides
MSGGGLSLAFTGPARKARRLEVHETIEAVVREEITGVGAGGVQTAGTGNPLADLKVIEAQPNSFKYAGLVDFQGPPSSPLCFRIASGKFVPSYIPEAADRADQEGGIDKFEAAAQDAVDAQGDVTYGLIRRDRTDEASTSRRAQGAGSGAVLGPGDQETLALRRDLTALPEVASLDAYEAMPVEMFGEALLRCGGWGGGPGGCQWAWVWTSGHAFSNQNSGELVTAVAWICARALPYVAGCSLGSPQYGHSLCKYVLLSPGCRLPCLSSR

SEQ ID NO: 16275 - protein, 279 aa, Chlorella protothecoides
MRRRHSTEPCTLPPLPSHPGQAPLPPLPFIPDTAPLPSRSHPPAPPGASDAGAPLAPGLSGGNQSIGQRSATESEALVLARATGLVSECRAELRELRARAKAARSNRERCMAALAAGSEAVGALEEVCSDAGALDSRGERALCALAGRVQGLMDQAEALVDVYGRQGGLGKFASRMFNPGVGAKFEAITAELQAHAKQVRLLAEGDAYSRGRGSSGTASGSLSARGAARGGPQACRAGSEASAMGISRLGRTSGSLPSQHSVVGVGTAGAAAVAAASAA

SEQ ID NO: 16276 - protein, 673 aa, Chlorella protothecoides
MPSIGCRAASRTCPQDLSPVQPHPHPRPPILPQQVDALRELVPEEAVPFVGEALRTLRAEVGSASAVLGFVGAPFTLATYIVEGRGCVVAGGGGMGVDGSTHGLRWDAKPELHPTPSPSPLKTGGMSKNYTHIKKLMFSEPAVLHGLLQRLADAVVSAASWFCLASNTGHPQSQRTLAGALQMRRPARKSEPKFSPATFHLTLHHQSTPFQADNGAQTVQIFDSWAANLSPRDFDVFAGPYLHYIIKKAKEASSRVVVVEFMAPQTGGGRTPCQLCGVLQPSCIRLPHQTDSVSLEQFPGTFRSNFPHSTSWPHPQPPPWSSPANQTFTGPPGPAHHPLHLRQRRAGGAHGRLRPRHPFSLPLGGSGGGRAPRGHQLRIPGQHRLRRAVWQPRGHHQSRTRDGAAGTARRGPPHPEPGAWHHAARMGKVHSESDGCPDVKVVEYQSISTLVNRPLLCRARQRMLWRTCSMRPRTCNFDLIGRLPVQPGGPDRFLADKLRPRQGLPLPSLAWQRGARHPCPCLGLLPSPAAEAVGEEKAEGIGECWWLNKDAGDLAPHEAHPNGNQVAPALGSHGREMALILGVDGFGELLVIAVTPLGRGAFGSDCQFACEKGPGMVNAVCVCHSSGEGGYTTTPSESQAQRPQIHLASSSSGTSHAYWQQKTASPARTCPVS

SEQ ID NO: 16277 - protein, 338 aa, Chlorella protothecoides
MQRGRLLWNTRSDSSRYPGKEYLGRCLSQLSSRMRLPTWHMIQKDKCIVHAFRPPREEFAAHPTNCWLIKVYLNPVSTRSSKVTAYLGEAPSLLPRHGEPCVRVLRAGVAPQGEFGCIGEYCYMQHPQLSSGCAVSLHSTVIVEGNVRLLGLRVPSRPRPPSDRRWAPGIEPRSAMSIFLSHSKADVSPPACDVDHAPVRPLDPPPSPFPSQAHGEDPLLLRALRGESVSRPPVWLMRQAGRYMKVYQDLCKQHTTFRERSENADLAVEISLQPWRAFQPDGVILFSDILTPISGMGIPFDITAGKGPIIPDPIRTQQVGRPWHNGGEGGLLYPGRPL

SEQ ID NO: 16278 - protein, 717 aa, Chlorella protothecoides
MNPRQQLLCSSPVAPGHDDDAPPRQRHARQLPHKGLLLGHVLPALQRPHQVKGAIREGLAQGVRHLEFGAVPQARLARHHIGPVSLDGTERDASRLRPGVPVQDVAGAAAQAAPYIHHLPGVAEGGQAPGGCMHYNSNPRTHRQGGPAGSLYCQSTTSATATAPPEHLLDTLHACPVQDVVHHVDLSLGVGLGPLLGAIVAVVEVLAPHGLPQAGGLVIELGDAVLEGQRLRAETGMPPLDSAHRSAKDAADANVSCLPIATQRHTFPPLVIGFSTVSSSPAAGRRGLHRPTRRTEGANGLADGAYSDAWHATSACCMVAGWWEVGPLSKQSTVDHMPGFALRAPPCAAYVVWYRFVVKNSQSPSRERADSHHRGTCPSGPTPPDPAPPPPLAETHSKVGQSLREVITGIWTGGACDCAVGRHLFIMIRDVPASRRPPESTSRSTDTVPFTAVGPSMAPASTSPTRMNASPTKEAPGRSAAKTPLASVGRVVVLGAGGGVGSAVVTQLAEQGVPVTAVVRDVSRAKDKLPSREGVQVSLGDVTDSASLTSLLQNWRAVCPRALLACTTVRSFHDSSAWQGAGAVIVATGPSSLKNPFGPYNVDYNGNVNVAKAAANAGLKKIVMVSSIGAEDWFFFLNRAWDVMCSSPGSGRGVGRGMVGCSGAPSWSPTCSYMPGEKAIQSSGVDYTIIRPGMSGGFISEQLCKNVHGTGACHSGG

SEQ ID NO: 16279 - protein, 227 aa, Chlorella protothecoides
MALHSPTCPPRLPAPAPPRTLPPLLDHLSRNLAPGETALTPEEQTLLDRLCEAYYLPAWCSLADYERLFAAHGIRGGWCCETGLHEGGAAATTREGSEPCRAWRQDLFCPPLVAHPTHPRADVKTADWSVEVQPFWGQVIKSALTTQGVTGLLKAGWTTIKVRDWSRGLRLAVAGAAGHIVHHNTRRTPLMSPLAHDQGALVMPLMARGLSMGLIKFVLITGVKAET

SEQ ID NO: 16280 - protein, 162 aa, Chlorella protothecoides
MTLGFLRSPPRLDAAVGLAGAATTPLPDLEDRGGRPASNHGSVQLWDGTGMSTFSAARGDWEGSGYGSLLYTPQVLPGSVLSSMPWLGQADFKKYMARLPDASLFLTIVRDREEGEAGAGRAVFGAGKVRMLFCIERGRCGMVIVWTKSLACIGPGPLLPLG

SEQ ID NO: 16281 - protein, 270 aa, Chlorella protothecoides
MCRSLAQGCRELGEPVSEVKRNCQVDDCSSYWWVLVWAGFGRAGQHLPGASAPFVAARWEASQAVVDKACVHATRRRLPRSPPDSPLLPAVHPSTRLGARVADGGRGRGRTHPHRCRRVACPGARPGTEGVWRLHPLMCMVCGEDATSPGDHRLSIRQAGRTSGGTRLPKCRHANLAGAWAERIVTETQGSAGRPARVVGVSLRGGSPGTSGHGLRIAVAARLVVAAGGSLHTPALLLRSGIQGRGNVGEPGARWALGAEVTGSEGLLWR

SEQ ID NO: 16282 - protein, 205 aa, Chlorella protothecoides
MQAPATGGRAAGNGAEANNQWRKGVALRRDWKARYALPLKDGIAKLYDESSGLWESMWGEHLHHGYYGAEEGTKSNAQAQIDMVDNVLDWAGVQSVKKVVDVGCGLGGSSRHILDRYPGSEARGITLSPVQADRANVMTREAGLGDRAEFQVADALSQPFPDGSFDLVWSLESGEHMPEKETFVRELARVALPGGRIIIVTWCHR

SEQ ID NO: 16283 - protein, 179 aa, Chlorella protothecoides
MASGSAFAARVAAAAGADTVMTLDADPRCRFLFVDEGAGSGVSVMNGEVVAGTGGTPSLPARLAPEGPASLLTPADEAALALGNAAPASDSGAAQARHPAFRRWLAEREAGGIATRRTPLFSAHQMGSARMGTDPAVSVVDAEGQSWDVAGLYVMDASTFPTATGGGGEEGSVLGAGME

SEQ ID NO: 16284 - protein, 239 aa, Chlorella protothecoides
  MOD_RES (149)..(151): Any amino acid
MLGSEHNDAFYMAPDGSVRTRTNRSGGVQGGISNGEDVVLRLAFKPTATITARQDTVNRSGEDIQLAARGRHDPCVVPRAVPMVEAMVALVLADALLQHYGQSENFPGVYNLDSPAQPSVSPQRHLRRAGSRPAQTSRRPPAPACACGXXXSGVQARAPHKVLAAHQRQPAHVKEGVAWARGLAFGACPPAQRLLALGAVVRLALPGHGHRRGLQQGRTGGPAEADKAGEAEDAVKIAL

SEQ ID NO: 16285 - protein, 191 aa, Chlorella protothecoides
MQGYTLKRLVKGLASGNAGARQGFALALTLLLKRLPGMTADDAVLLLASYLEAPSASKVSGVDDGRQTCHAVEFIVGQVGGFTSGHASFHLLRQGAETRDYLLGRTFGIGAIVQARVPASTACKAEMIDQLLDAGVLKSFLREAAATVILDLVASETEESVSALLSACAPLSAALSASIDQSTPEVMACGE

SEQ ID NO: 16286 - protein, 322 aa, Chlorella protothecoides
MTHLSGAADGDGNICCASPPTSPSLTLPTLSQAKAAAKPGMEDPTMQTLRAAGARGAALRPLAAARLIALADFLAKRPVAPGSAAPSPPLADLVAWVEGALSSGHARLARVGAGALSSTQPLREALSGRARLASVGAGALSSTRPLREALSRAAASADAGGRGRVAALTHLALLLQLYEWADPSVVDPGVGPDLADVVDRALCQAGAEVDGPRAGVNGDAAPAWHDTLVDVVLSLLARPCSPLPSAPLRNAAESVFRVFATDLTTTGGLGDGAGREGGRVPVVVGHLLCEAAAQARTPLLPRPARPVACAGQLGGRPGGGAG

SEQ ID NO: 16287 - protein, 171 aa, Chlorella protothecoides
MACAQGITAQLAAPSPHQQLPPSQAGAASPSGQGNDSDDGLGATDAEMFRMDAKLAAYFATIKNGKGGNAKAAAEQLDQFKLRVVTLLEYFLKRAPRDVAPVSPHPDLGSPPGTPAQSPASPLVPTAAVPMLNALAVAAKPSGSQVLSQRLAGLINSKLVKTKPGAAGKEL

SEQ ID NO: 16288 - protein, 111 aa, Chlorella protothecoides
MHRADNVATVLSPPFLRFLSTNVSQRKAYLHASAHRCELALVAALSGDDADLALAVSLALQRAGGSLWDRVRAGAKSAGAAAPGGKANAITGVQVGRVWGGRFGVRGLSAG

SEQ ID NO: 16289 - protein, 92 aa, Chlorella protothecoides
MDSHLYSDYLVPSNYDSLLGKLVVWGEDRTAAINRMKRALTEMVIAGVPTTAPYHLLILDNEYFKAGDVDTGFIAKHGDELVLPAEPARKVR

SEQ ID NO: 16290 - protein, 419 aa, Chlorella protothecoides
MGTSPLSSTSASLSTCLPDLVHSPGAEELLHLLLHRLCHRASAECSPGQAPTPHQSIEYNSLIQSRSGAGDRGGPSAPDPCLPDVPPVRRDHIRGGKPRDMVSLPRGLDGRRTSSPIPIHRSASPLQESTVVCVDNSEFTRNGDYAPTRFQAQADAVNLLAGAKTQHHPENTVGVMSMAGRSPRVLVTPTTELGKVLNAMMKMDIEGDVHLATAVQIAQLALKHRENKNQRQRIVIFIGSPIQEDKVCCGVLGGGRGQRGRGWHLLQRAGLTAPSLPDTAQLTFRMQTPSQDSMVKIARKLKKNNIAVDIVSFGSEEANVEKLEAFQAAVNSNGNSHLVTVPPGTILSDQLFATPIFMEEGASSDGGGPAPPRSEWSRVGEVVKACVNERWEGMRGLRTPPKASMASACHSALILFTPR

SEQ ID NO: 16291 - protein, 160 aa, Chlorella protothecoides
MRSTAPRRAARRTRSSSCPSTGLSRASAASVAATVRSSSCPSTGLSRASAASVAATSRAGASPAPAPSRSHSPARPCTSPRNLRTSGHWCWSRGNWAATPCFPRPVSARCASDAARKRHAAPRKSQASRQPQTCSGVSSRNLTRMPTSGGGGWEDVGGPY

SEQ ID NO: 16292 - protein, 263 aa, Chlorella protothecoides
  MOD_RES (104)..(130): Any amino acid
RRLRTAGAEFAAWVFRHAALADLAPAADPALAACLALVLDGAGETAGAADAGTRGAALRAVGTLAQRVPACLAGRVDVAAALFEALAREPAGTRALLQETLAGXXXXXXXXXXXXXXXXXXXXXXXXXXXASGRRGAGAGVGRAGGAHPLAAGGGARHRAAVGGQGVPGGGRGGALPGRRRSGGCAGHRGGGRGGLADPRAGDAGGARAAALPGHAGLPAAPPPRPGAGRRCRRRLGPLPQGVSRWGWGPGGPRRMPQWAATE

SEQ ID NO: 16293 - protein, 282 aa, Chlorella protothecoides
  MOD_RES (103)..(105): Any amino acid
MGRLLPPRLAAHLEAHSVLPVLYASSWFLTCFASDFPLPFAARIMDLVVTDCYAAPIMKVHGLCLLVFILGEEGADGPPWERGQRGSELTRSSLETPTHHPPXXXSSVGAWSARVRADLVLLGGVSVTRTPCHTRLHPRAMSPTLTTKAPLQAEATWRPHLLDTLGKPLSRHPPTTLSPTIPTSPGGAGRHARRRAAAAGGGGHRGGGGLPEEGRPALAAGGTAGDADAGPDAALDPPPAGRPGRAQRQRDRGPGSAARGWEGRCRVAARRGGAGWCHALGP

SEQ ID NO: 16294 - protein, 720 aa, Chlorella protothecoides
MHLREPELSPHPGWDAVEDRAPTLEIDELIAAIYILGCVVCPQDVLECVLAELLHKCQSHGSGLLQDPVQKVESAPCTHGGTQMVSIAFDFYSLAKPLSNTVHRLHDTSFLVGCICSTGRREEYHAPSVPGSPSLTVKVQAPGPKRHSSPVLQPALPAPPPHQIGDFQARGPFVSVFDPPECVRSSVSTSARPGPWRPVHDSAVRRNTARDPAPCFPFRRPASRSVTPAGSSTASSTGEEKCSGPTIADRHCRPVGGPARTPTRPAEPTRVPLSTPTRHAQHPARRPGPLRPHLRRHGRCLQYLFLRDGCRQARAALRLRGPGAHGDRRGAHRHLPPAVPPRAADQRQGGRRQQLCARPLHYRQGDRGHLPGPHPQAGRQLHGPAGLPGVQRRGRRHRLRSGLPPAGAPVGGLRQEVQAGLHRLPLAPGGVGARERGGGDGGRRTRLASTLVHSQSTSLARTSDSPLHPTGVHRGGGAVQQRAVHPQPAGAHRRGGDAGQRGGVISSLTASLRFDGALNVDITEFQTNLVPYPRIHFMLSSYAPVISAEKAYHEQLSVAEITNSAFEPASMMAKCDPRHGKYMACCLMYRGDVVPKDVNAAVATVKTKRTIQFVDWCPTGFKCGINYQPPTVVPGGDLAKVQRAVCMISNSTAIAEVFSRLDHKFDLMYAKRAFVHWYVGEGMEEGEFSEAREDLAALEKDYEEVGAESADADDDEGDEY

SEQ ID NO: 16295 - protein, 500 aa, Chlorella protothecoides
  MOD_RES (231)..(234): Any amino acid
  MOD_RES (371)..(374): Any amino acid
  MOD_RES (416)..(419): Any amino acid
MQHRAILSQAVCTGLDGLLGCGQALKLVARLAFGLGRHGEAWPARAGPLKGSKIYISGSHIKRSTLGLKGSSTSYGGKGSHDIIRTRAHTGTRTTAGCRPLSFPTSPITSQVHACKYGDTQHGSRVRMKSTGAALCAGTRLSPADRPFTSKVPVRCQARPRCSHITASGTQFRPCIDIHDVSGGVRLGILCSIVILSTGLLANPPCIRLQGSVKQIVGSSLKDGEGSHTGXXXXESELRLLDSTYSFYNGQAMLYEYMQISHRHLPKTLQTSTRPPLSPSMPPCSAASELKTNFVATQPSSWFAELFARDNLTGGHVIMLGASEANERAAIEALQAYPGGLQVGGGVTAENAARYLKAGASHVIVTSYVFXXXXTAENAARYLMAGASHVIVTSYVFQEGRLNERRLAGLVGGCVXXXXGGGGGGGRARVIRVCLPGGRLRGRWLAQTAAPNGMFVDGGAMHPSPPPHALSASGRGCWQRPPGARPELQEKGRRPVLRCH

SEQ ID NO: 16296 - protein, 199 aa, Chlorella protothecoides
MTSSNIPTLPTSTTVPHVPRGGCAPCHARQGALQWVRGSRMCMCGCLMYSSDPRATLGSGSVCSIAADAVNSGPLLISQAAEGNHFPFAPTESVLYLQLRPLPAEQRLSGGLGSTTAARMADDVGYQAWLHNDPSAPGCLATPDIWSQAVEEMAGLAYPGAVYAVVGSKKVGKSTLGRLLVNELLSTHSSVAYLETGEL

SEQ ID NO: 16297 - protein, 168 aa, Chlorella protothecoides
MEDPRVQFPCMFGGVLHDPPLPTPSRSPFLLSSSEATLRQLGARCAEFLVHGVDVEGKQLGIDEELVGLLGALSPIPCTYAGGARTLVGGLHGCDHGALPHGPVDIGPASPPPPPRPPSNTHGQADLDRVAAAGKGRVHITVGSALDVFGGALPYADVVAWHARQRGT

SEQ ID NO: 16298 - protein, 132 aa, Chlorella protothecoides
MALAFVQKLGQDAFQYVLGADNTSENINGCDELVDLQCGRTVFNSVPARMRAELWLSQMHRDREAVQACEEFAHLVSRVRGGRAWQGTRFCIVPPNPNAPSVTMLALAQSLPSSVQSEIEKDLHRTYPGHWR

SEQ ID NO: 16299 - protein, 354 aa, Chlorella protothecoides
  MOD_RES (145)..(148): Any amino acid
  MOD_RES (319)..(322): Any amino acid
MGQAWRGKVRSHQDDAYCARYAHGFTRHCRCQQDAPRQPPPSSRLGEPEPMKGDTNLEVSFTDLRFKVQLKDGSTLEVLKGISGQCRPGRVLAIIYSILCASIRGSSGAGKTTLVGAGVGEGSGGSNNRSTGTHPRNHPIIPTPXXXXAGGCRSGGEGRWFYQSQYGHPSQKPPHHTHPLHRGPTLIARHAGQQRLRGHPDGVGVREWSSTPARRLPEAVMLCTAGPGCLGRHARDGTFLCSLCPRFLRGLAIVALYSDLRGNPHPSPPLVQRDVLLSSSTVREAITLSALLKLPQTMTREEKQARVDETLAELVSVWXXXXERAAQAAPNYDSGGEASARGRDPGRAGECVGC

SEQ ID NO: 16300 - protein, 330 aa, Chlorella protothecoides
  MOD_RES (301)..(304): Any amino acid
MLLADGRTVFSGAWSDALPFFGAAGYPCPAYTNPSDHFLSVLKEEGARDKLVAQHEALAAKDLETGDGNLTTLPEALAVEGRSRSMLEQEGAAQESRPDAPFMRQVALLSQRMARMWVRNPVMLMSELAQYGFLAVFMAETPPPPFKGLMYLRLNHSTTTGLSDRLASLWFGLAILSFTPSYTAVTIWDKDRLLLRRESQQGMYSVRQMGAGGSGGLPGKAGPWHGRPVRAEACASPRLGTCAADDADPGVVPGEDADRDPHADCPGVGQGVVNEGCCILQVLQIWMSDVEEPAAGMFGDXXXXPCRLPRCGSGGCERGGAASCRAFKSG

SEQ ID NO: 16301 - protein, 92 aa, Chlorella protothecoides
MGNGASLSHSTPLFYHAHVDVPVHRCGHCKRLAPIWEELADAAAADPRLRGRVVVAKVDADAHRSLGDRYGIKGFPTIKFFGRGKPTAAPAE

SEQ ID NO: 16302 - protein, 176 aa, Chlorella protothecoides
MLSCDRPPCAQDRPPPLSCPVSPCSYSGGRTLEAFSTFLTEKVQSDAHARVELLDTFASKFLGSADQAGLLAQTEEAVLTLTGEAQANGALYVRYMKKAMEKGAAWVDTELARLEKLTSGASASGAKVQERSVWGRVRGFACDAWRRSCCEDGVHMLETPQSEDEREGLRLCSSLD

SEQ ID NO: 16303 - protein, 792 aa, Chlorella protothecoides
  MOD_RES (157)..(160): Any amino acid
  MOD_RES (687)..(689): Any amino acid
MAASISRVDHVCADRCSGRVKHCSVGGTAVDVDKRSARDVCRRSRPAGLLVTGPAGRGGAERVDIPPTRRCKSGGEYQVPRASARRCKNASKSPSARRWQLSAMHSIKRHVACSKLSCTGQRYGRCWTSVQGVPVRWYVTIKPAPLNTLPWHRRRPXXXXSPGCPGALVCDHQACPLNHPPLAQTEAACAAVLEIQTAEVTASEAEPGSPGLPPSALSVLGASAVLARLMLGETKASPPPGLHATAALLHDNCLLYLCDSPVIQEAVARLCLEWWQAGAPGRNALVPSTIAYLVAEAVGAGHTTVLWGIAHACHHVLFPPSFSVKPPCACPSPTLPPLPGTTAAVKRCHAIRHGLDLLDYEDEESIVHLKRLLLKATFCPAFLRCSEGRRFLAHLFRLQPAFVAELTAIIKNQVPAGRASGKSEGGWAGEGQWGVGCLYSDGCHCSGARIGVTLESAHSKMLRDRFRSPPHGCPAPLRTPSPPPLTPRHTTNPTLNAVLDAYGEILFRAVSGAEGEQLGAVVAHCLQPLAEAALLASSPGLGANLRRVLRGLHSRKHEPGVDAALLEAYGPLLLRRLAAPNPRVRVAALRLLADAFPLRDPAEDGAAADERLGDQFRRLRDALGDDAPAVRAAAARATAQVLGAYWELVPAALTASLLSRVSTRICPTSPPRASPPVSLTPRHPFPXXXCILSSLRGGTSCPSHSNLSHLTTKGITAGFPHPSPSLPFLLLLLTPISPAHCSNRRVCRRPGAGHGQHRGAVCGRRGAGGPGRAAVGGAAAQEAAAPAEAPAL

SEQ ID NO: 16304 - protein, 461 aa, Chlorella protothecoides
  MOD_RES (58)..(61): Any amino acid
  MOD_RES (267)..(270): Any amino acid
  MOD_RES (386)..(389): Any amino acid
MRRWKVVHESDGFGQKYWTPSEQRWRYEEGGGATKVNSFSKSWIHSTLPPYTTDLPPXXXXPSEQRWRYEEGGGATEISHQYIKQRKDFGRHPSFRNGPIQRWAPLPTTGICGPATRRGAGRPLGSRVPRDEGHPVGPQHVGTREDVPAPGSKFMLVSTQHGRQGFVHAHARVQVNTVVLQTVSQAVDATLGRWPKDVDPTDAQQVARFRKKVTGFETRSYAPCGNEWVHDEENNRARHVCMSCARRWDAERPAILLECLRTFIPWXXXXRTACVYVLRPRVGRRAPCNYFGMSAHLHPMVLVSAAMSGQGRGVKGIPKASIHIHIFTQMEKDEDYIRCTVRLGAVVEELIKENNALDIYEEYFAGGRRVFSCRWGDKAWDTGSDXXXXTGVQLQMRRPPPRRAGPALHRQPGDAAAGGRRGAGGAPELAPRRRGLPGGGRRLPRQPLGPGRRPATRGRRA

SEQ ID NO: 16305 - protein, 112 aa, Chlorella protothecoides
MATHAPARARITHPRRPPQHPPFSGLSGLSWLDVVAPQDLIGVLGCDTPALSQRVHQLLLPSFLPDEESAPGLLVSLLRSQPEAGRRLCLYLAGGVESKAQDGTVLALPSGA

SEQ ID NO: 16306 - protein, 159 aa, Chlorella protothecoides
HEAAPTPRDAPGAHQAPGPQADKGRAPPAPALAAATSSDPGVAPHPAPRDPTSTAPAADAALDAELSALMAAEDELVAAHRQHIEDSMAHVREEMALLGELDGGGAAGDVEAYAAELTGLLAEKAAAVAALQLRVTQFRRLVQTTLERHARAGSGAGQQ

SEQ ID NO: 16307 - protein, 249 aa, Chlorella protothecoides
  MOD_RES (122)..(125): Any amino acid
  MOD_RES (177)..(180): Any amino acid
  MOD_RES (213)..(216): Any amino acid
  MOD_RES (234)..(236): Any amino acid
MHSGTREKELLRSSDEQEESSADLANLILCRLRTCRKTQRAKEIARNKKERSLQRDAYSKRDDPESLKEQLKEVIAAEQAGKSNPTLRLKKKALQSAYEQAIKRQMVSIEPKNLGLGHSSVXXXXHQEADEAMDSALESKTSTIPHDCLSPYLSLQEEKACIKLAPGEASLAASETXXXXLMTAFHPTSHCRRRRPASNWPPERHPWLHQRPXXXXDGLASHHGSACARLQGSXXXCTDLRILCITTRP

SEQ ID NO: 16308 - protein, 142 aa, Chlorella protothecoides
MPDVNARMDAEASISGQDDGESVYDGLPFYQVSTQQQQQQPHAGSSRACCLISLNITLRPQHMMAGALAGIGEHVVMFPVDTIKTRMQALAHPGQQVRLNPGAHGPIFVYADLHFVTVCLLIRTDDLSGTRTARRTMHLRLC

SEQ ID NO: 16309 - protein, 131 aa, Chlorella protothecoides
  MOD_RES (111)..(113): Any amino acid
MPLHPPPAQLHLSVRHAMRAVLRREGVAGLYRGVTAMALGAGPGHALYFATYEKAKHLYGGNRKGHQLVATAGAGGLSVAMDGTRGEEREGEDCCRGDGSGFGSLEQLFPXXXGRWAFGGDGCDERRGEGG

SEQ ID NO: 16310 - protein, 266 aa, Chlorella protothecoides
MGWPTPEFCCFPTGAAPPLANPRLPLAVFPRVGHLPLFLPSVWLPRSLVALPPKLPPGATATIVNDACMTPWDVVKQRMQVSHSPYRNIFHCAKSTYRHEGLSAFYRSYWTTVGGWFSSWDALPWSPGLGAVVEIQIATPCMGAGAAWQGSDDRPRMFGSGSVLHPAVSSCPVRLSIPSHPALSWVQLVMNVPYTALQFMLYESSKKLLVGEGTADEEEEGLKVQGRAWTRSARHSPAILPGLNARSCNPPRPQCAQLQPPRPQCP

SEQ ID NO: 16311 - protein, 191 aa, Chlorella protothecoides
  MOD_RES (104)..(107): Any amino acid
MLSDPGAAREVALGSQGALEGLSRGKGYIDASTVDGGTSCTIGEAVRGAGASFLEAPVSGSKGPAEQGTLIFMTAGVLGDLEVSQGVWLTQSLPASALLGSFSXXXXHLHDGRCVGRLRGVARGLVDAVLACINAAGKLLQLALVESMRHDPPMSTQTAQGTRSCMMQLCRCLRPWARPPCTSGRQGRRPR

SEQ ID NO: 16312 - protein, 451 aa, Chlorella protothecoides
  MOD_RES (434)..(437): Any amino acid
MAADVNTDVNPIGILDADSLLRHKDWRVLGRLGNLAELQEVLDTSRRLTALPSGPTHRAGMSCSKAVVKVASALRRRCELAHPSVALSGLTMSDMRAGLSQRQHSSSLANIPDARVNPDGVRAIARNLLLDTLQMVSTWTPMALAWSKSRSNDYSPQLECTRGEGGSWGAPCPSANRSISVPNIDRDPWSPTKHMQMRKFEASGMSREQAEGLTQHLTQMLCQDRDKLADLYVTKEVLKRVRSGGVNGTLITSLTLAACAGCRLKPPPSHETLSGCRTAWRRSGLRSGECLHLCEAGGRGICKSPDQRSWMHLLRTHRMYLCFASDPLAQRKDPVGEHYLLHPNLHLAAFERNCSMSNSFRYEVDKLTASQRLDLNLEKGRIRDELQSLRDMATEMEIKVCWAVGCGCSGWARRRKGFKGLWLGRPVISLPPRXXXXGEEKASRFCRWGDQ

SEQ ID NO: 16313 - protein, 670 aa, Chlorella protothecoides
MQSREALNAGTSGSPEGAQPPLRYAFPSARGPTSHNRSSALIKDMDALKQRMATAKAGTGEVAAVLSSVTFQPRAAAFTSLIQATSKAKATEKALELFQCMQDIFGIPPNTFSSSALISALAKSGQWELAEFYFHDLGASRSSAAALDAPGEGRLPPASSGFPAVEGLRLVDVLPSARWVSTPQSIVDHERRRAARCHGCPVSDSHPVQHTRKGASSRRRSKSSSSSSMPRSTQTSSPLAAWSRPANAQVQPPGGAWLGMGRVSAARRLPPRACQPCSAPTPTPPDTAAPHRPAGDGDRHAGRHAQLWPVRHAADVQRGHRGGAGLELGARGLPRHAVRHGERRLRPRREGRRPLPAAWCSPKGRVPPLLLTWEAQGPHCSGADRPDPELHPDPGRGVGKHAAHPGRAAGRRAVPRLADGQHAGGGAPRDDRAGRRPPAGACPLLAALRPFQVTPPQTTPPPAPCSLSPFRSEMRNPQDPFSTPAHSLIPPPPQGHAYDLLSFATPPSGDLPNTRRRVPLSPGLMPCVFQTLFNSTDHEQVPCRQLRLAAGYSSSSFIGCICFFPIPTHTPICSLPSVAHAPPPVSHVFVRWRGLKALDGRMGRREGVAGSSTGGRCAGVSTEGWGGVASSSISEGSHRCATPGVCHLGSPAQPRCSKGNDQGAWAFRTD

SEQ ID NO: 16314 - protein, 435 aa, Chlorella protothecoides
MASCVEHALQRLHVGQGLRHRARVCAVAAQRGHGPVQQLVHDGLGQVLHRLLLLVGHALPQPRQRLLQLQRADGFRLAAQRLDGGHRLQAVAPGLERGLLPRQQLLRLRRSTRAPRAVGRHHLAQVVHVEHLRRVAGGGQVARHVARHRDVHEPAHAVQRRRRQALQEFAPHQHLLRPGGGEHQVGGGHRVAQRGHESQLELHIRELGGQGLGARQRAVEQRHAAAALGGQVLDQQARHLARAHDAHTRGGEARGGQLERRQLRGRAGHRHRAGGDGGLGAHALARRHRLLEQAVQVAAEAGAGLAHLVHLLHLGQDLALPQHQAVQSSRDAEEVPRRVAVAQEEEVRAQVGKGDAAGAGQPVLHLAHAAVEGQAHQVDLQPVAGGQHCCLLDEHSSAIARGHSASGTASFSRSSTGAEWMVRPMAMMLDFFSMA

SEQ ID NO: 16315 - protein, 113 aa, Chlorella protothecoides
MPIAATPPQPIIRPPFTQFVAGGIAGGTAAAATTPLDVVKTRLQLEGLGSATRYQTMSVIPVMRRIAAEEGAAALWSGWRPRVLFNAPAAAICWGVYETCKTFLAGDDVADQA

SEQ ID NO: 16316 - protein, 450 aa, Chlorella protothecoides
MEKKSSIIAIGLTIHSAPVELREKLAVPEAEWPRAIAELCSYPHIEEAAVLSTCNRLEIYLVGLSFHRGVREVEDWLSRASGVPLADLRPHLFLLRDRDATGHLLRVSAGLDSLVLGEGQILSQVKQVYKVGQACPGFGRHLNGLFKQAVTAGKRVRTETSISAGAVSVSSAAAELAALKLPAPGLPAARVCIVGAGKMSRLLVKHLASKGCGRVTLLNRSLARAEALAAEFPDVEFQLGLMPTLRDAVAAADLVFTASGSEEVLVGRELLEGLPPAPLDGVRRFVDISVPRNVAGDLTPARDAAEVFNVDHLREVVAANSAGRARAAAEAEELLTGEQAAFEAWRDSLETVPTIKALRSKAEAIRALELEKTLARLGEGMTNKQKKAVEDLTKSIVNKLLHGPMTALRCDGADPGAVSQTLANMEALERMFDLAASTQEAILAAAAARK

SEQ ID NO: 16317 - protein, 88 aa, Chlorella protothecoides
MCHVESGGGARRVALQYHSWNNRLTGTVPSSWQFAGLQELYLQDNDLEGGLPSAWGSNGTFASLQILMLDDNDLGGEATAGAWRCWAE

SEQ ID NO: 16318 - protein, 67 aa, Chlorella protothecoides
MVAERFDPAFPLKHQQKDLRLALELGSDAGQYLPVAAAANDLYLTARNHGAGDLDFSAVLRAIQRKQ

SEQ ID NO: 16319 - protein, 962 aa, Chlorella protothecoides
  MOD_RES (823)..(826): Any amino acid
  MOD_RES (851)..(854): Any amino acid
  MOD_RES (908)..(910): Any amino acid
MLARYRSVDSSRIGSELRLSRSRAVSHRAADRAHNMTGSLHPAGWQAAWSSALGVSGSQDRHHVSPRPDLDVRHPRGEQDGRDGSPPHGHPVRILTLPLRIPPPLRPRGQGGVPGRGPAPAASLGGGPGAVPGREESAAGAAPPSLARRLPLPGPVGGPALLPRPRRRRCGRLRRRRLGHGALRPCLLPHQRPKRVGGAGRHAGGAAAGHARAGQRRQPGRAGAGHTAGGQPGAGTGVSRGGWGLRRAFFFFICSLGQAGVSRARPCGGFAVHPAPGRSCKPTAPNRLYLRITCEIRAMWNRLGGEGVIGVSPSPPPPTYAHLHPFPTPPCRSFSSVLSLGADLATALEEQRPLLLLGASPGGVAALRSALSWTPLLAHAAQHPVVAVVLAPSPTAAPFVVEWEEWRQAGVKLHSPPRAGAGGAAGVGAGGTARAAGAQGSRGLRPAVRHRTGAGRRAGKEAGRGRGAWAFDPGGRRRGGRPGLNEGGALRRLEGLRSQRPYRPQVLFCAAVCSPSMHGLEHSDVMMQRDGSPAVLVLAVLCALSLSVAGQNSSGKNDGLTAALHYVPFPEVAMRRTPCMEPGTAVLDLITPASEIEDLPGACNCTLTGISGCAEANAVPIWGLGSCPLPTRRSLVPCLSPWLGLTMPPTKQLLIQSALPTPYPTHPNHHSVASVDDFLGCDNFLSSQGDDTYYCYVVSPEACPAVQASPRFSGAGYRGCNPEVDAVVAGAPDSFTLWELVAESPSLSFLATALEVANLTDTLASAGPDGQGYTLFAPRWSPPCQPPCTNARRTCFPPAATMPSPRSWSPRTRPSDSSWPHPXXXXCWRLAIVVCVGMRRWGPPCQLPYTXXXXAVGHPAQPRDLRWCGVYVDWGESTGMSHVVGREGRGLRKRGWLPQVAQPLLPGXXXAVGHPAQPRDIRWCGGVLTGERAPACLTWSGGKAGVCASVGGCRRWHSPSSQ

SEQ ID NO: 16320 - protein, 764 aa, Chlorella protothecoides
  MOD_RES (223)..(226): Any amino acid
  MOD_RES (280)..(283): Any amino acid
  MOD_RES (643)..(646): Any amino acid
MKLCRAGTPLLPLLRSSRYCALGFPRIFAPSYHPFTLSTPQSPSNAALRWSEGDVWTLDLDLPAGKHEYKLVIHNESADVAYWEQGNNRTFTVSEQSDAPLVLEFNSVEVITETADELSESRPRPGCPGMTLPSAARPCNASAMGLHGCVKRLLQIESKGCLELSSLEPIKLQLTHQTPTKPPPFISPLSPSDAVSDSQLTADKANPPTAAAEEPTAAKAGSXXXXADEANPPTAAAEEPTAAKAGSAAPPAAEEASEAAIDAPVSSPALEKEAEAPSAXXXXRPGLVSCPGEGGRGAVGSCRCGFFFDEEGGGRKAEPAAAQKEAAKHAAVDPAADAFNPAPTPTTAASEKEEAAATDAAAKKLESPAAKPENLGQRSLWRLSGPREGCAAPPTIKHPHLFQAKDGCAAAGPPRPEEGPAHDSSPTYPLCRLAQTAGVKKKGAKKATRAQKGNFKISACHMECNVRDGACCPGGAYHQHGVTQAESMIMKHLCDNGQSPTPGPWRPVGQCNSFGTDRSILGYLSCPVRIWAGESAAASTGNQGAPSEQERGSWRVTIPPRFWLDAMMQSIAIQKPFVASTTATRVTSRSSARTASTTVCAVRRDNQHAIAKVGMGLAGLLAAAQLATTPGPTPPCRSSLPQXXXXHVDSCANRRGPTLSFLPPTAQAFDLGQAINSVGGTDLVEKAKDAVGGSGGVQDLVQQGKDAAQNINAPDLKDAAGKVGEVADKASDKASGLADKIPGVSESNLQNVGEWPWDVDSSSE

SEQ ID NO: 16321 - protein, 415 aa, Chlorella protothecoides
  MOD_RES (385)..(388): Any amino acid
MLAHRDYYAPLLEDEEEAARLAQDAEAQQEADKQQAAAAVGLVDAEAVAQPGFAWSVRAKGEGPALTIWARIRTEVPDELAISSVVHRSATGHRSHGEHISSLRFYEGRPLLDPLGFERPLIFTARPCSDEAEGHLVGQRPASVGEGFPTHIRKVWEEPAAPPGSPGVVGETVVCSCKFLSLSSLPIIAVLFEPGSFHIESRCDNKIAFALDTALLLRVLHAAAANDASSLEMRLTMRACSSSMSGQHAPLQHQQCPGPCTTGAVSSGSEQTSQRPVLSFAWQGYDMSMVQVRRWGLDLAELGMLDACFRGHPLPPRRSLLMLAAGPPHHQAIPCEPGLLGGALRARPFCTITCRATCCVPAAQALQAFISMTRISTYPAHPTGXXXXGPGPSAQSHVVLDAAYLRRRLSRLSHP

SEQ ID NO: 16322 - protein, 181 aa, Chlorella protothecoides
SVVSSPVPLHQLHDLHLGQFPRAPGAGTRAGAGVSKLYRPTYPWGQLSGWYKQTVADPTASLSAERRGSISLPDVESCFSKGGTGRTPYSAKERRDLLEALARRPDAQWRSGTIFSFRNEARVYGSPMLDDAWDRVEGRAGGLEAVLQELRDADVPPTFGGSAGSKAGARSRCVRTGPPES

SEQ ID NO: 16323 - protein, 92 aa, Chlorella protothecoides
MHHEELHGPNPEGSSAPASTSGTGVPKLASDGRSEAKTNAGSDPPATAAHPEEQQGSAGEDEDDEDDENDTCGFCIFMKGGGCKKAFNVSRG

SEQ ID NO: 16324 - protein, 129 aa, Chlorella protothecoides
MPDRRIRLLLADPLSCNPRNARYGQLHAAGPRGEVSALHPAISARGEDVSEAALLQLLSGVHPPGTPASQRLLSTGKSNVVVFLTGHGGDQFLKMHDRSEFLEADLAAAIAAMHALGRWAPAGRTGAAL

SEQ ID NO: 16325 - protein, 719 aa, Chlorella protothecoides
  MOD_RES (34)..(37): Any amino acid
MNGVVPCLGEDPWDKVQAAAALSLTLSVNTRSHXXXXCRSVPGWSSPPPRADAIVFLSLLVIGVHGMRRSQPQPWTKGEGSWDEAPPGNLGGTEILCKAALPCVVAPWAGSSGTMKRRGSERAIRGVPLFRVSTMVSGDPGDISRYSAASGYPSLPRAPFTPPFHQLCVPPTRPQNPSSSPGVAGLSHRPTGRLLPSHCTGGSAQEVHRDGQPLPEPAKPAHHQPGVHGAHVCGHMVLDQHRSTRHHRSPLHHCCADRCVCVRREGGGGGPRDTLPPMPPLHTRVLPPNKKATPSSLLPPSTDWLDGYLARRLQLTSAFGAFLDPVADKIMWWSSLARAAATSPFPRRSPSLPALRVQGIHGAHPPGQRPAPAHLAARHGRAGGHHDGTRAHHVGAAGVGGGVEQRGAQGGLVSGVVDMEPGGDMLSHPCELGTRGEGRSRPWQPPFLTQALCQSGHGPHPPTTLQAVKVNSLGKWKTALQMVAMTALLVLRHADLILGPGYESGERGPRGCGRESWDRAAQGNPRPETSTSRSWAARTGPRGSRGPVAGRIPGGLEPRELYVMRMEVSCEHVSLGRREDVCEYELAWHIRALYLPIGPLRKAGYPPRKVRMGVPPLCALFLGTTFLRATHGGRVLRRMALVFCIPPLRGYPGNRRGRRVGRSAKSPDFYSEHLEAIGEVARCGTVTSTYVTLDLRRILSSVRTSPVTFSALDPTRDDW

SEQ ID NO: 16326 - protein, 382 aa, Chlorella protothecoides
  MOD_RES (181)..(184): Any amino acid
MPLMRYMWTFLAGEILRFLLPPPVVALCARNRSSDRESWHLLSRFTGPRCVNTLRLIPPAPHYQDLRIACAPEAMSTAVSMHSVASARVSPCRSCLRARPAVGQALTLPSPRMYPSRSQPHRVSPRRVQQERVEQTSSNDTSPHPDTLVDTLLQDIQSTGRGVAMICLAVVGVFIRLRKGXXXXLVDTLLQDIQSTGRGEGGSEIFMEQAPCPSSTLRSTDAGDSVSPPQRARIDDTIRHLARIGDGQDPRPLRNPDLFGNFSVAYVSPGTAQPGAAAGGRFRSTLGKALFPTRGLFQSVLSPDIVVNKRARLAIWPPLQVCFALLGLIPGSVVLRGKLQPIPNFATGSEETLDTVKVPGGGVGTVAGCSCRTEWCRGRVLL

SEQ ID NO: 16327 - protein, 158 aa, Chlorella protothecoides
MSGAWSLSQALPPVQIRIYNLAKQAMVKKLFTGAGVITSIALHSTGWWDGVHRAMSDLGLAGACCTPLAAGGPPAPCQGRPPAPPPTPGDHLIVGSEDNRLAWYDLDLSTRPYRALRFHSKALRGVAFHRWACRGLGFAAGLGGQGPARVFRTGMARA

SEQ ID NO: 16328 - protein, 114 aa, Chlorella protothecoides
GPEGAVLLPHAARVTALTWHARGDYLAAVSAASPSQAVLVHQLSKGATQAPFRKTRGRPVQVLFHPTKPLFFLATQQQEVGNGGTEGCGVSWHGGAAGRGEWVDNPTAELREWH

SEQ ID NO: 16329 - protein, 302 aa, Chlorella protothecoides
MGRSGCGDARDWFIVAFDKVERGRRGRQRPDWDASAFDGVERGRRGRQRPDWDAPGGPGCPAQPWPHPHHLHRFSKDDQQSAPTSRVGTPAYLAPEVIVSKPGTHYDGKKADLWSCGVLLYILVTGTYPFQRVKDSTMKGPQKLNAILNRILAVDYIFPERKRLSPECKDLISSLLVLGELDDGASPCAIWRVLGEIVPPTRPRLPIQPHTLAPASSHPSLPRPPDPNARPDIPAIQAHPWYRVDLNPAALSFNDTLVADSLANATPDSVYEDIRSIVRDAQQVVRGKPQHAGKEGRRGPYI

SEQ ID NO: 16330 - protein, 147 aa, Chlorella protothecoides
MLYVMLVGAYPFERPEDKHDAQKLQKMIQRILRVEYDWPPHIKLSPECRDIMARILVADPQKRISIQELQDHPWYMKDLPPGVKEMNDNMRMPPAGSQSEEEIRETVAEAQKAPGRGGGIAGWEDDYIDDTMDAENYESSFDEWGGT

SEQ ID NO: 16331 - protein, 319 aa, Chlorella protothecoides
MSACSGESASVSSSAGNSADSPRPSDSAEQTECGDTGAKEETEHQSPERPEQAEATPLPGQAEGVPVEASWQCAFDRNSQRHYWYCQETGVSVWHAPPGWEGQPCREAGGAQQPESGVGYNPSPDGYFYVDAEGTTQGPFDREQLRAWRGHLPMDLPMWRPGDEAQQYLATVLGDDGLLRQWHDANPEEAERVCLLWVRWMQGWGAAWPSWLDHLVGQARRQTHQTVHVCGPHCCSPATLVCQGVHRRQPTSALFSAVVTPLCPSHAQGPSRAPPAAIYEAEERGGSAAGYAAAALAGLPPDDDAVRVRRGRGGWVGRL

SEQ ID NO: 16332 - protein, 304 aa, Chlorella protothecoides
MHAYVECRPPPHQPCPYPPHTRTNSTYLPEPETWLHRAGAGAKQLWCMGLLSLLIRGGSGCKAAVVLYLVLVTTLSLPRHVWGPQLRRLGTLCALLLLLTALGSDLAAAEGLERGPAPGGAGLSALPASMQDLPGSPRYSSVLLKLGFLRVTRRSFRLAVSAAGRAARLGSAWLGSPSILSRCMDPRDALGPWARSSTPMAVLLLDVPLVQRDHSFLPPLHSPATTGEHCGADLCSTAVGLPLPGLHPPRAHGRGDELCPEPAEGGGIPCRRAGAHALARAALHLNGGLWVQWTHVAGGDGAEP

SEQ ID NO: 16333 - protein, 409 aa, Chlorella protothecoides
MCPRVPPRCPQVQVLVDSVVGCLPVYRDAQHLALPTVRPSALWVEAVLADRYDTLGIPVRTSYAEATFSGCTWDTTLTFATRVSWDGLTLAGMGRAWPGYLRYTCWGQHGICECSPPCRVCTLRRWAGDLVNRRRLTMHTPCPPHMASLHAPGFFTVPRPGPHGPAGADGVGGAGRRAAARPGGRHAALLQQERAAEDRGAHAAAVDPGPRRWGLAVENPGQGPPEGAGGARVRGEASWGWDGGPRTWAPRQNAWRLAALCHAVCAAAAGQSRDEPGLQPKHGMPRPTIAVVVWLLSHTQTHPPSSLPTAARTLRSLRLPQPPQAGGAGAQALRAGRAGKCALAGRPDPARHRRAGGRGRARRGAGRRRAPGPAGRPALLPPGGGVPGGGAAGGRRGRGRRARRAALHR

SEQ ID NO: 16334 - protein, 580 aa, Chlorella protothecoides
MQGLCSQAPNPLRRPSPASPPPVQGQYYKRSKEGDAIIGFLAPLLAESAGQVAAYAPQGPAVSAVSRVDDPTASRLVEGGASLPNSAVPPPPEAPVARPTDPSAPPGPASEEEEEEDAGRPPHHDSAQGPRRVLGPAAPPPEFLAAAALLPLPPSPEPGVPGADDDDEDAFLVGPVPPDLAGELDLASSDDRSAEVARILGLAREREARLAGVAAADAARDPLDPYEVLGLGPEATPAEVKRRYMRTSLLIHPDKCDHPGAADAFQAVARAAKELQVGPRCRGGWRGWGCLDRHEFWRLLFVVQPWTGRAVEMEGGSTRPNGPCMCWRRGIQPGTCPDLGLRAAVDARREEAALRREFEAEQAVAERQRAWRIARGEATPADLAGPAPGAAGPAREAWMTELPPERSASATVAAVAPGSTHRGFSQSGIKPRGDTSGWTLTPQQRALQLEGGGAAGGGTLLGPASGGGAAAVTASAVDAYNAATRKRSLVEQHAERLAAATKKKGKKKTRDGAPAPAQAPADWDPATQPWRPFDREKDLVGGRGDVQSAQQRIAALPALSSRFGGAGGGRGAGSGARTFL

SEQ ID NO: 16335 - protein, 300 aa, Chlorella protothecoides
MPQNHRQEKKTKEKKEKKRKYLGDSSCPSCRHIATAQQVEEAQSVVPEVASPVVEPPKKKKRKASEAETSAAPVPAESAPAVKKKSKAKAAEAAASPVPVTKPAAPAAVSQEKEEKKKKKKKKAEAEASAAMEKAAPVETVGAPVTEEKRKKKKKGASVEDSPAGTALPAAGMAEEPEPLAPGSSTRQGIEEMQAVEEAAPRQGTAAKAFQRVKAEEWIDKRGSWDNSYVGTFGEQGWGFKAQQILGQVGRRDGVRQWAQGKVRGKDFRHEKTKKKRGSYKGGLIDSHTVSSYKFDSDGE

SEQ ID NO: 16336 - protein, 214 aa, Chlorella protothecoides
MAGHRHGGHRTPRIFPPPLGPKSAGVSPWPPPFPTPQSKARESLDRALDFRGNVLLAGVTTCCVGCAAWQKNCHLRPRLALGMTSVSVTFVILPWAFSGFSDTIGVAGVGPWPRVAVPMPVRSSIGGRAGPSGSNPPTNMPHRPGTALQVATEALAVSYSTLALLVQIQAVLRANAFLVEYAAAVPELLPLFRPPTAGVLAHLHALFLRTPWEG

SEQ ID NO: 16337 - protein, 168 aa, Chlorella protothecoides
MIFLTLLAPFFAPYILGWPALATLVTLAADLGITLGLGVAAGNPGLPDYLSLSLTITLVGAWLGLTLATALWRNLESSFDRMPWLRHTQELQSRKGGRTYQTKCPFTGAPRDGWRGVWCIEDSPGQHAVVARPRAGTGEARTTRLSTMPRFPPTHLLPPTPSPNLSHA

SEQ ID NO: 16338 - protein, 240 aa, Chlorella protothecoides
MTTSSPPAKRQLTLRKACAGPRTSGETERQTQYAIFNEHKIQELHGLADGYVQAWTARCSALSMTGDRAPVRPGTTMKPDPEAHEQHLDTAEMLDTAGVYCRAPTGFSRTHERLLAWASGMMFFVRECGLKWTPAVQSDVLTRHPLNAGFRYVEACQRCLDQAIPKNQVLDRHSIEHLVLVLRCDGLHGSRAVSAGAARVLASAALAFPPANLCWHTQGPHSGQPFVAVSDAGVWSPVGL

SEQ ID NO: 16339 - protein, 352 aa, Chlorella protothecoides
GVARGRAPPRAAHAPAAPARRQAGGAGGDAGAGPAGGGAGGDECGRGGASGAGRWRRRRPAPARARPPEPARRRPQPGGHPAEPGSGARQRAGSVVWRRAARGLRRGVGGGRAGKTARTRRRLPRRLGTVGVTRGRPASAEWGGSAGGGPCDGLRLLKPRNLPRDARPREPTPPHDAPHRRVLSRSQGPAREWQEHMTLQHVSGEGAGALDVADAARIFEDRLKSALLADDGRLALSRLAGSTVAGLMPRIESSGQVGGATWRLVSAPSIPGRRGIRDGKGGVGERDKRWHAGVAACWGGGSPGQADVLGAGRAEKKPCAACTAGAGGGEGRDIQERVAGGAAHPGPVAPGG

SEQ ID NO: 16340 - protein, 185 aa, Chlorella protothecoides
MSGCGAYLRRLTTGLAGCALRRGEPIVAAVPSWSASPSPLCVAPQPRWRACYATAAPTLNPLDQVAIPEPETTPQGSQQYKKKKKDPRFKFQEKGVFGENLYTKGFSENLHISPHKLNDMVKVLRGQSIHDAIIQCQVRAAWMPEAHAWVQAWRVLGLCVQRPAGEGGEMLWAQRDAQGLQGQAM

SEQ ID NO: 16341 - protein, 119 aa, Chlorella protothecoides
MFKKLRSSFTGGSKSSSKVRLDVTVVSAAGLPGPTSCRVVWARQSKVQVTRQASVGETGTASWNEELSQIATMERDAKGAYLPKVLPGRAARLHLGRERGVGTSVGDAADAVPRDWVAW

SEQ ID NO: 16342 - protein, 214 aa, Chlorella protothecoides
MAPAVDVLLCETMSSADEAAAAASAAAATGKPVWISWTLQDASDGEPRLRSGESLQVRRWLGSLAASSPGQGGGQGFPAAWDRVKDIPCLQAILINCSSPGTVGAAVPCLRRLAPAGVRVGGYANGFRQTTGEWLEGRGKADINDVGDYDEVGDLLPGAYAAHAASWVRAGAGVVGGCCGVGPAHIESVSALLQREGGALEYDSCSAERRVPPP

SEQ ID NO: 16343 - protein, 125 aa, Chlorella protothecoides
MASGTADSVLLLDGGMGHLLKSQDIARFAPDLPVERQFAAAALANAAAPDLIVGLHEVYIAAGCHVITSNTFGAGAAERTAELAAAGAMLARRAADAAPRPVVVAGARRRRARWRSVRGSWPLSG

SEQ ID NO: 16344 - protein, 759 aa, Chlorella protothecoides
  MOD_RES (709)..(711): Any amino acid
MRTSSPCWWAFRGEEQDRESCRGQVLTLNITIRGSAEPRHVPALTMQRGAPAARFCSHRKPRASKISRSGWVNNGSVHPHRSHMAGEGHFKCQRAGMLRPVEWRAGAVTDLHKPDGQRLRRNLSAIINFAKFREEKLIAYAELQVSCGGVVKAMWGRGDCGMCPCCHWGGLLLGCLPNLMPTWTRQRAPMPTCMPHWTSSGGRPRMSSRCVDWGHRRAPAARGSPLIAAQSYPCNDRDVERLTAAAEAVYSENAALNRQQAALSSEVKALKQGANALTDEAAGLRLRLASARGEEELLRGQVVQSPQKAAAALEALAAALERERDAVSEAERRQRDTAARTDAVHRVEKEVSKALALMEGAELEIGRKKEVSREVKRLRAELAAGEHEAAQLSATLDLLKRQTAVVEERGGIDWRQLRGSFHGSGCTALGAGTRCWRWGRRPFHSHTHKSNCRPTPLPRSARCGRRQQRGTSRSSCATRRPTRPRTPPTRPSSPRTRPRSTAWTVIMGGGGCNRGLHPSRQGARGLPRASLALLARTPTCRGAACRPGAGSERIAEGFSRPFGTPADMSWCSLSPWGAAPGAACRTTPIPHSPLFFLLRTDPDAAGAAAGGEAGPRGSACPGPHPVCRPSGGGGTCWRGGGSAVAGSWVGGTFRTDLPWGAHLRHGGQRTWQEGGDGAHRPPDSMMDMTKVGQGVVCRRPGIYERLNTXXXGAHRPPDSMMCMTKVGQGVVGRRPGRTLTPVRDRTSWCFPSDTLLPAA

SEQ ID NO: 16345 - protein, 707 aa, Chlorella protothecoides
  MOD_RES (123)..(126): Any amino acid
  MOD_RES (220)..(223): Any amino acid
  MOD_RES (284)..(287): Any amino acid
  MOD_RES (311)..(314): Any amino acid
  MOD_RES (397)..(406): Any amino acid
MAYLPLRKQGKGELRHTGVSHPASDSRLYRICSGLESYSFALPRISWAAPATCPAQGAQADIGAAGAPFKSPRALSSASSGLSRGAQRATKWTQRRQDKVEGLQQRLVVHMIAIGRKRIRQGXXXXMIAIGRKRIRQGLPPPSSGSNAIPQARTGVLKGYDLEPAPKLEAPAQDRGRALHGHAVPRHPERGSHAQTVRSNKPEGRHERLRTSARSVREPXXXXYDLEPAPESEAPAQDRGRALHGHAVPRQPERGSHAQTVRSAKPEGRRERLGTSARSVREPXXXXGGVVRGVAEGDRPAGLRLSSCMVXXXXDEAPGAGSPGPRDASPELRARPSKQDVWERPAPAGQMRAASKKAGEREATPAGPQSIQAMTRCLATQSSGPAFPPRSTSTLTXXXXXXXXXXVMVAPVDSEDSDAEAQAGPGSILDALVSNLAARDAALEEELGAAAAAAATAPGAAGWSEDEGATSSDDELYTNLRAAAGVGAPGQSKRPKRPKVKQASREESAGAGLRPGELARAAVARTRPGRPCVGVGQADAEPADGFAGLGLAPELAQHLGSLGFAVPTPVQAACIPALLRGDCTLGLQGAGSHVPCPAQGVPDGLAHAVDRPIPAVLELSLPDSVLGPHQTVQDGQDVLANAPTGSGKTLAYLAPIVSELARRAQRVTREQGTLALVVCPTRELALQVLERGIREQRTLGWIAGDEL

SEQ ID NO: 16346 - protein, 132 aa, Chlorella protothecoides
  MOD_RES (22)..(25): Any amino acid
MGLGGVGRVWQQGYGRHGGEVXXXXRVGVGGHGFGRGWEGVAARLREGWWRGRGGGGGGGPGTVDSQEHAHVAGRCSAPTLSNLVSALAHLASSVFPVPGGPHSSTPRGTLAPEALNRAGLVKKSTTSCSSN

SEQ ID NO: 16347 - protein, 174 aa, Chlorella protothecoides
MQGESQLADEEAYRQKLAADVKSEDPNAQAEEMLKMKTVRIKRAMSVGGGRGGWLSEAAARMVRFHSSFSRILGVEGLGIIAASLGTRVRVPLYEPPPNLQRGRRCLIDHAWTCRDPERQRRIREAQRQLRGVKLQYSDEETIFFDDVAGIGDAKVYRSCTFNPTSSHIIPAAT

SEQ ID NO: 16348 - protein, 99 aa, Chlorella protothecoides
MWPFKGEKPLTEEQQARLRPVVAVRRRHGSVSPVAPPTPTQVVHCYAEVLDPALAAAHEDCFTKAVNSRRDPPYTACQGQAQAMRSALAKRKLYPFADR

SEQ ID NO: 16349 - protein, 152 aa, Chlorella protothecoides
MRSPRGVLLCTDVAARGLDFPGVTATLQVDPPGDAGEYPGEAGYVGRLAERGVRLAALDATRLLDGALGLDRRAGKLARDERGLPLERHQGAYALQRRLMGVVAADAALTALAAAAFRSWVRAYAAHPAAVKDIFHVKRLHLGHVAHSFALT

SEQ ID NO: 16350 - protein, 272 aa, Chlorella protothecoides
MAAALIRRTISLQTSLRHVSSLNVGCAPQPVRLAAFSAVAEAAAPGRVFGACVFERLPLVVPPHPDWEVEHSRWRFEWNLPYFKKYPADFIDEPRTEETDSAVAASNRWGPAPLESEADRSGDVRSLKRRLDQRVFMLVRRKGGSGAWEFPAVQHEEHCLCSPWRRPAWTLLRPGSPSPPSRQGETIRGSAERALGLTLVREGLQPFFVGNAPAGHVETGEGTTFFHRCQMIAGTVRLVPGGPYSDLRWAAKDELPEFVQDQALLDLFQKML

SEQ ID NO: 16351 - protein, 158 aa, Chlorella protothecoides
MGQLWGKGWCKRGRHAFPQGCRVSACDRNDVVCGRVGDGNAQCATSFAGIKNVPRRLRIVVQRKRNEDDDDKVGDRVGREAKVRHGRRFAFLLTAGLKARSPPSLMDTAGAAVLFCHPGRRPEHQGQGHRPPGCLILPPSPCFPSGCPACNSFAQGCT

SEQ ID NO: 16352 - protein, 359 aa, Chlorella protothecoides
  MOD_RES (145)..(147): Any amino acid
MDVTSPRGHLHVCTAKGHGQSYSSHGEVLEGAWEAVKGADGPGAPGDWAPGAGGCRSPCRGGCRMRRSGKVVILLTGRHAGKKAVIVKNFDDGASSRPYGHALVLGLSKEPRKVRNRGSRAGGPGEEEGFSDVWPPALSCLCISXXXPLRPRPRAGPEQRAAQGAQSGKQGGTGWGGGGLLGWLAPCNELVPGLATHPWAPMVVRCNARRAGKLVVCESSGPANAWPESPPLSLLLAGDQEELPQGPGPALQPEDLHQGRELHPPHAHPLHAGPGAQGRGQQRGAGELHQAQGGQQGRQGPAGGEVQDREEQVVLHQAALLSPRTRAGRPCNALSPGKGGVVEGVDRTPRRIGVRGVAA

SEQ ID NO: 16353 - protein, 376 aa, Chlorella protothecoides
MLPSCGVGQRHAVLLPQGPPHASITLCRGVHPRPHLPSCAGVGYDGNRHSFRPGPPPRPNRASVARPAGDPDVVSTAPAPPSKGGLAQRVISGSLLASLALVMIGAGGWPFASLACLAAWQCSREYVGLLQASGMASGMEPPSKLTSSTVTLFCVALNVWTAASRGRGSTPLAVAAFCLMFMQLVDAHKPRFAQLASTVFGLIYCGEEGGPCLSVRRERRGAVTGQACHGTRQLLTAVRPGAWLRVPRTARLDRSDPPGSNCAPDACVWSSACQGCHRPRGLPDPRPCRVPAQLLAEAPDAGRAGNQLAASARLAGGSHVDGGRDWVGRTSHRSGVSDLSERATLSHGCWLPVPQSLPPVPARYGDPPQGNPVSPA

SEQ ID NO: 16354 - protein, 234 aa, Chlorella protothecoides
MVRHTTKETPLHSCCACWGRPFQQETQTHGPAAPTSFDGGIVRQPNHTIRPWIFCPGPVRLTSQLRDTERLRRAMSAAAFFRSAPCQRTGGEPSCSYAPSPQRASHRRSAARPRPALRARASAGGLSYKDAGVDIDAGNELVRRIQKLNPNIGGFSGMVPFGDSFLVAGTDGVGTKLKLAFDVGKHDTVGIDLVAMSVNDIITSGAKPMFFLDYFATGKLDVDTAEQVDGGVNL

SEQ ID NO: 16355 - protein, 743 aa, Chlorella protothecoides
  MOD_RES (358)..(382): Any amino acid
MASQRHVSSHDSVEALHPLGHDLVRNVQWSMQVSRARFLHHQGCTAAPSEISMSLQILHGDCTHLTTPSPAFITSSPPRHRSQDSAGEDPAPCSPPHHPRPRLGIRWCEPPPGAQYCYFLSCRSQGMWEPGDEVPSQPNTAGRGKSGRCQRGLAGMLAPEIFAVVSRKVGGVGRRRHSGPAGVQAKVVRHPRLGLVLCDLFKSPRSSDNSQGRAEGTDVLRQSTRVWNRHFDLKEGTCQVHGPAVGATVVGMQAEERFAHLLQPIRDLAANWNVKIATELDEYLDALENIAFTFEGGSSLNFAEVVGHLESTDSPTIAASSPAFPLISCAGHSGFSMCVQQKGRVSPHPGVPGIRVPXXXXXXXXXXXXXXXXXXXXXXXXXLSSVAAAVEGKNGAKKRAGTAKNDDDDDSDIEEDEAFLSLDDLEEGKNLDLDEGAGDKGTVAPLRPPATLLALTGIPQKEGDAAGFRVHSCAVHVSGALLLESADGMHLDAGLQPTDATRGVPGDEFGRPREDASGYGQPDAGGVPTADNPLEDDWGGQEYGGDYMDDDDDRGDLDGGYGGSPGEPDARLGVASAAMAASGKRSGELSCNPAACDSEEESEDVYDPYTPLDPNDSGPVAPKPLRKALRVRCWSWAAAGGRPVASSAQRPGTQQATESAAGTAVPDTAGGNSQGRSARWAVLPGVCLWTPKTGQDDRPGRADGQGGECVITGVVVSKICTTRNHRIQEPMSSFELGSGVETL

SEQ ID NO: 16356 - protein, 223 aa, Chlorella protothecoides
MRTSCSHWKSAGTSQEPRLTRALGHHPWDVFREPAPGHVYQALRMGFRGHASIGHLVRMTGGSAAQHALAHIAADLDVDGLRQPEHVADVDGGGGEQRAPHAVVGPGRGVAQAGAADLQHLSHQAEAVGVDAGGGQGQHGVAGGDALAVDHPRLQHGAHREAGEVVLAGAVEARHLRRLWEAGRLVRPREGGGSREQGAAQSREAADGRCTLSSCMSSYRAPQ

SEQ ID NO: 16357 - protein, 215 aa, Chlorella protothecoides
MGGYRAESAPTNGSTRSVEQQVLESNPLLEAFGNAKTSRNDNSSRFGKFTEIQFGRDGRITGAAIRTYLLERSRVVAVASPERNYHVFYQLCGGADEAEAARLRLGPARGFRYLNQSDCHELAGVSDAEEYRRTRRAMTLVGIDAASQDAVFAVVAAVLHLGNVAFVPGDGGDGSAVAEPAWAHLEAAAALLGVDAAGLARALTTRTRQTPDGVW

SEQ ID NO: 16358 - protein, 133 aa, Chlorella protothecoides
MTFDDLLKAHISRMIAAAAAAQVQTELASRVGGWRSRIGPVLEEEDARPAFDIHVYGQRVLDAMQGLSLREPGAAGGRLWAQSSRMRASPVPAAGDGTGVVHVSCVGGKRGAGYHVRVKDNRHVQHGREWGSA

SEQ ID NO: 16359 - protein, 253 aa, Chlorella protothecoides
MTKNSSIAPQAGVHTIGSRVWVEDGVEGWVKAKVVALGPTDITVALEDGTSRTCKAQDLPLQNPGTYGVEVRTNRALETCMLHCTLRTRSWPKGCKASTESCDDTWRWLAISALQQLAFSLSHPPPPSTPLHFQDMTTLSYLNEPGVLWNLRVRYDQNDIYTYTGSILIAVNPFAAMPHLYGAHMMDQYRGVGLGELSPHVYAVADSAYRQMRREGRSQSILVRDVECGAGGGPGPALDGRRRRDLCRTPARM

SEQ ID NO: 16360 - protein, 131 aa, Chlorella protothecoides
MDGGIASVVAGLVDVPVVSLDVAMSRCSCIRERRRDASRRWAVRVGNTANLTPRLASHHTSQVALPTSAGYGTAFGGVTPLLAALNSAAPGVTVVNIDSGFGAAMAAWRILVNAARVRNAVIQAHAAAGPG

SEQ ID NO: 16361 - protein, 297 aa, Chlorella protothecoides
  MOD_RES (260)..(263): Any amino acid
MELLQSVATGVMSASDAAVQLNAVTRPAAAAASEHGDGGGEAGPPRPPPALALSACPEVVWGEGKTPNQLLASLQRIAGKQGIAAATRVGPEAAAAVTGMDDRVLHSPAAHMLTLKTGPAKKLPGTVALICAGTASPQVVEECRLVLQAMGCYAFKLPESGVMGMHRGIGTISWKGVGQWERKMRLPSWRRRFQARVAQNGWTGDGGRAVITEQGWATSRPTSHLPLSEAGMHAFSTQHHLSAHTLQQSLSCRIVRNLDXXXXGMHAFSTQHPLKCTHSPTSPILQDRAEPGRRAGC

SEQ ID NO: 16362 - protein, 180 aa, Chlorella protothecoides
  MOD_RES (152)..(155): Any amino acid
MHIVQTGRSTLQAPQAHQSSLSLPQAALVVGSALQSTLTKADSWLEGRGVLGKVEQDTARASLTPKERKVLEKLQALRLDDRRVIAREHKREKEGRGVKAPWLIKGSYVFLCWVLDILYANRPIQVCVGDGGKEGIRGRVLRLGQGGAGGLXXXXGRKGSEGGVFCLGQGGAGGLGSRLA

SEQ ID NO: 16363 - protein, 538 aa, Chlorella protothecoides
  MOD_RES (19)..(22): Any amino acid
  MOD_RES (298)..(301): Any amino acid
  MOD_RES (371)..(374): Any amino acid
MSAEVHPQLHPHTLEQPDXXXXVGLRARASCISAEAHPYLHPHTLEQPDPTPLIPALLGAGNGGAHAILCLHLHAPPLRVPGVVEGGGGAAQGEARLMVFGGCGRVWKVWIGAAIHFAEEWNELHHLQIMETLGGDHLWIDRCVWVTSERVGPRAFNAHAACSKYDARICLERCDPECIPHPPTTSAVSSPSTPLFSITGSLSSYLSMKWLGPVCKKGIHARGPHSLNWPLEFLSLAHIPESCGGHLLRVPRGEQGGPAGHSSTPSGSHVLQVGFILPRRHAPFPGDLYLFDALHTEXXXXCHAPFPGDLYLFDALHTEWESGSIRRPECNQGGFDHVGPIGSMIKVRFQHPVTRFPLPLLCSNLYDVFVXXXXCRPANVTTHGQGGFGHVGPIVSMIKVRFQQPVTRFPLPLFCSNLYDVFVNIRDDELEHVATMKACAENTIKPKMDVSGEAEGGGWGTTPKWCCRWGEDRAGSQGSGGGQRPGNEARHQQREQQGGTGSDLKEECSEPANALMSSTGVIDACIRSTSLCLERLGA

SEQ ID NO: 16364 - protein, 159 aa, Chlorella protothecoides
MDKEAATELLLDGARYGDEDDVAHALDEGADVDAPGPTGSTALHMAAANGHTNIIKLLVKDGANVAAANSEGNTALHWAAMNHQVDAVRLLLEAGASPSAINGRDETPVDEALRRDYNDIMALINSFSAPGTDVTDTKGVDEFDEEEEANEPSAPAAQE

SEQ ID NO: 16365 - protein, 523 aa, Chlorella protothecoides
  MOD_RES (138)..(141): Any amino acid
  MOD_RES (302)..(304): Any amino acid
  MOD_RES (366)..(369): Any amino acid
MKVRGLQGGIQNLSCPSLRASPCLQSTAMLSVYLEDLAWPCPRDQGCVVVIEHALQVLPVVCPTGGGARSGQGDPHLVLDSECRRQDSPARARRRGPSVDRQLRARAACSGMLGLCSGPWAPGIEMEHLEHYRDFPSXXXXVGMAGVPSVPDSCAPGLTLQHYRDFPSCRLRTKADDGSCLLQRTDGGAEGQHRGGLLPRPGGGACLCAARISRQPGHRRPAPVAPAAPDRHRGAAAGPGGEGHGGAAAAAGRAGPGAHLVHRPAGHGQVGAWAQAGTAVPRCFLRAPAHQREGSCGLGRRXXXAPAHQGSCGLGHQGFGNCTLVPRCMPGWHGWAEEAVTSPAVPASGHRICMNTHSVCVHDLLXXXXWHGWAEEAVTPPAFPASGHRLCMTYPPCLSPRPSQDILPLPYPPPVPEELFGPLSMKALEHDEYKRKTTGYLPSASVAFVDEIFKANSAILNSLLTIINERLFDNGSVREKVPLRCLRAGEGSPTMPGGLTSLKGGNGLLIVCHAAPAACWVSF

SEQ ID NO: 16366 - protein, 218 aa, Chlorella protothecoides
  MOD_RES (160)..(162): Any amino acid
MPWSCLDVVPGSETPAAPPLAAAAVQAWLWRVQAMLPPHAPPSHPSSPDLKPENWLLKRSESSVHPENLRAVDFGLSTFHHPTAPCTERVGSSYYVAPEVLQVRTWVGVRKGRVQIACGRPCPAVLVLHQACLRSLAWGSRLPRSAVVRPLRPASPSPAXXXAAVLVLLQACLRSRAWGGHLPRSAVVPPLRPASPSPAAQLQPCAFWRTPFCPAAAA

SEQ ID NO: 16367 - protein, 793 aa, Chlorella protothecoides
MAYVLLSGFPPFWGSSDPVIYHRILHDDLDFGYEPWQAVSATAKDFVASLLRRDPARRATLADARAHPWIADAPALPSAPLLPEVLDRISAFTRQTRLHKLLLTVAARHLGGAALGALRDVFKTLDTDGDGLIGLGDLTAALRAAGVDLAAAEVAGLVDSLDGAFDGRIAVDEFLAAALDQRKVLSAKAVNAVFAALDRDGDGLVGVEELAFVLEECRVEVDPEALRRMMRGEGALDRSGMVSAASFQNLLLGGEAGEAAAPLAIEAYLRDVRRFAAASAFKKLAMLVIARQLDAAEVGALRDLFASLDPCGSGVLTLRQLRAALGGRVADPDLAAALEVLDLKRRGTHVDFDEFLAAALEEQQLVTETKMRAAFDYFDKDALGVITPDQLGSVLRDVGMQHGDVQGLLASAGGGKARQPSTLTYQDFRRVVLDQAPNILTVSCGGCFGGVELRNSGVVKCGDRVRRRSSEGEVSEARRRGGGRGAARSCRTACTSVEAPGWAPVSRHGPVHTPCPAYRHLPSLPPPIQTIASSAAVRGRRWTRGGPRARPAPAAAGHAPGPAVQPPARPPRRGRAGLRGRQRQLLGVGGHRQRRLPPPRHRPRPSAGCGQEGHAAVWHAARRTGLAPAQGPRRGGAVAGGAGRQAHRAPVHAAEAGEGIIAHAAARRRGPHLHHQLCQRRQHGRLLGGRLREEGPGPRSWTSKHVRWGNGHARGEMPNLGFLLGPVPSPLRSWGQLRPHADLCPGIVSLMMLHWGFTACNKSSGSISAAMARRTSRNHLGGHAYDMRMVDIV

SEQ ID NO: 16368 - protein, 448 aa, Chlorella protothecoides
  MOD_RES (206)..(209): Any amino acid
MMSRTITLALFALALSSLSAPCDARVPSRDLLAFHGRSLLEFENITLPELPYEYSALEPVISAEIMELHHDKHHRAFLAGFNTAVAGLIAAQDSNNVASIVTLTSALNFNGGGAKGLGLAYHGDECVVRRRCRATHRCVLVRGLWFVRATLGFCAHPPLAGWINHNLFWPSLTPVSLAVLVVSTTKMHTTSTCPSKWSHHHPHPFXXXXLPILVLSTTTMHTTSTRPSQWSHHHPHPFSQNYTELSGPLGEAIDETWGSFDAFKTAFNTATIGIQVRDMIVVRLIKSFQGSGWGWLAVNPATGVLSITTTANQDALQPRTGLVPLFGVDVWEHAYVSLASVRSVVVCIRLLVVASASLGLGQPPAFVSRYGAVHIWQQFGSTHDTVPFHPRLCSTSSTTMCVLITSMPSGRSSTGPRWSSGMRLPLPKSVIMQREVHDIFDVDAALVL

SEQ ID NO: 16369 - protein, 115 aa, Chlorella protothecoides
MLSCAASAVRSGRSTLVRDVGLRGMATGQDLKLPALPYDYDALAPVIIPEIMEIHHTKHHQAYVTGFNNALAQLKDAEAKTDPSAIVGLQSALKFNGGGTWRALPGVPANPRLPS

SEQ ID NO: 16370 - protein, 141 aa, Chlorella protothecoides
MQDDVTGISTHLWFGHADARRFVTALKPRLKAAATDTQRLLAEVIGLQVGSALGEPGLAVLLAEGADQATPPRLSACRYQHVLPSPIHPQHAIEAGLDSAHLADLLPGVWADFIRNADMSDVRPLGTRSIEVVRSKYSMQP

SEQ ID NO: 16371 - protein, 123 aa, Chlorella protothecoides
MAELVGDHGLQAQAPLLYPTPGRRAWLGLRREDMRARLGRFGLSGHHHLQPICKLSGGQKARVVFAAISLSAPHILLLDEPTNHLDMQARGSGGGRKGDGGYVCVCRFKGRRAHGSGDVFREA

SEQ ID NO: 16372 - protein, 110 aa, Chlorella protothecoides
MPIPHCPQSIDALAEALEAFQGGVVIISHDARLLQSICDDTERAEVGGERGGRGRAVVGGPGAFEACDCVISVWIVEDGTVERYDGDFEEYKEELIKEIAADMDEDEKAK

SEQ ID NO: 16373 - protein, 181 aa, Chlorella protothecoides
MGAIGSVAGCHALRTRPPSPPIPFGITNRWKKTLIVVSHDRDFLNTVTTDIIHLHDERLHYYRGNFAQFEEMYEQRRREVNKEFDKYQKQMKAAKRSGRANADKVAKEAKSKAQRTQRGKYEDDSSKAADAPRQWNDYTVHFEFPEPTELTPPLLQLIDARWEWLPVLWGSLIGEGGPPCC

SEQ ID NO: 16374 - protein, 167 aa, Chlorella protothecoides
MTSIRRLRISPRPLRQAVDLMPTTSHPTPQDPHQRYRFLRVLGTGHFAAVYLCSHLGTGELVAIKALDKHHPEFERHTALEEVRVLAAVQDHHNVVTLYEVWEDASYIFLVQEACLGGELFDLVVQNKAFSEQDAAKTIAAVLSMVSHCHARGILCRERGYKDLLGA

SEQ ID NO: 16375 - protein, 136 aa, Chlorella protothecoides
MQEFQPPSGPLEEQIKATWGSLDTFTAKFNAAAAGVQGSGWGWLAYNPETKGLQIATTANQDPLQPTTKLIPLLGVDVWEHAYRSPIMSLMLSSASPPSTLQYLQYKNVRPDYLKEIWKVINWKEAGDRFAAASKV

SEQ ID NO: 16376 - protein, 360 aa, Chlorella protothecoides
MSREGGGIAHSGIPFLPGYTVREPVSVSLLARGFEVLTSDLTCAHGPHRTGSLGRAVPLDARYPRTQTLSFKNGYAVADVPVASLKPACGPADHVAFPPAPSRIELSQATRPFVPAFVQYEHCVLRFLAWFKEVLPGILDEGEYIRKAVVSFWPEDCSLAIAEPRLPNSGLMQVWRCGVVGGTSLRGGKDGPCAALKGADVVLAWRTSALGARSVFGKHSTTCVLRIPTPALSSPIEACTWARTLPCPRRQPTVGQCRAPARQVCVVLMGPSCAGARPPCQDVCWTEAGPRLCLPPCADRREAPAESPTRLDEADFSAPQELVPLAPACGWAPGLTPLHAFSILCTPMPSPGPPLLRGVE

SEQ ID NO: 16377 - protein, 168 aa, Chlorella protothecoides
MPRATSTPRSRAMLPLWASPTSPRYGHVDPFQSLMMRSAPDMKHPVDRDGDDHLCLSVPGGTGAPKAPPPPISIQSELGDVVYVEVPEVGASLSKGANLGVVESVKAASDIYSPLSGEVIEVNSALVDDPAKVGRMARGRGADLPVTSSMKQWMSKIMRNGDRLYPCL

SEQ ID NO: 16378 - protein, 500 aa, Chlorella protothecoides
  MOD_RES (66)..(69): Any amino acid
MHGSFWGMPLPVNLEYLPRNSNHSWGKVKHWATSQSSTGCLALGCVHLKHVAPSCTLEHIDLLMNXXXXACGPFLHLGIHRLAAEGPRYACCNAVEDSPVVSPEGGWTCVEVLLQENPPPPHCTCDPLQPATLHFCIMADTLGQVVVALSSSGTLPTPVGQPAGTDRSPSKLRKASSTSVTSRQPDEPTVPYQARPVTSAVITHNLTAALPVMEGTRCDVRPERLPAGAGGPGATGHRGLPTEAGGPHGSPHGFHERNHKELGWVLPRAAPLTVPQHLTLYPYNLDFDYGPLEGLQKFCINNLGDPFIESNYGVHSREFEIGVLQWFARLWEIEEDEFWGYVTNCGTEGNLHGILVGRETLPDGVLYSSAESHYSVFKAARMYRMEAVKVGVLGTGEIDYDHLRACLAANADKPAILNLNIGTTVRGAVDDVDRVLAILADLGFGEDRFYIHCDGALFGMMVRFFGGGLGVTLRGIRERLGGELRRGLNPREGWADCRGV

SEQ ID NO: 16379 - protein, 506 aa, Chlorella protothecoides
  MOD_RES (69)..(71): Any amino acid
  MOD_RES (141)..(144): Any amino acid
  MOD_RES (415)..(418): Any amino acid
MVAEQGCPPLSHETHPPRSSIERRARAPDSDATLRGEECNCSPNESPETSWSSQGSPEQSQGKSRLLAXXXSPYSDATLRDEECICSSNESPGTSWSSQGSPVQSQGKSRLLAVTLQGTVRENNEVRPPNAHLGPNPAVEXXXXGLDDAENDEVRPPKAHLGPNPAVEPDGTGDARSSAACQVCGAPLEHMHFLEQVSHVKRCMGGRRAARRSAAAGPRRHASAPAPPRSLPDVLKVRGAGAEAGRSIALVEDPLPLLMMAQPSQPRSEHCIDQGPPPLAHDGTDLSTQIGTESHAHVGPNSPQAAGLSEHAPAFQRAEVTVDILHTLSDAELAELGITQAGARQRLLGSLTCRPAPAPVPGSKALRPLRQVLLPIQLPWNSPAPSAAWLPCADPVRDCSPAPAEASGRAWEAAXXXXADPVRDHSPAPPEASGRAWEAAALSPLRRRAPRARPIAGPVSPPRRRARLACLGPETQLPPGSRLVSPPRTLWHAAGTCSARGAGPSA

SEQ ID NO: 16380 - protein, 96 aa, Chlorella protothecoides
MVTFKKPIGSVSVSGHKFVGAPVPCGVVMTRLKHIQALSTGAARRPGDGGLDWGNFQRGSLLTPGRLASRAQPKGIPVHGEGCAVHKPACQAEPGR

SEQ ID NO: 16381 - protein, 157 aa, Chlorella protothecoides
MGPDPLPNPYSSLHRPRRFVISFFAADDTLSVFEPPAAAAGGAGSKFLERTRAYWVPGQTAVRKGGRGTVSSRTPACGAPRPLHARLSSYHLLPSQTLISEKDIWVGAVIPLAGRRFELLAADNFTLQHMELAAHPMARLGDALTTLGQALSGGRWL

SEQ ID NO: 16382 - protein, 389 aa, Chlorella protothecoides
  MOD_RES (160)..(163): Any amino acid
  MOD_RES (253)..(256): Any amino acid
  MOD_RES (362)..(365): Any amino acid
MMSVYERAGRAGEAVGMLRRARALGVRPNTVMLNTALSALGKAGRVDEARALFARIPDPDAASYETLVAALGARGLAAEAEATVAAMRAAGHAPRHYAYCGLVAAHGVAGDWRAALAVRRRMAQEGLQPNVHVYNALLGERVWCWVLVSFCSLGGGKGIXXXXNALLGERVWWCVQPGGAVGRLPGACAGDAGGRHSGQPHHGPGKTTWGRAGPGARPWGGNQGGGRCARPAQALLQVGVMPSNSTFSLHIPXXXXASGRCDAQQLHIHAPHPTHSCSRRRGVVARGLSTARLPWPPPCRPPWEQREWRSCRPASSDQSTVEEDEWKRRRPWLPPAASPSTSPDARSQAATGARCTMTHKPXXXXRLWKRMNGKEETLTSPRRLSEHLT

SEQ ID NO: 16383 - protein, 106 aa, Chlorella protothecoides
MVQEADARPLLSARLVPPAGGLQAGEVLTAVLEILAPYPLALIEVDISLVGVERVDTAYVSRDWRAGVPPLNTDPRRIQRHLLQSGLCAACQTDLANPELRRFVIQ

SEQ ID NO: 16384 - protein, 117 aa, Chlorella protothecoides
MQVEAALEAEEALAPGWRAGGRAWPAPLIVAEAREAVPHAASVGLQLALPRGATPSFCTPLCTLGWALRFVFTAVGQSPARDPGSTPWRGATEKLTWRLPILVVAPGGIPGEEPNEY

SEQ ID NO: 16385 - protein, 117 aa, Chlorella protothecoides
HFFDTPHRDRAADRDVGPWLAAALKERHPGAYVKYIDPSYLVRSVPTVSSDRTYCKVLAHNAVHAAFAGFTGTTVGLVNTHYVLLPIPFVTQAPRRVDPQGNQWNRLRAANGQPNFT

SEQ ID NO: 16386 - protein, 336 aa, Chlorella protothecoides
  MOD_RES (263)..(266): Any amino acid
MVLVRSALDAESQPCAWWPMPFTPRATHPCMQHTHGNVLVRATYDKTYELVVTPTQATILALFNDGEWSVHCLGGSHSEWDRRWMLFEQDGNLAWRAAERLLLGGVQDSLIQAGREFAPMALSRQHDTRYPAHSSFPALPVATSLKYIEIQEATNIDSDDLERTLASLVFAKHKLLSKEPMGRTINSTDTFAYNAGFKDRMRRIRVSRWVTRGGAGRVVICRGTLVLSAEGSGMGRVPSLMHVQSTLGRASSWSRRLNCTHPXXXXAANQGGPAATGGPAQGEGGRGQGPGAHHPSHHCAHHEEPEGDEAPGAAGRGGGPDPEDVCSRCQAGKEAD

SEQ ID NO: 16387 - protein, 387 aa, Chlorella protothecoides
  MOD_RES (8)..(11): Any amino acid
  MOD_RES (87)..(90): Any amino acid
MQIGRATXXXXSGSRHSTLLKPRVEQHQPAPHIPWSMPRADWEGHGRRSHGILLRFPAPQGGRHAWLQRGCTSVEPCCSAVSVSLPXXXXARWAPCVAAAWGSTSEKLTDDEVESLLDRDQAQQAVRAEPGVLRRRRCMEARLRCRLNNRVAQPACSSHFAMLHWETGGSKGLLGTHMASEELEKGVLIRLKQQCGTQFTSRVRRGFVGEGRDADKRGCSAGVTACRRVIGCTLPELAACPSMGGCRPVSLLFPHTSQGAAPPHLPCAQMEGMVHDLAHAKDKMEEFVRWQKKRGVTLPVELNATVLTVGFWPTFKVWGRGGRVLVGWNSKLQGSWTRQGTDPSMVGTIEVSPRSAFSNATEGQESLGAHGPDSLSNPFSENRAHPA

SEQ ID NO: 16388 - protein, 359 aa, Chlorella protothecoides
  MOD_RES (81)..(84): Any amino acid
  MOD_RES (198)..(201): Any amino acid
MCWEAFCQEQRPVDRSQPGVWPMSPAYDLTPGPKNHHSLNFPHCPPQKEDLARMFRLFGRIPKGLEPMAAIFKDFVESEGXXXXMLARGCSTEAANHTSRIDGGQGAAGRTAPAGCLTWLGRALSLTPITPPLPRHVACASGNRGSWVQAGQGKGCRWVGVNSRYLAVLGPSAVCGRQHPGQDTFSPRPTSAAHEDLXXXXKGCRWVGVNSRYLAVLGPSAVRGRQQPGHETFFPCPTSVAHEDLENHARVRSHARPLRPPLPVPCPGKAGKDGAAAPEHQFIRVAIDLHDTYSDYVVSYFGSASLFHKALKEAFETFCNKQVRYRGVGHGWLGTDSWDRLVPGLVPGMAHQAAGTPHC

SEQ ID NO: 16389 - protein, 167 aa, Chlorella protothecoides
MPSLACECVRGHPLHPCADEIGPGQVRIQIKAVGICGSDVHYWKHVRDMEEACVAVRKLLLAGRAAMLRALVQPRRCPSHAKVHPLNLDSQGRIAHFVVEAPMVIGHESAGQVVGVGPGVTALHVGDRVALEPGIPCWEHRLSRQAGFLQCMVQAHWGLIRQPATLS

SEQ ID NO: 16390 - protein, 592 aa, Chlorella protothecoides
  MOD_RES (295)..(298): Any amino acid
MGAALPVPRSGCADRGVPTAALSSSPSVQNHSTLSCHRHLAVYTSSRVPFETTSSGRHPSCAGAVSQIAAQCWTAVGGCTCAGRARRSLTLHTRSCKPSSFSSRLGEPTRAVPGDSTPGKTGVRMGSWAPHSGHLLVQSPPTISNADLRCTDKMTSFAMMRMSGAVRMARAGWVRQQIVRTPSTLHRPLVMSPLRAASSASSSESELIAGMRSKIQSALEAQEVDIVDAGGDGRHVEIHVVSAAFAGKNAVARQRLVYKVLRRGLAQTHQHGRWQGPGRHAHADLTIRPFPLSLXXXXARMRWPDNAWCTRYCGGAWRKLVSMGGGHLGGDAADGTCRRCHDHTDARGGWPVKQARLLLDEQTHSSLSHAPGSPCTLSPCPRSESRASLLTDHESRSGLDGVLPPGESKVLLRLLLGLGSSLCTKRGCVQIRVGLRHCFGPPSRQFHHRRGRQALGGDSANLTAPASTCRASQSYVLSQPWEPHLVLGEAAADGAGLPDTQVQGHVLLLGKGLLQGITLVLVDHSQHAGHRLPDHLAARMEGAQWEWSAPIPHQLPANMATSAGWEPLRHEQSASQDCPLESIEVATPQPTN

SEQ ID NO: 16391 - protein, 222 aa, Chlorella protothecoides
MLRLERTGGAVTSITVSCRGGGGGGDLYSPLKCELRACLGATHVIPLIRTVSSSQMTLAGASPPATCLASVGPSLLFLGSALGDSLLVRAEAAAAAADAHNVSMGGQGGAPSPHSNLELSGGEDEEDILERDGGEGPGGAAQPMEVDGQYAAPASAGAPASADDEEDEAMRLYGMSLGQEDGAGASRAAEPLRYALSVLDALINVGPIHSITMAGAGRGGQV

SEQ ID NO: 16392 - protein, 144 aa, Chlorella protothecoides
MRGGRAAFTRGPLAAGDPLGRCGAVVVYDNKLAVLPAMVPELLELDEAAGLAGAGRVPEAGTVGNSYVDDLGGALDIQERPGHPGGGGGGPGCPGGWFHVVGLLGRCAVQPWRRVLYGVPVLPVMRCAPGRLRLGAQWPSRRCA

SEQ ID NO: 16393 - protein, 161 aa, Chlorella protothecoides
MNEVGLLVWKEVVHEVIKSRVTDAILELVERERDGEAVDCPLLKNSLATYQEVGMGLLDAYEKDFEAALLQTTAKYYKRKSAGWLEAGVVGERIPCTEGDGWETQLFLLPRRHIAACLGAQPSTLAAACCSYTALAIPWVPECNSCTDSDSWLCCTCLHGD

SEQ ID NO: 16394 - protein, 168 aa, Chlorella protothecoides
MCEPLSVGIHACRRSGVSPGKRVLILGAGPIGAPGAGRGGAWLDPGLPAQLPRKMVMGALVRAGLVALLSASAFGADCVAITDLRQEALDLAQELGARVTQRTLHGETPEEAARKLKESAAPDGFDIVIDCAGFESTMQVRLSASGRLESGKARHGMHEQVPDSRGGE

SEQ ID NO: 16395 - protein, 188 aa, Chlorella protothecoides
MGAPCGSPGSGYYGRSLASLGTTLLHSPHAVTGEDWREAGKVRRPGQSPGGVLPICGYASAPGIFTVHAFLPLIAAKVRAHELRPKSKAELLGQVGRRMECRLKDLKQELAALRVAKVTGGAPNKLSKIKVVRKSVARVLTVINQNQRNALKEAFAKKKHMPLDLRVRKTRAIRRRLTKHQVGLPGLR

SEQ ID NO: 16396 - protein, 333 aa, Chlorella protothecoides
MGEGTYRGLTQALARHASVRCASLDRLTARDEESGAEVLVLTPRWGAALADCAARVEAGLFGAAPAGDGAWAGGYHGQSLEAAPPVSTSADPAPARDPRHAASSASGDSDDSNGRDIAPPPALRPLPAIGASSPALWNAGQGASSPSSGPLPTHPGPQATLQPPAQPPQPTTDSPATLAALAEARAALQDALAEAAGLRTSLQASRDEADALRASLGRLEGEMEGLSSAYSSLDSHAAELQAELARLRKREQHGAASEGGGPSEGPGAAPPPEDDELTDLLVCLGQEEAKVRMWMPGGGWVSVAPVTALFDAAAALGLAQRCMASWPAGALAP

SEQ ID NO: 16397 - protein, 546 aa, Chlorella protothecoides
  MOD_RES (461)..(464): Any amino acid
  MOD_RES (544)..(546): Any amino acid
GRPASRPREVPRALADRDALDALHPDGAAWGELAARAAEAQVRPELYCLAAGPYMDVASLDAFARGAAGSLRLYPGFHAPADAARLQDDLRWALARPAGLEAVGRLRVSTGLSVGRCWGAFHRRTPTDLHFPAIDADQALAGVFGYECEERPLSQISVPAPYYPLPLPLPKTIHSLHRGGREAGGAGGGVRPVRAALHLARRPAARARAHLGPAHHHGAQQRLPRCRHGRGAGADRAPSGRAGAWQGAGRLPRRGHGRCRGPPGRLSPARTWVGWSLFRLLEVCLCARKTGGGVVVLVSAFRWGVEPGRRPDRRPLSPDPHSPPDNPITRAGGAAVGHLAAAPARGPPAPPPLQPGPEQERAVQARRGVVGVVRGGEGSMLRRLWAAPRESLAPPSHPPRPLQPVSSTLPPGRNDARLDERALWLHRLLTCPVEAMASIVYPRLLPLHTLPLAGPGGGAPXXXXLSAAFVEAHGVYLLENGCAVLSCCGSLGPWCLALRACLAPLVACLPPTTRSDAIHPLTHDPLDPHKPPTPMRPGTRPASXXX

SEQ ID NO: 16398 - protein, 172 aa, Chlorella protothecoides
MSSFLQRRCCTASTGRVERQQPMPAIWHAVCGAYQTDSRHRSTVSRPSTRSMHRVCLLHLVHARQGNSSFSLGSTGLGARPADSPTPHHQAQVHPTSVRAPEGSPAPVPTHPPPANMAGQQGWLRGVVKEVLSGDTLVVAGAVKSGIPPEKRLTLASLIAPRLVRRCKGLSC

SEQ ID NO: 16399 - protein, 566 aa, Chlorella protothecoides
MRHFNVVPHSIIYHSTPPVISSLQGSRNKSTITPWVILLWGHLRKPIAPTEIDAWAPLLASRGLYLEALRPICASPTTAAVPLAPEPPGAVCQELGNVSVSDCTWWIPHGLGRSEAQDGPPAENADEDGAPVAPRTGRSAMGPAPPAVRRSPPTGGGRHSHAGSSWPGRGGVGGDAQGWHCSSRCMSRWTTRPMYLPGGQGGLLPAIGAPRQCAHDRRLSTLSTASGSVVPSPCQTDGRCSPQVPAETGSQHAGARSHGSGDRGASPPTRTPRIPPTIHQMLGLFEPDWRRPRHGPIDPLRLDFPGLSADARAAMRSWQVLNPRHAYRLWDAADVEALVALHYPALLPAWRALPHAVERADLGRYLVVHRHGGVYADADVAALQPMDEVLRPGDALVAAWENVIPLGEVTEREFGRHAQLLQWWFAAEAGHPALAALAARVAAAANVTFYANPRRDTIERSGPGPFTDEVLRAAVAAPRGGAAAGAPTVTVLPQAAAGFQWTNGARSLLPRSSLHLFAGSWKENPVKDGPVKEGKELWNVQRSEGEGQAGGSEQQPGELPTPAKPL

SEQ ID NO: 16400 - protein, 153 aa, Chlorella protothecoides
MLLEENPPLGFSWRAKRVRTGLPEHPRTGEPSLIPRAAPAPVVALAASAKSPNQGLLALCEAASSAGNDDGEPSSTSTVSAPGLQGPPGNPGPPPVLIKSVTASPFPGTPTSRGPGPGVLLTKKKTAAYIGVRRRPWGSYAAEIRNQITGARE

SEQ ID NO: 16401 - protein, 153 aa, Chlorella protothecoides
MLPPSLHPPQTDAQNPALSQWRLSTSMFGQEWSLSWLSESLPNKPHTQMQWRSVPGYKGPGGSLEVPNRCGSHVLSCAAGDVPFKGCHEGSKVPHHCQLIPPFLATTHQGPAAVPALWPRVMHRGADHRLRGPRPVAALCQRADPHRGGHLAH

SEQ ID NO: 16402 - protein, 374 aa, Chlorella protothecoides
  MOD_RES (163)..(166): Any amino acid
  MOD_RES (253)..(256): Any amino acid
MSLRYILLMQRDVAAAARYYNEGLGLPLKVLTERWAELQSGETTIALQTAPGEAYCTTGFSPVLSFNVESIQDTLTRLLTMGGRMDGKIHHSVYGKFLLATLDLPVSGCLHPRTRWAHDQLGRGRLTDMALGCDSGPSSVLGLQSCSSLDCAPAIAGFGVFLXXXXMALGCDSGPSSVLGLQSCLSHDCALAIAGFGFFLEESGLLCNSDLVEFALSLTHLRLPAGTIHTEARSLPRPILGVQKCYLVGYSPXXXXAGTIHTEARSLPRPILGVQKCYLVDILLVERRDRETSKPWRSPPRVVTRSTPRFVERFGVTGVAPWQGGGTALKVGLASHPAAPRHHLSSTSTGGNRLTEMSPGRRGPTTPWPSPTLS

SEQ ID NO: 16403 - protein, 504 aa, Chlorella protothecoides
  MOD_RES (93)..(96): Any amino acid
  MOD_RES (458)..(461): Any amino acid
MRTGGHLASPRGTVDVIQNRARTVAACREGRVSNICSRHERSDLVGIGACDHNLSCRKLGVLGYVTITCPVSSWGSWKNSNLSPTSTGLVHGXXXXVRVPFTSDGERDPRHVPLAGWSTATCTPHGEQDRPVQTRLRARDRCGLRRRTEAPDCCSIPAPPDPSRPQQKVRSHNATTVARYEVPETMSTTATSGSIGGQPSPIKTGSTEPLQRLDTAAVAKRLQQELMSLMSSGEKGISAFPQGDSLFTWVGTIEVRPAHLARSSLILEDSTGPGAGALPECQCCSCIAHGASGTVFEELTFRLSLNFGADYPFKPPTVKFETPCFHPNVDLQGNICLDILKEKWSATGSSPLTTTPHCSRIQRPDCAAVDPVAAGGPKQRFATKCPGSQVVGPGPSRVSPGDESGGGLDGDEDLQCCQDVLRLLSDAILCSTVPVASKYTLIIQLGRTDSKLTPGARXXXXVLRLLSDAISCSTVPVASRYTLIIQLGRIDSKLTPGASRRFVL

SEQ ID NO: 16404 - protein, 198 aa, Chlorella protothecoides
GAPKARLTSSASIQSHASRFLHPFARPLLPPFSPPLPSQPTESLVHALHQITRALPDLLPRVQELLLDLLSLVLARRTHGALTPPATVAALQAALAVGELQGQALTRMALQTFAQFRFAPHSLLEFIRDHVVPCLDNGEASIRRAAVLAACHGVEDHVEYGRRDGRRIHSSQLRIVDKVGGCGVWWWAITGGRFGGGG

SEQ ID NO: 16405 - protein, 325 aa, Chlorella protothecoides
MAGGSMPACHWTRPQSQSPITTPGQPLWCTQPPDQNNPVQIVQRLLTSAVSDLAVSVRKAVLQAFVKARSLASSLAQSEALGILFIALNDESSGVRSLTLQLAGSLGAVNPAFVMPALRRHLLQLLSDMECAPDTRQREDSAKLLGVLIGAAPKLVLPYTSPILACLVTQLGADRGAPGHDPGAAGHEGRLVGSSPSLHSLAGRGSTHGAGARALPPPKGGSAAAKGARPDDGFELFVLMTLGELARVAGSRLQPEVGKVLPLIIAAIQEDGSAAKRLVAVNTLGQVVENTGCVLEPYRMFPQLLGILLRMLNEGGPIVKREVMK

SEQ ID NO: 16406 - protein, 120 aa, Chlorella protothecoides
PAPAATPTPALAATLLDDGARIFDRYRALFALRDRGGEEALEALAGAFASSSALLKHEVAYVLGQMQDARAVACLKRVLGDAGEAAMVRHEAAEALGAIADRACLALLQQVESFRSGSWG

SEQ ID NO: 16407 - protein, 389 aa, Chlorella protothecoides
  MOD_RES (33)..(36): Any amino acid
  MOD_RES (263)..(265): Any amino acid
RGAGATGAGIGPDGPSLGPGARKAGAAGDKAAXXXXPDGPPLGPGARKAGAAGDKAARSSQFRGVTKHRRSGRFEAHIWVKDLGRQVYLGGYECEEHAAEAYDIAALKCKGRRGCKTNFDLTKYADLLGCINRMTMEELVMAVRRQSQGFSRGTSSFRGVTHHPSGRWEARIGVPGSKHIYLGLFIEEREAAKAYDRALVRLRGRGAATNFALGGERERECVWFVLGGARFVAGSWGLECGCAHPRTSAGPRSEIVCLSQPAXXXFGGGQIRGWEVGLGMCVCTFADDCRSEIRDRVSVSTGVAALIPPAPTPPSFTLPLQTDYKVEMADYHKMQARILGADAHFAEISSNPGLFERWVKGGCEAFPELGSNPSSHTHVQNIEGGGGKG

SEQ ID NO: 16408 - protein, 100 aa, Chlorella protothecoides
MAGGLFFFGAAVWWALFAALATVVVAARRRGLAYTVAWWGSVFPLGLLGLTALRLGTLLDVAALEVVGTVLSISTAVMWLTCSLMLAARIWDGSNFARAL

SEQ ID NO: 16409 - protein, 120 aa, Chlorella protothecoides
MDGGALPFVDGGDAGAVLRPPSTITTGWGCLKWRASALLPSHSEAGERPDPSLDKSEYGDLYKLTLDYEGEIVRDMHVKYFDTIPPASSICVMRKGFLFAASELGDHALYQFQARRGWTC

SEQ ID NO: 16410 - protein, 96 aa, Chlorella protothecoides
MEGSEHVHSQLRGPSTPILTRIPQDPTGEAASEAQKHLTLYELDLGLNHVVRKQSDPIDNGANMLVPIPGGGDGPGWKGSWGVFCGWAGALMGDAP

SEQ ID NO: 16411 - protein, 142 aa, Chlorella protothecoides
MWTAEQPSSARGFHKHTPGPPSGNPTPRRIVPGEHLAVDPKGRACLIGALEKQKFVYVLNRDNEARLTISSPLEAHRGQTLVYSVVGLDMGFDNPIFAAIELDYTDVDQVWGMGARGRRGPGLGCTESGGRVLLSWRLSRAA

SEQ ID NO: 16412 - protein, 99 aa, Chlorella protothecoides
MYLYNLTLSRASAITSAIYGNFSAPKLQEIIVSRGKVLELLRPDENGRMQTICSTEDYVICGSDSGRIIILQFSKEKNAFVKIHQETFGKSGARWAGGA

SEQ ID NO: 16413 - protein, 142 aa, Chlorella protothecoides
MTSRPSSSSALVPKQAYRCVAVQVATFPGYFLPLASHLLHVKLRHWEKALRELASLALADLTRVDADWLAGTALPTLLPLTESADLESRHGAVAGVAELVAALPREALTPFHADLAQILPRIDAAKLNRGKGGEVMRTALCR

SEQ ID NO: 16414 - protein, 424 aa, Chlorella protothecoides
MDAAAGRVGRIASHLQGESPSQEGVDNAPTSADAFHSQCYNYEPGRLLMNQVIGVRVRHRDWEHTTTISGTGAVSRCGGVGFCNVWGETSRRSSHWPVSPCAGMASFPFPFIPAPSPVQVAIITGAGQGLGKAAAILFAQHGAKVVAADLEGDKAQATADFIRNSNGVAIAYAGDVTHPDFPAGVVAAAVGAFGGLHILVNNAGFTWDGVIHRMGAKQWQAMLDVHCTAPFRLIQAAAPHMRDAAKREIEASGKARPRCIINVSSVSGGRENAAVSGPGAQPHREPRTAEDQNSGSSAGRKESTHGSAGQANYSTAKAGVVGLTKTVAREWGTFNIRCNALAFGHINTRLVQAKERGDSILVDGERVPLGIPGAVMKGARVEDMVALGRKGSPEEAAGSMLLLASPYASYITGQSLEVTGGGWL

SEQ ID NO: 16415 - protein, 522 aa, Chlorella protothecoides
MATLDDSNVARLEAKRDFADFLDSDYGRDTGEGKYVKKIEDMMKKYPTTKTIRLDVDVQGGAFRWGVVSGQGWHWARPVGTSVLPWHRPVCDPPLENSPLQRSSCPVPRPRSLRVQSRPAPPCLGVPGRLHSSLCRGPGGHDPQPEPQGGAWRVGGETMEKSVCSIKECLSNSVCSAQESVFSVIALDTFTRPRHPEEDLVLLEEGQRVHVGFSGEFGRHAVSPRDMNSQVQPHDPSLCMTVKTPLLTTFVPLLPPSSSCPSWCRCRASSRAAPWFAPRWSRACTGALPPTPSPAASIATPAPSRACPPAPSTPRATSRETCCRPRWGVGGGLGEVGMGDGMGRGEPEVIPGGGCSVRDVRHSQLMPGTAAGNLHTRKTPPVPLPPDAYPFTLQYGMSSFVDHQTVTIQELPETAPPGQLPRSGGWIGRQGDVLGRRPSALAAGCRGRPIPPHARAIPAYALLLLFDPYLLFPLASPPQSRWCWRTTCVTPASPATGSGSWVCTNPSRPPLPAPAPLCLGGF

SEQ ID NO: 16416 - protein, 92 aa, Chlorella protothecoides
MLPRREQHRLQLREVIKEFQRFPGDVGSSEVQGECQGYYSWWSGMYMFTSTMVQASNLTLFGIVMLRYEIKCATLRSVSLLSISSQTKAPVP

SEQ ID NO: 16417 - protein, 377 aa, Chlorella protothecoides
MYARQGYATTSRTDCGVCACLHARLLTSFLGHPVWAHMSRQVPVPPEALAALPPAAMARGGASAREELVEVSLHSSSAGAGKTAAPGPLLAAALKRRQGSGGQEIALTEQRIGALAGVRQVSGAVGPSPSPSRAWTSGSEDLPAAPLVLYGGEGRGGGQSEGGGGTAAPVTGWSEGLGVPLEDTPEPGAFPDPVLALPRREQGCRNSCHTQSRMEMGQLARWPTAARDKDVFIPGRHCVCWRTKSIIDMARREPRPSHQAPPTAWRTVVAASSTAASGIHRVQVRGGKSLPAASPSAVPGADATAAAGLEEESGLGCTSASATLAAVSGAGAPAAPFAPRAPSGAARARRRLTSSSIHAGSIGAGSAAPPGASAAGP

SEQ ID NO: 16418 - protein, 195 aa, Chlorella protothecoides
MANSVSRLAADATSPTFSGEDYDNIVSLSQDPGLMECLAGSLAPSIYGYSWVKRALLLLLVGGRERVLGNGTHLRGDINCLLVGDPGVAKSQLLRAVMNLAPLSVSTTGRGSSGVGLTAAVTTDADTGSICGMHGQAWQGLVGVRCTVEPAVQELEWYLLPPSALAPLCPHGEGLLLIPLLLATPAQQPPTHSRR

SEQ ID NO: 16419 - protein, 373 aa, Chlorella protothecoides
MVLADRGVVCIDEFDKMNDADRVAIHEVMEQQTVTIAKAGIMTSLNARRARCSLPAPGTVPLLPHSDCPSSTPHQTHSVVAAANPIYGHYDRSISITRNIGLPDSLLSRFDLLFVVLDNNDAARDRQARRLCGILVSAHPRLSSPSTLPAQIAEHVLGQHRYRAPGDDGRNGGDDRYVEHRVLVDSTQNSQPGHPGRRFTVAPLVLPPLWTIEPSPPTLSDAPCTNAVTPSPTHLAPSLEEDEDRERGITPMYVRYDARLYGPRQPGKREPLSIPFLKKYVAFAKQRFAAPELTPEASDAIAEYYADLRTSPEVKALPVTVRTLETLIRLSCAHAKVCDVTGGWGGGRVACCGLDNSRFERRVGVWRASGGDH

SEQ ID NO: 16420 - protein, 205 aa, Chlorella protothecoides
MSGQKLHSPGAKAMFTARAFRAPKLPTMPHVRAAATQAVDAPAKTAQQGSCASDWDGFSTGGCPIHAHGLAGHCHPCLPFPLAGTELEGGVTVVTGSSRGIGRAIALRLGAAGGRVVVNYAASSAAAEDVAHQIEGLGGSAIVVKGDLAKVCRRCNALRVWEGWGGGWLGWGADLEPGPGWSREPGKHSIPGLSYSHLCSGLRRD

SEQ ID NO: 16421 - protein, 502 aa, Chlorella protothecoides
  MOD_RES (131)..(133): Any amino acid
  MOD_RES (212)..(215): Any amino acid
MRGLGAVLRLPRLGLGGGLSHTLTCLPLLLAPDQPQSGTASGVMEIDMAQGMPTRLCAMCNDDWGICLLYNTISIIIRWLEAGGKRVQRVLDDEAAAFRHYMEGTEFLQASLLESMLAQLPDQQATEPEAXXXMDTPGKTSSGLMETDMAWGMPTRLCALCNDEWGIWMGCIAVATGRLLTPEDDPVSLRRQSNSAGDQKASLTGPCLCIPXXXXRYRAPANTRGRSCFLEKTSNPAGDQKASLTEPESVGGHEYLTEQSAEAPHRRYLRRARAGGSVEVLLDEGVLATEYGDLCSLIQAGQMGSCWDKMKLSRDGSSIAYTVDPGDGSERLQVHVQRIGSAGLGTRLPQLEGSVSIEWSHDGSHLYCTRADGLGWGVLAEQVQPDAVLRVIWGRQPSSPARGAGCCLLAGHRQDQGLEVPGGEQQRQAQQRGPSTGLGGRGGTREPPPGPPTLAGAGVLCGACRRGTCVCWHALGWGVLAEQAQPDAILRVMWGRQPSSPA

SEQ ID NO: 16422 - protein, 236 aa, Chlorella protothecoides
MWVPACCGSRASRTTSEAAAVAPLTEAPAHQKAGLPVRGVSHPKTAPLASAHEEVIGNERSLGSLTAWQLLAEDVAAHPPSRGESGGPDRSLLPSPSSAHTAAELILGSPESGRGSTSHRLAAYELLEEVGSGAFGTAWRALRRGDGAAVCIKQLHTGSMGWRQQQAQRVGGLPCGHDGDGVTRAIAEAVRPGNQAEPRQCRCDARLAIPALGQSILQLLASCFRIHAPCPPPDSG

SEQ ID NO: 16423 - protein, 76 aa, Chlorella protothecoides
PPPRKSPPPPPRKVAPPPPKKKAPPPPKKTSPPPPKKKSPPPSKKKSPPPSKTKSSSSSRRTSPPPPKKRPPPPRK

SEQ ID NO: 16424 - protein, 407 aa, Chlorella protothecoides
  MOD_RES (54)..(57): Any amino acid
MVPTPWPGTGHWSLCPQSALRSPALRASRHGHSPPQPPSLHPHLPYPQHAPRSXXXXTAWSQPPSTLQPATPSPLPSTRTSLPLPPAGQFPHLEVNPFPEENDWFTRDTEVMPLTGAPEPKRRFVPSKWEEKKVVKLVRAIRRGWLKLGAPPAEEADKPYLMWQDDGQASSRTGTGLAYIPAPKPRLPGHAESYNPPKEYLPTESCRTAAAACGSPSPPPHPNKQNPTRRVVPFATDPPPHNPFPPFLPPTMLRRSWRPWPCSRRRSAPPLCPPPSPPCARCPPTRPSLRSASSAAWTCTCALAGGASARPSRTPACWSRTCPSRATCSPFPRQRACASWATPQPSRGWPPTPAARGWPPPPATAACGCGRRAPAAARRAGTWASCRAPSWGGAWPGWPGARTPRCA

SEQ ID NO: 16425 - protein, 205 aa, Chlorella protothecoides
MSPKRASTGARKPAKNEERPPSEVDVSELVLSSGSDTEEEDVEAFSGDSDSEADVEHEIDHAVKDYVGALRRNVGNGAGQPPTVDASEEDEGREEADEAGFVTSESETGTDGEMGEEEPASPRPQDDPASDSSEDERPGRNTVGNVPLEWYDAEEHIGYDKDGMKLVKKGRKDKLDTLLARNDSTKARLAGELGSGHVGCMGMLD

SEQ ID NO: 16426 - protein, 268 aa, Chlorella protothecoides
  MOD_RES (176)..(178): Any amino acid
MVSRVWCYSLLSSGSGHQHHAGRHSRPPPARTWGFPRAERSWSWIAGGIPTLPARGQFDRPPPMLLNHDLMSRPGPRSFNMQLGACGTSRAYRTPISSATHRQNIQPRVRFAERTLASRTASRGKGHPRVGAGKATPVTSKPANKTATPKPLELEPVPLPFTPMLYTGSASPLGAXXXLWLLPRVPLPFIPMPYTGSASPLGASPAEGGVNFALAAPHATAVTLCLYNADNSPLQELKLHSTGAGRECCTSHPLLRSSGCSADWDIGE

SEQ ID NO: 16427 - protein, 664 aa, Chlorella protothecoides
  MOD_RES (175)..(178): Any amino acid
  MOD_RES (280)..(283): Any amino acid
  MOD_RES (540)..(543): Any amino acid
MSALLPPHAVPVMGDAGFKQKFATRLAGSSDLYNYNKRWVTGGVAWLPPFLWLWVRVQLPCLCCATPSSPAPCRKASDSINFVIAHDGFTLADSVAYNEKHNDANGEFNRETTSLALSAVGGSQPLKTGLWGQRSSVGNPATCCAIPSPMHPHLRKLEDEERQLLHARLAGSASXXXXIPLPMHPHLCASFHIGDGTNDNFSWNCGVEGETSDPGVLALRARQMRNLHLALMLSQGTPMILAAAWRCCSSQMPPVPVGRLAGHLLGQEWPHTAYHLGILXXXXNGGFNGKGTVCRPLTPSRSLLETKYSKFVWCLQGMNTRRRGTATTTTTGTTPSSRTMTGRSWRRPSRAGGSGGSSGRMLSAICVCGLARNGGVILHAMDWWYARMQLPGAAALVECLPALSGGLLGTCLDRDSPHTAYHLGILKALQANQPPTPPPCHPPRFYAGLIHFRTGHPLLGRDKFLGPQDVTWHESSWEDPESRFLAFTLHDRWVGGWGGWERVWTPHLHVVVSSFQQAWKHGRGISESCGGSPCLLLCGXXXXDRASLSRAEARRACCSAAFAPLGVSPSALSQSYLTLLNPGAKGEVTSMPRSTPTASPWMWTSRCPPRASAGQGWWTPTSRRHGTSPQGCAAAPPVLRVLLAHGMDRGTRGGKRPVLEMDGM

SEQ ID NO: 16428 - protein, 230 aa, Chlorella protothecoides
MGSHGTPWRSCLVCLLAASTWAGVAARLAPSLNASADLLDLDAPHEWQPCARGLHTSDMTLCFLGGALCPAPLVGEEGPLGLTAPFHRRDPHKDLFPLNLRDIIGLTLASLALALAASGGLGGGGILVPLYLIVLRFDTYSAVALSNVTIVGGTLTNLAINIGRRHPLRDAPLIDWDLILVMEPSTILGAILGTYVNVRRMVGGDVVMDRPALTPNQAAISSASLAPPPI

SEQ ID NO: 16429 - protein, 157 aa, Chlorella protothecoides
MVQGNPLAQRRCLSQGGTCVRIAIPVPSSFTPPLATPLLSTLNAGGDDDPYLLSWRGINAGVYYQQDPASHAILNFSGCGNTVAANHPLVQDQILTSLRWWVEEYHVDGFRFDLAPCLCRGQDGEPLATPPAIEAMSKDPMLSKVGRRWAGGGPGML

SEQ ID NO: 16430 - protein, 201 aa, Chlorella protothecoides
MVTSCIRLPGRMSGINTLLKHRHPVAPAADHSGVDRRVHAARGRVCAPVCGLHAVRRRQQPARAEEGVDLAGKVAREGKRLLRPLSALSWGCRRLLCALMPGQGTRNLFLNAVPADRASATALIAFLQVAAYRLHRAYRGQALKLFEVVHRDYLARLNACEDPDARANFTRIKTFLEERAYLAEPEGRALPKFDTSSIDRA

SEQ ID NO: 16431 - protein, 489 aa, Chlorella protothecoides
  MOD_RES (15)..(18): Any amino acid
  MOD_RES (419)..(422): Any amino acid
MQRALPPRWEMVRVXXXXLSQEGNECSVLCPRGGKWETLPPNSCGPLPPLGRSWVARLGYLRGSDVAAVSRYWLRGCRPVGLSGPWSSEPCVVEGGVGESDSTCLLLLSNIAVWAEAWVGSIDGAQSQAGSIVGGIGKARNEWKLGCLSDRVGELIEPSRCNKSALPSVLAGCAWSRTGHAAQRQPAHPSACRPFAAQKALQASITQSSCRLRPSTGIRLAVKAVSSTEVEPVASAFTQLSAGTGRKYIMVSGKGGVGKTSLAASLAVRFAEEGHTTLVVSTDPAHSLSDSLAQVGGALFASWMAPVCGCACCSTAQGTEVALWLVLSHAHMCIFHNPLTLWTPPNHQDVSGGMPVMLEGTELPLWALEIDPEREKAKFKAYTAGGLEPIVRAGTGASSSKAQRASQCCLSIHILSGQXXXXTACFPVLPEHTYFVRAKHPLLCPSSPAARRWEAGGQGLHGGLWPGRPAGAIHRPEAGGVAGHPPSGL

SEQ ID NO: 16432 - protein, 305 aa, Chlorella protothecoides
MVYGATPFSHLPFIQKMHAIIDPSHAIAFPPLPNPALAEVLRRCLDREPKTRVSMRELLAHPFLRPVTAAPEGAGGMPATPAPRRGRVELSVEQLERLMLKLARAGVGAEGEELATLSQQVFSQLSAGLSPQLPSTRSVGRAARGGGSEAGDGAQRGVMTGAGPSRLAGGGAGTPDPGPGAAVSPSTDAPGSSAPGPQGSGVAAQAARAAASRAAARAVALAALESGASDGATSKTTAPRAPLHPISQTALATQAAALRRVNPQAAKPRAAEPAAGSLEDKLRRGLQRFNFEGVADAAQGTSGSP

SEQ ID NO: 16433 - protein, 245 aa, Chlorella protothecoides
MQVYKVMAPNRKIFALKRIRLTVSVCSFGCGESSYDGLPCRGKGEGCMDWGVLRFCCAKGRDSEAAAGFIDEITLLNSLRGKSNIIQLIDAEVSWEGGGKRWPLQSHRPRERGMVQALCRPPGKAGLIFSSASGHFPPCCLLDPRLATLPNPPISHPPSFKGVPGRGHNLHGAGVRGDRPRPPAAEARGGAEGTRRRRCIARRELHPAVLGADVASEDRKEGRGGLEDTAKAEEPGFRRCLGVQG

SEQ ID NO: 16434 - protein, 808 aa, Chlorella protothecoides
  MOD_RES (9)..(12): Any amino acid
  MOD_RES (210)..(213): Any amino acid
  MOD_RES (474)..(477): Any amino acid
  MOD_RES (620)..(623): Any amino acid
MEGWEAGQXXXXSERSGGGRGIGGGEEKRGNIQRGDQGKVGTCGRMEGWEAGQEGRAKERLAWWKGLQDLPGGPLPSVLAFSCDGQPEGGLLVRQGADLDAMAAPDRWGSEGARGIGGRRDNRVTMCAADTVLGARLGLLGGLAMALIVSVSTDAHAAPCPSSPRSMLYELTGVVAHVCDADESLEWGTDLYEGHLVAHIKVRAGGPCVXXXXSSGARTSTKATWWHTSRPVQGPRVLCVDSKPSLAHPPHLQAMHACTSRQSGVAKGTGTWLSTGLRPWCRPTAAPSLVCRFRGSRALAAGKVVRQRRLGPLPQTLLGSRLHTRLRHPPRPHHQTGGSSTTSASSPCRRPRRGSCTTARRCRACSSTRGGPWMPRSARLECTRRRGCWIRAPPRCCPRWASRPSAASHPWWVGDGGDGGDGGVRSGRWWGAGLSQPNGAHRHALCARQRRHQTSALVRTSLHPHNLTTAPSPXXXXEAPPNLSAGENPTAPAQSHHRPSPTRNRVCGPTCGRRPSCRWGRTSCRGRACCWLWTPSSCPTARPSTAWSGAGRCFGAGGWLAGGEVELHNALLEGRLPVQGPFGPDAAAHRSTPPCSRGSMHRPSRPLSIPWTSPPLHPGXXXXALGGRCTAPPLPSAPPGLPPPLRPGSRGMEVTTRPSRLGLARVSVVRGEGALEGTACIDDYIRSPEAVHDYLTRFSGIVPGDLDPARSPHCLTTLRRAYLKLRYLVDSGVRFVGHGLKQDFRMINILVPSEQVGGCLGVLQGAGGSRCIGDRGTERSAAHGTPTSRLRDRTRWPPLFATHRQTHA

SEQ ID NO: 16435 - protein, 86 aa, Chlorella protothecoides
MRQLSLRFLASYLLKTSIQSGNHDSIEDAHTALRLYKEYLRLEASGALAWTLDELYNWGKAFGWEPVVWKGGKPHPQGPAPMPVPP

SEQ ID NO: 16436 - protein, 178 aa, Chlorella protothecoides
MSVLEDVVALVCCADAVRNARQAIQARLREHGARVVQRLSKDVSHVVFERKHVPPSAKRAEPDADLLELYTKLDKGKVSRSSALLPSPPCCTSLEHLQSTWPQFALPPTVVTPLWVEHSAAKGRRLLEKKYIVARPKECLLAPSGTPRAASGGLPGGVRMCVCGVSPYTWHDPSLGQR

SEQ ID NO: 16437 - protein, 666 aa, Chlorella protothecoides
MAGTCSRPAQGGCCLGVGPSRHGASPPCGPGHAPSPTRSVDDHNHPLPHTPPPVPGRDCLVLMSTGSGKSLCFCLPPLLAGGHGPGVALVVSPLIALMEDQVQGLRARGVPAAALSSSLPTQQRRDLLADLQAPRPETRVLFLTPEYLATAPADALLGGLAAAGKLTLFAVDEAHCISSWGHDFRASYRKLGSLRSRFPEVPIMALTATATARVQDDIVSQLRLRDPVRLASSFDRPNIHYSGGRGDAETQSAGVGGGVCSAPAEVPAGLCPPQAHQDGPCSWMVVYLDMAASTPFLPATPAHSAEGTSPREQWVDDDPAPHVTRLLQQHRPRAAIVYCRSRELVESVALALARAGTAARPYHAGLGAAQRAETQAAWSARQLHVIVATIAFGMGIDRPGTGGVEGDGDVPGVQGCEDKVVGSGAQLAATLWSLTPHPHHTPPSLELHVDADTPPPPPPLPPSTDVDLVIHATLPKSLEGYYQESGRSGRDGSPARAILLCSHRDCGALRYLAALELRRAAQKGGGAAGRSAVGGVRGAGAGDASDDASRDASGPVVDYCLVARCRRRALLAHFGEWLTVGSGKAGEALGHGCCDVCDAPAAVALAARAAALGPGTTPRLARPGHTREGRAPDLLDFERERPHEGLDFEDDPDRREAACEVQRAQS

SEQ ID NO: 16438 - protein, 357 aa, Chlorella protothecoides
MVEAGVQAELESLRARLAQSELDKAALQSDVEMLCLQTTSNTTFNSSSVLQERIRAALAASQAQASSLGEDLRALKAAHRDTGARLRDALDRSALLDRELAFYQTSSARAARLEDAEGHAATQGAARLAAEEREAVLRAEVARLEALAAEAAKLPGLREELAAALRREAALERRLARAGEEAEDLRGRLEEAAQAAADAAAAYERQGAELEAERDTKRGAQAELESARRQLAGLEAELAAAAASREAADAALVRRDKEAVALEAGAAEARSSLEEVAAQKVSALLRLSEAEGLLARYKERVASLAASLEAARRDAAAGAPSGNDSAHSSPSKPATSPAKGRAVPGGGWWGRSNSLEP

SEQ ID NO: 16439 - protein, 289 aa, Chlorella protothecoides
MRRARSCLGRGLRQMMATPPLGVAQATEPLALSRPAVRGLASGTPITSRGVSVGGAPFEGAGVHLALTLGTGAGLMWYFGQQQEKKVASQATVGSKVAGAAAIGGPFQLMDQHGKPFSDKNLLGQWSLLYFGFTQCPDICPEELEKIVEAKNLAGSRPGGLARGRAVPAGHVPSPAGCVHHTPVRGCWCLALVLTTLHNALHLATTHAEKATGKSITTVFISVDPERDSVAQVAEYVKEFDPKMIGLTGTLDQACLTQGPLGVGMVDSRLIIGAMADCKGLIQDHVEHD

SEQ ID NO: 16440 - protein, 521 aa, Chlorella protothecoides
  MOD_RES (393)..(396): Any amino acid
MTGNRSLYEVLGLDSTATQLAVLLHPDKNPGDETANERFQTLARVYAVLGDEERRKLYDETGVADDLENPSAGSFEDLFDFYRSMYKEVRWLGELGVKRPGPVRIWSEGCQNLHPWVAASQHAIRQTQEAPCCVQVTEQDLDDFEAKYRGSEEEKADVLKYYDQFSGDMDKVFAWVMCSDPGHDAHRFADIIADGLRTSGEAPSKKFAAWEKKMRRRKAPDLATSVAKGGGSKKEKTKGNTSDLVALIRRRQRATRRILWPSFGESLGLGTGQFWGLGGVVTSWHTRPSPSTHPSHATLRRSRRSGGPSFIDALASKYGVNPSGDPEPSEEEFAAAAARHRDRAAGQGGGTLSATVAGRAPHRSGTQGSAGMWLGRHKCGLPLAFNSNLPTRXXXXKSGEGLSPQRGREGATQVGHSGVAGMWLGRHGVASLWHPTPTSRPETSTLAGLPRPEVLLQALSHLRRHHVLPEKGDKLALGVEQVGDNGVVDEVVLLIPRLAVVHAVCARRGVGLRGGDISRVR

SEQ ID NO: 16441 - protein, 324 aa, Chlorella protothecoides
MTSEAGPLPEASERNSRDASTSKPSADPEGSTIVFAKRRNRGSIRKKPTSEAGGEGAEAGEGLAPLIKRPARTQAPAQGTEQPASGGRPFAFESSNTLQQSQDGGATRNLETETAHDRDARLVGGRLHDVGVGNSIVLPVRVCMSSASWLQAIIQYSHAMPRTPGSQASILHLRHPFLHPSHHPRALREQVLAQQAEEGGAEGATYKGMNNYRDYRAGFRREQTIGAEKGGGAHGPLRASTNVRMTVRVDYQPDICKDYKETGYCGFGDACKFLHDRGDYKAGYELDREWEEKQKRERERLLTNWAGAGEAEASGWGWEAEAED

SEQ ID NO: 16442 - protein, 117 aa, Chlorella protothecoides
RGPRWTATHPCGPAAHLYLARHGERHQALCSTCDACQRNKPSQGLRAGLLQPLPTPDYPWQHMTLDLITGLPDTLPGYNVVVVSWIAVPSWQVGALRDHHQDCCGGGLAPTPVELCI

SEQ ID NO: 16443 - protein, 119 aa, Chlorella protothecoides
MRAARATGRRPGVQAHNALLRTLAGGAQWRHARAVLEGMAGGEGPAPDAASFAALILALERGGKYQEAWEAYNQLQARGCGSLCVGWWVWVGGGLIKWLQGALMKLWLNSGGCLALWVP

SEQ ID NO: 16444 - protein, 452 aa, Chlorella protothecoides
MSLDCSHPDCGSEWGAPGDLPRRRGRWAACGGPWMSCDAITFVMDDVNRTGGEMLPRLSARFCTLRWEIGPYSPPQQHRPSRQSLVTASRCPPCCAASPPLLTAGACALIRIHPFDPPDQEAEASNPQGCKPGLKLDHLRSTMSSISNATPEDWYVITTLALPHLLYAYIWFNSSTWLKTFGKKSVQRFETAAWLLKGTSPGGEASGGRLCWNPSLESGLTCSQPRTPHLTLELAVLQFSSVIYWYSVKKPEGVILGSISPFAAGISLVLLAAGQVPGGCHLPWEIPRRPGTTCVVFFAVSSTGGCASCQTLLEAAHGTPPPPAPSCQALNIGIYRAIGHAGVYYGFKLGHKCAERVGGCDPGVGPGASRPGLACGLLDRPFVPFVGLLDGRDSEPMPRSSASPCFLKSSQSTASAVRCMCFFPRVLCSDKLFAHPARFHLTLCLFCFAEAI

SEQ ID NO: 16445 - protein, 656 aa, Chlorella protothecoides
  MOD_RES (136)..(139): Any amino acid
  MOD_RES (174)..(177): Any amino acid
  MOD_RES (274)..(277): Any amino acid
  MOD_RES (541)..(544): Any amino acid
MVGKGVAYPNANPVYARQLGHHIVTNSRPVKYTRKWWGKGSHIPPQTQCMLGNWGIILSLSGLPPFQGPSSTHPRSQLGQPGERGRPHQAGPRRAFHAGHDHDHGALQPPAGAVRGTHGHRPRVPCGAPAAGLEPXXXXLTTIVLAFHAGRLLLGWSLEDAMDKGWVLRPAGPXXXXGGYGAQPSHHACGVTLQGTRGAVGWTFFLGGVCQPDLADFVAAVSLGWSEEVQRPHSNRCGPSDPLDPRMHLNDTPHSLQPNSQEGKQEFWELWSLXXXXQVQRPHSNRCDPSDPLDPRMQLNYNPHSLQPNYQEGKQEFWELWSLFNIHDFKLDGILVSAGLAQIGKVSGARAACYALRDGFPCSTGVMKVGIRHSRAPAPPTTPCLALAPQLAGLILVVCFGSCMDVAAIQQDLPERIDFDHELVTVGEQGIPEAWAMPSRVPRLQLPFQSPRSLQCDHRADWHWVLRQLHLQVRQRMSEVRLALVPHSGACPASDARRLRIQRWTRGLLLMDVWLGSHPRAYPTTPPFPLSTQQPDHLHDXXXXRCPSAQNPAVDSQPAAAGRMARLASQGIPHHPSLPSIHPTARPSSRCGRASSAAGTGSWWRPWSSPSSSSPSPSSRYAGWRSFVAKVCSGLTPRTLGLPPGCIWSCGLHPAA

SEQ ID NO: 16446 - protein, 119 aa, Chlorella protothecoides
MPNFFFGALLVWFGVEISRDWLFLSFYKLTRIEYGVLWLTFAFVMQLGLEGGIFAGIVLATLYFTYAYAQSQISGLRIFHTMTSNVVRTSEGGGGAWGRGGWGATGLLDCRRCPAHCSA

SEQ ID NO: 16447 - protein, 611 aa, Chlorella protothecoides
  MOD_RES (246)..(249): Any amino acid
  MOD_RES (357)..(360): Any amino acid
  MOD_RES (481)..(483): Any amino acid
MLFGSDVSQEDAFAQLDAAHEAGVTCFDSAEMYAVPPSAATCGASERILGAWLAQRPQARQGACVATKVSGPGAMPWLRGGPSALDPENITLAIEGSLQRLGVDCINLLQLHWPDREGPEGVLGGTMEKREARCSTGWWTQETSLKHMAAPAWYRQGWLLSTPTPLFTGKMPGIERKAWRLAQVALPQSLSAHRIALHALASDRPHLCCRCHATTHRNVPMFGKVRFDPTGDYPSCAIEDQLAALXXXXAPYRPTCPRIKQTPLRHRGPAGGPGRGSCGGQGAPCRAVQRDTLGPHALPGRGRDLAASRRLAAVGLQPDLPLLRPRAGGVLPPGGRRLHGLQPPGGRPADRQGEALXXXXRWTWMCMEGLGDVVGRAGLGGARMGTIVFSGQGIRGVRADRLAAMTVMVACSGLRGAGGGAPIPGLLYRLGSECFMITALRQNRTERLPQRWGHGRLHKFQPHEPPTLIPAPTPRLNLHRXXXRRLPKRWGHDSLHQLQPHEPPTPIRAPTPRLNLHRERYSEDGKRYARREPVVAAVRQYAELAREWGLTPAEMALAWVLNNSLVTTAVIGATSLLQLRELIAAAEGRPLDPGLLAACDRVHALSPNPTP

SEQ ID NO: 16448 - protein, 857 aa, Chlorella protothecoides
  MOD_RES (54)..(57): Any amino acid
  MOD_RES (274)..(277): Any amino acid
  MOD_RES (747)..(749): Any amino acid
MGAGDRSYLIRDGEINVMRNVLGGMEDAGVESGGEGRGLGGDPCTLSPLQLPGXXXXMEDAGGKRGGRGVGGDPRTLSPLQLPGVWVPSTLKAMSFALACSPFLPHSTAPAVKLSFGMPESGGTPGTGRRSTRRSSLGPAAASGGGSLTPSRALLMAAESKMAMLTPLRKSNLIQADIETGRVVSEWSFQKDGVDIPMDDIVGDTKASQVRGEGRDPGGSVLGVEQGDGKGSPGSGTWHVGVLTGTVDRQPALARQTPARQTPCALDALQLEPXXXXWHSGLPTSAGKGPADLPGPGHQPAGPLGHARPGGGGAGDGVADRAVCRWQGLCAQHQLHLHGHQRWVSGREGRVFLLSERENHPGRQSQSLGELSPSSWGRHGIDKTICPAALCPSFLKQGTLSNILHHAPPSGDGYVVVGSQDGRVRLYSESTLTQARTSIPSLGYPITDVDVTYDGRWVVATAAHYLMVVMTTYRPPGSEATLCGFTSRMGANSPAPRLLRLRLEDALRTVNKGFMSNFCVIGHASVAWPSRAMAGNVCAARRRRAFSRTQSDESLSTTHRPGLIPSQGNAPLQKGRFTWVTERGRQERWVVASCGSYTVRWNLRVVKTANAQTVSGGGLTTVDQYQLLSKEEHVVDSAFMHDNFARSEYLFLCRSGGEGEGRDVLRAHCVQGAAHEGGDLDCLVGQGLGNADSRLSRSTPVPTMKVISEACLHPQVMESPWWWLPTTMCTTSTMTMTALEMLPMPPXXXMPTMKLLTEACLHPQVMESPWWWSPTTMCTTSTMTRTALEMLPMPPSLATYHRYCASKTSLSWLAFLGRIVAPRHCKICLSRLSSGVQIGASTARVLAWEITFITRGK

SEQ ID NO: 16449 - protein, 72 aa, Chlorella protothecoides
MSSETEAAARAAASGAATSAQPTIFDKIVAKEIPAKIIYEDDQALAFRDVSPQAPIHFLVSMLELPAAQRPG

SEQ ID NO: 16450 - protein, 321 aa, Chlorella protothecoides
MSGQRAVVAKASKEKAAHGKLEAVQRDAAARLVALAGEVESSEGTARRIEANAELVEAALASVREALAGGLDWSALGKLVREEATAGNPIAAAIDSLNLDKGQVTLLLPDAGGDDAAAEATGEEEEGTAAGEAGRHGRARRHVAKVTVDLALSAHANARFYYDARRKHQAKRERTLAASDKAIKAAERKAAAQLKQVRLLGGVCVENLAGWNLVVHEGWAATEPNDLLSLRSRHRLCHSSCRMLTCCSPRSSACGARTPMPPFPKHSIALPSQVHAAPVAAIARKPHWFERFHWFISSENYLVVSGRDAQQNELLVKRYMK

SEQ ID NO: 16451 - protein, 160 aa, Chlorella protothecoides
MAPHSPPHHPSSSISGRSRSRSEPEGSASEGAESEADSRPGGDGPRRRRTELRRSRSRVDPHEIEDAEDQLENYYVKVDGMLRRLLMIAEHIDANEDLVEIQASRGRPAATSCDLHSPFCSATTTFQMDHRRNELVALDLLVSLVTAAFAWVSMIAGFWG

SEQ ID NO: 16452 - protein, 321 aa, Chlorella protothecoides
MKLLATLLVEYSAGQMACMAGLTVLSTIPYSRHQHCPLILCRSRKEPAPEEGGAQGKAGSEEDGAKHGDGKADDIARVFDAQFEELAGEEREEEEREEEREGGSDGHGDGTAIAPGTQEGEPEDDDACPEAQTFEPEAEAGVSVHADDGEPEGGQAGNVDDAREVAALLQEENIQLLDEEDRLRLTDLDALTGLPRPDDVLLYALPVCAPYQVGLAAAGCAVWGSEGGRCTVRRAVQPGTIVLTSYKFKVKMVPGPQKKGKAVRQAMELFQRAADTTGRERDLCRAVPEPEAVITLVGTVKIQAAGTQKLKQAMQQQKKKK

SEQ ID NO: 16453 - protein, 219 aa, Chlorella protothecoides
MPYELRALEVALATVTATLESEVCRLEARAYPVVDRLTTDVSERVPTSQLRSHESPVCPFARPASIAALLTPPLPSFWSRQVSTSVLEGVRQVKHELNRLQTRVQRVKQELEEILEDDDDMADMYLARRAATYGEELPAQPRDLPEYQQQPCAGYDGPEADMVPLLQGTSDGPTPIGQSEAGSQAHGPTPRSSPGSRVGFHPDPIVVDRGGRDGRYLAV

SEQ ID NO: 16454 - protein, 235 aa, Chlorella protothecoides
MSESSLPDIFADLVPGSKARDSVNDDSVLPSLKSNDRAQHKEGLKELDPALQSFLGKLTEGLQRVVESVDRCGEEGGLAVSCIGGVPPAPRHMCPPAPLRRLESLENRVEQTGRALADLQEVGAVRDDAARERFGGLEKSLREVHRCVQIIRDKQELASAADELRQLSTQSSGPSLAEVRHAADTGAAGAGEAPAAIGGTRRRPSGPPLRPPLLPQPLASRWPGSLRACPWPLRP

SEQ ID NO: 16455 - protein, 224 aa, Chlorella protothecoides
MQPLVVGFGLLFRVEDSCIAAHLGERAVKSGQDGEEDDAYVAANMRHAPLAPSEPAPGHEEEEEESPGPDPLATFMDSGLEALPSLGGKGQGGRGGPAATQDLQAQFQRYGLGERPGAGAEVYGAGPDAGLAQGGRQGGRAVRHLSAKERQALKAGTPGVEAGTGQRGGGRASTAAAPTVERGQGASTRRGKKVGGKYGDDEDAELARQALQSGGVDDGLCVGD

SEQ ID NO: 16456 - protein, 290 aa, Chlorella protothecoides
MSAGSTGEDLAWVAHVLTGGAQGERRAPVRQFRVTPRPGTPTRPRGGTSKSAGRGPLSRVVATSSTAVPQRPRPEDAEHGEKGILPGTVPRCFISHVNPHLTPDLRGLRCRLCDAWVPSAGDNWAVHVGGIRHRRAVASVRLTGAPGSHVTSIFERPEAVAGPAGRTDPAHPPGHAQAAGARRTPLLDTGTLLLDTQAAVALGYDGVLIERAQREAARSAGIDPAQARDLQRELLAALADVASLGDRRADRIGLEGWCLALHEIHDGAGGRCGGSLPWTRGRPMGGHASF

SEQ ID NO: 16457 - protein, 145 aa, Chlorella protothecoides
MPACDRGEPPFQAQGVQISERRRHDGICRHSHAPAQASPGKGGAGFTCTTPAHLLLAPGCSLAGAEDALAAASLRYPLVLKPCWADGREGAHALALVTSSAGLQGIIERGAQLGLALPALAQPYIEHGGCLFKVGTGSTMEAPVG

SEQ ID NO: 16458 - protein, 62 aa, Chlorella protothecoides
MPPCRSKSNQYTHTSLVKIDGVNSKTETEFYLGKRLAYVYKAKTEKKGSKFRVIWGKVKPGG

SEQ ID NO: 16459 - protein, 225 aa, Chlorella protothecoides
MASEPEEASTPAGIPGDSQEEDGSRTSSPPLPVGSDDAVGSAAQPPERESMEEAGPGGPDFVPPLPAGDGPGQALILHGTGASSDSDSDDYSTSSDEEPDESQLPPGPIDPSRCSATGPGFSGGSSGMPVKMVITAKDSAGRRIRDGGAYVLVTLDKPAPTGSVVVARAEVTDHGDGTYTALYTCPSWRVMGAAAFAVGAHVWEGGPVRGWWDMATVAQLWHPGL

SEQ ID NO: 16460 - protein, 336 aa, Chlorella protothecoides
  MOD_RES (85)..(88): Any amino acid
  MOD_RES (182)..(185): Any amino acid
LAGGRAERGREAGAEARPEDAVRALDALLAAAQQLHDLAAELGGSVGETIMDDAAAMVGGGVLGGVVWLANVDLMKAGKRWGGVXXXXRGGVLGGGGLVCKRGIDEGGEAVGGSARMGGHRAPGPDLWSSNGLQRRASRRRGLRRWHTSCWPPGAGGRPPPSLHAQESWRVMLSKDTRCAGXXXXRAGELAGRAVERHQECERVDEEAVRGLVSLQSSTAAFRAVAAAEAAAEAAALGDRAASDVEALALDPNAPTESAAGHAYLCDDWDAPQAFVGEGKSTARIARIPPRLEPIPVRPIVLDAALNYITMPSLAHRVAKKAGTGVVSRLFGWGER

SEQ ID NO: 16461 - protein, 734 aa, Chlorella protothecoides
  MOD_RES (161)..(164): Any amino acid
MDVIDLEDDSIDAEVLNSMAVTMDNFKTALGLSNPSALRETVVEVPNVTWEDVGGLEGVKRELQETVQYPVEHPDKFEKFGMAPSKGVLFYGPPGGKGRWERGEGGGWPPGVCGLMCMRLRQKGRLPRREQRYFPWLGLALERSRASACPPMLDVLECHSXXXXPPPPPPPLSAGCGKTLLAKAIANECQANFISIKGPELLTMWFGESEANVREIFDKARQSAPCVLFFDELDSIAVQRGGSVGDAGGAGDRVLNQLLTEMDGMNSKKTVFIIGATNRPDIIDPALLRPGRLDQLIYIPLPDDASRRQIFKACLRKSPVAPDVDLDLLSKVGVVRGGSVWAGRRGWCLDIRGRCRVVGGWEVSPHSGLGREIEAQEDGMWRLLSGVGAPAATREPETLTVHSALSAEPAEVLLWRPFEQPPRNITEICQRACKYAIRESIEQDIRREAEHGASEAAGELMDEDMPDPVPALTRCVWAGSAGCGSGSRTGSGVWRSVWNVACIVFVGPGLSGIPCAVADMVARPSGQCFRTAHPSTRPLHNLQGALRGGHEVRAALGVGRGHPQVPGLCADPAAVARVWVRLQVPRRPGDRGRDRRQRRGRRCRPGLRWGRGRRRPLCLRSGAETECPCEDGTCDHGRPALLCVWGMHWSHWSKHDHDTDRRDCPQTLVGVGQEINSEAHEGQLGHPFLWPLRVPSCQSSSSTVRALIPGRLDPVWLHSNEQVAGLYRRCHARC

SEQ ID NO: 16462 - protein, 467 aa, Chlorella protothecoides
MPSFSTTPSGLSRPHPHIHALIVHAPPSHPTPPSSQMPQGRPPHTHPLLNTRQTSHLIQALLVLALDALALAVDLGVRRDDAVLGGVGLHDLELHGAHAAADEEGVALAHGAVSLHEVGLEEGVEQVPRDALHRVLEGQHVHALAVLDVGALVHRHDVAQAHAQVLAHHLVQPDLGLLAGVVGEDDAHRVLALLALQQHRVAAEQVQRLHGLGVQGARGLTATKNTGSAWTVEHGHAALTSRTSTPRAVGRQQGMQDHKQPPHTGAVASHIQAGHLTHNTPCHTWPTPLPCPTHIIDQQAIGALLSLQDCRPKGAEVCAGERHLVRTTPHAQPSRRALCQNSPLRHSLRFDRSVRHCLGWSMPRRSDSNQASGDRSLRQYPSGRSAVSDHWNSQEYMALHHPRCTGIEPWPGVDGSGPWKGKDVSRDHDSRKWRGGSSPLMHGELHASASLSIHLRPYWPYNSPNNR

SEQ ID NO: 16463 - protein, 412 aa, Chlorella protothecoides
METLDLFRGDTVLLKGKKRKDTVCIVLSDDTCEEAKIRLNKVVRKNLRVRLGDIVSVHQCPDVKYGQRVHVLPFEDTVEGITGNLFDAFLKPYFVEAYRPVRKGDTFLVRGGMRTVEFKVVETDPAEYCIVAPDTEIYCEGESIKREDEERLDEVGGYDDVGGVRKQMAQIRELVELPLRHPQLFKTIGVKPPKGILLYGPPGSGKTLIARAVANETGAFFFLINGPEIMSKLAGESESNLRKAFEEAEKNAPAIIFIDEIDSIAPKRDKTQGEVERRIVSQLLTLMDGLKSRSHVIVMGATNRPNSIDAALRRFGRFDREIDIGVPDEVGRLEVLRIHSRNMKLGEDVDLEAVARDTHGYVGADLAALCTEAALQALGAGMHLPPAWELRATRTVRLQGLWQHTIPFAATW

SEQ ID NO: 16464 - protein, 418 aa, Chlorella protothecoides
MVDSEVIASFCGVTGADSDVAIQMLEATNGDLESAINFYFAAEGAAGGPDREDDEALARRLQQEANEPLEDAVRAPMPVVNQRLVGDLLPGPIQTRRRPWSIKGWTSAGADAVAPLQLVVQGCADSPIGCQHIQGIHVSVGHVLVCGCDADASEQPSSGGLAASFEPPRELLFHGSFEDAKESAASKEQWLVRLMGACQWCPEVQQLPPTLLMAPMRASPLRDVLARLHAHSTWSNAPPTHPSHTPLPSPNQLLNLQAADQFASHQLNRDTWRDPMISGLVSQNFVLFQPGHTGHWCPGHAGQAPMPPLCPRPSVPSNDAVSSPPPPPQCTMPGLPGGGGGGGAVRGLSRLQAALHPRHRPGHGGAHAAVGGVPAARQVRARRSWAAGGRQVLKGTARQSVAAGPPFHLTSSGWDCGT

SEQ ID NO: 16465 - protein, 131 aa, Chlorella protothecoides
MDTATGEYFFMEMNTRLQVEHPVSEAISGVDLVEWQLRVAAGERLPLTQDQLRIGGHAFEARIYAENPANNFLPAGGRLLRWRPPPGAAEFGPGAVRVDSGINQGDQGRGPGDLRGAVSRGRRLASGCRAR

SEQ ID NO: 16466 - protein, 102 aa, Chlorella protothecoides
MAPKSAPAHPPYLSLISEAISGLKERTGSSYPAIKKFIGSKHKLPTGWEKVLAQQLKKQAGAGKLVRVKSSFKLSDALKKPAKKPVKKAAPATKVRVGTDMP

SEQ ID NO: 16467 - protein, 307 aa, Chlorella protothecoides
MAGKDARDRPWACVAEGSPSSSPGPTPSQPNPPPLQVGVHYDPMIAKLIVHGPTREAALRTLHAALGETQVAGLPTNIEFMRRVTQDPDFQTVGCSAHARNGAGLGAGSRPLGLLPGLEPAPSLAREARVTKDRTWLFPRHGMHLQGNAPYDPEKIRTFEFQPTHAHIPAPLALQGGVDTSFIAEHEDSLLERVAPGTDELCLAALIYAAPHASGEPSASTKAPCPEPWRQPSAFRVNHPARASVGFGHAPATGGLELDLVGAGGGVTLEGAALAEGSGLGAEARVEVRRGRSWGGQGQGVGRRGGI

SEQ ID NO: 16468 - protein, 272 aa, Chlorella protothecoides
  MOD_RES (149)..(152): Any amino acid
GPPPAPPAQVLLSDQAKRSARRRGPAPNGSPAVTPPPGSPGWSPGAGAQSWQALLGALTNVVETLRGEGVPPPAVRALAAACLRFVDAELLNALLLRRDCCSVSAARVLLAGLAELRGWAAYLGPEWCPGRETAAAALERVAQAARYLXXXXGARVLRPRPRRWSASPRRRATSSRHGRWVLRLWFGGGPGILVPDGGRLGLSGGTRFHGAPRRAHPGRPGPPLPQPDPAAGVPPDGAPARRLDFGGGAGLAKHGAAGDAAAPHGLPALHGR

SEQ ID NO: 16469 - protein, 433 aa, Chlorella protothecoides
MTDQETAPPAPSVPARPRLNLKPRDPEAVARMEAERQASIGKVRCVAITLLCRGSSRPQPPPRLHGDCWSSRPIPARAQSPFGNAKPREAVIAGRVGKTEEEAGMLERPGVFVAEPGSHTELGARGRNAGGPKQQLSKVSAVRNLSHGAKPSTPPAPSPPQLRLSPSQLDEKKAQEAVIRQAEETAEAEEDAEKKAELNSEVAVQKEKLAELLGGFEVHLVIRARFPPSRPAVRGTSSTARAALSDPTPPPDPPTSPPTPPLGPPPHTQKLALETAMSGSGPRMSSLRRAQAEAAAAAGQYDSAAGGNRYHPTQGYGPPPDAVAGAPPSRGFPNGQYGAAGRAPPRSQGFPEYQQQAGHGARGGEYQEARQGRSQYQEPRQQGGADAATSFHRAPGAFVPGEDSDAGRAAAAAGTGRAGARAAGAGRAGGRRA

SEQ ID NO: 16470 - protein, 197 aa, Chlorella protothecoides
MRLWMSGTMRLRHYGHALRGEDAGGPCPAAADDLLPLSAASRFLNNTPHSTHHNPMFLLHKARLTVDAGSVEAVKRDYGPITVQFVLPGKPSGEVEMVGGRGTPNQHNCWAWRRLCCQAKPLPSFHTNLGPRGDAGASDALVSKHPETPWLSTLSLPASGLDVRYMKILKQEKNYNPARWFRVVAVANSYQIRPHWL

SEQ ID NO: 16471 - protein, 354 aa, Chlorella protothecoides
PPFSPSSPSPTHSPPLPQQHPGPVKDEIFVDIVERLTATFDATGRQKSSSITGAVQIKSYLSGNPPIQLGLNEDLIIRGREGGPASHASSDAVVLETCSLHQAVDPRRLDTDRVLELVPPNGHFAAMNYRCVCGVGAGGGDRAVWGNHGGWRAPGPPWVLGEGRGTASVPTRDPPLPRQVDAQLPAALPGLPAHGGRCGGPRQADAVCAAAGGVPAEQDGHWRGAQAAPAAQRPACARRDGCGFGRGGWWGGEEGAWCWARGSGGARGGWARKRLLRCAPQMVRARPCTHITARSPSNKPDGARPATLGLPSKTHFAQGAEWVERDRVLVWNLKHLRGSQEHTLRVGAVLLAGV

SEQ ID NO: 16472 - protein, 428 aa, Chlorella protothecoides
MRPRITGTHPCTTDPAEIVERKLDKAVDKRLDEWVPASRISGLHSVGSGEGLSRASTAPASDLLAGLTGDQKMTRRLKRQFAEMHHVGPGVEELPPLDQHAEKEHQEKTKVKNVQSIELGRYQMDTWYYSPYPEPHASCERLYICEYTLKYFRKRRTLLRHLAKTPLRAPPGDEIYRSPPPPASDPGRVGGAIASPPLSMYEVDGKKAKVYCQNLCLLSKLFLDHKTLYYDVDPFLFYVLCERDAHGSHVVGYFSKEKDSAEGNNLACILTLPAHQRKGYGRFLIAFSYELSKKEGRLGSPERPLSDLGAVSYRSYWMRAILEALRDHRSAMSIKDISEATAIRTDDVVKTLESLSLIKVCESIFGGGVGEGGRVTERMAEVARCLDGGTREAGKKVAEGWERILHGLGRGAGRGMVHVAVQTGEHQS

SEQ ID NO: 16473 - protein, 180 aa, Chlorella protothecoides
MNDGGCGTVPRRLIIVSSLSCALLPVTPRSLHTVLRFRIYATAALHAHPLPPAGTPEEPRCGFSRKVVDALRSTGTAFGTFDILSDQDVRARLKALMPSPKAQVAASVYSPMSAGVLQLADIPPAICQGTATGRLRHRARDGCRWQPQGNHYGDAGVIYDVVILHLGLDYHHHCIVCPVP

SEQ ID NO: 16474 - protein, 432 aa, Chlorella protothecoides
  MOD_RES (155)..(158): Any amino acid
MSSSAWCSATPSTGAWAGEGTSRAGQASGHMQAPSWPSLQVVVFDCLDYCATLHNLQAVKDAPNFKVGWCYQRSPAWIAMDLTCVTLQGLAYDYVMSLEGHAGATYHPAYTGIPTQPINTTYRAVHQRGHQERGPAVLRDGNRENRHRHALCRPXXXXHVDHSFGNSVSFTINNMYGTHVLLEAARRYGQVHRFINVSTDEVYGETSFGLAAGLVEKSRLEPTNPYAAAKARRRGRRLLRLVAVKSDVIIKSGLSCLPHSTSRAQVEDSCMPVPAGAEIMALAYYTSYQLPVIITRGNNVYGPGQFPEKLSECDCGSSPGGGSCCAAGLSVGMFLSNLRLYRVSIPKFILLAASDRPLTVYGAGEAVRSYLYIADVAAAYDAVLHCGLVGEVYNIGSVRERSVLEVAHDIGAAFGRQAPLLEHVRDRAFNDR

SEQ ID NO: 16475 - protein, 454 aa, Chlorella protothecoides
MHSCCPQRTRLCACSLIVSPCAESPFSCTHCSLCSCKHCPDPSPRLLLPHSSSRPWPGSLVEIAEPEFLAAVMKAEHALCHFFHAGFQRCASMDRHLAILAPRFPGTSFLRLSAPVRGCSWEGRGIGPAQENSVLGRRSSKIARVITAGNRGECQFTDCCGHRDAPFFTEKLKIRTLPCVIVFHRGVAVDRIVGFEGIRGAGADFKTAALEERLQESGVLVGVNPCSDSEAEAEAVDRRTVRHGFTARGKGGVWERRATAMCDTRSCYLRQPGPGAVALGVASRIDCPCPQLGTTRRWRFSPACGWRAASTFPLSLLAYMESVHVMFTSRPTQLEVSVCTTITQSPSSLSTHLLQPAHPQSREPSLPTPADLTHQYSAGDGRFRYQSIVFLRPCSHDVLSSQPSAASLSLLMKYRLQMGWHRVPDPGGQVAQEYDFSRRINGCKGVAHDTAASP

SEQ ID NO: 16476 - protein, 365 aa, Chlorella protothecoides
  MOD_RES (132)..(135): Any amino acid
  MOD_RES (164)..(166): Any amino acid
MSLEDAAAADDGRDLASYDFDGDVVGRIQSCEGPAPASDDPGPCSPPPEAAYRYREAHLRYSLGLLADAALPSSDRLWHATDTLAAGWLTAAQGLLAACLARLPVLLGAALGPPLHAGARDHLPQVRHVAVXXXXMGMWWEESNLVRGRHRRQTTPGPAPLPRXXXLPVLLGAALGTPSHAGVRDHLPQVRHVAVTSSDLLPSLAKLALFRLDRFFAGRDVLSSRVHGKLECFARLRDRFPGSAAFVAIGDGREEEAAAAALGWPFIKVSLGRCPGHLTGFSVSQDSVRHAPWMSGSPSQSCTPPLQPIFGPVIPPVTLPLGALLVYTFYAAPCDPYFFSQSARGAACGLVRGRNGPTPPGRWRR

SEQ ID NO: 16477 - protein, 102 aa, Chlorella protothecoides
MGGGGTESPDSKKARTHAQAPPPPPVVLVWDIDETLVIFNSLQNGEWERAHSDSGAGEAQALGSQWSSAVLDLADSHLFYKQVLEWSVEGHGLTDAVPGKHF

SEQ ID NO: 16478 - protein, 701 aa, Chlorella protothecoides
  MOD_RES (134)..(136): Any amino acid
  MOD_RES (322)..(325): Any amino acid
MAGEDIWSPNSQVPRTEVRVLWLAGWLLAMAFAVSPWGYTHLTVPSVSTPVTPARWTQDIWFVIFGLQAVGMVYQLLPSGEGIILMPCPAVSLQESVVLNLLVHAPALAGIPILSIQPSPTCSGYDPDGDKQRXXXVILMPCPAVSLEASVVLNLLVHAPALSGIPILSIHPSPTCLGYDPDGDKQRCVHATSFLWALGAMCTLGWLAALAQGTPGGTWLGLACILAALFITLRSLLHLYRCLFWTDDGDWEEGLVVALEAFHLRCTCLGVVVGFTFPAARQLEHGGDGWPRRWVRSHQPSTTPLAARPHPSLTISQAETPXXXXYMVEMAGHEDGFDLTSPAQTRSLPGLILASQSHRLRRQFGRTSSRLLYLAYFLPTSMLAAWLTLAAATTAVAALIVSVDPADLDLASLAFLAGVMLLGAAVTLRQRDTVFGLTLVWGLVGTYEGTSDESAMLQWASLAAVALMVVLCALSGGGRVWAGGGRACLCGRKDDPACRACLVSCGGRAARARASTSRRRSRCGRMSCDEIDHPSTGLLLRRAWWPWVQVPGAPPVDHTVCHAHHLSLLSYNLAVRHPLDAQAFMLLFAMSTFLKLSFASAVQQKFKPCNGTKGRRLVPGAPPVEHTVCHAHHLLLSLYNLAARHPLDAQAFMLLFAMSTFLKLSFAGAVQQNFKPCNGTKGRRLVLSAFVVHRQGASELW

SEQ ID NO: 16479 - protein, 160 aa, Chlorella protothecoides
  MOD_RES (119)..(122): Any amino acid
MCAVQNSCGCGSGPPYHQGCLWQREQSAREAPHLAPPRRTHCISPAGIMLSSQFPINYFAVSEVDQSFPEFNAVFADVGELPGSKAAWYFRRTEDYGYKGENESADDLGRQFALEWGSXXXXRMDALWLRGGLCRSGLFPCGPGLVIQGQHSQVGVLGLV

SEQ ID NO: 16480 - protein, 352 aa, Chlorella protothecoides
  MOD_RES (31)..(34): Any amino acid
MGAMSLQMSCRRAQLGDRRLAKEVMPRAGPXXXXDRRLAKEVTPRAGPCGLRSARAAQNSMHRNGLLPPKAPSVPPATRAQKQSRLHAAASASAPATQSLESLEMFAVLDKRGLIRPEVPAGTLATVFAVYDEAKDLQYIGFSRDLKNSLRTVFSRRPEKTHHIRWVTGPRGKGRNLIRGLYDPLSQSTSFTPHPLIMALHQGTAPATIGSNRAVRVTYGWVFLAPARTQPGSPICYDLAVDAEKAAWQQPVEPFTISERGKAAAALETVKEHFQDGPMLPVWAPVPITPLHNQTSLQLQTRMKLRGCKEVFEANEELLAEGRVDFVPAKQITAEDEARREAEEAEAARAVR

SEQ ID NO: 16481 - protein, 785 aa, Chlorella protothecoides
  MOD_RES (550)..(553): Any amino acid
MGKVVTRFPPEPSGYLHIGHAKAALINQHIADMYKGRMLVRFDDTNPSKEKDEYTQSIIADMQRLGLRYAGITYTSGAALMHWVAESQGLRCGSWSMASTNPALSTLSFPPSHTLPITKSDPDYFEQLAECARRMIAKGYLYADDTPVEQMRETPGDAPLGVGLSGGAHGGDAFCAAGQARVGNDGDLRGDAGGVGGGPAALPTSEAGHVGTQQSSEGPRGVPLQPGAALEDRPEVQAQPLLTTSHDAQCYPTYDFACPFVDAIEGVTHALRTSEYKDREAQFYMILKLQQDVWPGLPHVTMWDYARLSFIYTVLSKRKLTWFVENGIVDGWDDPRMPTVQAKLVSLHDLDKHAHAVWSTVEACGTSVMGIMRRGLKMEALKEFMLGQGASKNMTYQVGNRWEAERSHVLHNQSCTLLLCQEWDKIWTINKKLIDPVCPRHTALGLCGQSDQLLAAVPPRPSRFTLSPSHEPYKLLHDRPPVPTPPLAIARVLVTLSNGPASPETVSVPKHAKHWRAGCWGVPASTESLSARGVAFLPTLGIAPGLSPTXXXXGVPASTESLRARGVAFLPTLGIAPGLSPTTAPLYHLQRIWWDQADAAVVAEGEEVTLMGWGNAIVRKISKREDDTVQSIEAGGHVCEASSVVWGLQITTWTFAAWIWSKASPRGRLQEDEAETHLACRCEEEQSFCWVHCDVVVSWMVTSTPRLPCWIRLHHPSEMSSGEGRVTPLTSHRLLVQIPELVPLELHHLGYLINKKRLEEDDIFEECVNRNSVRRGQGLRGGDPA

SEQ ID NO: 16482 - protein, 358 aa, Chlorella protothecoides
  MOD_RES (216)..(219): Any amino acid
MSATNLRADRLQPSHPHAPQEWIGVPYGSRVHARAPDSGWAYLLAPTPELWTAVLRHRTQILYVADISMVVAMLELRPGCTGKPWVNALCGCQACCHAEPLHSENLALYPHSAVPRPPHPHSPAVLESGTGSGSLTTSLARAVAPTGHVYTFEFHEQRAQLAREDFAANGGRRGFSFSMLYIDTHSVHHLEGYRVQGFSSVQRHALSLSFFLTPTXXXXRWAARFLPFHAVHGHTQCAPSGRFTCSRLQLSAAPCLVSLFLPDSYLCAPPAGLSDVITVQHRNIEESGFPSDLHGKADGLFLDLPGPWKAVKSAAACLRPDGVFCSFSPCIEQVREVRGAAEGALWKSHSHNPLRIMF

SEQ ID NO: 16483 - protein, 175 aa, Chlorella protothecoides
  MOD_RES (109)..(112): Any amino acid
MTSISPAAPPPPRSRPKVQRTCGALARSGFHCLRTMEVLLRSYEVTSSGLKAVEESVLGDDLPSGEPADVGGDPDSKRAKREDGAAPEEAHTAASAAPTLPSQAQVLAXXXXAAAPAAPTLPSQAQVLARPVASGRGHTGYLTFARLAVTVPGPQPQAVLVVPAPAEGGAEQDTA

SEQ ID NO: 16484 - protein, 71 aa, Chlorella protothecoides
MGVKVTEGEATSVTGEKLYTTSYLPDEPPRAAFVIHHGLAEHIGRYTPSKMVECLWGVSDVRDCSGTGGTA

SEQ ID NO: 16485 - protein, 983 aa, Chlorella protothecoides
  MOD_RES (126)..(138): Any amino acid
  MOD_RES (343)..(346): Any amino acid
  MOD_RES (467)..(469): Any amino acid
  MOD_RES (611)..(613): Any amino acid
MEGRVESFGGGLEAEQAAMLRVGCSELEMGHSSLRWCTSLCSTLQRHAPWSLDQGKYTVLSHSRDLLVAQALRPTAVILEASYHQDGDDGAALMWWYSGGWEPKSGSMLNGNAGSAPRAKHSELDXXXXXXXXXXXXXPLFPVQDVQLVSIDDPEDGAFDSIQGILAEFGPAFAPPCQLGSSAGPAAEDEAELGSGQSASRPTSGGGPVEYRDPGQAPCTCPEPRLQDLLLGCPGTGAAGQDFLTEVKGPLLLAQPLFLCGGEAGPGDPAPPARGSVLLAGRGRCPFADKARAAAASRAAALIVINSGEDERAVWPMSGDGAPGGAGMVGMGLMYSCTQVSPXXXXGAGMVGMGLMRSCTQVSLRSAWRGQRASPVGTGPEHRLRCVRAASGGAAPAMACPSRWPTADLGALTMPAVMVSAAAGGKLLDLLRSRTRPTLRLRAAEGIPAPANASALPSASTAGPLLXXXARRGGDPGPGKRHGPPLRERSRALAAGPRPAPGLPGADGPPALPGPRPASPVEWGGRDGRHRRGRAARSAGRRPDAGGCQGGSASPVAGRPAGRDLPRAMRRMMAAGGCVDSFPGRVLLVPGVPCMDFALVGSALLTCMATXXXFSWAGPSCAGGSLHGLCSGRACTADTHGDVQCPSTHSRPIFLDPSIPRLGTRCGTEGSLHIFATMASEAVTATAMKTQRPVRPAGCWTLCCGRSTSQTLQKASGFPVSRLCTTLSEPGRHGAARQDPLGDALDQLVLLRPQQDLVVTPSHEAVRLVLAAHRLRPAAGKELVGDAVGVAVVRVDGHRQPRRAPENLAHSPAQGHRGLQAQRRHRVEGVIHVGLHQGGVGVQPGGVHHLEGLEPRHDVHQHPGDGLLHHQAQGGRDAHGGGHDDRPGQAHGLRLGGQRGDQAAHGVTPQEEGGGLPGPDGRDLGQGGGAPGVQVGHHGVAGGDVGPLPGALAVAVCVVQEHGDALLRQDSGHCSKRRGDLKS

SEQ ID NO: 16486 - protein, 704 aa, Chlorella protothecoides
  MOD_RES (337)..(340): Any amino acid
MAQRRSPLNCILPGKLPNPHPPTLSTGARSLIGLVGNTISCDTRGWERHDSGIGAGVDSYYEYLLKVTGGPNLWLELAKQAPVVAGQGWRLGVLAAALMCCSAGVLRGFGCDSPSTAPTRVRCCALARRPAPASYHPLTPNPKSPQAYLMFGNRTHLQWASESYAALLTHSAVGAPLSGSPWLLDVHMSTALLLHTGVWSLSAYWPGFQALAGAPWREGQEQGKGCAKGRGALTQRKDFREGMRPGCWVSNLPLPQRQLEEAAAQHRQWLAVWNKFGWLPEMFDVQKQTRHPTLSGGLGRLFLVGDSSAPGNVGSVEASLLLTVTLLTHTHCCSTRXXXXGQCGQRYPLRPELMESTFMLAADAPDASYLRAGEAMLGTLRSRNQVACGYAAVHDVSTGKLSDSMESFFLSETVKYLYLLFANASAALDRWVLTTEGHFLDAWADTEEQWEAEHGTVMLGAAGAEGPIGANATSGGPVGAPVPASTGKGSGARPGGYVTEAPPGNASHDAAALMLAGTFLSHEETTVAPTQEVVSMEVETVAARCRHLCEAQDPDQFARRAAALRAALPALPDSQPLQPSLIRRRRCTACQAFTRAGEAARRARAARRHVGATAAFARQLASATARKAAEAARRGWTPPAYFLCDLRRTGGVLGCGALKVLQAGMELEDLMVRYGREGGRLWWESGSRAGSDAQGGLQRARNGA

SEQ ID NO: 16487 - protein, 211 aa, Chlorella protothecoides
MAERTSDPWLCLDPPQLYNLDATLNCDIAVNLRSLTAEPARSSAVAVGALDPIYKGIGHRGQGDPPSGCRSLSYTTPTLAHPCTPTETTPNALDTELVLSKEQGDEVRTFPLPDGRFAFHNVPAGKHYLEVELVGLVYSTVELTVGVAGDVNALLSDVINVRSHAWWEGWCGTSWMLGQVTRCDDVLVACFSQMLSYVFALVGVPRHKQFS

SEQ ID NO: 16488 - protein, 199 aa, Chlorella protothecoides
MGVGPGVPPQKQPRCSSPCPIALCQDDLRPLSCNGSDSQGGIGLTTLDSLDTLLVRTYSLEQGVMNQLEAFYKALCWVTGEGTDCGSGGDPPPRLTFDLDVRVHVFEVTIRALGGLLSAHQLLTQNLQLAPWYRGGLLLAAVDLADRLLPAFNTPSGIPLSWINLRHGQASDRVVEGWQGTLSMSLKHSASLEPPGICV

SEQ ID NO: 16489 - protein, 167 aa, Chlorella protothecoides
MQFTQAVHMFEFDRHLAPYDLANLATWRSLSAHVTPAVIDRLQPVGGNICVLAEAPPGSRGRRQTPAEAALEAQLSRRKATSSSQGGGGSDDSAVPGSHPQGALFAAPHAGRCFYTRTQTVSRDGVYDAAARTRHNLDRSEGLDSLIREEYAGDGDLLLGEPLAGGG

SEQ ID NO: 16490 - protein, 88 aa, Chlorella protothecoides
MCLQSLPPWVPTTGELQFAFLAFLVGQSFAGLIQWRALLQLLLGCFSAALGQHQQLFAQALDVLAAQLAASSQKQVIVRDVQGILDPG

SEQ ID NO: 16491 - protein, 211 aa, Chlorella protothecoides
MRVGGCGTPPRSTHRDALRDGARFALHRVPRDASHEVTEAAPAVAGEERLRALVQRSPIMLFMKGSPDAPQCGFSAKVVAALRAVGADFDSFDILGDAGVRQGLKAYSNWPTFPQLYVAGELLGGCDIVLELAASGELAAELAAAGAPGDADRTAQLTALVNSSPVMLFMKGEQRGRWVVRGAWEGRTPCPHGHAPGPKLPLNQVPRPRRG

SEQ ID NO: 16492 - protein, 90 aa, Chlorella protothecoides
MDAANLAKVKGQMHSFAMGEAMAQAAQDYQQHILASQQAAAGKGLPAFYADDMLNDPEVESLQAERLEELKMQAERRAAKTAQTSYGEAD

SEQ ID NO: 16493 - protein, 220 aa, Chlorella protothecoides
MEDAQAVAEVAHDASSLAALVGALGATGAAGRVRTLLAGSGVAPSQALLNAGVAACAREGRVADAARLLADFRGAGVAPDARTYTSLIAGCSFGRQGALAWDLLGRMRERGLAPGAPTFNALVKVECHVAGPDGGLAAVNAMLTAGVKPDVVTWTTLLAAGRQAGREDVVQQVLLEWVLERCGGAGMALEELRALQAAREDAARDAQWRGHYAVDEDDEW

SEQ ID NO: 16494 - protein, 150 aa, Chlorella protothecoides
MAMPTADSRMLMQVGPGGVDDGAGPCCQGCGDAASEQHAPGAVAACMPDLVEACAQGHRRQPLPPIPNPTPSLSPACACSVLIFEVTEPGFPVEEAVRIFIQFSSAGEATQVGGPVVVEPNLSRIPCCRVLPGCGQVLHTPSGTSRPCWT

SEQ ID NO: 16495 - protein, 487 aa, Chlorella protothecoides
  MOD_RES (152)..(154): Any amino acid
  MOD_RES (332)..(334): Any amino acid
MPDLPPGYASAFEGAKRGGLASDGELLDYPSTETFLRRAFFDLGELCARRPGLILAATVTAAGLAALGLLALRIESDPERLWVGPGSQAAREQADYEGGWEWEVRALLMPCMGTQQRLHVSGPWTLVSHPPARHTPTARTVRTARRRPSAPXXXGVAPACSPHADRPHRPHRPQASFGPFYRISQLILSTGEGGGAITTDSHLRTLFAMHELVDQLAAPYGEEAGAAGNATLSSVCFKPLGAECAIQSVAQYWQLSVDVYEHGGCLGVGVLSGFVLVLIGCRCTWALGTETVMCEVGVEEGLCRADDGPLHQCSSPLALVHGLPSPAWSGTXXXIPGRWGLSQSCARLEWRKNCAEQMLVPYTSALVFGRVRGLPSPAWSGSPPMMVPVTPEFCYGHWNTQCLSAYGAPIDPHVVLGGFPTAAAEFRNFSADATAFVVTFLLDPAPALRCVGSAMLELGFGLCIDKELLFRIPTLRQYPSLGLFLAF

SEQ ID NO: 16496 - protein, 589 aa, Chlorella protothecoides
  MOD_RES (61)..(64): Any amino acid
  MOD_RES (155)..(158): Any amino acid
  MOD_RES (351)..(354): Any amino acid
  MOD_RES (461)..(464): Any amino acid
  MOD_RES (547)..(550): Any amino acid
MRIVTHCICGQAGHHTYGGLGLFSPRGISRRHVVPAALSHTGIPSHEVHDDCGMLLSIFNXXXXLHMWSGWASQIWWLGTISPSWNLEEARGASSTFTHRDSVSQTHVMAPAPSPEDFLLAEPDALSDVQLDAYYMDGLDEDQRLPHRPLHFLLXXXXCPIGGTAWVCPGYHASLKRPILIKPCARSRSRPLHFLLTPCRLEPNSPAPPQALRALGVLSWRLNPDTPEGAQKLAAIRRVRNYTYEASVADQDIAWHVPRPWHSRPCSSRHHTLPSPLCHRTPSTCRQPPFRGTMRRSRPSLRSTSTLMRRSDSCWKAAVRRLVGGSLDMMVACIMGLERIHALQRHVACKXXXXDMMVACIMGQERIHALQSHAACNLLLDQFRSCKPVPLSDTLPFHTLSTGYFDVRDLEDRWIRIHVKTGDMLVLPEGIYHRFTLDTSNHIKVRSLKLLWDGAEAGVGXXXXDGAEAGVGVHQINVPPQSCALVACLPPSGPETLHRRPGVDPSEPAAGDTPVEGKMACISMVKRDSRRGRACSYACANDSDWSXXXXMVKRDSRRGHACSYACAPDSDWPLCFNVAGLLAGDDDAV

SEQ ID NO: 16497 - protein, 207 aa, Chlorella protothecoides
MLAITGSLAVASPALRGCGRKQPRALRACRRAPRPMHRRQACAALPNDENPEQAVQRRLRESEEVAERVKFLQDRVELDAALERVRPDLGAGASASTKHGGHPAEMLTGDGFVAGDSLVVLEVASEEICQTGWDEEPELQWDEDKRAALEPCLRLKHTFARIARDCSDAVFLAISVRVWGKDWSGGLCLNGVCMPHSDQPSYCKPGS

SEQ ID NO: 16498 - protein, 357 aa, Chlorella protothecoides
  MOD_RES (281)..(284): Any amino acid
MARLAITSLAFMLLCVPDPVCHTTSGKWSVRRPSATSPAADTMASPWRRSSTPICMLTRAAARLSTPKARTTGSGMRSAGPPILKFWMERWVWAPQYLRCNRGLRGGMGSGMIRGAVGHGSQVRTGARIAVPRRSEESSGLTIVRSGACMSRTQSPMGPHLTGRTAPPGVRMCHAPLGTTRTDGDKTLSPRHPRTEINGNSPFIYAPGSDRASAPCARTRADRRCRGPDILKESRIAVPRPDPGADARQRLLPDPANVQPAGKGSASFGNIYSNKSRLLFXXXXPDPANVQPAEKGSASFESIYSNKSRSLFIQPERHPRVQSRRPPSGCSRHPSAGCEYAAAAAPCSMRSAPRSGC

SEQ ID NO: 16499 - protein, 422 aa, Chlorella protothecoides
MGPVATPTLAEPRCSCCEPVVSLSFAPVCVMQCLQDGTRSRNIFGGIPWQRGPWLQPSVSRHETFLPDATVRLTPLPKRRAPGSGRGREHVLGPHPCVKLLLGAVAQCQRRLLQRTAVLVRLLGDGCCLVVPDVVVQRGDQHEGLVQKLRDARLVGPDAPHAVVGEGARGVGQQARGVQQVARHHGLEHVELEVAVGAADRDRHVVAHHLRAHHGQRLALRGVHLPGHDAGPGLVLRQAQLAQAAARARPQEAHVVGDLHQAHRQRVERAAGLHHRVVRGQGLKLVGRGDEGQAGVLRHRRRHGLGEADARVQAGADGGAALGQHGQAREGGAHALDAVGHLRRVAGEFLAQRQRRRVLGVGAADLDDVRKLGLLGLQRGLQVRQRGQQAALDLCHPRDVHDGGEGVVGGLALVHVVVGVHQ

SEQ ID NO: 16500 - protein, 343 aa, Chlorella protothecoides
MTTNGAPAEASPPPDANEREHSRACTAWMCHVHQPPLSFTHILPTPPSPPGCPGTASTAAGTSDACKGCPNQQACASAPKGPDPDMLAIAERLAPIKHIILVLSGKGGVGKSTTAAQLAFALAGEGHEVGLMDIDICGPSVPKMLGLEGEEVHQSGAGWSPVYIQSPDQLPGVALPAPLNLQLLKAKSQCHAGSTQTSGLLCALTLNPFPPSIPSPFFIVPKENLGVMSIGFMLPNPDDAVVWRGPRKNGLIKQFLKDVHWGDLDYLIIDTPPGTSDEHISIVQYLKAGRVAGAVVVTTPQEVAIVDVRKEISFCRKVGPEAGNGSAGIIWIPRAAYFISVMG

SEQ ID NO: 16501 - protein, 221 aa, Chlorella protothecoides
  MOD_RES (133)..(135): Any amino acid
MICTLPRPPPQILIFVNSVESGLRVRLFLEAFGVRAALVHSELPLNSRHHILQEFNRGLFDILVATDDVHAGEKKEAKEGTGRRGRRAQKQPQGPNGEAGVTRCRGRRICCVAEGGVADQSPSPASPSDRSAXXXGGSGVMMVFLGCSELSQNGEAGVRRCRGRRLCCVADGGVADQSPSPASPSDPSGAPQPGHMHNAAGKGRGVWGHKRHRLQGREHSD

SEQ ID NO: 16502 - protein, 282 aa, Chlorella protothecoides
  MOD_RES (158)..(161): Any amino acid
MEGEEMGARMEREDKKTFRKPEGAGECRAVWPARTATSGLTELMCCCIPPRPGSGNQEDLRRAISFHQAGPLHIPSTAVPLDQEGALDALRMGTWRLRGHTCSQIEALVAQIEGAWRTVFGSDFRLYQLDREPLQGFSPATVSHHSVAHPPRTCVLRXXXXAMCLQEGKPVTGTSSGFQPSNGLPSLRCTPAQDMRFADSVDMNKDYPSSWAELMDPTKDEPGYPRLMLENRAYQTRVFRKVHLEVGIRQDNIQVSLRSWSGSCAGNLDGATILKSQSPGGD

SEQ ID NO: 16503 - protein, 119 aa, Chlorella protothecoides
MSREMQERYSLGKARDIPAWASSILSPLAVVTSPATPEEVGNFIKYAITLVRYHTEVGRIIDPVSGAGAAARLQTIRAAHKHYCTQNLRNLKTRRMLEASFGVEWSDKYLRHIMFDFEG

SEQ ID NO: 16504 - protein, 90 aa, Chlorella protothecoides
MQIQIANIFLLGCPACSHNFKHLFCLLECHPDQATFTNVTATQPAHDTGVTSVANVSYYVTPHFGQALFDSCKDVTYPVLNQKAMKFVGG

SEQ ID NO: 16505 - protein, 121 aa, Chlorella protothecoides
MSSPTHGSLSPLSGSLLRPALLPSLPIQADDPKSKELVEELQVKTIPTVQFIKNKQLLWEHKGINKLEQNLSEGVLYYGDQAAENLKASSFVKDLHSPEEFQEFVKSQEKDVRWCGRVGGA

SEQ ID NO: 16506 - protein, 213 aa, Chlorella protothecoides
MAEEAGLRLSFSAQRSVADEISREGWADAWTVVASYAAMLAYIAAAMGTFPRGQPRLLHSRIGLGLAGVSCVAASVAAALGLFGWAGTPATLIVMEVIPFLALAGCVGWSAANYSLAWCFTTLSVPTVGVDNMFILASALERQPRSRPLPQRAGLALAAVGPSILLAATCEVLSLARVAFVGHWLVSNAFKGQKASDQASVAHSWHVVLYARP

SEQ ID NO: 16507 - protein, 427 aa, Chlorella protothecoides
MAFTRSLRPLHTPSLPPSLPSTPTTSRYIYTEGDPPLDRLHQLAQAAVARRKTPLSAGDVVAGVFVERGVDCGEALLARVKALQPLLARVAGTPAPVRLLVVDSLAAPLRDLGPSPGRRELLARAQTFFRLAAALRALADRHGFAVLVTNQVTDVVAGPGAALARSATGGAPLLTSGREVTPALGLAWASCVNTRLFAAHAAGGGAPGPRVLHLRLGHASCTWSGALAWAPGAASSSWGPAACGAGGPRAPGGKAWRGDPDPPGGVGVRVAATAREAPIPPYSGQADSLPGGGSHAWGPFTHVIGSAPPRPCSRGALRRQGRAHAFLLLVPEQLGGQRGAQRPPPPPRGRGAQLPAVPGAGAQQAQQDREQDQAVSGAHQHQRQVHAEEVDAEDLGARKGQHRHACGLDLFFWGGGQYERGRDREGR

SEQ ID NO: 16508 - protein, 243 aa, Chlorella protothecoides
MFSGLYGDLPSAKGEDTKPSDGPWVGKGLVAPSSLNARRAGPGASAPMPPPSVLRAGRGRGREGPGPVAPGRGGRGGRGPGPGPTAPPAEATSSAAAAIASAAPLPQGSAPSVADEYDPARPNDYEAVRRAREAKRLEAEAAAARQEAAREATEAAARLAEDVAAQRHAPPAPADERSARLALSGEEAWQKRGAPQRPAWATAQDPGAGAAGPPQAAPPAEKKSLAQVRGSECASAVTCDWTA

SEQ ID NO: 16509 - protein, 117 aa, Chlorella protothecoides
MSTFTGGALKLKGGLKPTGIKKKKKKSSTTTELVAEGEGASAPLAVEARRTAAEKAADAHALKYEEARIRKAAAKSHRERIAEMNEKLANLTEVSGQACRRVVGGVRGRGAVCSPPS

SEQ ID NO: 16510 - protein, 129 aa, Chlorella protothecoides
MKNRPQPPALRSQTHPCLKHTVQFPCRYVHRLGRTGRAGEDGFGISIVGPSETELAASIEEMLAGGSTKAGESGEEEAACEPVMKPYTKLTAVALEGLRYRGTDVARSLTKRTIIEVGLDASVCPLCIS

SEQ ID NO: 16511 - protein, 478 aa, Chlorella protothecoides
MRAPVRTCDPCPTAPLIIPDPIPPLKPRLHLRYWGAQTQRSIQNFKIGGPAERMPEPVVRAFGVLKRAAARVNMQMGVLDRRQGEAIVSAAGEVAEGRLTDHFPLVVWQTGSGTQSNMNANEVIANRAIEILGGELGDKSLVHPNDHVNKGQSSNDTFPTVMHIAGVTEIERRLLPALAHLQSALEAKQAEFAHIVKIGRTHTQDATPLTLGQEFSGYATQVAYGIERVRSSLPRLAMLAQGGTAVGTGLNARVGFAEAVAAAVAEDTGLPFVTAPNKFEALAAHDAVVEASGALNTLAVSLMKIANDVRFLGSGPRCGLGELSLPENEPGSSIMPGKVNPTQCEALTMVCAQVMGNHVAVTVGGSNGHFELNVFKPMMARNLLHSARLLADAARSFTDNCVGGIRANESRIAQLLHESLMLVTALNNHIGYDKAAAIAKKAHKDGSTLKQAALALGHCTEQEFDAWVRPEDMLAPTP

SEQ ID NO: 16512 - protein, 108 aa, Chlorella protothecoides
MCEPCVHIFPAVLALARNFEKHAAFARVQLDETPELEALLAGSLGIRDVPTFLFYRNGAAVGRHVGGSRADLIGNILQQQVGAGHPLPPPGPKATKAAPAAARKFSNW

SEQ ID NO: 16513 - protein, 549 aa, Chlorella protothecoides
MSRLQPECTGHVPSLHPLFSLADDDLGEASWGERSVTGALRALIRDRLVPALRRPAVKSGVLVTFTVFFILSLAALPRLERGTFDVSNCMLPFAPGMAARAVPIKATRWPALTAPILCRHSASVTLTKPAHLNLHRGLEQSTALPADSYLQDYFADVAGLLRVGPPLILVVEGLDLTQHAHDNVTAICSVSGCDPDSLLNEVSRAALAPWQSFLAAPAASWLDDFITWLSPDAPLCCRQHGGDLGGGILGLGPDPDPAYCPPPDQEPCASDPTACADCRPCLGPGELSDGRPTLAQFQARLPWFLAAKPSAACAKGGAGAYDAALRRSASDATAVAGLSRGRVDASAFRTSYVSLSRQADFIQALQASRGFAEEQSRALGLQVYAYSIFHVFFEQYLTIAGEAATILGIAATAVFVICLAMTGGVTGFRRADVHARLYSPDLSTHPFATPPVTTGSPVAACLVLLTLASMVVDLLGLMTLTGIQLNAVSVVNLVAALGIGVEFCAHLLHAFMEESGDREQRTAAALTHVGAAVLAGITLTKFVGGWWRV

SEQ ID NO: 16514 - protein, 297 aa, Chlorella protothecoides
  MOD_RES (19)..(21): Any amino acid
MALLPGLLYPAMLHSWSAXXXTWCCDAGALHLKLPLQDSGVKHCLLRHGFAAGSLVSSHAALLECHPFPGIHAVHPPCRPAQAHAATAALAAPSVRTASADGSQRLQHQARPRPEVAGEARQAIIEQYLWAAGTALPSQPASARSGDDVPDEVQSPTQRIRALANAASQVIAHMEAADKTLTPSQSGQLTQLPSPLIIQVLDRRLLARLCLVLLDLEEETASPGRDGHGAVTAVPNAMPSPFFFDADSLYVRLEVVPPHIMAFVKELLAVPGPDERWGRVWEGRGRWLHSSTIKGPP

SEQ ID NO: 16515 - protein, 405 aa, Chlorella protothecoides
MQWGSAVFMGGIHDFQAAGADSFPVLSRGREHNSGGHGLSADGAPAPSASAASLSASFGWSLAQAPMALAICTSSLSWPWSGDLVCPPPNLEAPALNTRLSLQASPSRHPAIPPPHPLSNSLVLAMHLQEGALRLARQVVVGVGGAALGGPQRVGQGVGGGLQLGEQGGGDGDVVAPRQLPDLADVAEGGGHDDGVVPVLLVVGVDALHAFHTRVLVRRIVAPICLLVPVQDATHEGGDQGRARVGACPGLGDFCVVGGRGMRESCGVWGNYEGRWQRTECIPCLIHHPAGSMAQPRSKTRRSFPPPSTFQATHLRKGEDEGHVGADALLLQHLTGANALPGGGHLDVNLGGVHALGGVEVDQAQSLVHRGLGVEAQVRIHLGGDLGAGQGVGREGMDCWDCWGP

SEQ ID NO: 16516 - protein, 1084 aa, Chlorella protothecoides
  MOD_RES (30)..(47): Any amino acid
  MOD_RES (72)..(75): Any amino acid
MPGGRGMDRAGHGGFEWGGPQSKEGGAHTXXXXXXXXXXXXXXXXXXMIAWWGEAPLPATASGAAQPLQGHXXXXQHDLVDRNTRGAGCSQQTVHTPGAPFPSPYQVITKAKVPIIKFEEAESCYKFDISFDVANGPELSRCRAKQGLKGTGGPRKPAHAAALPSLCLQPPPAAQVHPPTFPSPIPTGGRVGEGADGRGLGSYALLVLVAAFLQLHPSRQPSRRFGKGPSKPEDLEQNLGILLIDFFRLYGRTLNTYDVREGDRRGRRLCIILGGRERQGTPRDALLQSAASPTHQPSAGGGELPQRGSLHQEVGLRFLLGKAQILETSRSPCCPISPQPFQSERPYLLAVEDPCDPTNDLARNSYNISRVRAAFEYAYLRMVAPSSPKESILARVLRLDPVLFMRTPVAHPESPQRPHKKSRKKRKSESPAAQVGRKVAAHIVMVHAERPPRSRIRRRGSTGSAVSAWRRRGLRLPQEKTHATLPILCLLPQSPDRDKTAIGDREEGRPKDSKLRMALQGIQGRQTLVAAGTSDLIDEAVLQNDANELVSARRAHERAESGHRRLTGGSCAGRPVRDQDSNLKHLFKRLHARMEAWPKERSATVHVQVGTSSTETGPRFPQASAPPRPAPWVQIIGAITIMSIFVAAAAALAVLASLGLLGRAAESGPQDLYSGTLDSVNSSSYPPAYYGSLHTYLNSAQLNSQGMSVDHDVIVIGAGLAGIAAATKLQAAGLSVVVLEARKQPCCPDVCARLDWVQTATYDDSPAELGASVLHGDISNPLAPPLTGLGVKRAIFDPGWDSQTVLALPGSGNAEIDPSLASSSTWLGFLAAAEALCTATLADIVEGLSPDNAPGSDEGDEVAEGSPPLGPSTPAHSSTVQSPGVPTASPPSLAPCSEGTLPSCQPPPPPPPSPSPAPAPSLQDAVDAYLASAPLTAAARRALLARIRLVEGQAGAHASSLSLAYAFAVGPTSGVDDLVVSGLGAVVDSLAADLDVRLGTTVRSISHGDLAAGVTDASGAALSAQFVLCTLPLGLLRTGAVDIQPPLPDQLTRAMRRLGVGGAAALALWFDQVRWLTGWIGGMR

SEQ ID NO: 16517 - protein, 290 aa, Chlorella protothecoides
MYSGPCHVPLYRVRSGQGACRGRRLDRALAEWQPPQPAGRRALWREGPGGRAGLQDHRRHLLDGRLVGGCWLEQGESARRVEATNPAVAALLSAGALLLGKLATHEIGLGTTGLNTVLGTPRNPHDPGRHTGGSSSGSAAAVAAGLCPLALGSDGGGSVRIPAALCGCVGLKPTHDRLDHSQGPEVDCTVAVLGPLAASVADCQLAYAVMAGARGPGSCAGPHGFDPGPTHPPVRLSAGLPRAGQDLSGALAGKQAGIYWKASLRGWRRGGTSWCVSLVPDDHPGTQPPR

SEQ ID NO: 16518 - protein, 368 aa, Chlorella protothecoides
MTSPVTMKVNAQSAPFAQRRQMSASVSRSRTVTMAAASTFQSTKVRVRVWEQLDLLRSYSRTSGWNATDGTAPATLKAANQLEALKQMSKVVADTGEVDAIRRYKPFDCTTNPSLVYKAMQLPEYEPYLRAAIAAEKESHKGARPYAYIADRLAVNIGAELSKLVPGRVSTEVDAHLSFDTQATVDKALRLIDLYAAKGVDPSKIYIKVASTWEGIRACEVLQKQGISTNMTLIFSFAQAGACADAGASLISPFVGRILDWYKKANGRDYAPHEDPGVESVKRIYSYYKQYGYDTIVMAASFRNIGEIRELAGCDNITISPALLAELEASTDPLPYALWPTQGGSTDPHYDLSGKAEGTFLQMHGEDQ

SEQ ID NO: 16519 - protein, 83 aa, Chlorella protothecoides
MVELEPELSDVERAGAAFKLTFGEDPATDQGPWRQHTCADYRRAYASGQSTPSQVAERVITAVAASEEQGEGACLAPTDGHIL

SEQ ID NO: 16520 - protein, 143 aa, Chlorella protothecoides
MDPKNPHMQPQEKPTGATAEAWLARLLQADLATVDASAGLAHAMAVKDEDEVKNVKKAAFLASGVLTQFMVKEIEGGWGLGVVGWHRECMDVDVPAPMCATPLSPTGVIDNEEKVRHSKIAEKTEDTILNPSKINIKLKVWEG

SEQ ID NO: 16521 - protein, 193 aa, Chlorella protothecoides
MPSPHRPHAMAVQTSPSWNGATALAIVTGQPTEEIRYYTSSSLHLWLLGYDPCGACRPIAHASSVKEGVHAPCHAVNAETAPSQLGMACLMLDGILPHSTTDTILVLTKTELHALAGSKKTDLLGPLAPAAEAAGVKLVLHTKPRKEDGAAQMQSLLDALKGSGEVGTVTVGTLPKVSAGLAGGGAPPAVLML

SEQ ID NO: 16522 - protein, 504 aa, Chlorella protothecoides
MSTHMYLISGVTEPRGKGGCPVHCKSKVQSPLPRAPHPTTHIQPHHALHRWQEGEGEEEEDPAAAGDGDDFLLTDTGADLDLRLARLEALMQRRPELLSSVVLRQNPHNVHEWHKRAKLFAADPTKQILCYTEAVRTVDPDKVSWAWRRGEGMGEWNPFPPRRWGRCTASGWLLPSCTNSTATSSTPASYTARRPRLVCGLCEEDGGLRWRGDVRVRVLCGWANGVQRADRKVAGQGVLHLYPTHSRSPGTYSPRIRVCFDPPQPTTPSPPTSQVPYKYVDDLATIYCEWAEMEMRAKAYKKALALMRTATTPPQRPRTREVGTLGSWGGDAHWAPGSLAPGTRSPAVKSAWRPYDEENKLPVQERLYRSLRLWSLLVDLEESLGDLASTRAVYETVLDLKIATPQIVLNYAAFLQESKYWEDSFRHVGGGSVGRRGVWVLNRGSTVRLGVYERGVALFKYPHVKDIWQAYLAFFNQRYGGKKVERARDLYRQAIDEVGGLSGF

SEQ ID NO: 16523 - protein, 469 aa, Chlorella protothecoides
MAPASRPNGSDAPENGIDSLLPDEADLLYEEELLRNPYSLRMWVRYLDARKSAPTLKRRLLYERALEKLPGSYKVLWRGMMPRMRGTWGQERWAVVLSRVAGVLAHVPDLWPPPPHPTHTPHTRIHAPSPLSPPPPAVACVPAGAAAGGARPLPRPPGPGGSEQRVRARAGVHAQDAAHLGRVPGVPGPSGLGHAVPPRLRPRPHGAAGDAARARLARLPGLHLAPRHATGDRGAHIPALPALRARARRGVRGLPHDSRPLGRGRRAPGPPGQRRGLPLAGGQVQARAVAGAVRHHHPPPAGSQGPEGGRHPTLRHPQVHQRGGAAVDLAGRLLHPQGALRAGQGRVRGGPRVRGGALGTPSGPPGSPPSVPREGTDVAMCLGARPWTPMRCHHAVPLPLALVLIVKLSPPPHTLPVVTVRDFSLVFDALTQFEESLISAKLEQVGSEGEIAYLGGWGLIACDGPGLDA

SEQ ID NO: 16524 - protein, 637 aa, Chlorella protothecoides
MVVNERQYVKGLKKTHKCGSQHHAKSREVGLAPPISPSTRSAAFEPGSLQGEPGHAPHSLPWLTTKCPCIIAWLFKEVTPKSSLDFSLLNRLSCWVLPGATPIRHCAPANGPPCPHENGHTPDPTPPSDVDPSLSSDQLTVGMRNEHTPRGRYTRRLFLSAGLALALYAWWEQPGRGVGTPPNPPPLLDLAEPSANASLPGRAARADLAARFAAEDRLLSSVAPPPPPGDAWPLLGPRLQPAMPAARNGTLVLYVYHHTRGPEHAARAALFVRAALQDGDGVAARLLMPRGTRHLLAPRLAPLPRNASWVELPEGACQASTWGVLGAALPLLASDLAASTYVVVVDSGTAGPFLPAHLRAHLHWTEPLLARLSERVRMVGPAISCEGTPRGGDVAGDWRRQPHLPAHAWATDAQGWALLSRPQAGVMACHADPWDVRWHSDLGAAAALFDAGHTIDCLMPRYQGVDWRDERNWACNDRWEGGAGGGWWGTEGREKVTAGKARLAALKRWLIWVWSRWSHCSWEGVYCQRARAPFSRAWEPGCMSLMALRASALSPPRTRLPPDRQRSNDGLSVTPYEVMFWPFSLAQAESYVELRSGLKYAQWSQASGLLSCMGGRGGESPRLSGRLACWGTGEVFQ

SEQ ID NO: 16525 - protein, 383 aa, Chlorella protothecoides
MVAPSGPPADESPCRAFPLCQADAIDVAYPPILQSGGTYDPKLSAGSNDDTLSYDVILCQVGARYASYCATVGRTLFVNPTPRQEAEYAALRAAHAAAIAALVEGAPLSAAHAAAVAALDERGQGALVEALGKNVGTGIGLDLRDGSCALTATAAGQVRAGTTFHVAVGELWRWLWEGEVEGGGKMQRGSWAGMFDMQNSSERRAPGVLMRSRDCDAAKSQGLVQGCLTEPSSASSPPCPLPRCPAATGLRQPAPDGEEGAEQTYAILLADTVVVRGGGQSPEVATIAASKDWEEVAYFLNDDEEEEEAEGEGGSGGKGGGRTLQPLDPQDLAGRRSQRTEQVDFRLRDEERCVRGRGRPYGLWACTGGGAGLWVGGPVKGRG

SEQ ID NO: 16526 - protein, 389 aa, Chlorella protothecoides
MADERCGLPPVAGEGVGGASTGVCFTQLRTGPSPRKPSKRCSTHARPHNPPPHKNKQTSPQVREVYETAIEAQPPFALSDADTRTLCLRYAHLEQKLGEVDRARAIYVCGRGCEHGGWRLAPRAHTLARTTWEPAGLSRDGALEPDRDIWALQHHDTLSSGPQRPPITPRPHAPRPLPPLPPAHADPRRDAAFWSDWNAFEVQHGHEETFRWGWSRAGRAWVAARGLGGLGCTDPLGSLATGVQPPSSPALRREMLRIKRSVAASFSQTHFNTTVVDAVAVAAKAMAAGGAPPPAVDDMAALEAELAAEPAGGTRLPGFVSAGVIQQGDAGQEGGEAAAAAAVNPEDIELDEEEEEEGEPAALELEQKEVPQEVFGSLAPPAKKSRVDA

SEQ ID NO: 16527 - protein, 102 aa, Chlorella protothecoides
MLRHDPDEIEDEQRERERRNQINHQFSQFVKRVQTNIWEREFPDLNLEFEVPFRELGFDGVPARTTCFIMPTVNCLVELTEMPFTVITLAGAASGLALVARS

SEQ ID NO: 16528 - protein, 147 aa, Chlorella protothecoides
MRPAFGGKGRKAAGELQAHANGFRYTSGRGEEVDVMYRNIKHAFFQPAQNEMITLVHFHLIHPIMGSALREVLLVSTEAGRCNPTHPLLKHVAPCQLLMNPCASTRARHPSPHAHGRQVGKKKTMDVQFYTEVMDSVQTLEAGRRSA

SEQ ID NO: 16529 - protein, 123 aa, Chlorella protothecoides
MVPFHVLTVKNATLNQDGDHAFIRVTFNYGGAYEPTAKFPGAAFLKELTFRSSDPRHAAKVVQEIKTMRSMVLQRDKEHAERATLVAQERLIRGKVRVSVGMRVGVGKVDDPPCQAEARTWLF

SEQ ID NO: 16530 - protein, 147 aa, Chlorella protothecoides
MNARPVKGSSSVFTIPLQDLDRDVGRIDAIQSKALDTIKDWLTSVDIKYYESKVNLNWKNILKSIKEVRGVEGPGGAAQTQCCHRATALLACPHEGHDSLVSPQSHSSSAPPQDPEGFIHSGGWSFLDTSQTDSEEEAEEESEFSPT

SEQ ID NO: 16531 - protein, 932 aa, Chlorella protothecoides
MGGVEGAETVSRVGDVQLGRGGARHGCRSSPSAPVQHGNNYLKPTAGLPPGSLTYSPHPLSRSPNSYQDVELVEVAVHQAHLCQPLHEVDELGVDPGRAGQFLDLHALVMRRFRGCTGSQAMKTGRVRACIGRCAPHILHEPSPPDNFGMHTSSPPLRKMGPSYSPLHNLVCPRSHLAPWLPTLPDLDQGECVHQAHEHRMSILVNGLRDGEAPGLQRPHEGKLLDRREAGEVEPAVVGALPQVVALGLDRPEGGAPQPVQLQAHAVALVVCDLVHIGLLTDANLGTDGKWKRGCGLGRRDHTGVSRAYVESIKTSTHVQISAPATAPHLATHAAHYTSGRESLDCQEVNAEGARAGCARWNLAEERGGSNASRTDRTSQQPSLLLPLTSWTHGEPACVVRAPSSTCAFPRACGRAHQAFSQFTDTAHITGESLPSTQPLRTQSCMKDVLETGDENSTPGSILKASAGSVLSTETHVLLTHLDGSEYSEVIFSKVQLLSVPKPDSVSHAWNLSARAGVGSGRPLAHDLLSGRTHARQGGRVRPGRASTQAATVGGIPRRHRDGTPCQAAEAVPARACGCQCRHPVSVPGGGGHRWARCECPQLDIPTNVSTPQLEILLNSVLKAEDGEKVPYSFHIDDKEVVQELGAHLLHNKVWSSLFIICKAWSCSSCLLEPLPGQAPGPVQGPPRRPLLRQHGRARRRRAFCQLLAQRSPPGQRVWGHHGPILGPEHPDATLYRAGESAVGGREAGLHRGFLPWFVKSQESYILAEPERDIKLRKTNKIVSRDSFADSILSSACISTAHKSWVLVVAWSPDAKLVASGDRSGEIFLWDPTTGKAVGQCKVGPGGGGRPGPHFKGLPRYRPSLLVPPQGHKNYVSSLAWEPAHAELPARRFCSGSKDATIKVWDANLRYVWWSGYGFDCGHHCRSWNGPA

SEQ ID NO: 16532 - protein, 302 aa, Chlorella protothecoides
MVSTNHANAEELFERDVDCLIRFFSKKLGYVPSLDSALKRVRPNFQARVRLPLGGQRCVLASPSAGDLDSELRASGFKREHQAALDSLRHLQSPASPMPWHNVHSVAEDDSDSEAGSGEEEEEEESSSEPECEPEASSSSGSDGEEEEDSEEEASEEEADTKAGRASPAAVAATEKPREGVAEASGKDSDNDDAASLSTVATGGTVWREASGKLVKRQPPGIHEVLECCEQNPRDPGPLHCAGAQCSGRHTASAAEAGGAEGCNGERVSERDEGEEQGKAEGGGGGWWRRWHHMGLRPQRRC

SEQ ID NO: 16533 - protein, 146 aa, Chlorella protothecoides
MRSAPGRRSSTSCRWAGHGGCGAPHSACGGAAGVRHVYPRHHPLPLLTRASPAQGYNASIIAYGQTGTGKTFTMEGEEGSDRSGIIPRAIQDVFSSIARDTGERCRFLVRASYLQIYNEVCEGGGRAGLPWAKDGRSEMARPWCGR

SEQ ID NO: 16534 - protein, 1282 aa, Chlorella protothecoides
  MOD_RES (658)..(661): Any amino acid
  MOD_RES (722)..(725): Any amino acid
  MOD_RES (1231)..(1234): Any amino acid
MDYEFHISRCDPDSESRASSLSDYDLTDVNRKSKRLLRVERMGPLQHCAPWGPAQRCASIHAICTYTYVALTRVFHGMAVPNVHEGCSDGHIAHALLPRPGSLSLTDRGLMGADHTSMEGLAAEFASCLLVMRLSLPIKVGGNRPCGGVRRGCFTQPKVMTPSPVLSLIQRGTLVAHLSANTSRGLTALLASTALGGIAVPLNRRWSAKQSAGALHRLGCRMLVTDHGLASRACAVVQELKARAGAGQGPDVELLILDGRSGQRGASEELSLLSPPGARTVKECAAAHPLLPCATFCTAQLLLPASPTCLGPPLTGPHGAAVLIFTSGTTKQPKAVGLSHAALLSQSCAKIATVRMVVWWGGVSYYRVAPWGFQLGPLLGLSSSDTFLHCTAFFHVGGLHWALTGLEAGASQVFLPDWSPAAALQMIKDAKVTAIALVPAMAYDLVAEARRKAGGATTAPLAGMRVVLVGAGRLEDATLAGLAALFPRAVVWAAYGLTECASSLTFACLREPGDDPGPAILAPARRQAGGWAVGRPPAGVEVAVLGGYGDVTRCGEGELVTRGPHIMMGYWADGGAHRSQSMAQGWLRTGDAGAVAEDAMSMLHIVWAGNTTLNAHESRCLAQAGEAVRGKCNPFRAGVRCRPPPPVSTAPALHPTPXXXXGESATLSERVSAAVHHPLLPPPQPCTPRLSSGSVYLSGRLSDTIRSGGESVPAGLVEEALXXXXADSATPSGRGGRVSLPGWWRRPSLPSTLCRRQSWWACPIPAWVKQWQPSWCCAPNRRLATLVAQKTAAPPAGRCCSDCGRAGPWRASSFRAASQSWVQVTYPGQPRGKCGSRSSWHNSRLSGHPSCDIPRTSTGKVRKQELVAQLQAAQASKLSSPAHQASHFAVLCRHVNACVQCSSLQPRSCTRALGLGDVHYGAQVTQRSPHLSHITHHTCHLATAEQGLVHDGCRHITIRLAIPEALAGKQGALIGPLTVGDVDGVLVSMPIKGVGLASDQVESWYKALQLILWGARHVLMPFGALTLDCSGGLHITNTAADRKLVLALRHSPVRGRPAPRWGVRSSLDPREDVPYRRRPAVAPMQKSQKVKGDPPSAPDGSGRESHIDHGEVRCHFLMSSAPSLLPAWEARWRTARPFPHPRALPAAHSLRGWPFQPCPAPPTAPCQEGPGPAPHHRGRHGAAPLWVAANRRKRPDTSAAAAAPPAHSQGKSIVKGPGFCRFSPGMRTVAXXXXGQGKSIVKGPGFCKFSPGMRTVAMADWATLTTHLPKHEAALFGTLAAA

SEQ ID NO: 16535 - protein, 915 aa, Chlorella protothecoides
  MOD_RES (419)..(421): Any amino acid
  MOD_RES (509)..(512): Any amino acid
  MOD_RES (659)..(661): Any amino acid
MPSQKCESACNMPAPQFRESCRPRSHSTFATCTLATDMSGHSPRAGISNKDLHTFTTVYAPGMPFPAAGCTIRRPVYVSIPCCISSSTFIEPSRKPQPSRRRDLGNMLGPRARTNCTEQRDARCGPCSTPHVIHGARPAEVRGAGRPDWLARSRGCKASIRCSSDRCGRWSSTAALEVGMLIGVSVGVRQLCWLGFHRGCLSFPLSTQHPLLQAVTPLALSPAGAHEARLTKPTPPSLAPGLHYALALAVPGAEVVTAFDINDTANDVYQHNFGRRPSQSNIDSLTAARLDRLRAELWLLSPPCQPYTRRGLQRQSADGRAASFLSLLRRLGEMQHPPTALLLENVVGFEASDTCAAMLRTLRDLGYAVLEVLASPTDLGLPYSRPRYFALATRARGAGLARHTLPFVVVRRGEGGEPXXXRARRRPGTAHAAICRRAEGGGRGAHRPAGSGAHDAPAAGGIPGGRPGGGAGGRRGGGPRRRSSRGSTAVADGSGGRGTRIGAAPRSSXXXXSSPTGAAAAALGSGAPLAAPGSGAPLVAAGSGAPLAAAGSGVPLSAPASATCDDPFRVPDVTLLKNGWCMDVVTPSALRTCCFTKTYGQYIKVGGREGRLGGRGARGLGPNVLSSGGEAARAPPRRRSHTGGPAFYPLAHTHGWDAXXXWSPGSWSRCPWQRRGGGTGSSPLALAHRRACFPPTGAHPWMGRPTDRTPPSLRPARAGVWVGAHAGQRGQRAWRDAALPLPGAGRGRHGGGRPRAQRGIPGRGAEGAGPALLLAAGDRKPARLPPGLRLPASRHAAPALRPAGQQPARGRGGEAAGPPLRWCRGGRRARLSGGPRCVGACCAAAGAPPTHPQVQGVVVPARSPRNVCSCAWSAVELLQPRRMCIGFRGHGRPARALRRARISMSREGGLGESTT

SEQ ID NO: 16536 - protein, 140 aa, Chlorella protothecoides
MRLEAELGPGHPAVGRAYVDLARLYTASCASCTARQLAEAALTRASEVLATCQEAQQRPPTCRDAFAYLLRPKEGPPHDVPGDVGLGRDPPGKEQWEEQDTAGTATPGGCEQLGGREGVERVEQCATLPPKQEEVTGPSS

SEQ ID NO: 16537 - protein, 196 aa, Chlorella protothecoides
MVGTRLSRLQPRASSLRREEEAASSPREEADDGAWPRRPPAPAGPGRPPAGPEGGGIFKQAAVEVLRAERRLMSTGEITRLALARRLVRCTGKTPEATMASALYTDIKRREGRSVFIRPHEGMFWLREWIELGIGFRDDHAEDMARRVRDGYSGYLAAVPGVPPSALGLAAPGYAPGLVPGLASRPPLGSPGRPGL

SEQ ID NO: 16538 - protein, 679 aa, Chlorella protothecoides
  MOD_RES (575)..(590): Any amino acid
GAARAAPRLAPEARAALEREALRSTDSDEVPAAGAAPLPDGEDVEWFNMCWRKVWRVYQRGIESWLAEMLQPVLDGVVTDSPVPAMLKRIRIMEVNLDHEAPYFSNMRRRSSRKASLGGRRPDIWGWDSKGVAEIACVVDVGVSAPGASPGRAGAGGRPGPLEGQGGGYGRGLASWDQDEGGCCVGPGCQTARAARFKRAHCCVAVAGLSRPAGMGRRRPRLQTPQTCPLLPSRPPQIPVLVSDLDVEATVWLKLRLAPMAPYIGAVSFAFVGPPAIKIQLAPYGRVRLMNIPVLQSGWLRGPAGAAPWPRSHRLFLPSPFHKFPSPPTPPLVTCLPSTLQTTLALPAAHPVAAADGGAAGPHDSAPAPGHRRPPRCDRDRGGRGGEGRHHARRGFGRASGEKLGTSVREPCALPLILAPRAGVPGRDLLLDARVQNKTRLAPSPASSSPGGCAGARAAGGAAAGAAGRRWGCVPSRFLHGGAAGDAGGGARPPRLGLPLAEQPLLPPDAGRAGGAVPAGQRDEPRVAPPRARLEPGVHLSGGGPARPGEEGVHSRAGNMVRQSSPSSPPPPNPXXXXXXXXXXXXXXXXCLAAGAGDRGPRLAHHGQDGGGQGGLPPGPPAERGGAQGLAARGDRRHRHVACEGWRGEERGGEGRGCGALGQGVQVAPAPRRCLASGA

SEQ ID NO: 16539 - protein, 806 aa, Chlorella protothecoides
MGKVGAVGGGVVGVHKFSMRTCGRTSGMYDLHMVGERAWRPWRPRLSHAVSRPRCSQDSGIACGDGVVHAPVPTPSYAVQQGCCGPDGGACPVARATVVGPDRLEAEHLHQRGKDHGHDGDAKADAHAQEAGDGAADALEVGVDDQVVDGDPDEDRDDVQGGDDGGGHRPGAQVAVHGGALQDEEGGHLGIGCKVDGEDHHERDQAHHTLQLLHLRDGHQPAIPHAGGLSRRGRLVQPTELGKGGGGERTGLGRQEDRIGGDVMQGGVEHWDGHLPAVSGSQRLANVPRLPGQGKGPELTSPLASVSPTPSHPLEPGLPGPPPTRRASWGTLALQWAQAPARTRNQRLMGLPPGGQRRYHLDPDTKQMMAMAKEMVGIRKPIIQLRGGQGSVGVGHWSPGRSAMRRPGLRSELAPPGEPSAGPPDVGLDPDHERAGKKAADVDKGVEPVVEAWDEGQLLGVALVKLVGAKHGDAGLDAARADGDQILGGGGDRGLVEGFVGAGAPAPCITAQPAMATLLASAPAPSTPTMKAQKKPVWLPLTRPLLAGVPRPLGAPTVHCVPLSPPTTKPAMRFAHHQVHAAETQDRPEASRVGVCQPGTDDGRHIAGTNPGGDLAAVGGKANSGAGAAPRSGSHSWVARPVPAHPPCVCRWCTSQNTISLQRALLLQNSPQQRHTHRLSCVRVGQVELVGEIHDDVRLHSGWGGACDAVGSNPVGRRSHSSVPAMRVWDALGGRKFWEGLLGSTARRPCSAPTPRTHPVTHTEWALRAGMLSQNAYWGLHRSPPPFLRPGDPGLWSRTLTRGRAP

SEQ ID NO: 16540 - protein, 131 aa, Chlorella protothecoides
MSVWWQVPQYFAVGMAEVFASVGALEFFYSQSPEAMRSMASALNLIAIAMGSYLSTGLLVLAKDGSTAAWVPLAHIPLSMSGCHREHAQVAIVAAITTKNGAPGWVANNLNQGHLDYFFAMLAVLMVRLGV

SEQ ID NO: 16541 - protein, 1389 aa, Chlorella protothecoides
  MOD_RES (66)..(69): Any amino acid
  MOD_RES (261)..(263): Any amino acid
  MOD_RES (317)..(319): Any amino acid
  MOD_RES (496)..(499): Any amino acid
  MOD_RES (1065)..(1068): Any amino acid
MVRVTLLASRMVVLGGCTGRFCAPHISPAAASTPGIMCPTVQHADHCRYKRLKTPAPAPDCRWGAXXXXPTVPHADHCRYQRLKTPAPAPDCRWGAAEICQLGGWMAASSVCPGGWCASVLQGEAGQGQDIRWAHGSQADDCTRSSSVDRVVVSLLMHKSPSPPQIFGPAAIKIHMLLDSLRAKGEIFLVGAENILERDRLTVTQPSYSGEGQVDSDPALMQSHLHCMLPHEAGAAPEGSRGRAVAACPLHRARSISRWLXXXGGGGGASKCECTVYERHSPGPGFTRKRSGRRGMASRPTRSESGLVGPCSASRAXXXRGGGGASKCECPVYDRHSPGPGFTWKRSGRRGVASRPKASESVLVGPCSASRARSHTPSGREDRWVWSEALRAAKGAWQGLTPSEAGALARDNEDRCVPAPVHGWVGYVCWGDGWGPSSDPQPGGAQGKQGPVVGRAWAPGLGPWLQKGLHPWHGAQRWGFIPLQQLLLCALQDPLXXXXQGPPPMARSTQLGLHPSPTIAAVCPAGSSLATTSSCSTFPPSKIILCPGMWTLPPGPTSPICWSRGPASSACTQSARRGALLPLHQAVQRPSVTSNPPTPRTGAPEAAPGLGCRGKQAQLSAEEDLPAGAGGFGPGLQACLVAPLALSTLEVQGRRTASVGGFGSGLRACLVAPLALSTREVQGRRITSASRQAQPTLRATQNEKRELETAIVVEGRQTSDKRISPSESASGAAMGWCSPASLVWARGGQVVWGLRSAVWQRCRFSRLNPWPRPEACRRLGVRPSCTMLGRSGSRVLDKALIRQCPSPFILCQSCRMERRGRRNASATSSVLTAGTATRRMMRRPTDAPCGGSRGWNFWGHRDGKQDLPRRSGAEDPGAGLRARMGGLPLARWPCTCTISASAQSATPSPPPPAPVHVSQEFFDVDDAQGTAGRHSRGNSLASMLTPTGSLLDGLDLEAEASAKEPGSTEAGALAPAPAQPASAAAAPARWEQGTPGDPAWLLAEKGESTREGCGVQGMPRPPFPLYSAPSEEGLQPFLPCLDQRLLRRHTCWALPPPPMGAARPXXXXSEEGLQPFLSCLDQRLLRRHTCWAPPPPPMGAARPSSPPHPHPLPAAKGIPRRRASLPPPAQQEKTVSLWSLIKGMVGKDLSRVCLPVYFNEPLSALQKSAEDLEYSELLDAAAALPRASADRLLYVAAFAVSGYSGTVGRAAKPFNPLLGETYELVLPEKGLRLVAEKVVHHPTVLVMRAEGRAWCMDADAEVRSKFWGRSIELRPEGVLRVRFADGDTYVWSKVTTSINNLVLGKIYVDHGGIMRVRGLDSGLTARVRFKETGIFDRDPRQVGGYGVDGVGGGPGDWEREGGGQQREGRGVNQRMGMSAGGGKRCPALS

SEQ ID NO: 16542 - protein, 125 aa, Chlorella protothecoides
MTSGFSVLWAQWRRHAVLGSRLQTLCAVFLFWLGTVRAGKVEVASVRAMREALNDTSITHVVLLDRPGGYVLTEEDFPKDSIWIDGRDVLLEGKGPNPVYLDVSNRAFLQCGHNPLSDAVQAEQQ

SEQ ID NO: 16543 - protein, 658 aa, Chlorella protothecoides
  MOD_RES (116)..(119): Any amino acid
  MOD_RES (298)..(301): Any amino acid
MALASFTTVVGRRPLLPPTHPPQLAKKAHASTLPSRSSRCTRRASWRRPTLSAGPCWASGTHTVPRCTPTSPHAWSTRCAPWMEKALGSGRPLARRAGHQARPNICQPQPAPPPPXXXXGGGPEATSAQGLQVCGAEALGSGRPLARRAGHQAPPNICQPQAPPLPASPFPPLCSSGSDAYLEQAFQLRGPDAAASPASSAATGTGSLVSTLWRATRLRGSGSESVAGDLGPTGSQRACLGPWPGPCSASCTLQTSPQSGHSQVGFAPIPTPAASLTLPTTQIGSIPHSHPQAPPVTXXXXWPLASWICTHPHPRSRPHAPNHSNQLDTPLPPAGSSSDAGTAPSSLAMQVHMVVEFCDHGTLEAAVQSGIFLDPALGRPRMVRDLFWGGARREGRGSCRVGMMSIPGAVPRVCNSALLTSLLSRVSSPPFSSPPASTAGLGAADGAGGGFRAGVPARPRAPSRAPRPLRRQRAPGVGAARGRRRRAGSRRHAPGEHAPLPRRHLRLWAEHDAECRGHPPHLPHEGHRSIHEPRGVQDQRRHTGPGHLLPWHHKGTSNHRGQGCADGSPPPGLHACAPLGADGKCAVPATPHPTPGLPHAVYYVYMGSLPYPDRNPGQVGLVAGPWSAWQGGCTRWDDEAESPPGPGETAHSPDCLNC

SEQ ID NO: 16544 - protein, 160 aa, Chlorella protothecoides
MSCSGRLAYALTMVRTLAFPCAPQTCPPTDAQVLLWRKNPPAKEPTRYNLTAFSILLNEVVPGTEGLAAPTDCRRRPDQHCLELGEYDEVRLRRGVERGNGCLWRGECMGRWLRGGRASRYSVALTRELGVIGAVGKSLKTCAPSSPLLGMRSSALGARA

SEQ ID NO: 16545 - protein, 168 aa, Chlorella protothecoides
MGRGGETATRAGRASLPARRAWEPHGGAGLVACRIIHPAACPPSPSQRPSQPSPPSVPQISDAFCVEQEQSSGLRSLSSTIHYMNLMGLAKSSLDAPPQVQIDARRTQVVDSGWINFPMGSVWRMLNCTLSCTGNVTHELTDSALLGLSKVPRFPVWGKRGEELTISW

SEQ ID NO: 16546 - protein, 387 aa, Chlorella protothecoides
MRCSPRPNTPTSCARSSAPPCPRRCGGCRGAWGVGGKGGMSGGQRIPPWSGGRRRSPLPPTPSDPPSLDTHPTLPSLQGGKHGAERAARPPAHHGGGAGQRLGHGDPDPAVRGPGSGQGAGAAPAAGGGCQASHPGLRGQPGARQGGAQASPMCVHGTGALEVPSARKRALVVRIPVQQLLHLLQNVPSFLPRELRFDGVHVDCIHSDQSDAARGAAIASFRRGSTWVLIATDLLGRGMDFPGVNTVVNYDCPRSTTDYVHRVGRTGRAGRAGARVYVALFLEDRNDWLWRGWACLVWQTRCVRVCTQPPAKPYDRRQHHQSPATPGRVGDHLLHGRGRQVPAGHRQRCTGVGLPRPRLDAGAEEGAAAEALRPGAGGCAGGRRRGR

SEQ ID NO: 16547 - protein, 426 aa, Chlorella protothecoides
  MOD_RES (368)..(371): Any amino acid
MQDPVLDGLIENCRSERLRCALCQARAPAYMKAMHIPGRDNHGCNPKQRNVSCTLNIDATREGFTPHRSAGRMSMLTRCRAHSRPPTFTPASPGDDEATLDATARPGLSRGGAEGAGPPSEASTPAFLDSLPHVSTRDPNEEANVIRKLHRIRVSGSLPPPPLRTFAQLAGEGEGGGDPRPSRLLRNLAGAGFLEPTPIQRQAIPALLARREVLAVAPTGSGKTLAFLLPLLLHARAMRRELGPAGAGPGTAPGPRAVVLSPTRELTAQSARVLALLLPGLGLRAALLSKATAAGTDFARVDVLLANPLRLAALAGGQGQGAGGREAEGQAPPRGEEPRSGAEHPPHQHPPGESSGTRVPASRGPPEXXXXGAAEGRGAAGRRGASTPSTPPRRVVRHTSSSISRPPRYHTAPPAGPESGADPGAG

SEQ ID NO: 16548 - protein, 512 aa, Chlorella protothecoides
MGTAGGRGRCARTLSHRQFPLHPPFAARATARSVVVSGGGDAVRGAKGRVPHGVRPPRPVHTLVGVGAEEVALRLDQVGGQAAAAVGVKVAQGAGDAGDANAGAHGHGHHAAPGVLLPRQLGGKVGVHQEVGQVGVALVGQLDPVQERGADDAAALGRRPGGCMSAESRSRKMGGPGRVRSDTVAHQKHKKETHPNPTGYLPDAAQVCQLDAPALLHALGADDVVALCVGADLGGVQCLAHIGHQRRLVHAGRGGRGRHAQSRIQRLRRHALVLEPRQEARVQRGGHGGRGHAQLRGLLDGPLPRPLHPRLVQDLVQQEALALGVAHGEDEAGDHDQEGLQLAAVPLHKGGRQLLVAQPTHGAQHVVRLRDQLHVAVLDAVVHHLHVVPSAPGPDVGHAGAVVGLRRHALHHGSEVGVGALVAARHHGGAVARALLATGHPHANVVDAQGRQLRLAPLRVLVPLVPAVDDDVAGLQELRQLLDGRVHGGARLHQNDHAPACWCWRGEERRGE

SEQ ID NO: 16549 - protein, 309 aa, Chlorella protothecoides
REATARALAAALRPELERAARDNSDPPGSPYEFEAGACARRALKNAALGALARLGGEGVTQDLLARFRAATNMTDEAAALAALDRIGHEQSPPRRGAAPGQRIGDVHPSIPPPAPPGGKVRQEALDAFYAKWKHEPLVLLKWIAMQAASNLPGNTAAVRTLMQHEAVKLSNPNTCYSLFLAFARSPVNFHADRHTIPVWVRSWMTGEWQTSRTASVLRLSPSKRWPHVHPPHNLAISAADGSGYEFMADSVLQIDQINHQVAARMVGVFNSWRNYDAERGALMTAALRRMASANGISANVYEIVTKALP

SEQ ID NO: 16550 - protein, 676 aa, Chlorella protothecoides
  MOD_RES (91)..(94): Any amino acid
  MOD_RES (653)..(656): Any amino acid
MWTQSSWPGSGINWMPHRVAQSLCSAMRPFSAAASGWVAGGLSAWVDGRPVSDLAPRNAEVAVSWVHAASQSRTGSTLHALCHGTVAQQSXXXXSRTGSTLHARCHGSVEQQRKADLPRSPCWMSTSRIDAPGLTTAPTPMCSWSWWSPTPTYTCGSAGTSTSATTMQLHEPEGGCIPCSQPPPLPSTDSISVVGRTAFATTGVIGKANRDGFRHSWVLSGMKLIAAVGLKSTPTEYRLQTLDHGTGRLRLDLVQEWCESVMLMPSVLDGCTMSTAQTIARAGPQPTFMGAETIHGASTALQWRHECLRLRARRVPSSLPQSPARGSRAAPAPRPNRTNLLKAPSVVYGGDLSMGACLCVSHPSPGRHPSTPILCRPVMSALPGLQFEGGEALESTAAQWFQIGNGAVLGRKEGLLVEYEAASASPIGVVLTDLEDDHQLGAISSPQPTVLSLALPPVLPDTIQGRRRWDPVGHRARRGRNLGMASAQLGAIPSPQPTVLSLTLPPVLPDTIQGRGRWDPVGHRARRGHKLGSAWTGGRRGRRGRGAALHPPECARDILPGEDGGDSAAECIARGGGMFRMCSQTLERLAYGMDGLLGTPLPISNTSMPILYHSLPPADFPAEQVAAAAGKGICHQGPPCRNQPVISRAASPXXXXWQLRLAKESAAKAHPAASSQ

SEQ ID NO: 16551 - protein, 96 aa, Chlorella protothecoides
MGDAHTVVADVAAALCFFYDRPKGGPFPHPFPTSPEGLEFKTDALNLAAWQETFQQEHHWRVDVGPAILLGLGTSRFRSNQHSAHEVRHVIGALGS

SEQ ID NO: 16552 - protein, 335 aa, Chlorella protothecoides
PALPPPPPLPALRTLVLSSTGVGWGGALRIGRSLPSLAALCLCDESVEDVSPAEMGECDLTATFPALESLDLSGNLLASWRQVAALATLPSLQTLNLTGNPWGSSGDDSDCAVPCPPGFRTLRTLLLGGTRVSSWSQVQALDGLPALASLRLTDTPLWTRAPATARAQTIARLGGLVQLNGSQVAAEERRDAELWYLRKVTGGVATGEELRALNAAEVVGGRGWPTPCVMRRCTSAWPMPDEHRVIALPRPAHQMSWLRARRIKRACSPATPATPLCCKHWGPLPLPWLPGGLGQGPAGSWRSPCTMKSVWSSSACQVLLVGGGSRMNAGPSVSR

SEQ ID NO: 16553 - protein, 82 aa, Chlorella protothecoides
MCPRTPRLHGSVRQSCTPSPCLQEEAASLASLKDEANIAFAKREYDHALATWDRALKLAPSGSTDAALLHSNKAACHMINKR

SEQ ID NO: 16554 - protein, 93 aa, Chlorella protothecoides
MHQLQCKDLETQKEVAVKALSLRSLRSWKQLDLFEREAAALKGLRHPGIPQYLGYCEEDTPDDRRFLLIQVGGYAVAEAPSCWGSCVRIQGLL

SEQ ID NO: 16555 - protein, 168 aa, Chlorella protothecoides
MRVSRLRQLPECAPPSLRLLCSFKEAVNECSTALELQPSFFKALVRRGKAYEQMGQLKNALTDLQRANKLDAATQESKEAEQRLRDAVAGKKPSGLGNGLGPRRTGGAAGSGKAPAPSRQIVFPAKLSFEDDVRALQLVPGVTYLELIEHVRQLFPAASPFVLKYLDK

SEQ ID NO: 16556 - protein, 367 aa, Chlorella protothecoides
MTTMTRLAGVLLLCGLAALAPTPARASLYDPHVPTMYDPAFRTWFEGWYVRITTAQPEGEGGDDGTGPVLPSSLGLIVGTMPRGRLGWNISLASLLVQQGSRALQTFESTGVQLSVTGAGGQTVVRDPEPHTPPDFSVVADDGTALLHMRGEQCALHVTLGGLTMDARCTGPPLRWGPNDESPEGGISGLPTQLVGLHWFVYSLGTPVAWSLRNDSSGETVTGAGLAHFEKNWGGTFPPGWAWAQGLDLAPGRDPSRPRAAVALAGGQLPTPVLPGRAVGSGRLAAGRALARRAGVGLPAPGPHLLHSRGGSLQRHAAPHRALALDGADGGGDGARPARPVWARDLPHGGGLRAGHGGGGVPSKPHR

SEQ ID NO: 16557 - protein, 444 aa, Chlorella protothecoides
MSTPPCSREGDLVTIGSRNDVQRAMQEAVETASRSSGNRGPVTQASLAPIRLQVVRVSSERWRGTPQHSTLTHRYPSHTPNTPPHPHTQDQVPKVPEDELAYVQQMLAQLQKAQAARGGAAEPEAAEPEAGPVQVDEWILSFVDLLKEHCGIDPDRPLEASEVGNDKLQAAFQEMMEGDPKADTLLDAALEKFEDQVCFGMYNQATVHQYRAEFAMYRAARAGEPASSVAEEVERHLARAEAKHAEALEYKPTFLDGYLGQSSVAQSRAKLAADYLLEPVRPREDLKDAAERAAAEEAANRAAQAKAFQRVSAESAQAAEAFMDASYALIGAAIDHMSEEERGKEVKPMRPTAEQTPGDPESEMPVKASLLINLGNAHYEHSILRAAGGLDWRPLVEKAAAKFREAGEGVVWGTRGGWGEEGRLGGRREVGGKKGEWARHGQAG

SEQ ID NO: 16558 - protein, 100 aa, Chlorella protothecoides
MYLLLSPSGRTNLFLLVSCPESPAHRHSPPFTPLAGAHQVDIRNALKGHPLSEELADLIGPEPEEPEVSQDAPTEESTTAPKGLPALPSKSKKKEAEAAA

SEQ ID NO: 16559 - protein, 229 aa, Chlorella protothecoides
MKPLRAASPRLPHHPTLNRERLQIGLKKWNVKQQLALFRGGQPQWDGSGVKEVGGRSSDLSRAGLVVAGYVNGQPQTQLVLQEGTRKVVLGEGLGLEEQEWLSRLINTHLAANRELRGEEPLPEPRPRGRRGWMADMEERMATFSEDLSSTFNQGRSFLVDVEDRAQREAQRAQRAARQAQRGAEEGARRARGEAEAAGRAARRFGKDLGPRVSPTGTIDVDFDVLDDE

SEQ ID NO: 16560 - protein, 283 aa, Chlorella protothecoides
MAPEQFAGGASPASDLYGLGATLLFLLTGRAPVASDRMRVSTSATAMSPRLRALVEGLLEPMAEDRLSVEEAQEILEGGRARAVGARKRDDAEAGRPSGSRVQVTRRGPRLEIDIPPPGFSGGLVCLGASADCAEPTGQPWELKVYGVQQQREGHRLAEFVARHAAAARVCPQDLADGLALPLPMLAPNLKPSPTSHTPSTSHAGDSLPSAAFALAWNAFVAFWTVSALAGGGIIFALFSLPFWAAGLKLSRAALAGQFLRWAGVEPRGVFLRRLSVSAHARS

SEQ ID NO: 16561 - protein, 176 aa, Chlorella protothecoides
MPPTWGTRVRGVELLRRVVVPSALVAREGSLEGGPLRGNHSSARLTIPPLLPFLPPGFMIVRGDELAFMSPQQQHDFNFPFQIGSPDSMSDFPSAAQVCRGRRGMMRGAEDPGGAGLPEGAAADRDGPVAMSSHQLQSLPRATMPYLPTYPPPFTTALLPEDVRGRRAGAGHRRRV

SEQ ID NO: 16562 - protein, 168 aa, Chlorella protothecoides
MPSPGQHAALPAQSDAHAPPQPALRCPSYPSEPTPRHCKSRWQEGNCRFGNRCNFAHGEAELRGLPPRSRGPSGGPYSQVGPGAGPGTWQGHQQTHGPGSNSSSGTPAADHAAKPEKMTDREVWVASGCPVAGPNGWTQYQVNIVVGWGSAPACCLVSLPIEVAMQGP

SEQ ID NO: 16563 - protein, 271 aa, Chlorella protothecoides
MVGLPEACDTPETVRVPAFPLQGPDDYDYDDKFLVREDEDEDGDGEPRGQVACPCYLMLRRGSCPVRPGDNRGRSFMHSERGDQVGMGLQPPSRPMPAAGTGAAEGEAQPPAGAAKHAKKKRRHRELVLEDDDYDLLEENTGIRRARPAAHRRIKKARDADRGLGREGGAQALQEELFGAELEDLEDEDAEAAPSAPTAPPGRAAPGPGARAGDEFDAEEEDEDDWIVDDFEGAEDEGAAAAAGAERRRRRRAMREGVPDIDPDALDVSAQ

SEQ ID NO: 16564 - protein, 701 aa, Chlorella protothecoides
  MOD_RES (125)..(128): Any amino acid
  MOD_RES (269)..(272): Any amino acid
  MOD_RES (337)..(339): Any amino acid
  MOD_RES (589)..(591): Any amino acid
MHTDCCARRHARPNYPRPPNLSAPAIKTSLCSLLPTSTHPPNTPGIVAVGGDGAFHELVNALFSEHRAALRALRLAHVPAGSTDAVACSLHGCRSAFGAAARVALGYDGLLDVLRVDPGPGRAPXXXXWRWAATAPSMSCAFGAAARVALGDDGLLDVLRVDLGPGRAPVHACCIAAAGFMGEVCARAEAWRALGPLRYDLLGAAALLTGRGVRARVSTLPSPLTGMAAERLGPGAEGAACRAGCPVCELAGEGGGASASSDGDVWSEXXXXAPSASWPGRGLVRVRVRMGTYGRRPTRRWTPTRGGCPATRLRADPTLSTGKARPVPSLWTLWALXXXPAAGHRRAEGTQRRVAGRNRRSPPARLTQCPRSRPYGPPARHPADEMGVAGRALAQREADRDAVPQRQDAVRHGARRAPSRRAGQGGAGAQPGRAGHAARTGAHGGARPGGGGPAGRGGAGRAGGEGGGRPRREPGLEPGRRGDARRFAAGPRDQGGAARVCPGGGDGAVRGCFHCPPCQAGRRPFPDARHRSVHWRRPPGQWPGTQGPQPDEGCGGSGRPPTVSCLRPSGETLWPPSSTTRTAPASPAXXXLRPSGETLWPTSSTTRTAPASPEGQSSAELKARRSSSSRPKMPSASSATASEARGVRRARRTVPCAARASSAKAGPAHQSVSVDAWAARGGAIPSASRRPRAIAVQAEGP

SEQ ID NO: 16565 - protein, 306 aa, Chlorella protothecoides
MACRARNRRLPAPRTGAASTLTPGPHPASHRGEAYYVRRDLADVHTQDRWRRLGRDVLEEELARPAKALARRRAPGLSPGPAGGVSKTISGRVAGRDPPPDPAGVPPEATEPAAPMVHYYGEWQTRVAVPLAARNGKVPRNAMGNVEVPPLAHALPLGTVHLDLPSVFAVCQALRVDAAPALAGFEHRGGRATPCLRGVVVAAEHEGAVLELYWRQAREREARAEARRRQAAEAAWRSLLRALLARVRLQARYGEEGAGQGGSMQDAAATLLEPEARGGSVAAGRRVDAERGLQHTSAPEEEAEEI

SEQ ID NO: 16566 - protein, 430 aa, Chlorella protothecoides
  MOD_RES (123)..(126): Any amino acid
  MOD_RES (268)..(271): Any amino acid
MSRQAMVCERVLGQDCERVCVAWILSATMRHPAAEQRVTALLSALQPSPASEARRLAIARLICSIIRKCFHNEFEVRFIATRDGARVEVATSHSCFWRTSVTDPNHANSMPGGGIPLRICPSXXXXRHPTAASGAPPSPTRITQTPCQVEAFLFGSVPLRTYLPDGDVDVSIFCSRRTDQATLRGVWAPRLVRALEWEARRGPVHLPIRDIQVIQAEVQLVKCIVSGVVVDISFETVGGLCTVAFLESMDRRIGRAHLFKRSILLVAXXXXLQAQHPLGEARRFGVNRGILGMGGVGEGRQQYQVSECEATVQVFWAHCERRDVTCLVRQCPSYQPRSTLSTLPHPRSADQGLVLLRVPPAGRPPWPAEFLRPGNPCAECHQPAPQRGAHPPPGLLSRVNLGDSQYRGSLCFELHFVKVCLHLPITLSFP

SEQ ID NO: 16567 - protein, 393 aa, Chlorella protothecoides
MQQQQLAAQQQAALQKQILAQQMLAGGGAAGLAAAAGGAAAGGLTDKRQREVYIGNLAMGQVTADMLREFFNQAFSHLTPDPVNAPPVTRSAMEGPSRYAFVEFRTEEMTLVALSMDKVVELCGRPLTIGRPKGWTPPLPSAAPAAAAAAGPTAPAAAPEQTLLLSNALPVSGVRQAEDRAVLAAEVREEAERHGRVEEVAVPAPPTSIQHTACDPAPQHPSFPPAQDAMPSRVYIRYATPEDAKAAVAIFNKRTLDGNVIKAVLVPDEEWQDSRAGQWVTRHSSIAGIPLPGAREGRGFIAGNSGRDFCVYMWGQRWLLLGGCAWAEIVFRGRPETYLTTLPSPLAAFLARPVYQDTPARRDHGAGSPQLRALRSGPDESGNRDGAHRRDQR

SEQ ID NO: 16568 - protein, 408 aa, Chlorella protothecoides
MLFINDTLPPFPAPAAAPTPAIRAPGTGPCHRLLPLTLGRVYPTRAAELTSPCLVGVRLPCVYGGAGRQCRPGLRWINLLILSPTRPSGETSRAIDMKSEARTAGIPRSSQHLLSEYSQQHSPTPTRIEFSAWSQHRERPGGCQVQGVGRKVVGPPWPLQAPPPPKPHTRGVHGPVHLRSPGCVPSPSLPGYTLGSRAPSPEQGACCTSYARLSADSATHPCLARPCRLDASLPAPLRGLDILDVGCGGGILAESLAKRGAAVLGIDVNEEGLAAARAHAQADPRLASLCSYRATTLEDLAAAGNKFDVGEAAASREDVHSRKGGVCRCLGDRAGVLRMCTHRADALPCNCCITSPTRPHIPSLTVSHVPPILQSLPARSSSTCVPCRPLCPAWQSARAFRPPSWSPP

SEQ ID NO: 16569 - protein, 234 aa, Chlorella protothecoides
  MOD_RES (122)..(125): Any amino acid
MTVGTLIGDKHGLIHMLGADQSDAHMYVIIRDHHPTIRCSPCQVNPQMPGLREEKESPSCLATPGSSTVSIGGVSAGLLALMQTVGRLSCTLIIPKLRLKPPSLPSTELEGQVKVTQTTDMXXXXCTLIILYLLLQPPSLPSTELEGQVKVTQTTDMVDFARRFGLEMLVRPESVKKEEDELLHGRTRATVDEVCPDCGAQGMEFYTLQLRSADEGQTVFYECTECGHKHSTNN

SEQ ID NO: 16570 - protein, 413 aa, Chlorella protothecoides
  MOD_RES (98)..(101): Any amino acid
  MOD_RES (136)..(139): Any amino acid
  MOD_RES (227)..(230): Any amino acid
MFQPRLQHQGSRPSLPKPPTAQGLPEGGLRRIILTASGGAFRDLPVSELPKVTVADALKHPNWAMGKKITIDSGVQATGAGCCPVVQCDACAFSRIFXXXXGVQATGAGCCTLAHCDACAFSHIVSHADEQGTGEXXXXLEVIEAHYLFGASYDNIDIVIHPQSIVHSMIETQDSSVLAQLGWPDMRLPILYTMSWPERVPCSEVTWPRLDFVKAGNLTFRSACGDXXXXLGPSACWTLAIPAGALPCDAQSLSCPVVTFLRILAYPCEPKLASPRRPLFPIPIHIHRQPDHAKYPAMELAYSAGRAGGTMTGVMSAANEAAVELFLEEAIGYLDIVPVVEAACEAHSTADGRIASATPHLLEWEPDAPSSHFHRVELVERPSLEEIVHYDQWARRHVRESVAKRAPAAVPAL

SEQ ID NO: 16571 - protein, 543 aa, Chlorella protothecoides
MGQPACEEGNTLLQALQAERNRLHRAVCKLKESNAELKAELDKEFDRDYKEAIQDNIPVIAKYTARVASLDEEIAELQAGRQRISGPEVLVSTRNDTTETGRQEAPEQQAYELPCVAKGNAQLQCSIERAATFQHPEWPQEYKIALTGLTGCSSVSAVRGALISGVASGMQNRLDWSQRLFICIRSERRSDIRVQNSIAGSKRGGTSCTPSTRKPHDSFHVSVRPAPLRYPCRVTAQGFIIDPQIRVYHHSRVEFEYVGGCGHPATAACFRGAARHALLSTVQHPGADPPQLCAAANVQGCECISCTSALCLARPCRLAGEIRLQDRTQGTSDPSRIAARTLVHSPVLQRDLTASTPSQPSSAGHHDTRTHQPRTTPSPAPRNSRSWAPPAPSAPRPWTSWPSTPTASSGGARALEAALDAAGVDRRPEIQIGAAGIDAVAAHPEADACVTGIVGCAGLRPTMAAIEAGKDICLANKETLIAGGPTVLPAAAKHGVSILPADSEHSAIFQCLQVGGGVDGVGGRMGGAEESREACLLLSLSLG

SEQ ID NO: 16572 - protein, 836 aa, Chlorella protothecoides
  MOD_RES (24)..(27): Any amino acid
  MOD_RES (520)..(523): Any amino acid
MHGIPTSTRPCLSPRTHKLLAVPXXXXPRPRCALRVDAWNLNIHMPMPVTSHPQALGSSMGDLIRRSRYSVPSPDSSQCCSSFPLDYIQPVLGHDCTGGSPAHQRFPARKAAALPAGCPPCVPPSTVSHHEHAVHPSPTPPRGRQLLGQLHKGAHAGLRRALDHAMPQVHDVPLRPRLLQARRHPGAHVGFAAEEQHGVHVALHHDVGAQRRARVAHGLVPVHADRGGGQRAQRGQLPRAAVGVQHDRHAGAGGGQAAQDPLSLRSAVGGVLRGGQVVRPGVEELEHLRPRGHLVLQVRRDGVGQPVHEAGEQGRVAQHHGLGRTAVAVRATLHAAGRGVLQRAQRGHGRGVAQGGGDEWTAALDHLELHADGGEEGEDVGEHDYAVGVKGVPGLQAQLRGDVGVLGPLPESILVGEPAEREGGGGGRSWGCGQRNWDERQRAEEQVVLRATLCTRQPVPAEGSTSPSTFRAPTTHFRKAAMYRPACRISQTGDLARRPHHDTHLGQEMSHPAKLRTFSXXXXQGLARHLNYVSQPWGHPRILHGGRIMIHIKAKKCPTLPSYALSPLATRSSRGSLVAWLAPGCACWGAATLETVLGLHLETGLEGVTLSEVAPGEGDQCRRQGGQDVTSCTLGEKSAVCQKFLTMASIDSRVWLCDAAERFRKISRSITKSMNQSSILGSKQAVVTVDPQTSSESQHGLEDGMPHRPSVPGGVEHCAIPGAEGAPEDHEINALQTHATERRSVRALRRCLEHPHRRLLDAGGAGDCMCFGEAVMAWSSGADALTHNAHTRTPLSPQGLAHCFEKTDDGKLVDRYIIEPLSANSLECMANGADLE

SEQ ID NO: 16573 - protein, 1298 aa, Chlorella protothecoides
  MOD_RES (241)..(244): Any amino acid
  MOD_RES (424)..(427): Any amino acid
MPRRASRVRQNPMRRLQVGERHDMGMETKVRTESKAKVCQRCSWSVASHSDARAHSRTPAHTQSTHHRSHLRWMAVAARLEAFTPTRLRSSAVSVASSSEPRSLTRPSMASVLDLSEAASTASSSVSASWSWAWESRPRSSLASGPGPSRRRRPRPVRGEGGAAGSACSAGCVSSEMKGSGPWKVAGTAGSCREARSAATAPLYARSTSGSSLRRGFSSPRAEPRLRYATQRETHLAVLAXXXXAYNALACITVPPPLRRSPDSARQLIARHTWRYLPRARDFLQLDQLLLERCNVLRKAKATLITPSSRGEREATPANGQTQAVTCRCPAQQLRTPPAAGGRRPQGRCRSEARAGWPWTWRLWRSGGQARHFLVSLTPTPSSHGELPLRTILELCMEPTVFLCQQCKTRILISASDAEPPLPXXXXSAWSPPSSSVSSARLGSSSRPPMRSLRCRAPAKCPLRWRSRSCSWRTLCMGHGASPAHVSGIGGSDGHSGPHLGAWCTFKARSHTRFLDWFVPCGPPSNGIPQPSPQSQFPEADPPARRMEESFVVLPSGTARGPPAPPAPRVPFHATLRALTNVLEAASAATGVDHPVCTDCAADVHRELDAQTADLQADLAALEVALGRLEGAPPDTPDPAAQDAELAAARRAVEEGRWGGFGGLFWVQGGPRTRGGVWILVHGWCPALLAQRAWSLSLLFPWFTKTHSHANLLELPLPHPTHSQHHRARLGEAEAAAAAAEAEVAALEAAAADLSAAETAYWHEFNAHQGALAAHVAERDAVAARLQAGSAALGTLRRANVLNDAFRIWFSGPFGTIGGLRLGRTPACPVPWEEVNAAWGAAVALLFILARLAGAQLSAARLLPMGSYPRVADARGTHELYGPVSKLLCPSYDKAQGLKACMSLDCVSPALPCCMTCVASWERECSAAVRQMLTGRRLKGICLATLLSEQQNSAGESAWGWLTAVTRCTPCKAPPGTGIDPPPPELTSISPTLPCTAGVCGVAGGPGGQPRVQPALGNRGGPGGVAVHPLHAGQGQELDQGAEVHAGGPEVLPQGHGRAGQRARGGRGAALRPARGPGLEPGQGMTGGSGEFEEKWGGGAVELLHAGQLRLETKMAGFLGVPASITDCPWTSVARSKRSQRCVWLPWHAVYNHAVARRQSACPVKLNFQCPQACWGISSVKLRLTLWMSWPHSMSLPGSSSSWPPLAVPPGPSSCPPQTGLWRSAGRLAPATHSDAPACSDSTPCCTCLPRPLAPVKVCRRCALVTLAPKGSEPEMYRSYWSDMDLPMCQIQLHSLSA

SEQ ID NO: 16574 - protein, 105 aa, Chlorella protothecoides
MVVLPSRSGIDLGSERLRHRFTIGWALMTDIFVYGTLQYPEVLRALIGRVPDLTPATLTGYRRYCVSQQVFPAIIPGEADDSVSGPRIGSMVPGRDVRRESAKQG

SEQ ID NO: 16575 - protein, 311 aa, Chlorella protothecoides
MPAPTSITQPVNSHPTPFPPPPDRRFFEGWYWRLTLPGRGQSFAVIYSVEDPGSQRPTSGVGAQIMGPNDSYLLQYEEGTAGFWADPHELALGKVFAASPGCAPAAAPCPPERFEALVSEGFQVQGGRHQGRIVSREAGVVPGPAPSVASARWDFQVTPRLGWGSPGQRQLSTAGWLAAVPIFEPHWQGLMAHGSASGWIEWGGERYAFQGVPTYAGERLGIGRVAGGGAGWCCPQEVEVGWRSRMARPGAGCRCIESMSVQSSVCCSLPRPLSRALQHPIPRTTPCSPPAREELGGRLPQPLVLGAVQQL

SEQ ID NO: 16576 - protein, 107 aa, Chlorella protothecoides
MRVKLSRQRVRRAGQDHFLGVSARFSGGIIAREEDEGDGNAVLDHLIATGAMSTATLPSPRTGTFLEVSFRRLLEECEAVVQGSDRSQPEFAHWPVSPLFHHVSWVL

SEQ ID NO: 16577 - protein, 280 aa, Chlorella protothecoides
MFSDILTLLPAIGVEFQVIKGRGPLIAAPLRDASAVAALRPLEDPAASLPFVGETLRNLRAEVGDGAAVLGFAPTPWTLAAYCVEGRADRNCRATKTMMLRDPALLACLMDRLADAIAAHLEYQVASGAQVLQLFDSWAHHLTPAQHAAHGAAQTERVLRRLAASCPGVPVMLHTNGCAGKLAALGALPAAAVGVDWHQPMRDARAALGADVVVQGNVDPMLLFGSEADVRAGVAACLEEAGPERHIMNLGHGVIEGTPEASVGAFVQLTKELSAARRRG

SEQ ID NO: 16578 - protein, 297 aa, Chlorella protothecoides
MSGMHQAVWLAPPSAPGAHTPHTVGMGPPPRRPTGARRGVRLVPGLEEDVGLIGLHAAGDFHEFVPNKGDIGWEVEPWGTWRIHGENAEHTALVEATCPPEVGTVLRAPTADLGLAPFCRDSFSGRVRRLRSRGWGEGACWPGLGDRAQSVLPRGARAATPATHRVPNTIPGARQDVAARGGGARAAGGRLREPGGDGGGGGGGRALVERVEGPGGHGGGGQGAAQPPRGRGGADGLAPGRPPPQGTLGSVSRGSQRLLPRGSPAGSNGKVLIVSTRGLPDSHGRHLTAKPRSAVPR

SEQ ID NO: 16579 - protein, 184 aa, Chlorella protothecoides
MAAIVGAEYVLRWVPKGEALRGWEGKNVLVDVGRARWGLGCAGWRVHRCSCFGVRRLTPSLWQDACFSTLPPIQRVCARYHSDHGSVPGHPRPLKFFPPTTHHPSHSTGTHHWSKFLTPTELTQLFRAHTPFHLWQLAGMEFNPVTGTWSLGTNTSINYAACFTRAAANAPLAEEPAEYPPPEQ

SEQ ID NO: 16580 - protein, 75 aa, Chlorella protothecoides
MDEFESEEYVKTAGAVLNAETDRLESVLYYVWHPSLESQLERRAWSPEAFREQHLQAYTKMCIEFAAELRSRAQW

SEQ ID NO: 16581 - protein, 121 aa, Chlorella protothecoides
MEFVGGGNLQQYVERAGTLPEWLARCFFQQLILALNYCHQHLNIAHRDIKLGNILLNTKYQIPILKICDFGYSKNIVTGSVPKTRVGTAAYISPEVAKSHGVTAYDTGMGVRMGKCDDAGR

SEQ ID NO: 16582 - protein, 112 aa, Chlorella protothecoides
MAALPPVSPECLALLHRILVIDSGARASFSDIMADPWFRLFLPNLGEMGSAVAEEVQSEAEVLERLAEAAVHSDERAREEALSDEAIARGIEDVFLEVDPSQALSMDLSFQR

SEQ ID NO: 16583 - protein, 205 aa, Chlorella protothecoides
MHCRPGELLGHPLRRLEPEVLRAYRGAVAALRASLQEPAVPATFQGPDPFISEDTQPAEQADPAAPPSPRTGLGLRRRDGPGPDANDDRGLDSQAQLQDALTDELAVLAASLKSNTLAMEGRVRERGSLLDATETALDRSLVGVKASNLAATAIHRKCDRWWVLWVCAGVRECARASLWLATDQEHRWQTLAFDSVLTFVSIPMS

SEQ ID NO: 16584 - protein, 73 aa, Chlorella protothecoides
MAQQHGCGVQAESDVTLVYSADGTSLGEAFVHFSGPQARLRLGLSRDATVMPVRGMSERVGCRMCMSRHQEVP

SEQ ID NO: 16585 - protein, 121 aa, Chlorella protothecoides
MIEVGSRKALESEPFRLRQALAEVNAALAQQRRDNDAQERMLRAREDAMKTKDLELQASILRFAQFLQQNEGKRSRAARRVQEETSAEEAARVRAETLAAELRDAHSAVETLRKELAKIQR

SEQ ID NO: 16586 - protein, 220 aa, Chlorella protothecoides
  MOD_RES (136)..(168): Any amino acid
MREDFIVAHLAEPCSSCRGYISGDVRLVHPSPPARVTVRAERTFDGIALDRPGGEASRTQTLTRFQLCPACYSAAAAGAGAGSGALAAPRAPDPSAPPCLPGLPAGIELGALRPLPCALIPPTADGAPEMENEFFXXXXXXXXXXXXXXXXXXXXXXXXXXXXXXXXXAVPGQPLPVRLPAPHQAQLHDGPVPPPQPHGGWLGLGSVSGGKGGREEGGWG

SEQ ID NO: 16587 - protein, 564 aa, Chlorella protothecoides
  MOD_RES (532)..(535): Any amino acid
MAPPGDQDPSGVKILSQTVFLNVSTVKQACSGCGAGGMCSHSSIRRRNHVSQLATALCRWSEIGLEVPISTAALLFQTAGLAVTCVLVNGVEVQLSPTGLAVTCVLVNGVEVQLSPSKAGADSPLPLEAPSLETVTAAHIRHFKDDLSGHVASVPMPSVLDAPLQHAHVTVAFRFSLRNDYGTMLCHGGAGAGPAQVRLEATWRLWSRHVDVCKLALMGPWPRPLFPELLSDGRDVIVAQTPLRLFLVVPEGHVAVASGKMLECRAHGSSQRRYEYLVAQPATPSIAAGALHGRWHRAPAKPGDPCIVLHAPQSAVECLEATAAFLGLLNDCYSDKLLVPLPLEEYTQGRVHQVHAVAHLVSSPPHPLTSHKVFVPPGVLTRPHITPGWAVHPTTCLVTRGCDEGATGTRLELAAAFAKQVFGLALRPASPADAWLVTGLAAWLVDQFIREYLGRNELQYRKWKASAAVCTADDGSLPPLASQLPGGAATAAQLLAGAFPLSEVMELKVCLDARGKGMRGDPCSSQIWGSGXXXXVMELKVCLDARGKGVEGRLVQLSDSALWK

SEQ ID NO: 16588 - protein, 342 aa, Chlorella protothecoides
MHTKDIQADCKICPLRLPQKPQDATGKDALVLSTLKAAAVVRLLERRAGEDLFRKHVQTSVAAALSEASTQAAETGAGAPSQTSATPPSRTLDATQFVTELGRLAGFRKDVPAFFARWVLGSGTPRITAGFVYHAGPQRRSVLELALRQEGGTRAAAAAAAAATRVSDSAGAGVGILRVSVQEAEVAVEHPVHLGAEPWKLAELKVNPDVKKVPGRRGAKRRKVQEEAQDESAALLSTLEGVENPLQPVQWVRIDPGGEWLCSVWLEQPLRCWVAQLAHSRDVVAQAEAVAALAQHPSLAAVAALVRCFTDEGVYHRVRADAAVALGRRTEGAGVPEGERCL

SEQ ID NO: 16589 - protein, 283 aa, Chlorella protothecoides
  MOD_RES (115)..(118): Any amino acid
  MOD_RES (168)..(170): Any amino acid
RWVAAGAAAHGRLPPLRRFVRRSLWARVARAGGQPPGPHPAPPAPGLGGVGAVAQRGRGRVPRHHESVPCAARGRRRQGGRGRRHRRVRGHRRPARRHRAVPGLLRRCDGREHGXXXXLRSRGGADRGCFRLNQGARACASLRLHGLPLSSTNGTKLLGRLLSRWPRXXXPAWPAPFVNKREEAAGTPVVEVASCRALPSSSSPTTVPLPTRSIADEGGDVEHTHAAASAARRLGLHYLQRYFLLIAYMGYMEAVAPPRDVSFAQWMGERREQKYLLATLELE

SEQ ID NO: 16590 - protein, 263 aa, Chlorella protothecoides
MHANMSPLRTPQGTHGRLQRGGCREGGVRAVQGLEGDRLHRRDAGGAGDGAHLGRPGEPTAVGVTREVGLRASAGELGVVRGRCGFNARHHSPVRSQPWPLSVAVCLRDAARLSPRHWPMPTRALTTPNMADTNAIQLATSPLHPSPSPLTSPLGRHIADAVTDWGSVVVAYEPVWAIGTGKVASPEQAQEVHAFLRKWLREKVGADTAAGVRVIYGGSVTDANAETLAGQEDVDGFLVGGASLKGPSFVTICGAATSVAQPA

SEQ ID NO: 16591 - protein, 124 aa, Chlorella protothecoides
  MOD_RES (95)..(98): Any amino acid
MPEEKIEYKVAVFSSSEWVTDSFTEPFSVFSTVNYFPARLEPKSAKLAAGHDAVCIFVNDDAGAEVRGIGGRQTSGALCTAGAAPKPPEACASIXXXXWRRGERDWRHADLWGLVHIGCRAEAT

SEQ ID NO: 16592 - protein, 216 aa, Chlorella protothecoides
  MOD_RES (10)..(13): Any amino acid
  MOD_RES (205)..(208): Any amino acid
MSLNLQGFEXXXXPSAQSPSPSPDRPPSPAVMSLNLQGFEGKVLAYDPYPSEKAKELGVSYVPLEQLMREADVVSLHVPLLPSTRHIIGPANLKLLKPTALVINVSRGGLIDTSAAIASLTDGNLGGLAVDVYEGEGGCDVGEDGRGGRWFGPTVCAPRHQECSPTPSIPFLERMDTPLPLAFPLITSPLPNHPLHPSQSPCSSXXXXRGEGGNGV

SEQ ID NO: 16593 - protein, 113 aa, Chlorella protothecoides
MRVIDGYTMEDAVNVMQVWWKDRLDSLDVGRADALALQCAAVQDKWERLAWVSGHALSHCILLRPTLSQEAHMNGLALVTACAQETAEEYCEQLRGAGLIASLEPDGGGGGSS

SEQ ID NO: 16594 - protein, 487 aa, Chlorella protothecoides
  MOD_RES (93)..(97): Any amino acid
  MOD_RES (263)..(266): Any amino acid
MTSGDVEGDGGDESGVGCRQGVQGQGHREGHCRAHLRLREQVGTPVVFDAAHAVPSSWLTARGRALRSCLGLEAQHEWREGAPYPHRPAHPGXXXXXPSPPPAPLPRSCIGHFSPPADNTATLKEGDVVKIDLGAHIDGFIAQAAHSLVAVDGPAKGRAADVVAAAHAAYEAASRLVRAGRRAKEVGPVLSKIAEAYGCTLVEGVLSHEMKRFIIDASKAVLPRPGADQKARGARGGGGAARARAGVRDFMPGFPLSCLGAAXXXXPARRCCRARVSTKRRGGGTGVAGGPGRGPGSVTSCRAPLSCLGAARTRLPASPPVPISSTCKVLLECHPQILTQPPNPHLLQADDFEIEEGEVYAIDIVMSTGEGKSKVVDEKETTVFKRALDVQYQLKIKVGAMEQWSVTAHTVGLSSLPCRQHSPFPAFHSQTSAGVPRGPVGDQQEVPHHDVLQQGARKHKDQAGIGGMVVEGEGRGPPRQGGRDTVQ

SEQ ID NO: 16595 - protein, 319 aa, Chlorella protothecoides
  MOD_RES (16)..(18): Any amino acid
  MOD_RES (189)..(191): Any amino acid
MLAKQGIRPPCTSTSXXXVWRMVAEPGIRPPCTSTSNHPAQDSSSRSMIWGVGCPLRPSCDCETRDGGRPFPLRQALTVDDLGRGFVLGHDIGVGNGLILLHRWRIGCVSGHAPPRRLNGPKGPPRLRQAALNLPERRHYWGDVMPRGSSLDNLLKSGVSARASCRAIVEARHGKPTKCMQIVQNNKRXXXDAVLLPRPGMGNLRDIIPLRSPAPCLSGPCSRCVRGGRCCRHHIVPYEHLSVCVGGERCGHPQQRPLLGATLALDERKSLWDPPLSRSTDGWGFSQLGGGAAGTHSPGALKQQIIGALHATQYLRGEL

SEQ ID NO: 16596 - protein, 315 aa, Chlorella protothecoides
MLALLTGMLLILVPLSINAARRTNVQRQTGHAPPPPPPLVDAEGVPLFGAGDGGGASEDGLDCATTLAVPYEAYVAGAEAADAALFGAPLNDLSAERANTTLAALSRWTLRLAFFMLVEPGQNATGLAAFAAGQAALLTAAFRGAGIAFSPATAVAVPVGPGGATCGVDAAGAPSPAALDALGAAAPVDVITVLACDLVGGVRGASAVLSSNASKIPALVLLHRAALVSSETALIHQIGHLLGLPHPFPEVATCKRDGDCIADTPLQHAANTGCPDPSTSDMNLCPGTDGAVPIYNFMDLTDDACRCICGGGGGP

SEQ ID NO: 16597 - protein, 87 aa, Chlorella protothecoides
MHAVAALVPNRSQPPSPTRLPPHPHLQFKGTVLLVPSGVDRITNSTLQALESDKSIEDAEVKALLATSLKTKKKKKSKGEAPKAVEA

SEQ ID NO: 16598 - protein, 189 aa, Chlorella protothecoides
  MOD_RES (127)..(130): Any amino acid
MLVKGEGAAFTAEMDAALRPRRALVHVLRGGRSEGPQAQLSFAHPPPSYDWMDSDTIIAALIPEDHPTLPVKPATVGGPKIEDNSSGKKSQARTYPDLLASPHDEAVFDHLGTSQLVSVKVRSVVPXXXXCWPVPTMRRCLTTWAPPSWCLSRCGAWCLIGILMMSSCRVRARCRRVELHPRSLPREQA

SEQ ID NO: 16599 - protein, 320 aa, Chlorella protothecoides
  MOD_RES (86)..(89): Any amino acid
MQDGGDPAVAAEPRDIVYTLEAGDLEAEARPLVSTNLRCGGIVWGDDDLALVGSFGWHDIVRRSMEGLGHQIAPVCGRTVWHGMAXXXXAEGWGLQIAPLYESEWKSRRSIVSTFSPGSGGAAPQVLFDRNYEDAYTGKAPGCTGWVSSWQTTRSAWHARLREEASQPLNPPLRRHPLDPGSPALRRTRWSTYVLARLDGARRLLLQGSGAGPTGSRPFLDVLEVDSKATRRLWQSSPPFFETTSTILSDEDERTITLDGLRILATRCVVGVVGVWYSLHWVECLPDGGSETGRNSASGRPPPSGFYDSSVSGGFPIGMF

SEQ ID NO: 16600 - protein, 573 aa, Chlorella protothecoides
  MOD_RES (83)..(86): Any amino acid
  MOD_RES (159)..(162): Any amino acid
  MOD_RES (279)..(282): Any amino acid
  MOD_RES (355)..(358): Any amino acid
MNVGLTRARSSLLVVGNAAALAQDGNWGALVSVCATKVLGGEGSRGWVAGGNDGRMCHWPAALSLSVAPGLPCPAKGLRHGKXXXXHWPAALSLSAAPGLPCPAKCLRHALQRVCGPRGGGPGGPPGPGQPAGARQGKERAERTPGDGGGPAPASRARXXXXLASLQARAKGKKERNGPQKMEVDQPRPAVPEGDDPYLYSDEEEGGVGAPASKLGSVAQGVWAKRHVKGVTRALWEDESLNESVETHPTWKDRCKVPLQGYPAVTLMQVNLKPLLFNXXXXETHPTWKDRCKVLMQGGVHKPAVRCRGSWYRLLHGPAPLYSAHQAKAATPGSARVLTPWLTRHSRSTGSTPHXXXXRPRRPHQAAQECLHHGSHGIHGPQAPRHNPSSGVALCGCGHERVARPLRGPLLLLTSPVLPRYHPCRPPLPLQRAPTEAVQPGVHLIQRVHDRLARAVAVALVRQHHQACDAAVPLQRGVKALRLQREGPRVVIVGAVDEQERATHLVRVHEGRHLEVGLRHLPQRALLLLEGEGGERAVVSPAAAHTTGEEVGGVRQQVGSHEGAVAVPGDGHG

SEQ ID NO: 16601 - protein, 121 aa, Chlorella protothecoides
  MOD_RES (112)..(115): Any amino acid
AAPAAPAAPGGRTRDALGGDVFCTFLGALNFELPFEATRAAGLYAHLFVNGGNVVGLGPACREEAAAFASGFRWSMVSRADGPQREGEGHRCPLRGHRGAGQGVCSSTWDEXXXXVSGGPW

SEQ ID NO: 16602 - protein, 276 aa, Chlorella protothecoides
MQGRITKVLNMKPPEILGLIEEAAGTKMYEGKKQAALRTLDKKQVKLEEINRVLTEDIMPALNKLRGEKAAYMEWQHASSSLERLRHFCVAHRYVEAERWAGRTLGGGESCWDVHLRGQGGWSHGSHPGALQPRMPTCSAHALSIPPASIPHGRSQKRGQADIDALIADMKELEAKGAALQQALKDRDDDIAGLQTEKDLQSSGEVRELTAAVDALSKRLVTETSTWKHAKESLAQEQGELARLEAALADLGEAELAARLEAAQVDAAAADATLAK

SEQ ID NO: 16603 - protein, 602 aa, Chlorella protothecoides
MESGYAAQLQEIVQSWDYWQLERDVTDGKGPISQLPTIPKTFSSVQVGGLLRDFCMVGLSDSAHVEVQGSRNELLRESLVMHDCWPARAPGRTPLQAYTSTFQPLLLEEAAAQLLRGQDEGSVALSQRCVVAACEDKGEGRLLLVLTLPPGVNSSFSENDVVLVSRDDPQVHRVAGAAAGPRSAGDVVGQSIVIPKRCQTARRVQAPSPAVPSSEGLADQSGVLHIPCRALQSEESTDEVHHALGMVAGHEGEQSLRVRFNLSEVAQAGSAAGTARQVVGWDWRCMWPSPVLQSNGAMGSSGMPCCASPALLSWASGYWAPPRACDQPAHPTLHAFSQQPRVKRMSALLPVAGSGWWLLRLANTSTIQREWAAVHCMAHSPLHDVLLSAKVGADERLYCAEGLYWSWAAPSRVAPHVPALSFITQYKHDWQRPSSSGVAAKQLEAPPRMLEAMAESYNASQLAAVTAGLDGTSLTLIQGPPGTGKTKTILGLLSIVLHAAPRGAFSSQRAQPAGEGSAAQAGKPEARARPSRSLTPAEVHATWQAHCPWLTGAPDPRAAVVPAELADPSDDYGLTRRAIPFRIGKSAGIKARVLVSGDYSLG

SEQ ID NO: 16604 - protein, 110 aa, Chlorella protothecoides
MVSWGSPSTDPPNRPPPHTPPFPPGQVCAPANSALDEIVLRLITSGLTDKDGKAFTPSVVRVGVNIHHSVQSVALDTLVTLRLGSEAGKASCGRCRRRMVLWGGRGGDVI

SEQ ID NO: 16605 - protein, 171 aa, Chlorella protothecoides
MAANLLAHAPDLFACGVGRSGAYNRTLTPFSFQQEQRTLWEVPETYLKMSPFMHADKVRRPLLLIHGADDNNTGTFTLQSERFYAALKGHGCVTRLVVLPHESHGYRARESVMHALYEMNAWLDRFCRSALEGQRGAAGMVAGEDRAGEQKQGAAERSGDALVAAAAERDT

SEQ ID NO: 16606 - protein, 163 aa, Chlorella protothecoides
MHIKEITVDGFKSYAQRVVIPGFDPQFNAITGLNGSGKSNILDSICFVLGIQNLQQASPGDGGEDILAMDGIPYLHSRVHARMSVQAPPPCSLQVRASNLTDLVYKQGLAGVTKATVSIVFDNAAKDRSPVGYDHLDEITVTRQLVIGGRSKYLINGKVAEPS

SEQ ID NO: 16607 - protein, 260 aa, Chlorella protothecoides
MTTPLGQPRGSAAARLRQTLRMVQAGRPMAAAADNSEATPPAMAHTDARTGYMLPPPEMAAVVDAPPEPTLSFSPDRKMVLQLGRPPSNPPISELARPELKLADCLWFGRFTSGDVGFHSRSSAFLMLAARPSPFPPPSGRQTGLRIDPETFSRSRMSYYTDLMFTPFHDALVLPAPAADCHHPTGIPPGSWINYARWSPDSRHVALTLRSSAEGARGPLRLWTVDTESWQAREVFPGTRGLNTIFIRHVEGGMGGWGVG

SEQ ID NO: 16608 - protein, 322 aa, Chlorella protothecoides
  MOD_RES (135)..(138): Any amino acid
  MOD_RES (317)..(319): Any amino acid
MVCRSFSLNETKDSLDGGEVEPPAQHLTPAPRGRTEINHAVHACGLQQCGRRRPAAGACRRYVLATPPPWPCGSRCRACPWTPCPWSGRAEQGGDLIDAPSRGAPIFQPLRYIWARGRHQQHELGHGAPSDGEAXXXXAYIWARGGHSQHELGHGAPSDGEAHMRKNLGIYRSRGDRLLVVEGTMAPMEELSFEDFPGTTLRVWLFTNVTNSKDVQAAMVEGTLEYEAAIMNAAVVPSLFAVHLAAHHALLSKQRGSLRTRSLHSELVCNLSGSKHVSPALGEGRVGFSVRVCMCNSLAGLMGERATAALTAVLGLXXXMHM

SEQ ID NO: 16609 - protein, 149 aa, Chlorella protothecoides
MAPIAGVTQLQGDITSAATAAGVVAAFEGRPAQLVVCDGAPDVTGLHDLDEYVQGQLLLAALAIAAAVLQPGGGFVAKIFRGRDAALLTAQLRCLFRGVEVAKPRSSRNSSIEAFVVCRDFAPPPGFDPTCLQALLEAGAAEYEAAGDR

SEQ ID NO: 16610 - protein, 66 aa, Chlorella protothecoides
MRSLAVRQLVPFMACGDLSGWDADRSYDLPSQGAAGYTPLQPVQPPTAPAYKAAIALSRTGGSRAR

SEQ ID NO: 16611 - protein, 802 aa, Chlorella protothecoides
  MOD_RES (194)..(219): Any amino acid
  MOD_RES (274)..(277): Any amino acid
  MOD_RES (423)..(426): Any amino acid
  MOD_RES (615)..(618): Any amino acid
MDVCVWRGYVHATNPDRPASDVPSGLGKACVLGCVVLTPAPCHTPPAKHPLRAVNRARPLQNLFNLKPSLGTDAFVAPNASVIGDVTLGPRSSVFYGSVLRADSGSIKVGAGTNIQDGSLIRTAPQSIDEHAADTTIGANVTIGHQVSMHGVTLEDEVLVGMGAVLSHGTVVSVGCHPSHQAWLQPAAGAFCAXXXXXXXXXXXXXXXXXXXXXXXXXXGQTVSEVAGRPWCCPEGNPWHPVHVLPAGGLGRVSAPRSNAHIDHMGDASLASPXXXXARGWGGCLLRSNAHIDHVRKGAMVAAGAVVPPGTEIPAGQIWGGNPARFLRDLKDNESSFLAGVACRRCDRLGVAGCPQPPGHKLTRKPRVMLQGLQSLREAVADGVQDLRHQVAVEAVDAAKVGKNLAKLNSSRDPPPVRTARAXXXXRTSGKNLAKVKSSRDPPPVRSARAKTKHELVALDLRLHPHWRPGMSEAFHSSGPTHRNPQGVLLSSADEETGSKPLSNQHALQSARDILSALKSSIPSTGIPSLPVGTSGTQPASPGSKPLNHVSGLEGASTPVAGEDAAETSGALCNAESSETDRPHVGHDVPKTSELLRTSPDLSTELALPAISKVXXXXDVPKTSELLKTSPDLSTELALPAFSKVSPASDLETMLAELGTRLQSLEDQAFTFSQRRYPRQCVVLLLARLTPVFVPAEPAAQSYRQTSGPIPAVRRAGGCSAGGPYGQSPRRGPLQHPGAGAGLGAEGGCGAGRPGGEADQSGERQREEDGRPAARHGHAKGAAAGGGGGGPPGLPRGHLSDA

SEQ ID NO: 16612 - protein, 231 aa, Chlorella protothecoides
MLDTLATLCVRTGEFRMGMQALRALERMGVEVDKSKYRQLLEGGGRGAGEAGKAASRPLLANEHLERLKFWLGLPNNYYEGGWGGTRGGGQEIMQQIHRRAGGGGDCEHVIKRVHVECSVSQGIILERSTPQHFPAQDKNSSRAPSPKRQWRQECRWDGAPHGSRASPPAPHSSASASPHPPQLQLIEHGHHIIHGEAVAVQLAKELLAVAHADAQLVAQRCAPPHRRRAV

SEQ ID NO: 16613 - protein, 91 aa, Chlorella protothecoides
MSRHHQSHPRPPHLCQGVAALTTCHEPTCQLAVPAGGEPGAVRVYDAASGSGSVLGELRAHRSPLVGGVGGWEWRALVGTGKGPDRGMASG

SEQ ID NO: 16614 - protein, 265 aa, Chlorella protothecoides
MSGTGASPIFASLRLRRRPFSPPSHDTPQVLLVTEAKRSHSVINPDLFQYHNHFEFLRLIGKTATSEVFCVRHRASGELFAVKRPRRRFRSKMQRERCLREVRAVAALPAHANIVSQYRAWQEGGHFHIQMDLCQGGTLLEALGQVGEGPGACMKRAREGLVWACAWHHTSSAMPPPARLDTQSHRMDDAALWRVAADVAAGLAFLHESGILHLDIKPENIYRDLGGAWRIGDFGLAVANESRVGESEGAEAGERFPPGRGGAGS

SEQ ID NO: 16615 - protein, 165 aa, Chlorella protothecoides
MARVPPRPPLHLSLCHAVSQGLCGWSAAARMCAGLAARGSCALGALPVGASPYHEVGNVGVEHASPEALRLALAAARPSSPERTAFTRERLEALGLVASGIGPAAGARAEGSNSAATVRRRAALCDELGIGMCNGKQLLRQLNSYGFSMDDVVSVLNQLELGGVR

SEQ ID NO: 16616 - protein, 200 aa, Chlorella protothecoides
  MOD_RES (25)..(27): Any amino acid
MRGRAYAQGFQLLSERGVCWNAGLXXXWCAWGCRMTARVMKGFNGTGIWNSINVGLSSPFDRFSIGTLDPRTLKICTPSAATICPAVSVVECVAVRVGKCLHDASGNIGNGNTGVQNIGYNNIGSNNQGLYREEIAQPMFIPVAPETSSGLPLSPAMQAMVIEGIPTSAPGIKVTTSFATNWTPSKEIRASCLPFGQQKH

SEQ ID NO: 16617 - protein, 81 aa, Chlorella protothecoides
MTRCNCRATVIVYNFDHPPHVVPAHLAAAPDVLTVERALVFPPGAEGSVLRNVLMDHQNIERVVLERTADDALRRMRDLAF

SEQ ID NO: 16618 - protein, 403 aa, Chlorella protothecoides
  MOD_RES (172)..(175): Any amino acid
MAAGAHLGEAVKLLGVTGAAFIAGKWHQRRRRGQKGVRLRHRIVFVLAIQVKFESEADRDIFIDLFRPLAKYVAEHEPQTLSYDLAIADTDPTLVLIHERCGGGPTWDTVSLPLRYATKKDLTEVHHVSEPFLAFKKATQELPFPFVKTGQSYYEQGIGVKGLQSKKVCKVXXXXSKGLLHGIAEPLQLTGVPYIFPYSPWCRPVPGFAPFSAPNACATPCSVKGLQSKKVCKVSEHSKHEHVILQRQDWYMQGSWGPRRGYRSRRGTASPTSRATGPGDAGHRLQAPQIPSQRPPGTEAPPPASAGHQQVQPQEHRRGHIHGLARPHPLQPIYVRPAERADGPLHAPRNQPHRAAQAQRVQAGGYACVGRRVHADAALVGPRRRRRLDARAAAPAAAALDQS

SEQ ID NO: 16619 - protein, 1213 aa, Chlorella protothecoides
  MOD_RES (209)..(212): Any amino acid
  MOD_RES (314)..(317): Any amino acid
  MOD_RES (379)..(381): Any amino acid
  MOD_RES (630)..(639): Any amino acid
  MOD_RES (696)..(699): Any amino acid
  MOD_RES (808)..(811): Any amino acid
  MOD_RES (920)..(923): Any amino acid
MDGEVVDRGDCDVLRSGHVWGARSSAGSSLREGGALITCVPGVDPRRAYWSQCSRCPPGVAPGHDKKASTGGRAHGLEPAQPAVPGHLFSLLRPGPGAIWHSFPGIPHPSCRLTWSWRCGVWLRSSTFSTRSWASRSAASRPSPGQRSCTAWCRWDRVLLRGLGDWGVAFVAPPCLCRRQTLWGGSVPHRSLPGFPGRCGSMLALLAAXXXXAWVSRTLRERACRPGSSPPNSLDAGPANHPPVRVPRPQRARHCVAHHAPRKLPDRHAQPGGPRSERARHGGQAALSAHQDAGVEPVLVGGGYLRRARGASAXXXXSGTCTGGWGLFEEGKGDVCMGGRLLRLEWNLVGANNAPSVKILWSCPDTHARQLPPLPPAGXXXLLRLEWNLVGPNNAPSVEILWSCPDTPTPVDFLPWPRLPACQTMIRQGCCGGAWLAPDDNGRPHHTHLILCQGHGRLESAHVALPPGLPADVLFHEEGRAVLPPPLLPGWVAGCLGEECIGRCTGQPCRDALPFEALAPAMSGMVCAGVRRCIRLHDPVPFLPIYRGAVGPWAKGMGGARTDHSMCCYLCDCRSLHLFLSQTISMKFLPDRLNASNEAAEKYISQFPLPAIRRATHLVEIAQERCLTLXXXXXXXXXXPPPPPLPLTQPRGSLCGVCGRLLCCPPTPADPGGRAVAGAGPSGSARCLVRRRPSVXXXXVDGRLLERDLLGRHVVCVAGVHCGKHHCVRPRGGPDGGGDAHPLPAPPLEREVGGRRGGGGLSNVVCHGVHLVPQWPCGPSSANAQKQGTSRRAVAYCWLASGSRTPDXXXXSGPVAPPQPMNRSKAPACGPEAFQGLFQFKAVLFFEEMASILLTPLLLYFSLPGCAGEGLSWVVPGRCGRTISGLLRTCTLTCRHLEHPLIRSTQDVTLMSLPTLHSSXXXXLQAPGTPFDSICTGRSAHDFSNSTLFLCLAGAILTFVEQNTVHVDGIGDVCSFSAFDLERHGNRRYGSPVEAPKAARSHQGKLEKSFLSFAAAYPTWEPPAPGQALVQAVGAAPAAGGWAAAGSRILPPLGASSGVLGGSTSRFRLHPMQPVGDVMDVGWGAEERMAVSQMQLHSFYKAARGAENSLHLEGAHDRHPLAPPAESQQIGPEHSSRPPAPESAIAERVSELLPMHNITGSRMGGSSFLSNSNYVKLKGSHVRKRKCKSFPAPAGECRRSPHLQDLSSRNWQL

SEQ ID NO: 16620 - protein, 548 aa, Chlorella protothecoides
  MOD_RES (216)..(219): Any amino acid
  MOD_RES (278)..(281): Any amino acid
  MOD_RES (524)..(526): Any amino acid
MQVWEFGIPVQIKYIADPAMHAISAVSVTPNKKWWCGQSMDNKSEWVWAVGGPLSSCEGESNACMEVVPGCGGAETGVLVLDLPTLPVVCRPLVVILINFPNALSTFTVVTYSATDRVKPNTKKTFAGHNVAGYACEVSFSPDSRYVTSGDGEGKLFMWDWKTKKIARTIKAHEGVCIGSAWHPLETSRVATCGWDGLIKEHMTCDVLLDCDPSLXXXXVFGIGRCERPAGFSRAWSCCDSSRLPTSIDPYGIFSAFLRANVHASSVTYSKGSGGEEXXXXPSSRYFVSRSGVSRVLVAKTNVSVRARRALSVANCASDCRMPRVSWLGNENEFFKPGKHEDSWTRSPRTEDSPHGMTGGCSTSGSSSTARSAGMANGDKRQDKPETGSFGLPIDAGHRRTRCAQPLRPPCNGRRELGQLDNPPSQGSRKSSFRSSTHLPASTPQRTSSSSVESINSKGSIKGAGYCLRMYDWQPSVTIPSKRRSNTSSVPPQSKASWCWYMVMRYDAYLYLCTPPLVCIVVAXXXVESLLVLYAITFVFLSGVRKQP

SEQ ID NO: 16621 - protein, 125 aa, Chlorella protothecoides
MQGVRDAWFSNDGRKFVTTGYDKVIRLWDSETGAVLGYPGVFFMEFREGELRMRDRFGLCKLPPTLGGDFSASVGCVAAIPYTLRITILTLHHKPPPPIPVTPASPLQQVWGGQDGIHRPLPSRR

SEQ ID NO: 16622 - protein, 141 aa, Chlorella protothecoides
MVLRDVTTRALSSRRWQAFAEPVTAEEDPDYAARVPRPMDLSTLLARVDAGRYATPGRYLADVALLPDAERAYWGDSPRGARAVSRACALEDELREALAAALAARSDLCAGLEAIAEAGGPAPAPPLGQGEGWRRGAVEWG

SEQ ID NO: 16623 - protein, 69 aa, Chlorella protothecoides
MDAAADTRIPTCLHTLCLGCAVRLVAGSVERPICPFCRADIDGLEGVRARKAVDVPAPVLLGLDLLVTG

SEQ ID NO: 16624 - protein, 209 aa, Chlorella protothecoides
MDPSRPVAISLGPGVGAPPTQPQQKRQRTQQSKMAPAPVDLTQPFTLRTRQPWAEKAAFPEQELTEEHRAYLEKGSYVPNLLCRRASLVHGHLQAQEEKAEKDAGSGKGETSIFHGKALEDYQGGWPLWVVWRPTLAHASPYTRGPCSHAPILHPATRPPCAHRRPLLAGGSPGPAGRQCHLLPPQEAPPHLVGPHKGRQCHQVLAAVL

SEQ ID NO: 16625 - protein, 154 aa, Chlorella protothecoides
MDLIGAYSDDGAPSPSRSGDGTAALAVVSAAPEVRCGTCHARHFPLSSCISNGIYASSQVDASGYALVESKLVSQEDTKFFQGPNTRMIRYNLPADQMHAPVQGPTHPSGRKADGGLSNHRTGHVEDSHLSSYAFDEQYNSFHRSGCQGWGLRL

SEQ ID NO: 16626 - protein, 1191 aa, Chlorella protothecoides
  MOD_RES (251)..(254): Any amino acid
  MOD_RES (347)..(350): Any amino acid
  MOD_RES (463)..(466): Any amino acid
  MOD_RES (631)..(634): Any amino acid
  MOD_RES (827)..(830): Any amino acid
  MOD_RES (1003)..(1006): Any amino acid
  MOD_RES (1066)..(1069): Any amino acid
  MOD_RES (1116)..(1118): Any amino acid
MDPAVRQVAAIAFKNSVKEGWGGEDEERPALVGPEEKGAVRDAMFAGLVAAPGAVKRQLRESARTMVYADYPAAWPGLLNSIGEGLVSQARPSGWRHVHRGGGAVGPWERQHGAAGGLRGRRVALWHGLALPWPAASCDSSPSRRPGEAGWCAEHAAPHRQEVRVQGRCGPPAAGPDGASHLPPAPPHLPGARGIALQGVGWGLRCVDMRLPRPLNSRPSPHGVLTAPRQTGSPLPTHPLPHIQPPRSLCXXXXPLSHPPPSPTYNHLAVSALQRQRVPGAGGAAQAHMQDPHHAAPPPGALCVGVVGRTDLACQTLGRTCTMRHTALLFLLGTVDHAAPAPDCERXXXXGAPLLLGTVDRAAPAPDCERQCMCLTETGKSGRYPSRHQPCPRTKCRATPTLGTHGSGGRRRSGPCTLPTACSTGMRALGVWCWEAASRQDVARGVSNSRVAQQRAPEPRQDXXXXGDGRPLRGRTWRGECPTQGSLSNEHLSRGRMLIPMRLSTLSGAQTSLFLAAALPPLGGRRGVRHRVPPRLGAAPPPRLPARTQRRGSGAIHRGPRVQHGSAVPDPGPGLLPHLEGAEGHPAQPAPQVRHGWKGVPGGRSQRLLQPALSGLQACSTLLNYACERDXXXXQHSSAHQWIPLHSHCSVIFPMLCFSESDAELWQENPHEYIRKAAREACRNLSFGREAGALPYYAASVRQKHPRTVSPPAAVSQGYDIIEDLHSTKTAAMNFLLELCKSRPKGNLDALVQVGGAGGRGVLEWNAAARPGQGVRAGGGAGEGSWVASQRSLAVPGSARPHPTPPLSIASTHPTPGHLSPLTPPTXXXXSLQGLARESGAGVEPARAAGSPARDHSLCLGVPGLAPPHPLSIASTHPTPSHLSPLTPPTQTAAHGGHPGGVPRRRPRRRPGAGPARRRRLPRHRHAERGAEAEGAVRRLAGAHAAAARCDLFSGGGGKGGRAWLWGKGEGEPGSRRRRVAWGLPRALRALNLVHHANKGRVXXXXASCGLGTAEGTREPGPPCQQGKGGLRNVPLPSSACLPGAPGSPSAFPNIGSPHPSAAGAXXXXCATSFSRPPAWAPGVSLGVPRHRRSPPEHRGPGASRAHRRIGGGPRXXXRQEHRGPGAPRAHRRLGGGPRLPRGCGNGGPAPVQGPGSQSPHPVPAAVPGGARVSRGGEEGECGRGGERGGG

SEQ ID NO: 16627 - protein, 512 aa, Chlorella protothecoides
  MOD_RES (115)..(118): Any amino acid
  MOD_RES (466)..(469): Any amino acid
MPLDNYISQDTETFLNTRDPDLLALTNQVNGLGGVLSWWRGCAGQLGSRKQPCLLSTRAYPGPAMIPHQNGNNSGPLCSPLFSPPFLPFSHPTAPSPTHPSDAGKGAGRGWVPRXXXXGSAEAVGSSLGRSDAAATLEKVLAGDGYPVDQVVCAPRLMGVVLQTCRGRVDACVAPYLGLILRRLARGDADEDLHSGLLVAAADALYYSPALALRALAAQPGALAALFGALGKAVAATRAGGRMAAFPSRRDKKLLALGLTAVLSTPEADTPPEIASAVGQLAAAVVRLLLAVKRQEEEAAGGGGAREREGEDAGAARASGDEADSEGADGDEANIDSDDDRVGAGRPVAQSESARHRLAVALSFPGQSPNHPPPDGPSSLPKPWPPSNSPGGMARRGATPTCQTPRRIGGATGRRRCPAPWTPWTPSSTLGRRGAGVNHRDSTDARQFGSTSTAPRPRHRSPRTRXXXXAAIQATMDEGTRAAIQGMTAYAAQLQQEKLEAAAAAAAAAAAH

SEQ ID NO: 16628 - protein, 360 aa, Chlorella protothecoides
MQFSLVRVEVVGRRASVLDTVLAGSPVGGGCAGSCAGGGRAGCAPGGPSLSGPVCPCMPRGQASYSGSSLNPAAPSLPYAEATISAHSNPSSPAPAGARPSLPAARPSRRVRPARRSAPCPVARTMGGGEEQPSSAEGVAWDKISTDELADWAGAGPPTPLLDTVAFPVHIKNFNSRQLQQLCKELRADLIHTVAKTGGHLGSSLGVVELTVALHHVFNTPEDRIVWDVGHQAYIHKMLTGRRARMHTIRQQGGLSGFTRRAESVYDPFGAGHSSTSVSAALGMAVGRDRKGRANNCIAVIGDGAITGGMAYEAMNHAGFLDTNMIVILNDNQQVSLPTQYNGKNQEPVGALSSALARLQ

SEQ ID NO: 16629 - protein, 231 aa, Chlorella protothecoides
MRSVLVTAGGTQVRVWDLFGGGRELACLSNHQKTVTCVTVSPNAGPDSSAAPRLLTGALDGHLKASVREGVGGRGFRRAHRALLAGGIRQGCRHWIVFASPILLGAPPAVGPISGEWMHQRPATPEENAADTRSSQFMLMGSPARGAACIHPQPATHSPPGQVYELERFQVTHIQKYPGPILSLGLSGDAGLLAVGLADGTLTVRKHAKPRADPAKAGILVGRRSRWGPSL

SEQ ID NO: 16630 - protein, 255 aa, Chlorella protothecoides
MQAGLGRTQHHLSLPPPLLLFVLMCCQGIAHSRSTSQLCRRAPALTAATYRYFIRGQSSKAAAKDSVIAAERKVGMPWTPRSPRGEPRCAPKRAHDRVAPRRVTVTCPLFPYQRPPPAATPPAQPCPPPATRDRRRPPINPPKTPPLTQVVASVVEELAARGGLSSALSSRDAAGLAPLLDHMRRNINDPRHAPQLAALAHRLLDVYGGSEALTGMLPALTLLLERVELELRAQDGLTRVQGMLGPLLAASVGAC

SEQ ID NO: 16631 - protein, 622 aa, Chlorella protothecoides
  MOD_RES (587)..(590): Any amino acid
MRAFANPCRTVRCCSEGGHQSPPRSQPPQIPRRLFLALPAALWSVTPLPSQAFDIFKFPGTDVLEIIKERREAALAADQKATEAFEGSDFLTRLKIYLPILLPPTSRNKRALDLKYCKRQAEMGIGDCGGLKAPQVILPRILYLPGTQRVLKRKDDGSLDFTEFEEAAKKLDASDLAAQSATPISRLPGFQFEDRTCPLNYRPSKFLDVDCVLDTGLIWLRTITMSAPTQQFTVRAAGSDHAYMQHFIGRFPLELPDLGTASSAAPWQMEAEEIPAGLTRAGPPPPRTAGPKPRRLRLRREGVRSYRGMPEGGLGSNQFLLVKERGSNDFVAIPVEEWYNFRPETGRPGQTLEAAEAAMAAARQQHDRINPRFVAALQASGADVDAPALPSGADRDEDGADSDEEWKGIKARAASHTAPQGNTIAGQGQGRAGWGVRDGPACVYWEHRLTGVQDKEPHQLSGELRASPQVCREPALIRSTTPTTMNVQQQESPWATQTEGCCEPGLEGLRQGPPFCYMTNAMLAPRGAAPKPTPPCTAGLPSLQAEDWDHEDEAADDDLDMEADEGEGGVEASPVRRWGTACWESGXXXXGGGQPCSKVGTVCWESGPPSQGFVGSSIARDV

SEQ ID NO: 16632 - protein, 601 aa, Chlorella protothecoides
  MOD_RES (257)..(291): Any amino acid
  MOD_RES (558)..(560): Any amino acid
MEKRHYTLNHHPCLSPWPTKHARQVGHRAVTRNVSPRDAEVQREAAMSRIRKARLYQQKTAEAQNVKDSNKSTGAKEAATYARGTVDGDAAQTAAAPDAAPIQQATPSTSAAGQIRSGPENADAAPVRVGTGVCGALRSAPPGASSSQLGQSRPLVPSNAGDEAGSNPRSTSAASTTAAATSDGSAYQPSVSTWGLFPRPADISKTYGGYLGLPSALADPSFSTPFAPPRRGPDAATRRRAGKRRGGRRAHRAHRRXXXXXXXXXXXXXXXXXXXXXXXXXXXXXXXXXXXWWTAGPGTSGWGSSKPRWPSEMTEDLAQGDVALERGWHGCSGCVTTAHVPSTVLASVSLSLAQPPLAPCRPLMCPLPSSRPPSPAQVPGSGPPRSYEKRGGGRRRPGRRTFPGLAGARRGGRGAVQGPALAPQGRGGQGGRPHALRLQGGREAEGHRLGRGGRAGPQESRRGGKRGEWRPAHTPAGVGCGDRARLPLPMAGVASVLPPARPLKPLFVRCSEDVSSRRLAQVARDRTWGGLSLALSSVYRASTLVAFQPGRGKAAAGXXXADMGRTVPGAVIGVQSQHVARISTWQGQGCSWASAAFSCWG

SEQ ID NO: 16633 - protein, 486 aa, Chlorella protothecoides
  MOD_RES (215)..(218): Any amino acid
  MOD_RES (338)..(349): Any amino acid
MQAPCLPAASKVCAAEIQQPAADPQLGCRPDGCGGHPACGPGAPPQTGLHRDGAGNRSRDRSPLHPALHRQVWETLGAVGSCDRGEGMTGCDSHSQRCTLPEWVRCDGVGPGLHPPSRLGRQVLVLPWLLVPPRLPSGLPCLQDGVWARVRDVHWPGGGWTGVQGRCVWEAVMALRMHAGVVLAARACGACSPKCQLLHCSGVFDRSLSHLSPPXXXXCSRSVCLGGGDGPANACWSGTCSPSLRCPLPKVPAAALPRGVRPIPVPSVASPPADPSPVGSRPGVRGAHPHPALDSRRAIAGLYDARELAAALKVVVFRRPAEGWAPWAPMGAGGSTLXXXXXXXXXXXXEELCGEERAVREFVGLPGVGRGVATSLALTEALGGRRHTCLRSLRAWARQEGPPAPQALCADPAHHAWLTSLALLRLRSCAIPLPPQPHTPGTGHAQQLEDWLRTSSELPGSTLRWPAWQLRIVPGLMRDIAGAHRS

SEQ ID NO: 16634 - protein, 279 aa, Chlorella protothecoides
MTLSQSFKDMLAVAPAPTQPISKTNGGVPVAPAPEVKAAHTSGPRPKASALLKEKYNLKVACVEHACHDGGVVTREAGCSRPALRSWARQWLASGGTVPLGERLRARGPPPCLANIHRESENDRAEIVIVCEPEGTSLQMGGLHPRASLYEKPVNLEAAKTAHAEFRNVMREKGVRVLTVREILAYGTEDHVGARVDLEDFAVQALTYQLAKDGRMEDIEEADRYYLSDEYKRKVLEHMSVPQLIDTILINPTVHLAPSYRDTGAVALAWKGGRGPRCH

SEQ ID NO: 16635 - protein, 253 aa, Chlorella protothecoides
MEEATETVSDRRERLKSVTLTRQCLSTSRLGDLRSRWMMGPRWEWRCSMPFAASRAMFRRLPQSSTRAEASGLAAATFSRSYSDPRAQNSVTMQAGSRHTPMKRMMLGWRMATMMPTSRSRVRRTSGSSRTSPSGPATVAPAAPMPKACRLVSTLMATSVSCHRPRYTLPKAPSPITRLSTRSRKSSSQGVASPPSNRPAAGLEAARAAAEAVAGLAAALWEAPDPAPRSRSSSLASPGPAARPRPALASAMA

SEQ ID NO: 16636 - protein, 207 aa, Chlorella protothecoides
  MOD_RES (85)..(102): Any amino acid
  MOD_RES (188)..(191): Any amino acid
MQVETPVLETAAGGADARPFLTYHNVMQRQLSLRIATELHLKRLVVSGWGWEWEGLALCMRLTGPWTLRAAWVTRLRSSSHALGXXXXXXXXXXXXXXXXXXPPPPLAPPSCQVGGLERVFEVGRIFRNEGVSSRHNPEFTSVELYQAYTDYHGMMELTEELIRACAQAWTLGGGGHFDLQAASGHDXXXXIRACAQAWTFGGGETF

SEQ ID NO: 16637 - protein, 149 aa, Chlorella protothecoides
MSPTLRPLISIPQDGAAAPSPVLLPALASPASAASEADWPGRMVTLWLDEEWTPLPEHAALGRAVCESVERLSSAAEGPLDASGLVIDLAGALAACDYHATFVNAFDVANKAVELLMLRAGHVVCCVPEAEQERTARHAAQLDRGGPPS

SEQ ID NO: 16638 - protein, 420 aa, Chlorella protothecoides
MAGHGNTGRGRNIALCCAHWSDSSTVHAWTWMKQYLLKVGLGSLAVWRRGSPVPPLHRLPPLTVPTSPASPMQRETMFGQGTRLDPSDHLIIVHVGKGGEKERWKMGGPLIPDLETCLESFPHTIEDLAGSIQGNIREFLDRAKIDIVVFGAVGFAYSKVQGSEYAALELERQLLLGSRLWRDHSTSSPQPPHPHRQSVPTVGPEGPVPGVGAGLGQAACQHALHHHPAGGCCSSKGGCPDTPKPHPLAPAMRPQAVRNVRMRFGSGPETSAESVVSPGGTFPPPRRIAIAYPTLAIGRALLQMARERVLQPSDTIDIVHVFPRDDADNPMKEVGPCRDGGGGLESQDAGLKMPEFWALGSGTCDGPLLCCGVDPLAHLQHVTLKATPPPPPLIYQTPLAGNEGDAQADAGNDPAEGGVK

SEQ ID NO: 16639 - protein, 681 aa, Chlorella protothecoides
  MOD_RES (277)..(280): Any amino acid
  MOD_RES (451)..(454): Any amino acid
  MOD_RES (483)..(486): Any amino acid
MMPVVARSAPALAWAPVMQARRDGGLARLRGGAIVLITLILMHRYSPRNVMHRPGLPVLSSALPWAPRCAGARGRTIPGPPGARTRDGCQSLCKRGSAGHSPGRPTHGHVGDHAGHAGSDACRHDHWSVAMWRDFKASDLFPEGGNSSLTGRLGEAARSLREGVTASGALKNIDHARYWAYHVSRTSFFLLQAIVGLFIAQSGGSAGSASATPTKLETIVTGARGPLAEVLLMYYQDLQNIKEGGKGQLAVLEARRTWKTGKYGFPWDMETVRHRQXXXXTGGAGGKENREDRSNGFRKPRCIIISRVILLPRPTSRKVRLPMGHGDGASQAVQPPVRAAAGSSLHGRGPSDHAAQVRLVFGVIIICHPVLHALISTCSLQGPRMNNTSLELPAGMPSSQTQCGSRAASFPNVRLGVLELSWSIHAAGKLGCEVLTAFHHQATLPLFTPTXXXXLVFGVIFTCHPVLHALISTCSLQGPRMNXXXXVGSSWNIHAASKLGCEVLTAYHHKATLPLFTPTDYQNTFHYQAVHTHGHACSPCGSFNSHLPPCLTLSQTDGWLSADSAKIYETSTETLFLGRQDAMQRCTLVPLHDYLQGRDPAQLRALEVAAGTGRFATYVKDNWPTLPLTVSDLSPYYLAEARSNAKHWHQLRAGGAWLGGAEGTGCDFLQVRARLGSLLVV

SEQ ID NO: 16640 - protein, 683 aa, Chlorella protothecoides
  MOD_RES (59)..(62): Any amino acid
  MOD_RES (295)..(298): Any amino acid
  MOD_RES (334)..(337): Any amino acid
  MOD_RES (569)..(572): Any amino acid
  MOD_RES (633)..(635): Any amino acid
MPVRTGQPLRIQLGEERWRGPELFFYPGAFTKGDMACMGRAPTPHVFVTLHRSACEVAXXXXWRVWDGPHLPSWHSRPPDATPSLPDLIDDAIQACPIDTRRALYGNIVLSALNPCDCHDAHPAFCSHPASLRHAGREHPLQGPGSAAGDRGPSTCQSCSRHRGGSPCRDPPHAALWCLVWRLGPGSQRRCDPGGVRPDWPAPAPVSVGVGNEVAVDSLQVISREYATQSDAEPRCEVPRKDLTLHGLLLPCMGDPLSSLPRGRHHARSLHGDRPHHCAQQRGALRLVAYLSCAXXXXRQAPPLCATMWCTQIGSLSAVLPHDIAALLTRPFHXXXXLRCGEQAVPCQMLHHDITALLTRPFHRYCTAHFLLIAWERDRNLPSQDIKWVQGLGERSTRRDLEERIPTVSLLVHGVHGEGALQNGSPLCRRHGGFAERQGLCGGALDLGVAGKGGVGRFMSEASLAECRTLLGQSHTVVPIMRLSTVTSFHFTCEAKTAYAHQSRPPTSKLVHLRVEDTPIPQLLGVCQDHKAAGLHDTCHLTYSGPQDGGGQLVEEVDAVDDVEAGVWXXXXSRTAARRMAGGSSWKRERFGCMRTDWRIHQHARLGRQSATASCKWPSIATVLPRLNLMPGXXXRTDWRIHQHACLGRQSATAFCRWPSIATVLPRLNLLPESRTTPLTRSP

SEQ ID NO: 16641 - protein, 247 aa, Chlorella protothecoides
MTTPRVTGREDISAAVKSTWQDASRVLIFTNSKVVHSTFEVGGPAGQGGLGDRCPKALGGGFLSLTAIPPPTCPADHRSREGCPDDGLRGPRDSSQAGLGAGRPAVHRFHPPLVYGRTMDGDAETSTGIAILKVDSGKYGSPTYALITYEMPNVSARMVQMLADFGKTCLEASSRLHGKKGRQDACKLSLVDFIWPGMHVHGRVGPPIKPAPKTLSGRRSSRSLEEPGHPFVPARAQGEAAAYVHSS

SEQ ID NO: 16642 - protein, 128 aa, Chlorella protothecoides
  MOD_RES (103)..(106): Any amino acid
MSKGLSVLARSAGQARQLMARRGGGGGPLSRAAVPTQPLAEQDELIWQDGTGNPETALDSYDLVTPGQALGWLAAGMGVFAAVGAALSLDPPEKRVPWDECTXXXXEKRVPWVSMNFCKEGDCKDAPA

SEQ ID NO: 16643 - protein, 327 aa, Chlorella protothecoides
MPGPGLRAAQCVWRTSARPLAPVRARKAQCLHPPPTRQGPAAAQPRPRRSCLGATPGWACAAGAGARRAPRRAPGTATPRPRSRCAAVTPSASHVGLGWGRSRGCTGHCGAGLYDNGWTLPHVLLDGCLEQWLDNHTNCPICRQDVSTPPGAPTGKGQPATQQQTSTAEERERAQRAAQEVLNTDLSFRLLMLQRMYPWYLTDDMIGRWTGEARETGTFDWAGTREFQLRDPGVAAQQRESGASGFGGGWGGGHSVGGGGDPCICPAPPPLYCFSLYQLGSVHFKCEGGYNGAVSAQGMVRCLDSTVWHCMVRSWPFASSSAKGVGK

SEQ ID NO: 16644 - protein, 180 aa, Chlorella protothecoides
MKRGNLRKTSALSFDDEDEADQEPLSASGPAKAPRPAVQARQKAERKSLLSFEDDAEDGMAALPVVVRPERRKLRGAGIARPESRELRLEARPASTQVSSAGVCLSCLSTSSPGEYSADRLKELQSSMLRKPVASAQPAFVVAGSFKAGPPKPSVAQTLSGGTAGLARPRSSSSLPYGQG

SEQ ID NO: 16645 - protein, 195 aa, Chlorella protothecoides
MDGGLRNNMPRCLSHALYTTLRHKIVPFVSLHHFVHPIWFEHLGGFQKEENIAFFVDYAKLTFRIHPDHHRNWPRLFGSRIKYWSTFNEPGIASFAGLMSGTFPPGKILRIAGTARHLLHMLQAHTRAYEAIKAMPGGDAVLVGIVHNFFWFEPKQAWWVPSYVRTICKFLNLMWGNDTVLEYLRTGRFESKASW

SEQ ID NO: 16646 - protein, 222 aa, Chlorella protothecoides
MARRSCPANLAVASSLTLSTALALSGTNTCSGSVGAIAGAILGASFWNWHSDMLRVRARKPAPLRVVITGSSRGIGKALAREFLRAGDRVVVTSRSLADAQAAAAALVGEGVGGAPRSVIGLACDVGDAGSVEALAGAAMHQLGGVDVWINNAGTSGGFQVQRFFRVVRGVVDPVSHFRIREGHVRFGVHAAVPGLAEGDGCHEQAHVRPAVESPPPLIIPP

SEQ ID NO: 16647 - protein, 239 aa, Chlorella protothecoides
MSSPPQSPCLGAGAYELLRQLHHAMVVGVGLVQLHAGELGVVARGHALVPEDAPHLKHPLQAPHLAGGGRESGSEGPGAGQPHAQCQPLPLPSPPTHHQALEVQLGGNAQGQLALHHIMVGEEGPCISTPGRRLQHGRLHLHPGLNPLPRPGPPPNPTNLQEAPVLQGAAQGADGLGPGPQRVGDARGNDHVDVPPAVPRLHVSQAVPLVWQRLDGLGQHGPGCDHDAQLPFVSPLHVP

SEQ ID NO: 16648 - protein, 108 aa, Chlorella protothecoides
MAVNLLSGTVAAVSATLLTQPFDVVRTQVQLRLVPRAAGAAGAAAPHLSALGMLRHISASQGARGLLAGAVPRVAKRALQTALIWVFYEELMGRAAVAARAAAAVPPK

SEQ ID NO: 16649 - protein, 113 aa, Chlorella protothecoides
MPEYDLLRHGTDDPFYVGFSMSVYQSSGHDHSSWGEFGRSRTWYGGHTIQGNQQCGESCNFWELFDADIERAASLGANCFRISLEWSRIEPERGEIDSAAVQRYHDIIDSLER

SEQ ID NO: 16650 - protein, 136 aa, Chlorella protothecoides
MDDFARPALVIDCGSAFIKAGFAGEVSPAVRDPSTVPRAAGLEPGPPLVPVKHGIVQDWDAMEQLWLDMTYRRLHVYTSDQPVILTEPPQNSPESREQAAEVMFESLDVPALHIGVQAQLALYADYAARQAMGSQV

SEQ ID NO: 16651 - protein, 70 aa, Chlorella protothecoides
MAQRTEKSRLVSAMSGSLSGACVSAIVQPLDVVRTRMQVDVNRGVHVSAWGTLRTITKEVGAPGKAGPSI

SEQ ID NO: 16652 - protein, 99 aa, Chlorella protothecoides
MARVVKPGGLVVLTDSQQLGDRSVFNSEMHKFGDFNEPYYRAYIQTDLGQLFEEAGLTCDTKVQGSSTKTLSFRKPTVPATEGRAILERSFSMDSMDEE

SEQ ID NO: 16653 - protein, 88 aa, Chlorella protothecoides
MTDMPYALHPDGLKKALHSINRLDVPIYITELGVADSGDDMRRKLIEGYMPKVAEAMEEGCDVRGVLYWSLIDNFEWQMGFKMKVWDS

SEQ ID NO: 16654 - protein, 75 aa, Chlorella protothecoides
MLDGILTSLDIPCTRIHAAIWKRQLGLFKKGKPGSMALAHQLLPAAAPFLRRAWNDGVVVKRWEPGVRMVRGSCS

SEQ ID NO: 16655 - protein, 229 aa, Chlorella protothecoides
MFKEQSLEVMESVVRTNLVGCLLCTRVALRTLGSQPTGGHVFNMDGAGAGGGPTPGFATYGATKAGIAQLLESVVRERAGKASGREGGGAALHNLSPGMALTDLLLAGATPGTKAAFNVLCEQPETVAAHLVPRMRALAARRSAGGHYLRYLTPARVLACFLAAPLRRGRYFDPAGRARYKSEAERVALAEGRRRGPRGRPAPLALLYSGSIALSYLMLATQAHAQHGM

SEQ ID NO: 16656 - protein, 316 aa, Chlorella protothecoides
MASRHLWPLITRLRQSGASASARPCALLEASGVLSTAFDTRWIGSSPSYSARVRRTGRDLVPRQAGDVAAEPGTAVEPAASPSLNLPAIQAVLQHPALVVTRPIEWGTVLLGFEQANRYTVCDEAGTVVAQLMEEEGSIGRAIGRQLLRTRRPFTATVLSADGEELLVVALARLSRLMTGQPARRGTPEMAPRCPGPHCGRARLFNGRGTFPQGLRCCSASAAPSTSSARPCTLRTGLGRSWGRFSSNGTYGDGTTPSLSAATLFEDGAPQPQAQRDVPGQIMSTKFAGAHRSPLLRQAVANFQPLAGASSPGTLS

SEQ ID NO: 16657 - protein, 379 aa, Chlorella protothecoides
MSSLPTRTLGKGLKVSAIGFGAMSLTDGFYKSDVSEEGGIQVLHRAAELGVTLINTAVFYGAGVNETLIGKAFPPEKIESLVFATKWGLENDFSTDFSPAAARRAVEGSLKRTGKKAVDVLTLRGPLPEDYDLESVFKGVKVMMRGLGLSLGIEEVPTLLCIDSATSQTAPQALVDERLVKHVGLSEVTAEQIKAAHAIVPITLIELEWSLFSREAEASCVLGWRGSGLQRTLLAHSSTHFLPSQDDIIPTARGLGIGFLAYSPLGRGILAGRFFSTAEIPEGDFRAAAQPRFQGENFAKNLALAEALRGVAVRKGVTPGQLALAWLLAQGDDVVPIPGTKSVKYLEQNVAAAGVRLTREELDEIEAAVPAGAAAGGRY

SEQ ID NO: 16658 - protein, 303 aa, Chlorella protothecoides
MCHENMSSGFSLLYNWNLGKSLRRIYLRHAPLFEAAAAAGELAYKTDQAASASTISAFDDAITTVTYGYASVDDYYAAASSDRDVGAVCVPTLFVQAEDDPIAVQGAIPREGLLGNPNAILALTPTGGHLGWCGGKDGIFGEGSWGRGVGVGERGCGAGVVLRHPESGAAGFWEGPGRGPPRGHHLLDCQRDHPQGGGLSILFVWSMVPGRRLKQGAHVAPSDSQIGTFDVAANRTGLLTRGFATLVHRTSTAKAVLEARINPSRKSFSTYNNKYDYTCGIPGVRLDRYESFNSPRTACNMNT

SEQ ID NO: 16659 - protein, 410 aa, Chlorella protothecoides
MLPPVFLCHSWKGQALQRLSTLACTARVLPRGCQPDGRIRYTKPTRSSREHRVDSDNPGRLHKTLCIKLWMRIVDPNPQQHLRLSTPYASGGRLYPKQQLTRLALVRVDSESDGAARSRLIGSTDSRIYIESITRAIWSVISRSHNHRVLLDSWEEFLADDDSSMGGPPTSQLQPKMNALRVQGTCNGRFSFVRPRCRAARPARQAFREPGTEFLMSNPCVADEFASGARRVELILSDVDGTLLDHSQTLTPGVKAAVEAASAAGVPLILATGKALGPWVGPVLEALPLPLPRIHMQGLHIVDPKEGVIFDRTLDEAIFHDTLAFCREHGAAGRAVRFPHLLWEQGACVAGSSVAGPPQCRLGMARVPCGGQGQCVYSPLSIVMELPGAISAEPGTVAPNLHHRTHQASR

SEQ ID NO: 16660 - protein, 319 aa, Chlorella protothecoides
MTGPGSPGLVFHPHSTAARPSPTSPLPLLPPPHQVKSTVKKHSAPLTLFCVEPSMRNFAHLILTRDAFFPPTSPPDLQWYIVNAAVSNVTGVSHFPRGCVDELCSLQGNSDGTRPRDFDYVPLTTLDALVKDYAIPAIDILKIDTEGFDATVILGSMEVLARGRVSLLTFEYHEVGVWREYALRDVVEKLDGLDYRGQRGAGLGLPEQSRSPETAPGGGAAALAHHPALHRRLVLSLFPLAFHLLIAGKQTLSRMTSCWDPAYEYYNWSNVVCVKRTHFMYAELEAMSSRFERHRAEYFAGKRAAGQGKEPTVQDAASP

SEQ ID NO: 16661 - protein, 167 aa, Chlorella protothecoides
MQFSRKSFTNLQALAAGDFGGSMSELAGGGPLSAFHAGGKKGSTTSMDSDSINRRSQRLAGGGSRPWDRLPSTDDFETQSGPLVHRRLIFVCNQLPLRVKGQGKGAWSFEWDEDALIAQAREGLPEDMEAVYVGCLPMEVDGADQDVSAVVLGDGAGGTTRVEEVPT

SEQ ID NO: 16662 - protein, 388 aa, Chlorella protothecoides
MFVPPTCLNPFPPAAEGRDLHGHPPAAGGPCRAAREALEVCEQPHRAVLGQGEFGDGGGKKGPAALRLAMPCQEGSGVLLDSACMPGYASLPFASLLSSVDFPPIALQSYLADFQRFTKDHARLQCFDLGFALNTFRMVRVALTSNFRKLPTDTLLKTYSRSGKRVFLLDHDGTLVPQGESSSRPGDAVLRVLQGLTANPANTVYVISGRARTELESFFSGVSRLGLAAEHGFYWRPPGSEAWSTQDPEARFDWRDIVLPILQVYKESTDGSYIEAKESALVWHYHDADPDFGSWQAKELLDHLEGVLSNEPIEVVPGQSIVEVKPQGVSKGRVVERVLHDALESGEAPDFVLCIGNDRSGEGTGERGRGGGGGDPGERRHWWRASWS

SEQ ID NO: 16663 - protein, 217 aa, Chlorella protothecoides
MPAHSPFKTIHIPQHLQAPSRFHHHIPSPPPKHRYGLYFGILTRDAAEVASDRMAVGLGQRRRLAVSVRSCGICAGELEDALGPAAAPTAAAAGSGALGVAGAGRSTVQLSCKHLFHSDCIRGWTIVGKKDTCPTCHEKVDLRKLYASRPWESTNMTQMLDLIRFFVVWNPVILTGLHFVFHWTGLEDSLDQPGFDPAQPWNGTAVGLNATANVTLG

SEQ ID NO: 16664 - protein, 127 aa, Chlorella protothecoides
MAVFLLIGKTSALTMNIGGVVKDWMLIGLSYWVYASAVTQLNLIGYLLAFLAVCWYNYTKFQSERGGKDVPYAQQPENAIPLALPSHDAQMKAKAAMDISKPEPPIPETVPLKSIGMRSPTSAHRAA

SEQ ID NO: 16665 - protein, 85 aa, Chlorella protothecoides
MAEAAGATVAARIITAYSYVGLWIGLSGAVIMFNKYLLAYAGLPGCPSAPPRAHTTPLAQAHVLLRHPGHRPGQVWKGGRHQHGS

SEQ ID NO: 16666 - protein, 228 aa, Chlorella protothecoides
MSPNPPPSQVFANKLVEVLGSLEDDFVWIHDYHLLVLPSLLRKRFHRIKCGIFLHSPFPSSEIFRTFPRREEVMRAMLNADIIGFHTFDYARHFLSCCSRMLGLEHKTNRGAILIDYYGRDVCIKIMPTGIKPERLLAAFDWSDTLWRRGELCAQFEGKTVLMGIDDMDVFKGIELKLQAFEQVLIHHAEWRGRLVLVQVTSAARLAFCLLVGEGNGGRCGVYPQQVP

SEQ ID NO: 16667 - protein, 242 aa, Chlorella protothecoides
  MOD_RES (70)..(73): Any amino acid
  MOD_RES (93)..(95): Any amino acid
MELYRLSAEVKGPAVQEYVGTLLDGGTKFLAFAHHTCMLDAIEHECNRRKGLRGSRTRRTSKEKRPRACXXXXVNKRECMRAGTQPLGIHRAXXXCLSSAQEGFRKKAPNRLGSTVPFPHHAEMICEARHGISHAPALYRYHQSTSPAARAARRFIRIDGSTQTSDRQRLVNSFQENADVQVAILSIKAAGVGLTLTVRGGEGLGGNVIMAKDWLGRSQRRPRTPGAPAPPFGVRWALVPEP

SEQ ID NO: 16668 - protein, 161 aa, Chlorella protothecoides
MRFAVSGADAAAARVGTASVAPLDWADAAAYASLGPPFPFLLAADCIYAEGAVPHFLATLLALTVPSSRILVTNEFRSASVHAAFLAGCEGVFTLRRVPVSKLDPAYEHPAIHIYALSRARQASRDISFWQSVGAYIGSARGTGWAEWPSWCDGHDGVTGQ

SEQ ID NO: 16669 - protein, 245 aa, Chlorella protothecoides
MPLEERWNTHFSTSVEQELFGQKSGLFHFHVLALSSSGLLRSPPRQQLKEVLPPLRVRLTFAQDPNSENLGTTVWDASIVLAKFLEKQACLWSRAWVHFLPHPDPAPSLVLRSVHNLPSAVCHSTPPWQALPGAGGRHGPRRRGDGSDGGPCDLHGLGVGAATPAPERAEQPDAIGLETWVLEGCSGDGTIAAQHGIVLLGKCGNSWARRCYESAGRLGQALGPAHALVDARAHCCPPMPRKDHV

SEQ ID NO: 16670 - protein, 448 aa, Chlorella protothecoides
MQLQRACAWVHFEDCSIGKKEERSLRLPSVTQCDRRRQHPTRATTISVVTLFQDSSHQATSGTSPCVLCLETPARTPGSITLESGAPFPGGRGPPGPAGYGPPPGGAPPPGHYHPPGPPHHGGPGYPPPGGYGPGPGYGYDGPPAYEPGPPPFRGMGGMPSSFFACVKLRGLPFGVQEAEVGMFLRRMDALLGGLAAGLCSVISESAGLPSHPSALGPATGLDTIDILLVRNNGRATGEAFVVLVHPAEMEGAMRKHKAYMGSRYIEVLEARKPDYYNAVCSTFGGGGGGYGGHHGGGGGFRGRSRSRSPPPGSERPAPPPTTIVKLRGLPFSASVDDIAAFFADPTIGLLAPNPEKCAQGVDRLPAWAKDACAGCRRGGAGLHCALLGAWVTIAVAADGRPNGMGFVEFESPEAAAAAQTKHRQMMGTRYVEIFASSAEERARYVPL

SEQ ID NO: 16671 - protein, 628 aa, Chlorella protothecoides
MQLCAPLPAQLRAVCRLVAFTPRHISSFHSSSRCHRPREGPVADAKGRRGMAELMRMEKEEEEQAIPGDGSGGELGGKLFLTSSYDPPSPPPLTDQQTHPCCGMRHSKSSSTPTRASGLATPRSRGLTIHSVPLPRTCSTLCMSESARVGHGVAVERFRANQSHCWIARGRLTVGPHGTGASGPPPSSPSCSDEGVGLAAPQVGVNIRLMVFNEMGKRGATSPALGVGSWVVVVGARRPLSLRRLGWQARLLPLFLSSPTPRFSILGEGEEVVLVNPEIISYGKTQDLFEEGCLSFPELYGNVEVRGAKRYVIPGAWGERPTKVTIRAHDEFGKRFKLTLSGWPARIFQHEYDHLQVSGASRHRSIPWRAGCAPADSRAPSLSTTHPTTKVHSLVRPPPPFTPPCHQGTLLPDRMQPEVRENIAAGLEALPQPAGSCSAGSEKAKSRQSAGGGGDLVVWEWGRRGGKRGKGVERGPFRVAGEGAQVVRSRAVARGTAGREKRERGSIRNERALGAVEKHGLELGWHVWSWAGPAAMPTQIVQTGRHCSGRAVSAAGEQTARPSGSTLGLDLSASRLLHTGRAHREQCWPRRRRRPGRRRRSGGRAVGQPAAGRRGAHAERAARIQARP

SEQ ID NO: 16672 - protein, 119 aa, Chlorella protothecoides
MHTTGSLSFYSERYAVSQPVRQPLPPRVQSTQGSPIASGFLVAAAFAAGLWAVLSALLVRNHGRTAYAPESRLTLLALWPLLLLTSPSFRGQFARAVGWTDVGSPTASTHDSPLREDEA

SEQ ID NO: 16673 - protein, 79 aa, Chlorella protothecoides
MCGYALLVYLWRTNQIASRALSYIDDRRGPRALAWLVVAALGAIMTLGIVDLVEEIEASRGGSPPPLAAAAAVRRLLGA

SEQ ID NO: 16674 - protein, 232 aa, Chlorella protothecoides
MRVTWLTQFEGAPFVRYGLAEDELDAQVPANVTTYTAADLCGAPANSTGWKAPGTINSGVMADLEPNTRYYYVVGDEERCAGTSSLRPPEHYLQGRRSVVSGRVTRLFLWELLARANPWTRPSSPSPCNPPHPLPQAANTTSTVSSFISAPGPDDTVKLLAFADVGQYNEDGTKGFGYWYDTYGLFDEVYAIGTLQYTVSAAVARPGLVMRGEAGMGRQVPQGSRIDPGPWV

SEQ ID NO: 16675 - protein, 123 aa, Chlorella protothecoides
MAGPGGGASAERELRHPLLGDAPTLRLMPGGSGRRLDDPEPSGLLDWWFRKPPMAEHKALPPGTLPERMEPKTYFANERTFLAWLHMAVTIGSIATALLGYSGATQSAKHPEEGSQIAFQAGH

SEQ ID NO: 16676 - protein, 487 aa, Chlorella protothecoides
  MOD_RES (8)..(11): Any amino acid
  MOD_RES (113)..(116): Any amino acid
  MOD_RES (399)..(402): Any amino acid
MAPQRLSXXXXFPEDESRGDFEGINGSATPICHAELRGQVHNYGILCQKDDLLVLLPVILPHLTTRGRDIRRKTYNAGSNQTSENDGLSVRGDRISRRWIPDGTCCAFPSRRXXXXGKPTTQAPTKFPRTMDGLSEETAFAAGGYRITLVVLSLLDVQGASAFGAGEDRGGPGPTHVRFSSVGYRVPGSKRRPGQGCPSMLRPGFSGPFHCKPKHRFGSPWRKTWLSGVADSSKGRQPYRGRRVSVRGESRCTHVSHSPTTRYCAGEVGVKVADGGAEDQEVDFKKVSQVEAFEILKVRRAHMPSSMMGPRFTRCASSSPPSSANPRRTPHIPPRVPPPRPPAVHPPRHHLRGVPRRAHPGSGWGSLGGLPVLHVEPPVLGHGGSCHHRHRPARLCRFXXXXNPLSWAMEAAAIIAIALLDYADFALIVALLLVNSTISYVEEANADKAIKALASGELLWFWGRDREGRGASPCPPTWQPPALALMP

SEQ ID NO: 16677 - protein, 109 aa, Chlorella protothecoides
MVLSLYVEQGTTLTPRWLHTRATLPPTCRQDPHFKAANHRRRIIQTTLLAEYAFIMAPGGILYTITDVEELGIWMVGRLGDGALGWGRSCMHEGGLLGGDGPRRSSCTS

SEQ ID NO: 16678 - protein, 96 aa, Chlorella protothecoides
MREGGLLGGDGPPEILMPIMAAGSGTKEKLDAHPLFEAVPEKEKLDVHPLFEAVPEEEVERDPAAALLLQGTEEGQKVARNGGKTWRAVYRRIQDT

SEQ ID NO: 16679 - protein, 368 aa, Chlorella protothecoides
MALLEKLLNRLLPAGHKTLIFSQMTSMLDVLSSYLEARDIKHCRLDGSVSWQDRQEAMKGARHCLITLIVPCATCDAPTPPTHPPQPPNTQLFTSDPEHKVFLLSTRAGGLGINLTAADTCIIYDSDWNPQQDLQAMDRCHRIGQRSPVLVLRLASARSVEGKLLERAARKLQLERMVIKSGAFLHADDAAAGSMSKEELLDVISGAGSGEHDLAQSGDISNEVSGWGWGSVVLNHQERWGGPRWGRVWCAGCCAGARMWEVGELPRIPWCPAQQQAISLRHVHRNGRPPPHAPGLPSCTPHPPSHLFMPGLTQRKRTSPSPFCCQVLDQLLDRSHLEAGSKRPYPDRGVGYEVVHQLSGSGLLAGVE

SEQ ID NO: 16680 - protein, 192 aa, Chlorella protothecoides
MSVATKSKTRSPGHPHPSPGCRTPARTDLPVWDCKMKKVCAVADNENVLYGWGKNAPAVTLPEGTGFAVGPGSAIRSFVLQVHYRLPRPAHDASGLRMQFSRQATPRSAGMLAYAARFTIPPRQQSHLVPNSCCYSGFEPMRGIAARVHTHTMGRCVGSRVGAHAMAAWRHGPASPLAECRRTSRPHVVTPL

SEQ ID NO: 16681 - protein, 117 aa, Chlorella protothecoides
MARVNPTLRALGRMAYGSALVAGSREAALEAYLRAAALHPGRLIHRVECGRVLLDLGRREEARGHLRAALACEAEDLNAWHSLKDARRMLAQLDGAAPAPEGGLALGAGPAAVPVQA

SEQ ID NO: 16682 - protein, 484 aa, Chlorella protothecoides
MCNLYLLVDAHVPAFQWCADSSSYVAASPPGALPVGAEAVAEEAHWRPPADLGQGAGVAADGRGRVYAFGRVGRVWDADAFDPATHLLRRGDVPIPGAPLAILDADSGAASAPGWGAGAFLMPHGASLAPDGTLWLTDVGAHQALHFTPEGARLGALGERGVPGDGTGAALCQPTHVAVSRDGTVYCSGAVHVADREAGAGPGAATWLLALAAAPGRVAAAWRLPGLRAPHDFALLPLPLAVTLPGERSLGVVVAEAAAEGSRLVKFAFRAAPDNGTEPVVHDARPLPTALEVASHSGAAAGHAQGTDADGMIIIPPAVAQPPVRGANGTAGADPSERRRDNPFLKRSEPQRDGIVLLPDQAAAGVDKPVMVTAQAARDRGGFEADAEEQGAEVADAKTQAAGVDPEALAHSKTGAQRAASTTGAQRAASWLALPPAPALGGGSLLAFIAGASIAVVGVLGWQSGCWGAAFRRRSSSPRRYVAV

SEQ ID NO: 16683 - protein, 199 aa, Chlorella protothecoides
MSMSVMSPMLTTSLSSTMMPKTAAFRPATQMPRGLRCPSRSIRAQASGEEKKSWIDRLAVPSAALLGAALLLTATPDAAEAARSGGRVGGSSFSSRRAAPAPSRPSPGPSRQYNSYNTYVAPPLGGGIGMGMPFFGGGYGMPFYGGGIGVFPSFGISGIFNIFLIFMLANVAISVIRNFTNGNGGNNNSKGDEDSWDDK

SEQ ID NO: 16684 - protein, 738 aa, Chlorella protothecoides
  MOD_RES (280)..(283): Any amino acid
MRVSHSFVERFGSEASGRICAPHKNLVCSHVGSPRPWIHSERYQTPVSSLFAQPASHSRVCMDYTAAQCCRSDACRRLYSVIGITQVQVHHQNPALDATPCAGSNVGHRLGLRRLPWIWWPLLHHAILSDRLILHDKDWKGMGVIHAHTGSMQCLVSEGDCDGQVPVCWLEQGSPAGRMWSSTRPHEDARMAPERIAFVLIDGLGDVNEAGLGGRTPLQAAHTPFLDAIAGARLLASARVAGRLDVVQHAPSRSRPIIYRGRTASRCHSSYNSHFPTPQXXXXTPHHPPPTQHGGPCSWPPRPIPRLHPTPPSLSINAAAGLNGLMDPVAPGLACGSDTAHLSLLGHDPRACYRGRGAFESLGAGLLMDPGDIAFKANFATLDPASGIVLRRRADRRFEAEGPVLCAALDGLPIPGFPELGLRVRYATEHRAGVVIAGPGLTDAITGTDPLRDGLPLLDPAPVEEERGGYGEQGNGAADGSGVEAGGGQGTDAEGNMGGPPGDEPAGPRKERPPPSARSAARYSAAATRAASDAMRAALARHPVNAERVSRGLPPANVVLLRGCGARLALPAFPARHGLRGGVAAPTRIIRGLALTLGMAALDVPGGTGDYHTALHAKAQAVAAALSAHRLDLGFLHVKAVDDAGHDGSAAHKAALLGAVDAMVGQLLARLARARLDSGEEGGVGGAWACVREGCRLDQLKGDRMPYCLSMSFPAAASLPSDVPPVQRHPAQQSIPSW

SEQ ID NO: 16685 - protein, 162 aa, Chlorella protothecoides
MDHSCEPVPVAIAHLRHVGSTTVSSCSYISRSVLLGRVPGHMQVQRLGGAEALLDIPLEPITLPPVPGEESGEESAGPTLPASLEPRLQAQPQKPPSSPHQEMGKPSSAQTFGDSVSSFDESAAGAGGLGRFPGSQLMPLIKHFAGWGPSPQDTARARRREE

SEQ ID NO: 16686 - protein, 349 aa, Chlorella protothecoides
  MOD_RES (285)..(288): Any amino acid
MEGSSSGLYGGWDRPSLLSSALYEVADVCAVRPVMLGSCNVEVSRSDVARCLEMSSMYGHILELPGPSEYIGERTRTFLSSQKAIDIPIAKPPNRAFSRAIAHSTMSLIPFALDPFFGDDFFHPLRSSRALTTSGPQLARGVAIDVSEDKSKFLIKADIPGVNKEDIKVTTEGDTLSLSVEKTEEKKEEDPETKFHRFERSTSFVSRSVRLPKNADLAAIKANYKDGVLSLEPCAVVHMIRPFPPLGGSCPSLVKASKPAGEPQGASGGDESMHGSPEQCTDKRXXXXEPSMVKTSKPAGEAQSASGADESMQGSPEQCTDKRLQQESKLFSINFNYPVISAIYKRIES

SEQ ID NO: 16687 - protein, 509 aa, Chlorella protothecoides
MQIWVGWTASIFAGYYIFKLRLADGATWCGWITLKQALSLNISSEVGLTGGIESCHPALSMPAKPSRLLQAEFLRLVGKGRGNLVLPDLLRLRCYDAGSLCGHSFAGLELQVWGRGVHPLEEEMQDPPPVSCKQGMILPATPCHSASSNRSGKFSLEKLARFAALCREKSSQFHHYELEAQLLGYCCLRMWMDLTQCPGGQKRFTQWANPSLLHLHPTWQGLKPDAGGQQRKETFLEARSGPVCESACHRGTAWLAPAPGEEEMHWGGGGVPLGPACRSADANSEPAPRLQPQHRAVPPHPLRPLNWRCTFVLGQVQHSKASPRLIQQSKASPRLVTPPSAVQTTSTPKPTQGHAHQHIYTHRTLQSHQETSLQSFVDLLQRVGEDKRLMELAEAGQDDWIPLEVVRDFAAGLYTGFAELMADVCPALVACAASRRSLAPRITHTEDGIYQKGDVKTAEPKHGDQASHICWPHSSASRVSRGFSESAAPTPALDAAVDVGGRGQGESLC

SEQ ID NO: 16688 - protein, 312 aa, Chlorella protothecoides
  MOD_RES (301)..(304): Any amino acid
MSLAMTNAGRAMPGPSTTPRLRHAGLNVASRPHPAFHRSMPARSRHVVRGMFIQWEGLIQSLRDQGIDSLPPREAEQAVKSGKAVLVDVRPAKFHEQAHIPGSKNVPLFEYLTLSNLNGVGSVLKFIAMKANGVQPTVFNPEFLQGIKAAAGEDTTLILYCEAGGTMEASTSFPYGKDSRSLKAIWKVGALPPEALEIKNWTLPVALAHPSGPDSSAASTDTTSQVTNDSVLPSQRVQHLAGGLYGWWRDGRDVEGEYTGAEAGRTPNAVGETRGRVRGGRVGRACLGYDPATYGVAMPLXXXXAGEWVVLA

SEQ ID NO: 16689 - protein, 1022 aa, Chlorella protothecoides
  MOD_RES (50)..(53): Any amino acid
  MOD_RES (569)..(572): Any amino acid
  MOD_RES (595)..(624): Any amino acid
  MOD_RES (1006)..(1009): Any amino acid
MFNPLPARLDLMMATRAEICGVKQVAFDCSGSFLSRTSQGRGVWGCSSTXXXXVKQVVVVAPPPGLTLTWLVRCWKRQHCGPCSLVVDNLSLNHLICAESHACDNQDRWVWFDAQARSRFRRLIALVGFGAEPHMAEATVHIEGLVMVEVLDKLRLRLLRYPIVSLRVQDEALMKHSRRLPFVSSESTLFSAKVYRALHSHSIFGYRCDCMTRHEFQIPPWQARLSPGAPWLPYKKRGETAQGRTHQPATSGFVYGRPSLPAPSLGHIFQSWSRHLGVCGREGRGEYQGRLEPCAHPSQPGVLSTPGFWAWASMLTVVTIMPSMHEADPSLQLFPRYMDEFEALKASNNAVLRLSLCMPVLPRWEVRIGHVCTAVIAVGDILEPFMGKGLIPADWDTWKVRRKKIVPGEPTPGEAWEWLGWGDLTFLESCNPGLIHLSTPAPPICPHNPQGFHKAYLNASMAMFGRCTERMIGKLDAHTASANSNDTVDMETEFLNLGLDIIGLGVFNYEFGSITRESPVIKEKSHDTKPVHTCSAAGCLQCLEGGGASQHILFAVLGLAPGVPGRAPXXXXSPMTLSLCIHAPLQAVYSVLKEXXXXXXXXXXXXXXXXXXXXXXXXXXXXXXSQERSKSPPHPQDVPTSLWTPPPADIQVLNECLDELIEQARRISEPEEIEALQQRDYSKVFCCACRAGHGAPSPDLGMLQCQACKGATCATGLPRLLDVNPMPVQLHGVPSCTHRPGQGCQPAALPCRGGCRAGGQPPRQVDMEVNCASGVKSGMGSLNEQCGSPAHAPGSELGEELPHFKYTPHQPTHPSCRPGRHRASPQNTSSAGRVLAALPPAADSHQERDGKRRSMTPAPSSLAEPWPLMSCRAACMATQPATLSARAPTFSSPPGICTAPPTSGTTPRTSSPSAGAPSVPAPSRRSGRATPPFRQPPPCTPTRWRPTLPSSPLVRLFRGKCTLDWVSWTWQRGFAALTKPLADSWDRGGVVLPRRWGGRVSLSSFXXXXLAKGICSNDKAVG

SEQ ID NO: 16690 - protein, 563 aa, Chlorella protothecoides
MVAVCPLTGPARATDLQSLRPQPLPPCPGQPGAGVLLVPKSLNTRQHSGIPTHSPQDPERLAQERQAAEKKAREGGYRGYSAAEARAGAGTPRPSPPSWEGPASPGREGVEGGAGEATPGYPAPASSTPPPSVARAGETKGVSMEANVANLEALRALLARPENARCGDCGAGGARPSWASINTGVFLCMRCAGVHRGLGVHVSQVRSCTLDTWLAPQVAFMAATGNAVANAYWEARLADRPPCHSLTDLEAFVRRKYAKKEWAEGEWPPAAAGAAGGGEGVDGGERAAGAAPGGRAPTKIGALPGPSPRPGTAPRQGVPPQDLAPAAPPPAAVVDLMDFSVEPEPLGAATTSGEADSSSADPLAALRQLDFSALPTTSSGTTPPPSAFAAPFPGHTPAPAPDLFDQLASGGKSGRLGGVAGATSWDFSSAQGLTRPPPEQRQPEGQSSSMRAGALNGSPAPQVNGASPAARRQQDADGSVPAQQPTPAPGGQARRPRLELPQAGCSPAPKPARDARIEAMLQSGLDDFLLASARVAAQPCAALTPGGRADPSPAMRAPRTQWQ

SEQ ID NO: 16691 - protein, 165 aa, Chlorella protothecoides
MPSRAVCDPVQGDNGQLYVSPDLPPAFRSELTPIATIMTPNQLEAELLTERSIGSVQEALDACAQLHRLGPHTGPQSLSHQLQLGLPQHPAGSQNQPFHPALPFPCTHDQVITSLDLEPDHVTVLASTTQPQAEGALSTFRILVPRVQAYVTGTGELGGDEYRVK

SEQ ID NO: 16692 - protein, 139 aa, Chlorella protothecoides
MVTSPGPGASLSGTVTEAAKDAGAWLRDYVTAIKNGRWVPASRNLSLRVGGGWLVGPLTSSLTPSHPSIRWHPFNATERAARAATRNEPWGPTGTQMTGLARLSHNSATDEAIILAVLELRLRYPAERWRNVYKVHAQG

SEQ ID NO: 16693 - protein, 188 aa, Chlorella protothecoides
GESEGEGCGVRRPAALEVHDRLPWSPCHPCVPSRHNHYPALPGPLGIPSASRLPTQVPRVRSPPCAPAPPPPRGAPQSSACRFLPFLLPSHQERRVPYRRGAELDALTGTRFALSLLLEALDVGLPLGRRAAAAAGRALSWILVDLVGAVLALLARGVRGGLSRGRRAGGAARGARGGVWRGGAPEAA

SEQ ID NO: 16694 - protein, 152 aa, Chlorella protothecoides
MEDARGMDGRADGLDTASSMESGTFSETPHSESGSSGRFSVKCPHYNPDEDVITRTEWIQERGMKVSIVGVQMGNIASLVVLSVALYWKVKKDPSFYLEGNDVPKMNLGFGCACLLAVGGTLVGFLRRVYRSYKCKKRWWEGDGEAATLFAD

SEQ ID NO: 16695 - protein, 382 aa, Chlorella protothecoides
  MOD_RES (137)..(140): Any amino acid
  MOD_RES (364)..(367): Any amino acid
MAMSLGELHVPRKAHPCLAPSFPPWSHQIAMSVVVVVQAYHATPKRPSDASILRVWLQEFSWTEGSLEANKKERSSSLPASAAGQARELDAEPMWCFEYGRLSLGELCRQVRPVVCHANPHEICASPIFTSLPDYKXXXXGQHRERVGWVLYGRLSLGEPCRLVRPVGCHVNPHEVCASLIFTSLPDYKELNSKAAYNVDTALSLYDLHSFEMLWEKSLVGGMSLDEQEGVGTLAALIAWCGEEGRERCPSLLVPARQTRTTATHGVSLLVPLPTPRPAPLVQDTKCLIGWSDRTLVVAFRGTASIANVASDLQVLPLVCEMWVWVRASLTRDKPAVQEARSRAAAMHTPSSLTPTPRRCGAPXXXXSGLGDVGAGQGITHP

SEQ ID NO: 16696 - protein, 223 aa, Chlorella protothecoides
  MOD_RES (207)..(210): Any amino acid
MALMRASRSASPGCWLGSSQTAPVGPSRSTSLATGEVRGNFGCSGICQTLCMAGSGGGASPPDAQGRWPCQDVAKFKGASHIRCQAPLPLAPFLRPPFPLLHSLGGALATLCAYDIAVCERLSGSVDVSCYTFGAPRTGNHVFAELYTRAVPDTWHIINNDVGTGAASVFVGRGVMHCSWVKPVLEVPLPHLHPVTAEEGDGSPRAXXXXPRGAPATPPPCDH

SEQ ID NO: 16697 - protein, 63 aa, Chlorella protothecoides
MVLCSVGILLYQIVWIWNIRQGFIFLAGQPYNEFRMGNQIIRLQVRLRGLAIVVFMASMIIYT

SEQ ID NO: 16698 - protein, 139 aa, Chlorella protothecoides
MNTVPLINLAIGAPFLLALFLACLGFMRRVIRSNRSGKRWCATAGPLLATALVLSPHLPKAAQGLGTRCLDQRGLCNPCAEPIAPPSRSRRRRRGVTNAGIEQVVQIINLLAFVVCSAYVVDKDCAVLSYTVIWGGFVQ

SEQ ID NO: 16699 - protein, 127 aa, Chlorella protothecoides
MTAIVLANTILMTPKRPDAGAILGEFAWTEREIENKKEERSSSLPPGTDTEQLNAEPIWCFEACVDSGRHLSLQLHRPHPSPAHLHAETDYEENKSKAAYSVDTALSLYDLHSFEMLWEEEMVRPWG

SEQ ID NO: 16700 - protein, 174 aa, Chlorella protothecoides
  MOD_RES (51)..(91): Any amino acid
  MOD_RES (119)..(121): Any amino acid
MAGGVGAAADVAGVVLLGDSPAQVVDVVRVGRATLRKIRQNLAWAFGYNLXXXXXXXXXXXXXXXXXXXXXXXXXXXXXXXXXXXXXXXXXREYIVFFGAGGAGGRAGNKGFQSLMEAXXXKESILCSLGRGGRRGAGGEQGVSVPDGSSSWGVVALDAGRQGALNFWTQWDSS

SEQ ID NO: 16701 - protein, 405 aa, Chlorella protothecoides
  MOD_RES (141)..(144): Any amino acid
  MOD_RES (226)..(229): Any amino acid
MYGLGVGVCIADMDSVMLARTRTFPHLTLKFTGTSSLSTGAESKEHRASSVVKYGRSSGKYRHRAIGVVKRYTQAYNYEGAQNYTSPHIHSAIANGLDPGTRYYYRVGGVGRNLWSEHALTSSKHVSSSLSSFPAPRSTHXXXXLACIAQFNTCLQLPVLLPRTQEYSFETLPAGKSYPLRLGLIADTGQTYNSSTTYERLKEDRPQVLTLMLTCLFRGHLRAASXXXXIPRYLDGANYYGLLELVEQIIYAAGAHPDAYLSFQRPSACSVHELRPGAPNIEGSHSLLHIPPLPTKVIFHMGDLSYSDDYLTTGTLFPWVLNVTPPVWTPPQTYQPRCDSGLAIHNAMWFGTFSYPFLDQAAAGHAAEHALSPVLSDHLALQGHVGKAGDTPRLTRAIPGHARQP

SEQ ID NO: 16702 - protein, 457 aa, Chlorella protothecoides
  MOD_RES (340)..(343): Any amino acid
MILSWSARAPLSPVPPHREPSFGHATLDILNDTHALFQWKRNADPLSGAGMEVEAAPKAGLMACSMLFFCVPQIRTAHVRGSCTRACSRSIADSQPFNHSMQWWQTRSSSGGVPTSLIQRAEALGRWKSRVPTQYSLSVRWGSPPHHRSPRDNLVQQEYRILSTKLTPVHSSKSRIITKDALMARSQTEDARDLDHPVRIFYLSEAAITMGRAGIIGAVLCAIVLPFAAARSMIELTTVDGGPVSLIPSTVQYNWSDTSPSGIARGTPDIPASDPRLQPAPEGYPEQVSVIYYGPTSSPCRRDAAPGRSGLRSAHLHLMQPTMGVAHKHEWVWYMTAPAXXXXAALGRSGPRSANLHLMQPTVGVAHKHKWVWYMTAPAMHPHALYTQAKLRPDTEPWRGSMTAPGAMCSWDSRPAHTRTYWKVWSWCVHVHSVQSLFRHCSGEQASAIRLDSLQAL

SEQ ID NO: 16703 - protein, 322 aa, Chlorella protothecoides
  MOD_RES (195)..(198): Any amino acid
  MOD_RES (222)..(225): Any amino acid
  MOD_RES (256)..(296): Any amino acid
MPTSPCLSTSVSKPKLRSGTTSRRALGSGDEVRVPRMVGRGDVIRRAVVDWDAVDAELQGIPSSFKEPRFDSVKHVLSLLSDERAEQELARSRCSTCRAFIPQHPLYLRHDQLRAQSAAVDALVTDVVDTYYAGFNRAIQNYSHILKLFSDARVQVPLESGRAPAVAGLVRQASRGCGAHYHAPQRRASPCSLRXXXXAGIEGVRRSLPCTTPPCLSMLAVXXXXPPPPPPPPPAEHAAPDPVHIPAAVRHPPGAXXXXXXXXXXXXXXXXXXXXXXXXXXXXXXXXXXXXXXXXXETLRLLGDVEAVLAVPSRLADLQQSK

SEQ ID NO: 16704 - protein, 257 aa, Chlorella protothecoides
MASTTGYPRKQVGAREWGMQQETCAHWQAQQLVCREVFSPFTPSKTYRGPGHSKRTPPEVIRLDLSDDGADSPEHWLISVPRKGPTRRLIDSGSDEDTPAKASPSSSIPGATVSDTPSNVDSEQTVDEDEGVSEDDWTPSSPESLPPGESCSPSTSKPEQQSPAWGPDRAVPHSSVFSTPRGPCPVIPSGAFKRRRAELAVTLYQEYNALIFDNRLPADLAITWNPRLSTTAGLTHYSQSPDGLGGRTCARVIGVWG

SEQ ID NO: 16705 - protein, 216 aa, Chlorella protothecoides
  MOD_RES (44)..(47): Any amino acid
MTDDGVAPELLYRAYHSGCYSTAAASSFAICRGPATGQASPLAXXXXDGVAPELLHRAYHSGCYFTAAASSFAIWRGPATGQASPLAVQCRSRIWKPTLLLHDCKTPKHLPRNSASIPNDRYTARVELSIKVVDGLPKLKRTLCHELCHVAAWLLDHCARPPHGNVWRGWADRAQRAYPELEITTCHSYDIFFPHRWQCTNAECAVDCGGGGHGAE

SEQ ID NO: 16706 - protein, 211 aa, Chlorella protothecoides
  MOD_RES (37)..(40): Any amino acid
MPLPSIPPHLCDSPCCLQHPTPAPPLQVWSHPGAPQXXXXAMTSMDPCPFPPFPPFATPPAASSTPPRPLPSRCGATLGRHSNSIDVNRKVCGRCRAPLEYLGRFQADNTPAKPREATGFSLFVKQHFAAGGWSWTGRAGHAMNPVHLCSFAFIPLNTERKQLPPGTPHGEVMKQLSLRWGEQQRATAAASTDAAVPATDAACDALRRLLL

SEQ ID NO: 16707 - protein, 296 aa, Chlorella protothecoides
  MOD_RES (262)..(265): Any amino acid
MHGALAVCQVPPALIEEYEWVSWPFEGHLRHLPAFRKHRHWCRDRGMTTNSKGILYALVARGPVILCEYNLVRGNAPLVALNLLEKWVPRPDAKASYVADKHVFHLLSDGELTYLCMSDESLGRRVAFAFLADVQSTFLAAHGASTRSALAYELNTAFEPELRSRMLRLNADPRADALTRIHGDVAELKSIMVDNIDKVGLAHHGVVWGGRKRRGSGVVVRLYLLALPALQSDLQQDWGAGLATPPAPQALSHHHSSYRRLXXXXTSWGVKNSSGWMMTRDGCCAPVRSQPCKLFN

SEQ ID NO: 16708 - protein, 477 aa, Chlorella protothecoides
  MOD_RES (106)..(109): Any amino acid
  MOD_RES (208)..(211): Any amino acid
  MOD_RES (232)..(235): Any amino acid
MPCLIAISPCPATASQQMVELAPSHADLVFDCVRVTWVAMIVSILFFDVRRRGGEVESSKGSGSEHLALRSARPIWRLLCAWTSLLSWCTGYVLPVVCHTTSPLLXXXXLGRLSFRGAPDTFSQSFATQPLPPWHPADEPGVGAVDRPGRRPRVFLHGAPHVPPALCSDAAAGGGPCGGSRQPRPRTRPHSHRHGGVTSLACPRHIRXXXXHRSSVLCIAATPQSCFRPLPXXXXASCTASTLQQCSGWRRPMQREQAASPAGPSTSPSSRWCDQLILPASHQTPPTPHPPLSAVKAPAVPYPLDPRVLSHHRSSVLCIAEIPQSCFRPLPQRACAAWRRPPYAQSLPPLTSPTQHTVKLDEHPMSATGQRGGVRRRVRAQDHARGCPRPSAVQGRAAHHGQQDVEAQCAESEDADAQAHAAPPQRAMHPPRLPLEGEGGGGEVVCALHEQVQPLAPIQDLSGGRRGQEGSGQPPVG

SEQ ID NO: 16709 - protein, 259 aa, Chlorella protothecoides
MNSLSWVSTFPWELGETRFAWGGGQRGGDASCSLSREAPPARRRGAAGPGGRDCRSQARGCKQSVVMVASRAEARGGLALRPAPRSGGRPPLLQRYSSSHLDGGGGAVQQQHRGYRKAVGVPAGRRAQQGRQGGSSDRVPGQHGSKIRPRLPHLPGNPDLRGIQGCLIAWQGCLKRCFNRSLSPSFHQNGEAMTLDCQCRGDLALRHRECAIKWAQVKGDCICELCKHEVKNLPALPPRPPQEEGNAGMEDVYCEYGIS

SEQ ID NO: 16710 - protein, 649 aa, Chlorella protothecoides
MEQAGTPTPHLTILGVHPVPVGELEVIREGVGEHILVDAAEEPLQQQLPLGSPEIREELGLFQTQFLQKSKLIDFQACACCGPGPGRCSPNLECGPFTECGPERWCSPRAAGCKGVKCVQHAIDLQRIFIRFPSRAQSDSPPRFLVTELERCCGKTALSDRPACAHHVHEGQSPSSRFHTFLKATCDFLRLHADSKDGPTSNSTPFFSSAFHQYGLAGSLSIALGTPRTSLRTVPSRHAPGVNDANGVSAGPGEHGARSGGRMVTAWQAPRCQGKSTGQDASLQDMVLKASQAYTSGNYEACLEHCMIGQSLLCVSAPQSHHRRYQIDLLLLTAVAYFELGQYAKSVAYNDAAVVLDPSLPEAQANLASGLSRLGQLDLAIMYYQVGVARSGERERTGAHSGWRAHRAWVVKVLVGQGGWCDSDFLCALDCVPVEIHKPCNKRIRGPLAPGTAVCPAPEAHHRRRPDQSGHRAAASESPRSWSTQPVGLRKPAPGGPITCHSPGCRGLPTLFFPGASRCSTPLPAGQRSGGGCGAGVSLGCQPAASVLRGAERPGQRPEGGGARGGGRGTVCGLPPSPHLGGRPGRGPGSGHPHPRATSGQQWLWCCVVWPPRCVHGGLAVAPVRVANRALLGCTVSNPPHRVMPQGLS

SEQ ID NO: 16711 - protein, 78 aa, Chlorella protothecoides
MAYPLSPDLALRISSAYAGHCLRAAAALNVGPLPHPAREPLAPGRRLRIAYVSSDLGNHPLSHLMGSVFGMHDRRWLI

SEQ ID NO: 16712 - protein, 85 aa, Chlorella protothecoides
MLKLVGRAREGIMCYQNAVALQPGEAEGHANLAAALKDNNQHEEAIAAYRQALALRPDFPDAFANLVHSMQCVCDWQDRPSLFQR

SEQ ID NO: 16713 - protein, 672 aa, Chlorella protothecoides
MYAPVTSLVPAEGLRLEVEAAPAGEDKPRRLAVVIRRAAIVSVAALHRFISGQRDEEEYAYHALQCLDIVLKHRMAMADRSLPVARGVFFRGPGTRSLGGGAEVWLGYQQSLRPCQTGLALNVDMAATAVLEEKPLLELVADKVGHVAGPLPDAARRRLNRDLRGVKVVTSHTGMTKAIRHLSRGSPFQETFEREGRQVSVADYLEAQYGVRLTNRDMPCVAVGNGTVLLPMELCRVAPRQRLIRLDETQTSEIIKIAAQRPGDRLAAIDHAVNRQAAFPDDPTARAFGLSISSRTVEVGARVLPNPMLAYGSPGRYDPKGGGSWNLRDVRFLNGSSLPSWAVVCFANQRFAAEDLEAARGQHGPTFMAEFVDMLNKCGVTTPREFPPVVYPDRNATVYSAVAEAKAKAQAAFGAPASLVLVVLPDTGAALYREVKQASDSMLGLPTQCIVSRKAGIGCPARGRPQYCANVAMKVNAKLGGCNTRLGDVERLPVLGARRPFMILGADVTHPRPGEGGPSIAAVVGSMDATATRYAARVTMQRGGQEIVAELKAMVKSLLLEFYGATRGMRPESLLFYRDGVSESQFQEVYYKEYSALLEACAEMGDAGAEYRPPITFVIVQKRHHTRFFPKSTDQSNRDRSGNVLPGVCVRAGEGWRGGRGSVDVELGDRKG

SEQ ID NO: 16714 - protein, 79 aa, Chlorella protothecoides
MGSKSRQELTCLWLPPRPSEQVNVPKTKKAYCKGKECKKHTLHKVTQYKTGKASLYAQGERGVLLGRLPDPGLDAVLDE

SEQ ID NO: 16715 - protein, 255 aa, Chlorella protothecoides
MPHSYFVNDHRRAHGDVLRGAAPTPTRTALGLPEDGVVLACANQLYKIDPGVLDAWCRVLRAAPRTVLWLLRFPASGEPRLRAQAAARGVHPARLVFSDVAPKPAHVARCALADLVLDTPACNAHTTACDVLWAGCPLLTLPLERMASRVAASLACASGLGGDMVVGSMAEYEARRAGGMGSRGTEKGSRRHKPAIAPAQDHPPGVHAMTPAPTPPPKHTPARLTHSGAGAGAGCAQAPGPASRGVPGSGVQPPV

SEQ ID NO: 16716 - protein, 464 aa, Chlorella protothecoides
MVAGCTIDERAVEGAGGRFLPEGAGVAVGGWEITCAKAPITADAEVDVLKERLGSLAWPEQFFGANHLTLVHPETGTRLTFEAEDALRAWLSGSEAPVHVKTAGKWMQAHAQDVDTHKAKVLQYDCLACHISHSHTHRTFTTGYRGSGAGPAGPQSAHGSSGELAWEATDAQMDRGMLTARDPILMYADIPLFESELEDNGVASLSVKVTSERGLAVRPPLRVILPSVAREGGGRRVLHRHPMLPVHRADAPFPMVSPPPQVRVMPRCWYALLRFWLRVDGVLVRLRTTRVFCAFKDAPDVVLRELFRSVLCCLWCTKVRCNLAHPSSSRLQHPQTTYQEGTFAALAAAGAPREGPSYADVDAAGAALAAVAPVGVTLYERQALQLKEGGAADTNMRRLARCIVVRRFLHIHGTERDAEAFHAQGQGSPSQLINPWVAEGLWACMGVERFGKDGGQRWFFTQSA

SEQ ID NO: 16717 - protein, 526 aa, Chlorella protothecoides
MEVTGRPDNADVWLTKTDKEQRLSPPLTSVNLRDLCSVSDNIKPGMCVRSSQVISQEDAQRLGVRTVLDLRRSPVLCKAHPNNTGQLMKHTFFKGRIWFSGICWSADRTGYTRMPQAELILCPHCRPSVTCGCGPPRSRITIGRCHARGAQPHPRKHTGNTAQCTMHNTNIKPSSLAQYSGSPANERGAKHPGQAPPQAAVPGAGLCRSSADPRAHCGRCVRGGRGLLGGYMRHPGAGLGMHSLASECLLCLRELAASQSCRYLPCTAAIANPDVMGYFKFYKILLEKARLPLARAVRLFADKDSAPVLVHCIHGKDRTGVVTMLLLLVCDVDPGAIVEDYVRSELILRESRDNNELVSLPGELWEQEKGGRPLGAAWYAPHHLSPLPSSRTGHLTTNEVIAAAASVIEALMDYMTRRWGGAKQYLVRAGLTVQELAAIRVNYMLSNQGQAAEEQHVSAALLASSGSHSGRHRKRAAPFCHHLSALGFASDIPGRGALDITKYISPQHSMIYRAVPASIFHISPAV

SEQ ID NO: 16718 - protein, 384 aa, Chlorella protothecoides
MPVPPPHSSLHPPTHADMPSLREGAPQASWDSPLHVMAYPCLTSERPALAPVVITPQHKVKPGAEIHTARLHLDALCYVRRDTPGALAAYNVSWEDWPAPSTSAGDHTCHPTTSECAGCEAVHSGADCWGVAPTEQGGAGGGGSDDPGLPLPATRIPAPRLAGARVGVPTSELEATGRRTLEHTHKALPPIRPRQLYPLAASARKAEEAALAERRAAIHAMLGLPSDRPLLRIARAVPIEGVSSRKAGCGPPVWVRGHISDEASCLEGGDACCTAPHLAPTSPCRAAPGAMLPAPSTRRLADVHVGIAPSRVKGGTQHLVQGSYLYYHYMQVTTGIGHHLRGGWGENGLPCPWCSSTAVPASGGEGGPAPESVVLGSASFSQPA

SEQ ID NO: 16719 - protein, 529 aa, Chlorella protothecoides
MTWILRCFIGGRERTGRAVQKKGLSEACAGRQAKSEGLHMHCTGCHAALLDPVILGLVPGRPQSIRPCLLSGDGGGRGWEGCLRAVALGAAEQHYVGLWLVDRIVDLCSEGQALRVSGVTGSPAPPTTTSGLAVANLMSLTPMTRPCFALQDTHTTASTVLTLLSNSFRSPCSPILEIAGRLGPSIPSRSAASPLAAVQRCLRARPRACVYRVRGEGTIGDTYPRIHQDSRFWKLPKRTRPELMDLQGGSGEHVSNTGAPGHRKNHFTIPLTCSHRRSSARCTGSDSEAWLSRGRGFGGLLSQYGTDETTFLLNTSMLSGKSDVQSICISCANGPTCLPIAASPKFKGQSRAGRPPGHMLLRLRSRDGLERVKVADDATVADLRQAIAADLSIPVDDFVISQEPTLVGRAGVYSLDHARGNTAPCSFFMRSWAFLLSHPNSPFTCSLADCQGWRVRADPVCPVQKPQGPGHPAWRHPLYEVWHQAQHPRPTPVNVRNQALWRPHGRAAHGGCPDPHRAPGDRGLLQRVL

SEQ ID NO: 16720 - protein, 363 aa, Chlorella protothecoides
MISILHGVLDPVKSPSSASPSSHAPPTNHAPLTTSSPKPTEWDEGGRYLRALERARAVAAGATMRMLRGDRALASGLGVLGRYFLTAQGDLFGHLMDSAGAEFGRMVAAVPLLQLQALLSAAVRGSSAAADPAAAQLHAAFDTRSVLNMLVSITQTAAATAGVGQPGSPLRRVRREGECRGWGEWEGSGTPAGRAVWGRLQRRVPPHLPHARCTCIPHSSTPDSPTPCTLSRPHTQGLKPVTPAPMSASERQTVGRQKNARESFMLSYAVPWPLSVVAPEACMAQYQMIFRCQGRGLGRGNINGRVLACSGGDGGGVPGEGCSWAQGVCGGMQRSGLAARHALTGTGLSQSMALAPPVTTRHS

SEQ ID NO: 16721 - protein, 121 aa, Chlorella protothecoides
MPIYFAQDRFNDSGWGCAYRSLQTLWSWFLEAGYTSTPPPDHAAIQTMLVMLGDKEPSFRGSKQWIGAVELGFVLDEGLGVQCKVLPLASGADLPDKAAELAHHFDMQGGSCGLGPGKGPG

SEQ ID NO: 16722 - protein, 80 aa, Chlorella protothecoides
MVGGGVLAYTLLGVDWNESTGEVAFLILDPHYTGGEDLKKVHAGQWVAWKQYGDKAAAGGKLLHADAFYNILCPQRPLGV

SEQ ID NO: 16723 - protein, 136 aa, Chlorella protothecoides
MPPFTTRQALWYYVQPPLEALRLVAGLCAEASARGLRGAPLLDLLHDRAARSFGDARAHALLTRLLRAAAAPYFAMLARWVGEGELADPCGEFLVQEDAVRLGAGIWGGKWGGDVGQGVGQASVACLRGGWVGPYT

SEQ ID NO: 16724 - protein, 205 aa, Chlorella protothecoides
MPEGGAGRATAAEEWLHAVQERELLPSRSSVPARPKLLRCPCKLPTAAPPPHTLRRAASAVALSRSCAVCQLVTHFFRQYLLYITFEVLEPLWLAFQHRVQTLDSLDEVCGEGCGGSRCPGNGRGSGAGVAQQLHALPVPAGARHRPGGPHFGGVRVAGSLGSVLEQHHAFLRRVMKGCLLSRKVVLLRSLLALKDLALQFVKVG

SEQ ID NO: 16725 - protein, 465 aa, Chlorella protothecoides
MPSPVRTGCCPKVCRLWAGRGPGAFRGAYVHAVEPLSCLSLGLSNLFSLPGKAELRAHLQKRSGKPFAERLDDFHLLLFLARQPNFDLTGGMPRSKGTREGGLREWALGNMPTHRSQSKACLSPGFLPGRVRGALYIEIPCYPVLPALSHRGRAPHGGGRRQGAGGGRVRAAHRVPGGDVRQWCAMAKDQAVEGSVEKKGKGGTKAIPSPPQRRAVPVPQSAWSSPPLEPGSDAVVHGDEVLDGPQRVPPCGGVQGAERLPHCVLHLVSRSSDRRAGAPRMVHVPAWRLLGRSGWAVGRCWAMNAWQQSMYVVGGHQGHGSYLPGRVQGRHARMRPRRGNDPPASPVQDRQEVAVVAQQRHASGGRAQRQRAQRAQRTQDGARPVGGKRRLQRDNEMGDALRDGLPSPGDEGGGARLGQHAVRLLARGVGAGRGGQECHPATSITLTMGQGARQRGSSPFDMYSS

SEQ ID NO: 16726 - protein, 646 aa, Chlorella protothecoides
MGDRASCGHTESRAPPSGAVCDHFYRAFGREGSVPTNRSVAAVAAVGRGSCRALLLRDLGDDDGGGEEGLGHGRGILQRAADDLGGIDDARGQQVLVRASCRVVAEGGRPAVQHTLHDHRPVVARVGGDELERIGQRAAQDVGAHALLVVVQAAAEGVDALRQLEQGAAAAGDDALLHRGLGGVQRVLHAQLLLLQLSLGLGAHLDDSHAAGQARHALVQLLLLVLGLRLGGHVADLAHARRDGLRGGAVPHDGQALLGDGDLGRHAQHLLPRAVQGHTHLLLHHGAAGEDGDVLQVGGLALAEAGGLDGHHLERAAQLVHHQRGQRLLLDVLSHDEERVAAADGTLQHTHHVARGGDLAVHQQQAAALVLGHHALRVGDKVGRDVAAVELHALHHLQAVLRGLGLLHGHHPRAPYARHGRRDELADDGVAAGRHGGHVAQLVVGDLGGKRGQLGHQVRHRALQPADDLDGVHPRRYDLHALLDDARRQDGGRRGPVPSQVVGLGGRLAHQLGPDVLHGVLQLHLARHGHAVVHDLGGAVLGLQHHVATLGAQGHAYHARQLVHARLHALQRLAVGVEVQLLGGAGDRSAAPRGPRGHAGAPQRGARACGGVCEGSEGSMGGWEWGGGVAVGGCPKQGPHSHHVAE

SEQ ID NO: 16727 - protein, 609 aa, Chlorella protothecoides
MLFCHVVAVWTLLWTSPNRHPSSPLPSAHRPLTPLTHTSTGPRPALRRSGVPTRPARRGAAVTRAAKQLHFNTDGEALKRMQAGVDKLASVVGVTLGPKGRNVVLETKYGSPKIVNDGVTVAREVELEDPVENIGAKLVRQAASKTNDLAGDGTTTATILAAGIIQEGMKIVAAGVNPVQVIRGLERTVTHLVAELAALSTEVSDNELRDVATVSAGGNAVIGELIASAMARVGRAGVVTMEESKTAEDSLQVVEGMQFDRGYISPYFVTDPERMVAEYEGCRLLLVDRKIATARDMVGVLEGAIRGGYPLLIMAEDIEQEALATLVVNKLRGALKVVAVKAPGFGERKTSYLEDIAILTGGTVVKEEMGVSLDGAGEEVLGMAAKISVSKESLTIVGDSSTAEAIAARVRQIRNMAAETEAEYEKEKLNERVARLSGGVAVIQVGAQTETELKEKKLRVEDALNATKAAVEEGIVTGGGCTLLQLAQRIDAFRGSLDNDEQRMGADILRRALPYPLKLIASNAGDNGSVVMQRVLDGGSPAFGYNAATGAYEDLLAAGIIDPAKVIRCALENAASVAKTFLTSSVIVTEIPQEEGAAAAPADGGYGGY

SEQ ID NO: 16728 - protein, 254 aa, Chlorella protothecoides
  MOD_RES (79)..(82): Any amino acid
MECKEAYQTLLSRSGRAGRGSSSAKPPPAPGPDFWNWDLKGFSPGEAQEEAYSLGKADGMLGPHLVFRHPHETRGLATXXXXWHAGTTSRVCHHHETRALANTPIPAPPIFSRPADVLRDIEREIAAYLEKRRKKQGKMGPTSFWDDLAGVGEEFVEFLESVGGVSLCILLEGLGLQDEEGAGKDQAEAGARDKASEQRNGSGAHAASGAEARRKREEDAAAQRKREEDAAAAQRAASPTIEDELSELRKKLGL

SEQ ID NO: 16729 - protein, 394 aa, Chlorella protothecoides
  MOD_RES (33)..(36): Any amino acid
  MOD_RES (71)..(73): Any amino acid
MAFLIEGMLLVFHLKGPKIEILVHLILVIQVGXXXXCGFGRLDHTLLLCNCTCTSAGHKLSRDASFPRHLXXXEPWFGTQGTLRLPWSGPCICALVASCLDWEQVIHQSPPRVADLPHRGGRGVRSPDAHQLRGRPGAPPVHCDPGRVVDPDGIHHVPRCGEGRSCGFGRLDHTHFLCNCTCISAGHKPSRDASFPRHLPAAKPQWDPEDMSSAMMAPVAWVTHVLWITAAMLSGKGWQRAAAQTHAPSCVWRSAASARGGLVLTLPSIPTLRCSQELKPTPPFPPPISVSISADALGYRAAPGLGVQGGARRAGAGLAHARCQRCPPLGCITCCEGMTCQACYRVYRGAGRATAGVHGFRATPCFPSPLGARAQLCTTASWAVVRRRPLPCTE

SEQ ID NO: 16730 - protein, 111 aa, Chlorella protothecoides
MATNGDIVEGYLVVKVLEVAGHNKNDEPVWDPSFQAGYVKGESTSSCLWLEGLRSVEAPASSRRAQACKKWSTMSSPGKSSSHCEPGCWCQLAAGCCGHGRDGALTHLPLP

SEQ ID NO: 16731 - protein, 238 aa, Chlorella protothecoides
  MOD_RES (209)..(212): Any amino acid
MNSASCSARRRSPMRGLPDPASSRPAVSAGASLCGAARSKTMAREVHACPLLPSSAVGADEVIHLGCAPSAGIYIRDLLEAVPVDKYFELFQPSTWREQCLACCHRRGEQYSMQARPTCPGSKVTTGKLPAPVDTICACTDARGVDLAHPSLPLTPPQSWARMAASSASLSTTSSPTKSGMAHPPWRQSRPQVCNLPPPNGASLPRLAXXXXGCVAVHRLELDMHMSGCVCVLAGTAL

SEQ ID NO: 16732 - protein, 663 aa, Chlorella protothecoides
  MOD_RES (139)..(142): Any amino acid
MQRCDRAVATHASSAAAGDALPTGPTRLEKLADVLTMMFPLWALISGVVAYRHPASLNWITGAQFEAGVGTLMLAMGLSLTKDDFRKARGLGGLCREGEGGGGGGGRPPSPHQHRPTHPSTRRQTHHPPQCVSNPVPIXXXXVADLHPLINTDPATHPPPNSPPAAVCVQPGAHTVWVRGPVRHHAQPGAGHLSRAGPVSRPLRRPDPARLLPRRPGLQHRHLRGQRRRRAVGHHDRRLHPGRHGHDPAAHQHAGWALRPGQHRRAGGLHRQAGASAHAGRRGAERDAAGPRRPRAPRHAPPGHPAHRGPLRHARRAGRAPPSVRAGGCVDVGGALALLDPETGGVGGPLPLRGPPARAMGKTGCHAVLQASRRVLGGATLPPAHPAAPCAAHPRAPPEQAPRCAPGSHTHDHNHLQAARRLGLPAGPAAAHAGLLLRLPPPARAGVRGANLAHRQHRDGDAERGHGLRALHQALCRRAGGHALRRLHPLHGLDRGGAGGGLAPRPHQGRQTCGLRARHRRSARKRRRSLPATTCALPDGAWRVARPPTPPTLGLQSPACVHHHVPATQDGCRSKVRGGVQPASTAATFTVGCRRREGQRRGIGVHGGGRWRGGSVFLGQHSRGSQGGRGRQQGQLDPGRPALLLLGGLAELRPERGEGGRLH

SEQ ID NO: 16733 - protein, 347 aa, Chlorella protothecoides
MQGFGQPAQALLRQCNITGFILHVSPYLAPALLCPTLHPGGQDWSYRGCVTNSHPSDVFPLSWPELPPCTVVGPGYAQIGVLAEPLGESLPCLAVGWGRGWSRSVGGSNACTAPWRSKAAGVPRQRECPHAQQAQMRRADVSESSPLRPPKPGCRPSAGQGGQQAGRQGGVCQDGGPGPLQLHAEFWRSAERREQQPSGAHECAGCLVPASRTAAEEGPRLSHTPARQGVCIAGASSPAGDSSPAGDTVQLALLCPLQLHNFVSSAPEASDSSKQKMTERSSNNVHNQLPLGADQATLRPASFSISLSLPLSLAAIVSEGEHGGDMGIVMSVLTSMHLSCKAMLAPP

SEQ ID NO: 16734 - protein, 204 aa, Chlorella protothecoides
MDGDHPHVLSESGLTSHSKDNNPSFNQKHIQQAKMASFALATTGASLAFTRVLRPQSLHRVALARPAAVRTKGAPRALPNPRRALSVTTRAMSGDLVATLKEKNKKNPVPHKVYLHDVIARCPPAIHRWPDCAEVKSLFQKLKVDAKVIELDSLADGNDVQQALFEVVGKKTVPQVFVGGQHIGGCDGEFTKGSDEYPYARPCT

SEQ ID NO: 16735 - protein, 133 aa, Chlorella protothecoides
MEPPNFLGDDFSRVTNIARVTQYNIACCYAALGQVDSGLEALESALDSGFEDYAKVGLGQGSWGDCALASPPRSALPRRRRPYPPPPTPLGQVRSDKNLEKLRTSPRFKTIIDKYDEPFINEAAIRWGGSSRC

SEQ ID NO: 16736 - protein, 586 aa, Chlorella protothecoides
MGASASTPADFSHKLRHGVIAKELDGGSLGEPSLAVIPQPGGAPLLALAYQVSSLPHQGSRDQYIAFTTSKDGQGCVASPRPCTCGVGAGPASSRACSPGAPDSQAARCSPHKADHLPAGGETWQPHRPVQWGLTPLWAPVLHWDAAGRRLALYYSESRKAPSPGGDIRRIVSLDAGTTWSPPSLVWAHEAHEPVPKVTSSRPVLGTSGELFLAVHLEPQGAHAVFNKDTYSELGAERAAVPCVTAPPGATPPSLLSAAGGCRRLRGLGAAMCSAGGRQSTFIVMPDSAGGPRSQAKRRCIDHGHGSSLATLAITTSTIRGHQLHVPTLSTCCCDPLRLSWPLSPAAILVSRDGGDNWALASIIDHPKTWLNQPALEVLSDGTLVALFRSCMGGRGGGKRGKYGVRVGHFTPQAGRVDFMPLASGRSHVCALWRHACLPAMPLLCACQVAVPPRDRTWLRRLLALRHHRRSPSSPPPSVYFPSSLMPGQVFRSVGTPDGSSWSKPGAVALANPNSKLASLLLDDQLLAVHNVGSKDRASLTISLSLTAGRTWEEVVSLHKLPGGAGRWDGGLALGVGGLCLYEGDP

SEQ ID NO: 16737 - protein, 685 aa, Chlorella protothecoides
  MOD_RES (286)..(288): Any amino acid
  MOD_RES (426)..(429): Any amino acid
  MOD_RES (532)..(535): Any amino acid
  MOD_RES (609)..(612): Any amino acid
  MOD_RES (653)..(656): Any amino acid
MKETEAWAHLDQVEQSSERAQEVLDQLEAVLMQQLASAEQVCPLAEGEAALEALTREVGESGGPNLGARGGGGTPGEATDPAAPDPTAADPLSTCALLAWLTQLSARIARREREAGAALGDLQLEVTRGERRLAAMRGAHARSDAMCSLLRASARERVKKLRRLQRSVATLLDRHFGSYLGMRGHAGSVTVDYETRRLRMEVHIAGGARVTDMNALSGGERSIATVCLIMAMGDGVPWEGRAWCGAGVYARDHSTWTRASMYVSQSLSLPKFSDPPLPPNFFTLSXXXGGLLKRGCFSASEGEGGGEGGGEERGDGVRWEGRAWCGAGVYARDRSTWTWASMCVSQSLSLPRFSDLPLPPNFFTLSIHLQVMWVRARPSAAWTSLTSSWTPSTDGERRGWAGVGPVLEGPPCEELTSAGQGSTEAXXXXSTDGECRGIGRCGAGPGRATVVALQFLLEFAYKFQDRQFIYLTPQASAAMGKALGIRARVGAWQEPGRCMHLHGLPALISTADPQSPRNDYETSAGLRLLYRXXXXSTADPRSPRHDYEASAGLRLLYRARIPSPDPALLPLQLQYHAGYNLSILLSFRKPTSGRLRITPGVLFRSTLVXXXXFPLVFSGPCACGPLAPKPDDHVRAERSGIGPCTLVHSVPDXXXXMSRATRAIVGNWQAHSVPDSTVMKMFTSS

SEQ ID NO: 16738 - protein, 481 aa, Chlorella protothecoides
MSLALKPDEEKMFEGQPQGFPFGDFDLEDVMLPEGDDDFGFPSEEEEEEEEDAQTESGFANVLGEGMWGYCVWALLCFASCRCRSCGPEAHPLGSTPPPLPSFPPIHIHTVVDGVPKVSQEKYQKLTSILTKILSGPGHIRENGLWHPVDEATGLSKGCVFVEYETPDQARAAQAALHGYALDKAHKFSATLYDEAERLAAVPDEYVAPEPRDAPPPENQWSWLSDRRGRDQFVARFGDETEIYWNDVAKQQPEDVYKRSTWTELFVLWTPRGSALATLHRQGVALWGGDSFGRLMRFSHQLVQRVAFSADERYAYTFSEVPPAGPRDPLRFLLIVWDVRSGRKLRVFEGPQAEFAVGAAARPDGGLAWDAFRWSGGAAPGAPSFLAHLKKGGVAVYESPDFGLVDRKSVKLDSVQSIEWSPAEPVLAAYQVEEGNMPARIMLMRFPKKEELRAKNLHSVAGRERVWVYGGMVEGEEGGGR

SEQ ID NO: 16739 - protein, 437 aa, Chlorella protothecoides
  MOD_RES (18)..(21): Any amino acid
  MOD_RES (216)..(218): Any amino acid
  MOD_RES (354)..(357): Any amino acid
MILPDAHTDRDRPHPSQXXXXGRLVQAWVPRVPLRERRASPAAQHSGVGYIGHDPIRRTHRPGPATPQSLRRGVTRVHSCPCHPPRRRPPPRRAPTPPSSSTSRSRTATSWLGTTRSVRRWMPPRPPSLMSGPGRSLRPRSGSWRCVPSVWCGGVEGAHSCVQGGGGERLLSEGVSGHMLCTSAPGMLKHCHPSCHLPYCYSHPTCIPSPFTSPLXXXVIPPANESLEQEIATARDSPSPLVAARARLEETQADKEKFLKLIASLEARPGLEIAAWGVPGSHRNAAHADTVPFPEHGGLNVSAMPLDSPGTPPTCMYTHQPALTRAVPQGLPGSQGGGAAQRRGSPGLGAGGRXXXXHAQSHKASLERKVAERRSDVAAQASELEGVERECASLRARLAVQTVRPADVQRMAAERVAAERELRAATAAREALEARLA

SEQ ID NO: 16740 - protein, 139 aa, Chlorella protothecoides
MVQLVSSHGKTLKVVPSLPSGEPGLHDGISARLWAATSALAQESMSTPFVTGIADGTLPRSTFQHYLAQDTNYLIMYGNAYATAVNMCRPDQQHVAAALLEVIDKINQEVAKHTEASLTGSSCLSEQIAGSECISGIVS

SEQ ID NO: 16741 - protein, 746 aa, Chlorella protothecoides
  MOD_RES (11)..(13): Any amino acid
  MOD_RES (46)..(49): Any amino acid
MPAGEGAGTRXXXMQAEQSFVIHMQVKNGSSKGPSGGCKHETGLEXXXXSFLHYLGQDTFYRLAYADAFKAALRLCRPEDEHLALRLRTALVQAEQSCVLHMQVKDGSSKGPSGGCKHETGLEISYVRIAWPDGCPQATSHPPSQRAAGFDLSLCKPEPATLAYTDFLQATHSHPDATLADIMSATIPCARLYAWIGHVLLPKQMDSSNPYMEWIENYSRKYDDRRFQDLEAILDETFVPECYGEDGRRKGSGPGAGCSIIHSIAGSRSSSLPPWTDRVSYLYSEAMRLEREFFAAQPLTGGECPTTHTLKRHPKPARAGLNAHCSALHLPQDDAPGIHQVTLFQHTLPLHRSQTDQHTGRCSVNTFGLCDACRTLHPDSGAAPYPAGMNELCGAQEVQFIQELHAKRAWAPDLPCLVHCGPLSGHSAHEGRKGFRGMPERKTTPESRPAVHQGELALACDAAPARVQDRRTRGLDLDSCLQPQGQPPMPAVPPWRDRMAAAHQHPDALPAPKVGQSVRRCFQGLLRACHGHECRDEGRHGAPRRCDFLQEGVPIPDQEGAGAVGDDIHCPAHSHYATLAGRKGTGHRGGGLRGVAAVHAACAFAAQACQGHDLRGISANDSWAQCHQILAQLQRVRSGRGWNGNCGGILRWGNGADRAVEGTSRLMRESRGAGAESGRTTTCHNGANPPKFWQGWPRTRRGPAPMAFSGALQSRRPVSCRLPSPPTVSRRSPAGQRPTPRTTPPR

SEQ ID NO: 16742 - protein, 533 aa, Chlorella protothecoides
MQLEKEFFAGQPLNSQVRQLRLLVIDFDETITTRDTSGTIAKTAIQAVVSKLNHELIVTRVSCSGELTCTTKSVSGHSAALNSSLQRAQVSEASKSEHLVQELADKHSWLIRNYTDRRTSLLEDALPPRTPTMHLLQEGEVRTEFDMGWLGDFVDRLADFDREMNTVVVDSANRRPPRTCRHPEGCPPRAAGAGRGGCGDAAREPGGDAEGSQGGHPCVSCAGLEFWGQAESVTPTHCDVSGEWVHGAQGGCPMLFARSHTDAGMDGLGLLLLSPCSNPRLEARSALGLCSVQSHQPLIPNPLLQGRGVGELVGRVCAGGAGAAGAAGGRQRQRRPRGRRPLRQRRHRLRQRAGVLWGRVHRQHPQARWKGFFLGCSGLEAGGGVRVGLDAGGRSRDASRPLVPAPCPARARPCQPAPGSHPMRTPQAPDPVRMKRPAHLAGVPVTVLRRRCECGADKARLLDDLLLGLAAEAGSGGDAVYVGDSMTDVPPLISADVGLVVGRNPLVRRVAAAGGVRLAPLPCAPMAAPGEDS

SEQ ID NO: 16743 - protein, 162 aa, Chlorella protothecoides
MGLTGRATALLLEKCREENPLVQCITNFVSMDLMANTLLAAGASPAMVRRGRLGGHCRLSLEIPYPPGLVETNISSPQAHSISEVESFVELASALLVNVGTLSEDWAGGMKLAALTAGRLRKPWVLDPVACGATPARTSVGSHHYDKWWFVRIPPLPHVTPA

SEQ ID NO: 16744 - protein, 231 aa, Chlorella protothecoides
MDRRKTLGALSPGSLNSRASLAPGRFTKDAAKATGWASKVPLDKAMSRMSLAGPVQRRSSAYTTTKASGLKSDPRPVGDKQYQANCARTIITYLATHNYEYQINPKVRGARDDGPWFGATTCPPDSPSPHRPFPAPSPQVLASPTTKDFTNIMLFLLRRLDPLTAKGPVKLEEEVPVLYKRLRYPFQISKSNLTAVGSPHTWPSILAALAWLVELLNYQDQAEHAVQMVRP

SEQ ID NO: 16745 - protein, 232 aa, Chlorella protothecoides
MALASLGGERTRGVDSSHPSEAAAPMARALAARQGCIVAVSGAVDVVTDGTSTLLVGNGHPLLQKVTATGCSVTALIAAFVAVAGPEQALEATAHALAYFGCGEGIWVLVCSCHAVPPRRHRGHGRLPLGLQTRIEIQTPRAPVLYPCRSRVACQSKLPLMHCWPALWRCLSLRHASKPLPALMRRVAAERAAVDEAGQVRGPGSFRVKLLDELDLLCAAQLVHASRIGRST

SEQ ID NO: 16746 - protein, 108 aa, Chlorella protothecoides
  MOD_RES (28)..(31): Any amino acid
  MOD_RES (101)..(104): Any amino acid
MRTCTLLPGAHHDFLVPRPSQLHGLRGXXXXPAHHCQEHIMTSSFLDPPSFMDFEDEDKVLPSDAVMEYEEGFKLVCDSKSLLYLFGMSLDYSDELIGGGXXXXQPQC

SEQ ID NO: 16747 - protein, 298 aa, Chlorella protothecoides
  MOD_RES (113)..(116): Any amino acid
  MOD_RES (258)..(261): Any amino acid
MGGLETWLATLQLHRESSEPLSAKWPGDCNTGWQDACPLAYRRLLPHRSHPALLLSTCTTPGATATPLTPYVPCSERRAPGQQAAGEARQCADARPGAGDRHATRAELCCWKXXXXLEKRGNALTHDLELGTATLRALSSAAGSDARTRVPRYDKSAHAGRGDRFPEDQWAAVEGPVDLVLFEGWMLGFQATDEEAAAAIDPDLVPINRALRRYKDAWDMYVHSWIVIQVADAGYAAAWRLEAEQKQRRSGAEAHAPXXXXRHDRCAGEGNAWFSLGGKGMRVAGMGKALARLSWHGA

SEQ ID NO: 16748 - protein, 218 aa, Chlorella protothecoides
MLPAAAAAFEELTDAAAQLMRSVGDFGLYSKTREQIAAGGAAALGPAAAGGLTATPGPSLTLMAGRGASNGDAGAATFHNPPPPADAELNIYGEEGGGGRAETPASERPLSPADAEARAAGEGDSKGPQRLPSPLAQAQPLPSSPEPKVEGPAPSPVPSGVGSDPLDGFQLDPGSGQWVNHSLGCTFDPATQLYGDVESGAWYRWQDGQYHPVVTGSS

SEQ ID NO: 16749 - protein, 447 aa, Chlorella protothecoides
MLSLSAPPQNLHSLLLPPPASPPRSEVEELERDICFLLGLLAIKVAHQQAICKAGALRTLVALVARYAARGDPHLSGSAAAAARRAADAITNLAHENNAIKDRVRGEGGVPHLVGLLSSVDPKVQRAVAGSLRTLAFKNEENKALIVALGALPLLVQMLHAEDTTLHYEAVGVVGNLVHSSAPIKRAVLEAGALQPIINLLSSPCPDSQREAALLLGQFATEGEYKFAIVQRGAVAPLIEMLAHADTQLREMAAFALGRLAQNADNQAGIIASGGLLPLMDLLESRLGNLQHNAAFALYGLSDNDDNLIEFVREGVVQRILACDMIVQPSRDCVAKTLKRLQERLRGRVLAQILYNMQGAGGAARARIAVALAALTTPDSPSPAAKRVMFLEKRTVHVLVDALTDPHTPGDLQAQAAASLMRVAEACGATSPLPLDPEPPEPQVGGL

SEQ ID NO: 16750 - protein, 112 aa, Chlorella protothecoides
MCASADFAAPCPKKRHSLSLPCTTLHALIPCSAPNPHPRQELADRGIAHFDLKCDNVLLQPRDPPSSQGPRGTPGSMQDALPFEVVLADFGESIQFDSRAEAGAPSLAAASG

SEQ ID NO: 16751 - protein, 456 aa, Chlorella protothecoides
MRSLAQPCGTHLESGHARSHAHPSRCHPCRGVPEHGESHMPSSQKLSSRSEWGLSRRALLAALPSMLATLPLACGAEPSPSPAITHRVYFDVGVCDAGVNRARTLGDTVACEAPAYLGRMTLGAKEPFSVHGGKGLMPCPCKMPPMQDAGIWRQRLPSGLYGDVAPASTASILETIRAGKYDQSLINKVLPGQYLLLGHQGPKRLGYVAGAQCSQPNTDLMQPASFQLPHRRPGTVSLAVTGELSLELVPRWWGGLGCIQRLMHGWTCCGGKQSIENEDEQYLQRLPSYCNVSMLITTGPGPVPSLDGQNVVIGELLGEGIAPVCQTWQQAVSGAGHCIDELCATCAHVLSKQQPPCLQRAGPGFRRQEGQPRRQAVGPALETHRGDGSWRDQGDMRKGGRHKMGDMRKGGPHKMVSLSPLRPAECNCSCRLMPIRIVDWGWWASLEASISALLLI

SEQ ID NO: 16752 - protein, 339 aa, Chlorella protothecoides
  MOD_RES (68)..(71): Any amino acid
MRGIRCVWGCTERWWCLGGGEFVHRSAIFSSALRKTNQHPTSHSRPMPHPRWLQEALPGVIRARDPPXXXXATPPRWLQEALGGVIRARDPPELHHEELVRLVDWKLSRGKWRPRLQAFAKELAPASVADASRSAFASSYKDSSSGAEPGPSALKSAFLELTKLKNCPGMSHVGGSLFLSRKTARVIRAVWQDTTALCIIAPCATLPSPAQGVGPATASAVLQAFHPSIPFMSDEAMMAALGEKAYTIPIALEFIKTLREKAAELNKLDAERPVTILPLPPTLSSLPGMCQGEGAGLPRTWNIASLQITLPGWLLNVGRGRLQPGARGSVRNRGMYGVQ

SEQ ID NO: 16753 - protein, 330 aa, Chlorella protothecoides
  MOD_RES (286)..(289): Any amino acid
MVSSEKGEGPGKLGGESCLCAPQWSEGWSPQQWQRRASPMTNRVHCSGNNMVPRQCSGALLTWNQSKRPSPDPPLRSALPAADIISAVEFDGDGEFLATGDHGGRVVLFERCAPSHLANEVGGEGFGGDGMQCRAGRHPWAAQCVNPLPTAHHASPHTQQPADSRPASPRIPNAYEYRYLTEFQSHEPEFDYLKSLEIEEKINSVRWCRRDSPALETPTAHHLLTTNDKTIKLWKVYEKQVLSVSGLNMDAPGSSGQRPSLEGGGAPPSLKERELRVPTVRRGHGXXXXGGGASPSLKQRELRVPTVRRGHGAPSWLLMFGLGLSIEAGG

SEQ ID NO: 16754 - protein, 165 aa, Chlorella protothecoides
MDDLTEVITRAAFHPTHSHQFAYSTSRGSLRLADLRAAALCDAGAKHFEDAGPGGPKNFFSEIISSISDFRFSADGRHLLARDFMTVKLWDLAMDSGPLEVHRVHESLRSRVRRERKEEGGVWAGERRKVEGVVAGPLANGAGGWLKHWNALKKGEGGNGSHSMP

SEQ ID NO: 16755 - protein, 403 aa, Chlorella protothecoides
MEGSPARCGPGPAFVPQEDTLLATLSVEECVRYAALLKGTGAGAGASQGDIAARVTAVLQELGLEGVARSRVGGAALSRRGISGGERRRVSIAMELVHGPGVLILDEPTSGLDSFTALNLMHSLKRVARAGRIVVLSFHQPSPAMFSLLDRAYLLARGRAVYGGDPASAAAFFKSRGVPCPAGDAIAEHMLHAASDPVTLGALLAGVQGNGAAGGGSPRVLPAGHGTVGAGKDGAAEKGPADAQELALVELEAGPGTTRSGTEGSHGVDAAGRGTVSDPGPGRSRSLELAVLFWRAGLDIARNPSLLLLHWAMALGMGIFTGCIFLNVGLDISGAQNRAGERSKMRRGGGEGGPVFAIVHCRVVAAAPAASLNAAGRSSHEPFPASPAQAACSSSSPSLPSRA

SEQ ID NO: 16756 - protein, 220 aa, Chlorella protothecoides
MGLQSDSTIVAVFLFVLATFSLVVGAFALAVTVGRCLGAGGDSALHRGCTTAGKASLVMNVVLLISLLVGGFFVNVASIAAWIRWLHYASVFFYAYTALITNEVATLSLDFVGPDARGKGEHLLHRWLVPGEALTCCSRTHHDPRASRITTFKPWQVEGYAAVKNVRGVAFLNIIGVDAGDLTRNIIILDCLYAGLLLVAMLVLWLRLPTTARMARVTRR

SEQ ID NO: 16757 - protein, 441 aa, Chlorella protothecoides
MTTALRAVWLSAESNFQGSLPEARCGHVAASIKNHAAWGDEFIIIHGGINREREALDSLAVLGLDQGSWNSPSNPTGPGPSARAFHAGAVLGRRLYVFGGHVYVKQQARLHTFNDLWCLDTDTWEWARLETEAEAPTPCPRDRACLVASLDGSSLLLYGGADASNRRLDDLWRYDIAARAWAEVGAAGGARPRPRCSATLCALPNRLLLFGGDNYGVSGELWSLNVVVERAGAAVKTSREGPGGDGKPATGPAPPATASWTLLSLEGAVPLPRRGHAAAASGRGFLVSGGFTEHRSLIGIKSRGVCLDGECVLRERGLRLRPAEGPARLPAVTGPTGLCRRRSGGVSTLLGRCMEPPLDPTTAHPPPRRLDAGPGGGVAGVEGRGTGVKRRRHALRTGEALAHCRVRRPPAPVWRWGVEIRLWRGLGGEACTSVVQGSLSA

SEQ ID NO: 16758 - protein, 135 aa, Chlorella protothecoides
MGKRKSGASSTFPETITQQPAQLRSAAGPYAVYFPSGYDPATGVKWETYTHAKKRHSLIVGRTDSVDFVGGSMGGEHSTAPPCRCPGVGWWGGSSRRPHHVALPVLPPKPPTSPCGGKVRQPGPHAPWPGRKFCC

SEQ ID NO: 16759 - protein, 202 aa, Chlorella protothecoides
MDRALAPPPSPPHPLPPPPSPPHPHFLITSSPPLPHHLLSPPPPFPHPKRYALGVFDRASGALTLAPLAHDRLLRLEPRVCGVDYGPSEALNSSVEGLEERKAATLRLVGQLGSQRRQRQLLAREAARVDPRATPRGTARAGGARSGLALQGGPGGGGHCRAGAAPARPWRDHRAAGLPHARPGLGRALGRAAGGGLPALCA

SEQ ID NO: 16760 - protein, 263 aa, Chlorella protothecoides
MAVFQSHDLLIHRHALLHLPPRHGREDDAGGRLEVADTADSAPAHPTPPRPGGPHLTLEGPPATSNRPLSPAPGAASGLAAAGLAYLPAVPLGLTSAFSSLRDRLGLPATAPAADLLPLGVLASEFDPALLALGQRVLDLPSGTGGDRGRASTVSSYLGIKELVQGRHGPFSTSPLPSPAPLFNHPPPRLQELRLGDVGALVADYRRLARAGFAAALRERPGDAADLSRMPGRFMHLRAEDLRMHEVATLLEEYRALLASQFG

SEQ ID NO: 16761 - protein, 1344 aa, Chlorella protothecoides
  MOD_RES (154)..(157): Any amino acid
  MOD_RES (621)..(624): Any amino acid
  MOD_RES (866)..(869): Any amino acid
  MOD_RES (1334)..(1337): Any amino acid
MHLSPHPSNQPPFLPKQILGSAAVFGDPIRLVHHLGLGVWSVLASPAAGLVESARSRGPAQLLLGLAEGPRAAAAHFAFALSNAAGKTTAAARKAMSALGLDRWVCLREGAGGPVCVALAGVWVWRRRRHASVNGCDLAGGGPFIWRSSWPLAXXXXPSADVTLPGVARSSGDRPGPLLLPRPSLTASSPLRRYTAEYPHRPRRVERDGGSALIWRSGTSLLSGEDQGPTNGRGEALLPATLRGLVGLVAEPAAGAETGEQRVLHHGGRPRSRFCPSIHSIARHLQGTLWRALAPMQTAPAEVVHDRHTHALLTLHNLTPLQHPPPTRWPAGRSARPGQGLSGSGSAAPGLRAGHAGAHCRQRPAGGGRCAGAGLDPTPPLRARRRPAAGVCRRAGARPLAASGAGGGGGVGKRGGRHDPGRRLCLLHPSRAGRRQAPGADSALRSARGGAAAALGAAPVLARGAGGPGKRRAGGGQRPAPGGAACTSLSFDPGAGAGRRAQPLLPLSVRNSVRRVGAGTGAARRPRMQGGGGAGGASGSVGGAVSDVLRPRPNPGTEDVLDPGSVHHSSYRWPLHRQHVCTARFFGTIQLIAPLVESIFKQPWISRWSPFFGKVGKTESXXXXNSLGSIGGHHFFGKVGKTESAPRTLPQQSSSRDPLVPASGSPRTDPGSKTFRSSPDCRNRTPSRAAIAGRCIRLSTPSSHLSEIMTKTSSVPTDPHERLAAISREFGEYGGAMASRGCCGEVSMPPAALSLCPAEVYLSASRVPASSMAPPPHRRQHLHRDFLYIYRWAHGLSMVRVSSCVGGASRPRTTGRRFAFGKSRAAVKPPAHPGQRACLAGPPGTQLCSVYAEAWIPFQASPSSPXXXXPQERSCVLFMQKHESLFRPHPPHLGPTPLTSDSAEGGNPARHLLRQDGPRPGRVLPVRPLLQPHHAHAGAPDRGDGGRGGRLLHRLRPVCHLGHAAGAVRHRRPYPGFGRGLRRHPRPAARLLPAQVWHHLHPAPRGRPGAVGGCAHPPHPRAVRGKRVQPHAGGGRHPSPGGAGPRPRADPGGGQHLCAHDHLAHRARRRRGGALRHQVHLRRLGRRGRRRGRPRGLHPRAHAPMLRPAHAAGAHHGPKGGGGAHPAPAPPGAAPARARRARGALLASPGGPGRGGALSGPAQPPAGGALRAAGQPGLWRGRHHDRGPAHSGAGGGLHGAPAEQARLRPARRQPGLLRHPHVRQRRLHLQRALRRRPGGGGHLARTRAPVRRHHRRRGGALGGAGGGLARRRLGAGPRRQSALQGSPGVYGSFGLEGMGGAETCWSSGGIWCGIWRFGCGLPASLRLKENRGGXXXXGLDADFR

SEQ ID NO: 16762 - protein, 261 aa, Chlorella protothecoides
  MOD_RES (17)..(20): Any amino acid
MLNPDPVRGYFRFYIEXXXXGSVRRAALSGRSEHPAAPGVGLPPPAPPCPSARLLLGGLALHAQGPLLGEGLAAALALLLQPGDQQLVVLRLLRLLGLDAARLERGAVPLVLQGAGGDQALDLGRLDGGLAVLLLDLAPVDLDVVPHIVVLGQVEHLPDLGGALGPTLAWLLLVGQAGQLRHALPHDHQVQDGEVGGDDAAADRLAATLAVAAAVPAEAGVAGGHEHAHAAGGQHTLLHGEALLVLATLDLEDVALELLGG

SEQ ID NO: 16763 - protein, 185 aa, Chlorella protothecoides
MKQGVLTPGRVRVLMSPGDSCFRGHGRRDGERRRKSVRGCIVSSDLSVLNLVIVRKGVAELPGLTDEEKPRQRGPKRASKIRKMFNLTKDDDVRHYVKIYGRKIEKKNGKTTIKAPKIQRLVTPRTLQHKRHRAALKARRIESKKTQQAEYHKLLVSRLKEERERRSESLAKKRALRVQSQASKE

SEQ ID NO: 16764 - protein, 429 aa, Chlorella protothecoides
  MOD_RES (90)..(93): Any amino acid
  MOD_RES (385)..(388): Any amino acid
MHEPLVNLSLPRVASWTAALMVAASLQASPAHAGSNQRLPPLDSGWATFDSWEPPLPGSFACLVFECPGSSACLLGPVGILNGQHAAPDXXXXSAWFLCLPGVECPGLSACLLGPVGILNGQHAAPGRSDPLRCERAFTGNTIGQANAVSDKILDLRFCSFPGAELKGKVLSGMQRLWGLMDLPRTSRAGEECCWGGVRHFARTCSDTGVQLPGVKGGLWCVHNLSSGASQRSEVVMSKAYAVGTNFKGEAAEEGYDAMEHTWREARHAEGASQVACVQDSASCGLGARSTLAHDVHVKEPLKVYQAHPTLPLHRRRHLQGSQPGRGQLRGRPDRQVGGGAGQCEPRCSWTALAMICAGVALGLQPHLTHPPSPPPVRTSAASAXXXXCSWTALAMICTRVALGLQPHLTHPPSPLPVRTFAASARSPA

SEQ ID NO: 16765 - protein, 209 aa, Chlorella protothecoides
  MOD_RES (185)..(188): Any amino acid
MGGGGRALMRPPICTLWAVCDVQGDMLDSIAERSLISFESVPRMSREGLYRRDFMSGRKEMLSDSGPVVGMPSWKLPQVDGRWNSTVRRKTRTLEKQGPPADCTNLEALHAITAGSGKTLSLLCSSLAWQQREKKRIEDGLPSAYPPSAAPPPEAPAPGLATEVTLLVGLGVGPHVFVTHATCAXXXXAAKSLPCVTEVQPFPSQRQRD

SEQ ID NO: 16766 - protein, 242 aa, Chlorella protothecoides
  MOD_RES (99)..(102): Any amino acid
MSASQHGLASPVPGGGCPGPTHPSAGVEGNMLVFDEAHNMEDVAREAASMHLPAPEVLEVGGGQRWGTGFAWGGCSRPLQHRVPGRPQARSSPQKPHSXXXXEGGDRPRMGAGARGHCSTECPAAPKPAPRHKTPTHTPPAAQIQTSFARAVAMNGKPEVYAPLADALLRLHEWLVAREADVAQGVIRIQKQNRFEKEEVVWQGPQALAAPSINFNRCTSVPAAAYLGTIDDPQPPAETGQY

SEQ ID NO: 16767 - protein, 466 aa, Chlorella protothecoides
  MOD_RES (119)..(122): Any amino acid
  MOD_RES (267)..(270): Any amino acid
  MOD_RES (393)..(395): Any amino acid
  MOD_RES (417)..(420): Any amino acid
MALGADAVEALWVAYQAARAEEEAMQQSRGPQGASAPGPAAPGAPPVIAELAVRVGGKALGQTSRLIQILKLLHEVGAGNWAVADARPAWGGFGWVWEGVAEAGGAGVHKVHRIAAWKXXXXGKRAVADARPAWEGFGWVWEGVSEAGGAGMHKVHRIAAWKAASCGEVKLEWVPCSGRMHALLLALCLLPFPSSTRSLRGDEAAPYASDVEGECGKGWWGMAYHCMGLQDPSPHVFAAPRVLATLAHTLRNCMSPPLLLPPPSVPXXXXWGMACHCMGLRDPPPHVFAVPRVFATLAHTLRNCTSPPLLLPPPSVPRDEAGSQWVSAVSLWCLNPEVVFKSLSGTVNCWTCTQLPSSTWLPSQGTWGPAHPAQALDPSFNLHCRAGALHGPXXXNQPPDMIPDTVPPSSWAPPLTXXXXAPDPSFNSHCRAGALHGPDQRDAGAPGRLCLRGQSWRGASSLMLCV

SEQ ID NO: 16768 - protein, 430 aa, Chlorella protothecoides
  MOD_RES (213)..(216): Any amino acid
  MOD_RES (399)..(401): Any amino acid
MQVRLAPSNSAPLMPTKADPGPTPGTPLSVVGLADGVSIPSTASVEEGSLVASSRSSDVPTGEASGSGTSSGRDGDAGPASPIGRPGGSEAFGRGSPPSTSEEIPHVDVDFVVRRLSCSSLPLTGQVVAYGWEQAAMLASTCKAMPNQLFTALWPATAACLDTFSSQVRMGWQPMHGGAKLALPAGRHSMVVLLRGGWVTVHSPCTSPEATGXXXXSGHLLLPGTAGVATNAWRGQASPAYRAALNSCALARQLGHGAFPCTSPEATGQSRCGSCSVACPNCCLTCAILSPTMTEHPGHAHRLVAAAAAVSQTLPPLESGGGQHGSESTASHRCGGLVAGRWGVDRVLGCEAHGRPGCRIPRCPWRCFVALVFGDVMPLSSMLAAGLHAMLLVPLPATXXXLTLSSMLAAGLRAMLLVPLPATQHGLLCS

SEQ ID NO: 16769 - protein, 375 aa, Chlorella protothecoides
  MOD_RES (82)..(85): Any amino acid
  MOD_RES (106)..(109): Any amino acid
  MOD_RES (159)..(170): Any amino acid
MVWYGKASAAAPVPASKRAVSPAPLGLGGDAEGAGGPLLGRARSVSGDGRITVGPVAGKMRDVVALISGPPVPERLHSQAVXXXXCCSALISGAPVPERLHSQAVXXXXQEGPLPSRAHPRRRGTALVSSGHTVGPLACEARRAHARLHAPGALGAFPXXXXXXXXXXXXAAAGHSEVVDGDLHLHAGLDGDGSDLLDHLHGGVQVDQALVDAHLEPVPGLGTLTARGLAGGDAQDLGGQAHGALDLELLLLGATDQVGADWEGGRRGSRDWVGRVLGEGWRRVGDVLGGQGDADAVDGHLMGLLHADLGGLGNVSHSAMRKREVRRGDITSSSLETPATASTGPWSRGQHALLTCMWLEVFPESDVACRPVTEG

SEQ ID NO: 16770 - protein, 124 aa, Chlorella protothecoides
MAVCRGKASLGSSGAGVEWEVERWDHGIRSCPLLRAQRGKASLGAVHLVSEGLDFADANARAVIIVGLPYPAAYDKQVLEKKAYNDAGRARGLLSGSAWYSQQAFRALNQVGAGGADLVAGSLG

SEQ ID NO: 16771 - protein, 149 aa, Chlorella protothecoides
MADVAKPTKVGVEQAHEVPIHRIRITLTSKNVTNLEKGCRLYPSPSLAQDPPHPIPTPSPPSFPVCTDLVRGAKEKELKVKGPVRLPTKVLRITTRKSPCGEGTKTWDRFEMRIHKRLIDLHSPVEVVKQITSVSIEPGVEVEVTINDL

SEQ ID NO: 16772 - protein, 139 aa, Chlorella protothecoides
MPDAITKLLSSFGVTFDQAIAALGAGLLPAAIQNRLNSVILYHIIPSGALTPTELGAEGTVPTALPEESLQFSADGAVITTATGTSNVLANGDSAGASYLIVDAALLPADFNTVAETTTEEAKAILAALGSSTPSPTLE

SEQ ID NO: 16773 - protein, 232 aa, Chlorella protothecoides
MRLRGRGALARGGRRAARPSVNVPASPALSSVRTHNFLLPQTLLARHPGVRGSLTVQPSFDAALGSLRAFFERLASSPPLTLRPKPEPATPGPGAAKQEAGGCAGGGSVQDMGAVLARAPLARWVSADTASADTASFLAFLEASGCTLAAVGARYASLEAVAQDAVLDCFAAARWGSAFVRGECWLGDGKTLEQLAAVWKPCLPRGLLAVMGAGDADVAGGQVGSTGWCDAM

SEQ ID NO: 16774 - protein, 188 aa, Chlorella protothecoides
  MOD_RES (147)..(150): Any amino acid
EAGPGAAPVPAREPGSAPVPSAAPGPARTAASAPPPPEGLGKAAAGRMLPAMAKLNLGRLIEGEGSPASQASGRSPLLAGAGVCGIRLGKGEWGRGLRLSEQCALLGALRGDGMDWAQEVKRDARASGPHHSSQSHTPHNPPPHAVXXXXGPGSEEGREGFWTSPQTSVTPPTQPPSPCSPASAGSPG

SEQ ID NO: 16775 - protein, 66 aa, Chlorella protothecoides
MCIGEKRKLVIPPELGYGARGAGGVIPAVSQWRSRGGRRFTRLCFTVIASMNPLLRIDRHVHWREA

SEQ ID NO: 16776 - protein, 177 aa, Chlorella protothecoides
  MOD_RES (42)..(45): Any amino acid
  MOD_RES (174)..(177): Any amino acid
MRGGVKRLLTRPVLHLLVQSRQVKWPRSDTLSAGWRRSCFWXXXXPYPLAPSLVGDGEDPASGRGFRGGSGGAQVIERNISLHMFLPSGQQNRHQESFLHFLQVFVPFQALQAFGFQVDAVTPGKKRGDTVRTAVHDFEGDQTYTEKRGHNFTLNTDFDEALTGLDTYDGLVIXXXX

SEQ ID NO: 16777 - protein, 165 aa, Chlorella protothecoides
MAGVNDQPQHAIELTRLLRQHRSMRCHVNLIPWNAVDDAGAWMMGPWGLLWDGPGGGRRQGVWGLRLGTCLSEAHREGGGLAGSSPPRHPAGKTHFSRMETTSSTSFRFDPSRVQEPQQGGRGDLQVHPGGAEGARQRADHARPGGGGCLRPAAQHVPEDAAAGV

SEQ ID NO: 16778 - protein, 87 aa, Chlorella protothecoides
MEPRPAPQKLVAAALRKVGLRGVENLMPSELSGGMKKRVALARAIIRDDQHAQAEQVSSVGAAGKGGVQEGLGDAGACARCLRHGNP

SEQ ID NO: 16779 - protein, 313 aa, Chlorella protothecoides
MKGGSRPVRPKTSIGFRAGRIAADGWSKLRPLRPTGKPASAVSTQPQGPASSPGPVRPTPDPPSSSSPTPLSGPSPLSGPSLRALVSALGAPAYRAAQLRDGVLAGARSLEEVRGLPAALRTALRGAGVRTGRSTLRGAVTARDGTAKLLLQLADGRVVECVGIPEGPRLTVCVSSQVGCPMRCTFCATGKGGFARNLLPHEILDQVLAVGEHFGRRPSNVVFMGMGEPMLNLPSVLAALRALREDLGLGARHLTLSTVGVPGTLRQLAARRLQVTLAVSLHAPTQELRERIVPSARVYPLQALMADCTKYFE

SEQ ID NO: 16780 - protein, 113 aa, Chlorella protothecoides
MVKTRLLLAPLAMKGASLEELRPQLQAMVEAGVADKCAVLPGRPPLGVLWDAGVPPPMEADGQDEWVRVMALAVGPYDGRIHLGAVAADFKLVRRRERSGGGGPWWARGATEG

SEQ ID NO: 16781 - protein, 170 aa, Chlorella protothecoides
MFTCPPLHTHKLPQAPDPRLAPVRSVSSSLDIPLLPAQSASETLIEFRDVYKSFGDKHILRGASFCVRRGEAVGIIGGSGTGKSTTLRIAAGLLQPDAGQVLVRGVERVGLMADQPDSDGALVMGLVFQSAALFDSLTVGENVGFLLLEHSKLPKTRIKVGRGDTGEGGG

SEQ ID NO: 16782 - protein, 63 aa, Chlorella protothecoides
MEAFAVNGPTEGHDLPPFNWREFKGQGLPHAGMPQRFQHRFEAMAVGSMQELEERCLHATAAM

SEQ ID NO: 16783 - protein, 211 aa, Chlorella protothecoides
MSLVSSGDVRYQGVLNHVDMANSRITLVNGEDGQPGCVLAWLRFSEDLFPHVRCYGSEGRRDPGPQVEGTDEAPLSLRSLHRRPQFPHSHPRGRSACMRRVSDRPTISRNPHRIGDQGADGGPAAAPRARAHAADGPRHPHLQQRGSGPARAQRAQRLGHVDRLQLLRAGGPRLRVGLWFLALGPVDGPVWPRGRAGVRACAGVRACARAG

SEQ ID NO: 16784 - protein, 368 aa, Chlorella protothecoides
MRNGSTGRAAALGVLGVVLLAVAAMGAVPTPISAWGPKAAFASVGVDQEAVTTLEALQALLSTGRSDGPLGKDTPIILYVSHSRDSGLEATLQPRLDSAEGWKQLPSASHAVSARIDGGGAGEGTHGKEPWLHSSSSLTLVCTISHLIQLPSTTSQGGEGVIFDALQILAGQRRAHVVGSCQGLAPGAPATTAELQRLLAAPPSGDVVVVCAGEEAEQPALLNEVVRLSAESQPLMLVVELPAGEVAAQAIQCHVGGIGCTPTHRPCVALTILPCHPFSQRRRLQAQYVSAPSLGFDKYARREGTKNYTVCDATCQRQASAGTLYFEGFIVLIVIGMAVAVGLTCLHIIDTPTHLPSVKPGSGSHHHD

SEQ ID NO: 16785 - protein, 355 aa, Chlorella protothecoides
MTAYSMLRFHCSHKPVRSTPLSRQQLHTSLRRPAGGAEGAGPHHPQFCVRAAGHHCRSVDLLVRRMLAHAADLGRNSFGIAEGHAVPRSISPSSTHPVSPLYHLHTSQPLHPQTLAVNVAEAYYRLEPFLKTALAAFVRQHLDTYAEQEDGSPKEFWVSFYNLEVRGGDGMEHSIVSPYQYTAIGPLHAPFRHACAHILCPPAPQQGDRLRELRSNKIGKLSQFVGTVTRTTEVRPELYKGTFRCMQCMREVGGGCNAWPQRLSGERTLAELWELAADLAWQPEACLTASSSSSCSGTNFTPPPCWHSFPDALPIICMAEQIRSCAPCSPIPPSIACSGERCGAAVQVHPAPDLS

SEQ ID NO: 16786 - protein, 158 aa, Chlorella protothecoides
MSLKSAVSGSSADASSSSQQTQERIPQQAAAKRRAMPPGFLGNYMQARASMASVGLGPAAPEGHGRASSSGPAGCSTRTSVLGPSAAGQRAAPFVPATTLPSLFAHRKHYLRAQRRANPDQQPYCQHQGKPVGFLSLPEDVLVSGTDVAACWPQGGPP

SEQ ID NO: 16787 - protein, 352 aa, Chlorella protothecoides
MHSGRDCTTIQATSYLLTMSRKVPIWLLGRLNCLPLLPLAACMPHAAQPPTPHRGPAAPDPGVPGVPRPPPGRRQGPDQRDAGHSCFPDARAGVRSHPQTVSRQPRPAALVSGGQGALQLRPAPGEAVVHARQGCRGAPLMLDLLARSAARALPPSLTVVHHHTSPVQDRAVREPIPPRASAPETQPAVQADALGGCGGGPGPGVRGGLVGAGGVQTCWGAACAGVCTRGRASPWSSRREPGSPCSSRACPGAQHAPPPPPSSTRQLTELKALLGLVGQSKYVLGFLSQPREGEYALEDLSARLPLDIQDAERTPGLFTGEGGVWRVWPNVCSLLAGGPQPPDSWDPGNGGS

SEQ ID NO: 16788 - protein, 137 aa, Chlorella protothecoides
MHGSCRHLTLVIGADALGDHSVHRMHCSNIRAPPTRADVDRSAKHRPCPSPSSAMASGDESRATRVWLQKQFRTSGLQLDPGALSYLVEAVQGLHDPEEYIHRIMDEASAGRVPHSVRHAFWEGLHHDQGLQLPLTC

SEQ ID NO: 16789 - protein, 479 aa, Chlorella protothecoides
  MOD_RES (343)..(346): Any amino acid
RAAAAHAQRAARAELPGGRRRRAGAGRGADAGGRRVAARPGQRPVPPPGRGPGGRGAHALRRLWLPGPPHVGAHRPRLDHGLQVPGEGLKERGTTQGGGVAIPAAPFIVFKPLPLLVVSSHCITALDSMYSVQIQGQFTFPLGSVRRGRGRGWGIHGHRVANLPPVNQSPISGPIGARLADPWQAVQAILVTGERDSDPELITPRSPSTNGSGATTSGSRGPSASRWQDSRREEVRKGASWRHLAKRGAVWIDHAKSLSHCFPVPLSSCPSCLLVHRLGSTGSGTWALPGGKLEYQESFEACAARETTWFLVKITLPSSCAQSKTSCHTVQLEEETGIVATKXXXXAQSKTSCHTAQLEEETGVVATKFTFAYAVNSVLRDGGGHWVTIFMEADCPQVRQRLFWRWHCIGLRACKSGARQVPRLGMGAFQCNSSAHLSTPGLPAGQPFPAQDTGHVRRARCPERNSGSSLDSLHLTHRY

SEQ ID NO: 16790 - protein, 738 aa, Chlorella protothecoides
MEVILRNDQVESVRPGDKACFTGCLVVVPDVAALTVVAAFGVVEVGAASMPSGAGLPACGPPWMLETVLVVAVGVTPPHSTKHHHDTPPSSSFLNVPRSAPGERVQARPSGGERGGAAPEGGVTGLTAGPARTGVRELSYRLAFLACATRPLDVGSGVVNIRGGEEEDGPAAVLAGLTQEQAESLEAMRRDASLYDRLADSVAPHVWGHRDVKRALLLMLLGGVRKSTREGIALRGDINVAIVGDPACAKSQLLKWVAGFLPRAVYTSGKASSAAGLTATVVREADSGEFCIEAGALMLADNGICCIDEFDKMDVKDQVAIHEAMEQQTISIAKAGIQATLNARTSVLAAANPAGGRYDRSKPLKYNVALPPAILSRFDLLHVMLDEPDAALDRAIAGHILDAHRGRGAVLTPPYAQADMQVYIKYARSVRPRLGAPARAALVAAYQALRGADAAPGTSAAYRITVRQLEALVRLSEALARLHLRAEVRAADVREAHRLVKNSIVSVDAPDQELVGGGGEEEEEEEVAAQVMGLPGSGGERGEAGAGAGGAAPEGETSAADGGAAPRAAAEDRAARRRVPTAKYNNVKGPGARNLLGLGVRSSGSVTFLDAWGPLPCPTHSLTPKSPQNLLVLRLRQADDEAGEAVDEEGAPEAGLTQRDLLRWYFEYMVERGAVAGQEQGLEELVLAEKVLGTLIRREHVVMVVQTPAQAEGESPAEYGRRAQLERVLALNPNYSLD

SEQ ID NO: 16791 - protein, 80 aa, Chlorella protothecoides
MDESQFVDWQKVKVQENPDEVSMGSGVGIFPTPPGAHGAVAVCPPCSREAACSSPAPRNQGRHLGCSENAVRHCVTSKNQ

SEQ ID NO: 16792 - protein, 70 aa, Chlorella protothecoides
MPITTPARRLRHGSCELVVLRSNLQCLLRGTAVVPPMPGSTPFQHAVASVAQQSHLCPVPLEVQVGVECG

SEQ ID NO: 16793 - protein, 416 aa, Chlorella protothecoides
MNRGAVRDHLPAEPRPPSPEPWWTVHVVNVSEAEHRRLTPAELALCRASAGARGGAARLADLGPEAPALVASLHRRGLVWLDVPIAARDQISVPPLEGFVSNRSGGGGDADPLETLLYSVFVAASERVTVADLAAILGVDVPTLRGGREGHPQQRGLKYVLELGMGRARGFCVPPGMGPRGTRQAVRCVVVSLPPHTTLSPRDSTHPHQPPVPKHNGKVAVSMACRLGFCRKLDEAEAGLSREASQAGSTPSPSPRASLSEPFVLGMTPTPRTTSACEGGLHTASQGDPGQGTLSRAPSGPAPSGPAPPGQAPHGPSNPASAPGTQRGGRGVALVVDSEVTGYLMMGALTPACKRHSVSLFEGGRVSGAAVVAELAAELEASAAAGAAFEGEMRALAGYAAGLATLMRALMAPGAR

SEQ ID NO: 16794 - protein, 223 aa, Chlorella protothecoides
MVAGWDVAGPGLYYVDSDGQRTKGQRFSVGSGSLYAYGVLDAGDMSVEDAVELGQRAIYHATARDAASGGTASGALRLVEADAGMSARRGGRRPHATARGEHPARGAALPARRQADHSPCARAVYHVTEAGWTKVRGESVGELHYKVGGVEGAEGGCQVTESEQFQGPCRGEHATSLIAVLRLPVPAPVRTAVASPLAPSLDFRQYYPDPLVRSSIAVDPLAT

SEQ ID NO: 16795 - protein, 98 aa, Chlorella protothecoides
MQLDLSMLEPVTRNAKQTQEACLTGISGEGIDAFPLPAVADLDSFEKEVVEYVKPSHGTTTLGFIFQGGVIVAVDSRASQGSYICACVGMRRGTGATC

SEQ ID NO: 16796 - protein, 59 aa, Chlorella protothecoides
MAGGAADCQFWERNLGRQCRLYELNNGKRITVRGASKLLANTMFSYRGMGLSMVRRVEQ

SEQ ID NO: 16797 - protein, 309 aa, Chlorella protothecoides
MGREARARRGWGSARGLETGCHGGDFAAGGASTLLLPACNSGVAFICRLIHSHSIPMSTSGRPAKTGPQTSFPPLDPLTPPQPTHPYPRHSPLAGSSDLQRWWSAGVGATRAALDAHLLAPLQAVRDELFTTFRSRPSIVSLAEYEADRDSLARMLGDFERDRGSAGGAGGGGAGPGAPPPTAGDAVLVQVGRLLEGRNVEDGDARSLPAPRGGGPPPKVRCQHVRHNDPTSPVPASRRQPDPPPRCPPPRSQGMDTMMRRYEHELKKPIRNLVAGDLARCLLIQASKDCGGRVGPREPHGMCPWKAAP

SEQ ID NO: 16798 - protein, 41 aa, Chlorella protothecoides
AAALRKALAHQPVSVAICANSALQFYSSGVAGDETCCTQLN

SEQ ID NO: 16799 - protein, 171 aa, Chlorella protothecoides
VRRGALRRHPGLAADPALGDEARAPGPDSPPDGPFGEEVEAEANATFQRVYTEALPVATLVAELARMAGSAERRERRLHDCVVHNLFDEYRFLARYPDRELELTGELWGRVMAARLVTGAPLAVAQRHLLDALGTNAPGSRMHAFGLRAARALAPRLPDWPEFAAQLAEAP

SEQ ID NO: 16800 - protein, 201 aa, Chlorella protothecoides
LGEHVLEPPGRRRSGGGASGQAHGEAAPRDAVTAVALSACGNFAVVGSADGAVHRYNMQSGLHRGEYQRQAGGGDAASEATAGRPSPAHDGAVAGLASDGANRWLVSGGEDGALRTWDFKRCGLTGELGVGAAVQRLACHPSSGLVAVAPADLMLRIYDVEFAQGAGPLPSLRATGDDNILAPVLRANLTHSWRGVLIPLC

SEQ ID NO: 16801 - protein, 491 aa, Chlorella protothecoides
MSSTTLFLSGAVLFPLAPCALFLVAVTWHPVLGPGSQLLQVLDMGGVVTSLSLSPAQDLLATTGQGSRGINLWANQLIYGAGGDIVPGSRVRHAHLPALAVDPEGEEEGAAARAAARSQAMLALTPRKVGAPDASSDSELEMSAGEGADALAPLRDASSSEDEEEGGGAASTPALRLEDEVAGAAWAKRTPSGAPAPLAPAMLTLSLLPRSQWQSLAHLDVVKARNAPAEAPRKPEAAPFFLPSLAGARAGRDPVFVPGLGQDGGEEPSPGDGEEPALAAAAMAAWGGSEDEDAANGDEDVADGDEDDEDAADGDEDVADGDEDAEADADADANAKPRRKHHPQSRVRGLGGASAPGRAPTLAALLAAPRPGSDEAVLGLLRTLTPVQVDGEVRALTRLAEPGQDGGEGERLVDALLAFLEAQLCAGSCFDLVQALLRLTLDVHAGAILSSPSLQRRAAGLAAQLRASWQRVDDALNSTRCVLGLLGNLQP

SEQ ID NO: 16802 - protein, 602 aa, Chlorella protothecoides
MLRPSERAAASFASGEAYRRGTALPFTQMVITFRDVCYSVPLPKDLDRGKADTGGEGPHAGQLRLLKNINGAFRPHVLTALMGASGAGKTTLMDVLAGRKTEGVITGDIRVNGHPKQDRTFARVMGYVEQTDIHIPQATVHEACQFSARLRLPTTVDAATREAFVEEVMTLVELDRLRGAFVGSPGVSGLSVEQRKRLTLAVELVANPSVVFMDEPTSGLDARAAGIVMGAVRNTVDTGRTVPGGRTIYNGPMGDDSADLIAYFQAIPGVEAIRPRYNPANWMLEVSNPGNERRLDKDFSELYDASPQAEALQKLLAAEAEPREGVPDIDYSALHIAAPMEQFRVNLRRNFLMYWRLPEYNITRFASTILIALVFGSMFWRLGSDRTTVSGVLNIMGVIFSSTLFVGISNCLTVQHVISTQRTVFWRERAAGLYGVLPFAAAQQLVELPYILIQAVVYVSIVYWMIWFQRDAGAFFWFLFLFFLTLCYFTFFGVMAVSITPNVAFGNVFCSFFFGAWNLLCGFLIPEPAIPRYWVWFYYINPVAWSLYSLVIAQLKDFGDEYIVGALAVGRGGGVGEEHARGVWVEYSRVALQGIDGGEGST

SEQ ID NO: 16803 - protein, 232 aa, Chlorella protothecoides
  MOD_RES (223)..(225): Any amino acid
MLYHATAGLHVVCMVHEPLGWLAWPAHAGHAMPPHTQGRRSVAAAHQPTAQKEVIDLRPPRGKRLGVVDGSLKVQHVKAGLVQEHANPHQAQRMGLWGRHQPHAHPSTGTRDFPPEDKRLQAWLFDHFAAVTQSFGFEMVDYPVLESEALFIRKAGEEIVDQLYNFEACYKGGPGVVFLFQVGGGLGSPMGSHVWPVPWRPALHIHLIYIPTATPTQPPIPPXXXRGPAVQL

SEQ ID NO: 16804 - protein, 476 aa, Chlorella protothecoides
MPFNAQDKGGRRVALRPELTPSLARLVLSAGAGRPLPLKWAAVGQCWRYERSTRGRRREHYQWNLDVVGVAGVEAEAELLAALVAFFRRVGLGPADVGIRVSTRALLGAVLEGAGVPAAAHPAIYVAVDRADKLPIAAVEAELGALRVPPAAIDALLRTLRIRDVGALSEVLPPDSPAARDLVVLFDLAAAYGIADWLHFDAGVVRGLAYYTGIVFEGFDRAGALRAVCGGGRYDRLLSSLGGADLPCAGFGFGDAVIVELLRDRGLLPDLGRRVDDVVHALEESLRPQACAAAAALRAKGRSVELVLEPKRMKWVLKVRGNGVTECGGGRDGCDSGDAALKQPLGIGWPGSCMACVHARESGAVPALVPSGAPPFPLHDSACGAVRGSEAGPAGARGVGQGGNQGQGPVQPGGEDGGGGGGAVPAGLSGACLPPCYPWISSSLFREDSPLNEARQRPNIAWKGVSRLCHFEVRSW

SEQ ID NO: 16805 - protein, 167 aa, Chlorella protothecoides
VKGRRIRELTSVVQKRFKFPEGAVELYAEKVANRGLCAVAQAESLRYKLLGGLAVRRACYGVLRFVMEAGAKGCEVIVSGKLRAQRAKSMKFKDGYQVSSGNPVREYIDAAVRHVLLRQGVLGIKVKIMREWDPTGKVGPRTPLPDVVTVLTPKEEEVAALPAPVEA

SEQ ID NO: 16806 - protein, 75 aa, Chlorella protothecoides
MLVGACVRLASAVSPTRVQLELLPALCSGADADALERRLLVAEAAAALAPLFPRAALAGAALGLADHLAHDAEAV

SEQ ID NO: 16807 - protein, 275 aa, Chlorella protothecoides
MEAGEAGREAEVETLEHLFSDPTLFPPEQMAVFTGREALDLQATARAREERLAVVEYDLRLAREDLEAHSSGHHGANGGGPADGSRAPVGPDGGAPNKDTDPPLPGAPPRPRSPRLDPTQRRVLNDIVMRYLLDQGYRVTAGTLRAEAGSGLADARAELAATADALGTARVQLADAREAEAEAQRRLESAAEEGQRLQAALDFEASRVRDLEERLAQKGGNGAGEEEDGDGWGKGQRGSSPAALSAAAARSALDEVAASLPALLPHVLINRRQGA

SEQ ID NO: 16808 - protein, 1086 aa, Chlorella protothecoides
  MOD_RES (264)..(267): Any amino acid
  MOD_RES (645)..(648): Any amino acid
  MOD_RES (703)..(706): Any amino acid
MHCFGGSAWSLATEIWEVSGVPPAPSVSAQFQQLADQGGVQVNKKKTTHASLTDAIDASVHSGVADGASEPLSRSRCLRGVGHGHVEKLVTSPLSFCTNALVPPRLGAPFECQPLLPCVPSTTPLSLQISSLKAVIERSRAMALLRAAGSLSGLARSAQGTSPALACSRVVAQRALYAAEAAPEAAPETDGSVTQVRRSHPIQHDPWDPVHAGSGRVWAPAGPGSRTPSRFQRAIPSCLDPPSAPPGHVALSPAPHPRSPFPQXXXXPGLGPRRPRARDTQPCPTGHPVLPDPILGPARACGAASSPPPPTPLPPASQVIGAVVDVHFEGKLPPILSSLEVQDHDVRLVLEVAQHVGDHTVRTIAMETTDGLVRGQRVVATGQPISVPVGRGTLGRILNVIGEPVDEQGPIDSNVLWPIHREAPEFVEQATEQQMLTTGIKVVDLLAPYQKGGKIGLFGGAGVGKTVLIMELINNVAKAHGGLVKGEGGVGFRCSPGALMSSVRAMPGRGRVEVVVTTVLMPWLGCGFSVFAGVGERTREGNDLYHEMIQSGVIKTGAAQAESKVTLVYGQMNEPPGARARVALTGLTVAEYFRDEEGQDVLLFVDNIFRFTQVHEEWQWVHTWAVVKGGGGHSRSRWRRCVFIXXXXAVGAYLGGGWGGGHSRSGGAGVCSLHRGAHCLPVSFKSAINRTSHTHRAPPPPFXXXXFKSAINRTSQTHRAFPPLAGQLGGVCPAGPHPLRRGVPAHAGHRPGPAAGAHHHHHQGLHHLRPGDLCARRRPDRPRPGHHLCTPGRDHSAVALHRGAGHLPRGGPAGLDLAHAQPARAGRRALRRGARRAEGAAGLQEPAGHHRHPGHGRAVGGGQDGGGPRAQDPALPVPALCRGRGVHGDAGQVRGPEGHHLRLPGRAGRQARRPAGDGLLHGGRHQRGAGQGGPHGRRDRGQVSACAAVCVCGAGMGGAHMGTPPPPHPPQATQAPAPPPAGPPSGPAQRFFSSCLLQSREAIGSEWGRVKGRGLPAPGAMRVWSHAEAPLPAGRATFQSRREEGSRSRRAARRQASTDATRSCTQHPPCLPFVISNQGGRCVDQH

SEQ ID NO: 16809 - protein, 61 aa, Chlorella protothecoides
MPLIYSFVARQTTVLADYTSFTGNFSVVAIQALEKGAQGNNSKFTYSCDGHSKPQGRACMS

SEQ ID NO: 16810 - protein, 127 aa, Chlorella protothecoides
  MOD_RES (39)..(58): Any amino acid
  MOD_RES (116)..(119): Any amino acid
MAIVSDTPVPWYAALIQWACADKRAHSLSVNTVLTSPLXXXXXXXXXXXXXXXXXXXXDAFGRQIPFAFLEKVKEEWFQKWADKGAAAFAHSLDKSFGRTVDALICHALAVSIPKXXXXARGRSATN

SEQ ID NO: 16811 - protein, 517 aa, Chlorella protothecoides
  MOD_RES (289)..(292): Any amino acid
MKRARDIRDQILGLMERCEVELVSNVGDLEGMRKAITAGFFYHTASLQRNGSYRTVKNPQVLGSAVRMVGTRRGAWQLISGFRRSAVPPPLQPCLLRPAPCTQTVAIHPSSGLAEALPRWLVYHELVLTTKEYMRVVSEIKPEWLVGGAGGGVCGGAGTRSEVPLARAWVEMRTAIAGAPLVGPGGLGHGWRCVRPMLGLHSSRKVTPHTISTSTGGDRAALLQPQGDHGPGREEAAQAAGQGGRAHMMALGRLDRCSGSWTSHEAEGGVMRGVRGGEGRGGGCLVEGXXXXSASQPLNKKEGVQGVSQGIFKDQGHKCIRQGHRGSAGRAEGGVMRGHRGGDRAEDDDSDEDDDDDDDHLHAEGLPPHAAAQLPPRLVKLVGLKVSWTSRSPQHDAQIPVLQPPTRLESQVVCLVHQQLNLLAALQDALDVLHHDVLYLVHLRGLGGADASTPAWHRESWRSGHRASCKTPHRNSPFSGRRPPLTAPLGVAHSNPSSTSSGGCKAEWGSVKATTFG

SEQ ID NO: 16812 - protein, 78 aa, Chlorella protothecoides
MARAPALAVPGRRRCISPAQSPQVDEVKNIMVENIERVLERGEKIELLVDKTDNLRFQARGWLENWNLCIVLWGSARP

SEQ ID NO: 16813 - protein, 189 aa, Chlorella protothecoides
MARQVCPLELAGNCTVTCPATGLTLTLKFRDEHSVKGSIVKRGSEARIAIFSGRWDGAVNVEVPDLGAGGTVSNARALAPAVVPWVNLAQPGPRRLTRLWSAILQSMYFMDVHQVESRSWGKCSVAETEEGPKLGMQGVAGQQRTHRTAFKHPNTAATTFRHPEGGGIREAGRGAGDRHCAAAQRILAV

SEQ ID NO: 16814 - protein, 107 aa, Chlorella protothecoides
MPGILPVPAAGDTVIQSLSICRVVITYTLDLLRAGQGMGETPVVILGQHIMSHRDLGAFRWGIVLLTNQEALHEDVAVLGFLEVAYGMHPRRGSQDLLTIARASKGA

SEQ ID NO: 16815 - protein, 133 aa, Chlorella protothecoides
MLAAKVNGKLVSNDHRLGNAGEPAGPWLRGFRPALAVAGKGPQPEDLNRVFSSASHVQASLFAAPPSHPHRHSDTAEVVEIITSKGPVSAQLLRRHQAWLSTAQTKTARHKIARFLREHAMPTVFQGLTPPCK

SEQ ID NO: 16816 - protein, 307 aa, Chlorella protothecoides
MAASSAQRNAWVLTGPRQCPPPMVRLRLVCFPMAGSGACMYHDWAFPISLGVEVRGRVSRTHSWVVVGTIPATSGPSHAPAPQPPPSAAQVLPIELPGTNSRLKEPKATCLRALAQDVVQGIAAHLQPGQPPVVLWGHSMGAWLAYEVAQLLSAPGSGLQRPLHLFASGNRAPSLAGLEHNPDSHVMHRLEAAEFWRVYTQRYGANPDLESRALRAYLLPGLQADFKLVETYTPSSLRPLDCGVIALGGTSDPRYSPGQLEAWAGVAPPSRFSVQWFEGGHLFVREQTTAVLEFLEGKLRHLLPDSR

SEQ ID NO: 16817 - protein, 105 aa, Chlorella protothecoides
MYADTRKPLVVAGSINADLIAKVARLPAPGETMESQGFDVFPGGKVKWVAGPNTPHRMHPKPAPCEGDCQPKLQITISLQGANQAAAAARLGYNTFLIGQASTAS

SEQ ID NO: 16818 - protein, 272 aa, Chlorella protothecoides
MLRSSLSDCGVDTSLVTSADGSSGMALILLQPGGENSIILVGGANTSDNWKITDEATQARRRVVLAGGLVLGMLLGLPMELGRESGRVAGAAGARATSQHSGSDCPCRAVHDAQTPTAAFPQAVQTAGALLLQREIPEVFNVIFAKVCAGLDGGLGCTGAAPFPSDASDHSRPSVAHLARGTAPANPPGPATTYPPPHTQIAASAGVPVILDAGGVTQPIQVDLLSNVSLVSPNETELARLTSGWHGCWTMEWVDGVQGDSVGWPCDSGVRS

SEQ ID NO: 16819 - protein, 127 aa, Chlorella protothecoides
MPRQSGSLNMPGRSGSLLDAGFITLKSITPAPLPLFHPPPDMPTKTMAQVQAAAEALVHSGVNKVLVKLGSKGSMLVGEGRDGARPGGSRGGSWPGNSSRCEGQAGHGPAELSHAPPVPAQHAAGTP

SEQ ID NO: 16820 - protein, 197 aa, Chlorella protothecoides
MERDTPCVWLQVAYSFLKTMRHVGYMPAWRMLMGRVEISTVPPASDLQQPSPCAGSSGSTPDDNDDDDKFEERIAALQGKRASKQRPTSQGAAARVPGRDISAPASKPSPTPPTPKDWGREEVFLDSPPHRGDLASNIALGATLLWLPLTAAAVGRAAFVRYLVTDKRVSVSTSAPWKSEGRCVTRRGPGGRTAADI

SEQ ID NO: 16821 - protein, 395 aa, Chlorella protothecoides
  MOD_RES (142)..(145): Any amino acid
  MOD_RES (170)..(173): Any amino acid
MAAPMSQRVSSQGCSSEIHRGRSTFAQAGTVNAHRSYIVDRHRNTQCSAKIQRKEVALYDYWDRIVPYEQAWSLQHRLLEEVQAGMHGVGAVILLQHSPVYTLGAGSTIDHLRFDPSNPPHPLFRTERGGEAWVNLERRKGXXXXVPCKAAKCIALLTTLVVQSLAHRQXXXXPRGVVRCADIGSCVMVCACASPTLVTSPYGPGDIPRPRSARHVPHPGPEAADPGSALVPAQPGGGSHQSLAHRQYRGEPHVRPHTRALEAVSGIEGKREPGRTGVWVDGRKLAAIGVRARRWVTCHGLALNVAPDLGPFSSIVPCGIAGREVGSVWEASREAEDDRQDSSIQAQQAQLLREYAVALLEAAEDVFVMRLVPGEEPLKALNAPVWLEECRMGKL

SEQ ID NO: 16822 - protein, 223 aa, Chlorella protothecoides
MQYVILSERWDKAAAKYRTATLPFPYDSKETYERARRQPLGKEYNTDASFRDLTRPAVVKDAGVVIEPLRYTPDAAAAAAAAPKRAAKMPVNNVVGGRMSQGRLAKSAGGICEPWMETSSVQMNTRVTGGGLLYSHGEKLCRISKVSKLVHSMRLCQHSMGRQTGLRTTLDVLPMRSGSHSRVAKDRGALLDERRHALLLVCQGKAAPEFPLLKSYALCVGVA

SEQ ID NO: 16823 - protein, 252 aa, Chlorella protothecoides
MASPHQLLAKVRCLSVPFSAPHGGRYLRNLSFQKPLPRAHSYEARIPPRARALATRALDGGSKPTSAGQPERPANPFTALGIEPSFLPGLEACRISEPSEVQTSAIPVLLSGRNAAIQSYTGSGKTLAYLLPILTLISRRQAEGSRAPGSRARGSKATDGPAAIVVAPSHELAMQIVRVAQSFFDPDQRRRTACFRKSIPSRSAPSHSAFLLGGASTWRQQEALKEHRPWLVVGTPGRLAELSRAGALQTHQ

SEQ ID NO: 16824 - protein, 172 aa, Chlorella protothecoides
MFEDGPSGEEGEEGETTDEGSDADGSDADINLDSDEEDAQSGHELDDVFDASSSEEEGKESDDDVEAGTARGSGSGSGQEDEEDDTAHAALLAAVTEGAPGKKGRKERRAVVTEAYPEAEHNMPNAGDCGLGNAQTKLGKARKTLLRMEAKESAVAPPLPGLIRQRLERKAG

SEQ ID NO: 16825 - protein, 383 aa, Chlorella protothecoides
MCGVQWCWPRTSRFKHVPVASHYPLKSHPLHPPPLICNSCSPFPTPRSTGILVLDEADQLLAPQFSQDVGRLADHVGRGLAAGRQTVLVSATLNPTNLALAATWCRDPVPLLTGQGRTQVPEDDVIGESSSDVGHREATASPAPGWGWGRRAAAASPGSSAGGVGTGLGAPAPALPPGLVHLVAGTAPHHAADTLRRGIHALDAQRALVFMNFQDRLRDVQGKLEARGMPAASLHGELSKQERQATLAAFTAGRFRALLVSDVAARGLDIPDCDAVFNLELPTDASHYAHRAGRTARAGRSGVVVSLVSGGQSYVVQRFGKRLGVDIQPVEFRHGVVERVREDQLAPPRKAAGGGPKAEGTGQAAPLALKATRKTAKKGYRSH

SEQ ID NO: 16826 - protein, 156 aa, Chlorella protothecoides
MPSQPAVDEGWDALLGSFSNLLGEVDEAGVVTLTLNRPKQLNALNSELMGELVAACQYLDRKHPSARVIIVTGSGSKAFAAGADIKEMSSVTYSEAYNKGLLDGWETLRTIRKPIIAAVNGFALGGGCELAMLADIIIAADSASFGQVGVGVARLL

SEQ ID NO: 16827 - protein, 660 aa, Chlorella protothecoides
MPPPTLPAPRYEAASKDVSKWRPLVKANAAAPTIHFTSDKAAVHTTTTVAGLVDKHAPETGMEAEVAAMLARAGAHSDRALAESEQALAARELTIEELRERQNRLAKTRALLYYHEAKAKRLKKIKSKEYRRQMKRADRRKADKLGAEEGGDAAEALVAAEEAEFARAKVGGGLGGSGKGGERLTLKHRNTSRWARRALKRGANLTDDATRAALAEQLQLGQELRRKVERPDRGGADGSDVSTSASDEEEDSEEEGGEGRPARRSKLHRTALDILEGGGDEAGAEAGGLLALPFMKRAREKQRAAALQAAERVLAEEEGRKAEGRARTSGRLQFSGDGGAAAASVRPVAAIAAGEDSDLESDEDEDVEAKAARLARHLSAERREEGVAQAAAEAADVREPATVQGRAGGGGGDPPAAGSAQPRQHSSAGFVAVAAGAGRASTRPAVERDDLFAPSTSAAAKTFLPSGTSATAETFLPSGSFAGARKGYTFKKGPQGVGYYIDAAGEVPAPKAKGQVQQKRQQGQQTGPTKKARSGDAGRAAQEAELGDDSLKPAERGEGWSVRWVVGGEHLALLDPLAHPFLTRFLCGLQSAAAYTQDDLIRMAFANDDVAAEFAAEKASEVEAELPKVEGVGTLPGWGNWAGAQREPAWMAAARRKAEQ

SEQ ID NO: 16828 - protein, 148 aa, Chlorella protothecoides
MRGFVAGLGAVRGLRPQALPVRGAALAAVAALGNVPAGAAREHTAKFSPAWFAAVHVAVPFVAMLRKAVLLPNWALLLTIAGSVAGQAAGARLERARLAGTLDLGGALAALGALAALPEAREGRDEESVWPAFAHVSQAPRAPPAVAA

SEQ ID NO: 16829 - protein, 162 aa, Chlorella protothecoides
MTRGRVPSATHRAVRPRRAEFRPLTPHPSPIHSQASSEPVFPVPISLSPPLKSEARSSNPSPRASIDASAEAQELKRQICFDFTKGMCTRGAACKYSHSVDHIIAVNSEEKGICFDFLKGLCNRGLMCRFSHDLTNLQAPQVRQPAAQHPGRNRVALCPDAR

SEQ ID NO: 16830 - protein, 322 aa, Chlorella protothecoides
ARPRRPSCGTQRGQRCHVPRAGGCVLVERCAVGFGRCSVGAERCAVGAGRCAVGAGRCAVGAGRCIVGEGSCGARARSGAVRVGPPRRRVARAPLSKGRRARRGVRRSLEAAAPRLGPRRPKPLLQQHALQDRGLVQPRLWVPPARRRLLAGQAQALELGHDQVVPGVKAGRRHRGLHRVPRRGGRVGPAGALLPAHPRVPCKHAWCSVMSWTREAILADRCARDRRVCLRVRAPPPHTHNSWQWPARTAPRLHQHMHVLLTAVLPPSTLQHVQLCARQRPARQLAVRPERLALQSSDHGLQRSRPAIRRGGGVQVSASIAT

SEQ ID NO: 16831 - protein, 300 aa, Chlorella protothecoides
MPGTPPAGHVEAYIEAHGDSHSIWELEGLAGDAGADEPRGRANFLLQLGLRALAGGNLPSGEHRLTQCRGVLQAQMANRAARREAGGGNGVVCDGESAANEVGMGVAAGDVQERAAAEARRASASEEDAADACALATVQGCLGDCARAQGRTEAALDAYLASAALLGDAGGAEAWQTLSVTLNKVAELYHMQGRVGEALPFYTRALDLRERLLCDLESENDRVDGGSTPPGWAPAALSALTGMVKTADAHAAAGDGAGAERLLGRARALLGRLEAGRGDLAPPQLQRLEALSQFVAQRGV

SEQ ID NO: 16832 - protein, 232 aa, Chlorella protothecoides
MAARGGDGGGRLPTQAALRASSANSLSWAVDRHGGMAAAARRLDLAMARRRPNGHWDMPALAAELAPYLLREPEGSAPRLPTAAALVAEGRTDLVRAIRLNGGFKACARKLVMYEEAGGGKEDGVDGRLNLGSHWATRRMPQTPGQARQEGRLEAAAARVRALQHAHAFDPRVMPTHAQLRAAGEGKTIAALLGAGGARRVAAHMGLRFQETRGRRPGRRRNEEALQEVVFV

SEQ ID NO: 16833 - protein, 98 aa, Chlorella protothecoides
MGLWWLAIMCWLLAITCCRRYGVLTCWAGSFTEPCCCSALLMHVIPARLMHALSLPLPGDYGWDTAGLSADPETFARYRVIEVIHCRWATLGAFWERL

SEQ ID NO: 16834 - protein, 184 aa, Chlorella protothecoides
YELGRQPANTKLSSNVTVRRVRVRGGNSKFRALRLDSGNFSWGSEATTRKTRILDVSYNASNNELVRTQTLVKNAIIQIDAAPFKQWYQQHYGVEVGLKKRSAAAAAPTEEVKQSDHVQRKLKLRNKDRTLDPLLDEQFSVGRLYACISSRPGQCGRADGYILEGKELEFYLKKMQKKKGKQTA

SEQ ID NO: 16835 - protein, 125 aa, Chlorella protothecoides
MVRTKTFKEEHPLGASGGRRAHVTPYIAQNLKSKSLAPTPPWPAEKRQAEATRIREKYPDRIPVIVEKAEKSDIPDIDKKKWVPGASRPDRGPVRVRHPEAHQGQPREGHLHVCSQRPSPNRHVY

SEQ ID NO: 16836 - protein, 189 aa, Chlorella protothecoides
MASTIRLPLPCRCNLRPLPSPPSLAHTGTLGIVFPEILQKYSGVQFQEAVWFKAGAQIFSPDGLNYLGNPSLVHAQSIIATLAIQVLLMGAVEGYRVSGGPFDWSDGLDNLYPGGTYFDPLGLADDPETFAELRVKELKNGRLAMVAALGFFVQAVVTGKGPIQNLSDHLADPGANNAWAFATKFTPSL

SEQ ID NO: 16837 - protein, 426 aa, Chlorella protothecoides
MQAQQLGLPFRHGPRSGKFPRQQASPRASNGEGFCRDKVAMPQKPSGAHEGTCTIVFLGAHGASVEVEAPKDGYILDAGLNAGLELPFTCRGGICGACVGRVTEGEVDASDCHAEPEHPCLWSFPPEGSPSALNLLTTSPNKWPIADVTFTLNEEEVEGGMTLLCMSRPISDRLVVETQSDWGYSIGDLSEWKGPTGEILGKRVQPLMGKAWETAKQERVCGAEEGRSPKVGAWKRGQGMVQLTRGIPDKLRNDAALQAAWTGLRVSGAGPQSGPAPFPSLFDTAGTDQPNGGASHSAGIFLAVVSLGPGLSRMFSSCARGSCAGAGGAHGCRGKTFGVLAAPFIQPAAVAEQRTEGWHQPTCSALTSATLPFPKRTLGRPPCSDHLSSFSVRAPFLALQRLQQVTMLSQVKPPPCRWEGGREVGR

SEQ ID NO: 16838 - protein, 138 aa, Chlorella protothecoides
IVSDICGCAPIPAQASATALELERFVRGWSRRVTLAWPYGGASVEVVGDLVGGWHCRVPLQYNSWRREWRLQLLGLAPGLHRFKFIVDGRWCADVHAPLEHDFWGNANNVLRVGEGGRGGDAVATLGAALLSFYCKLR

SEQ ID NO: 16839 - protein, 396 aa, Chlorella protothecoides
  MOD_RES (122)..(125): Any amino acid
MQRGPAARGACGPGPGGRGGAADTGGRWERAVSPCPASQAGRACEGVETCRMRGERGHASQTPLFSLPCLIPPNHSLSPTEKGLDRGCIRARLPGRQYGGGKHGARGGHGHGGGHGAGLPRXXXXSLPCLIPPHHSLSPPPKKAWTAGAYAPACLDGSTVMESTARAVDTATAAATAQGSHAALGPLSSPLRCGEALADAHLLRAQVHGLQGRWEESEESLAAALSVVEGVSAGGHPRLAFPLALLAHVYSRTARVTLAEGLYRATQPSCIAPLSFPTNLQGGDQAAAAGSPAGGALGLGAGGARAGALDRGRHAELAVRPAADGAAAPKHGGGGLAGAGSAPGRAPVCHHAHADPAGAPGCADAKGGPACAGDAAQPPLPESRAPGLLHHGPPVI

SEQ ID NO: 16840 - protein, 371 aa, Chlorella protothecoides
  MOD_RES (279)..(282): Any amino acid
  MOD_RES (301)..(304): Any amino acid
  MOD_RES (326)..(329): Any amino acid
MLQDVNTGISWVINNVALYGGDPTNLFVVGQSAGGHLGSLALLAQARHAARADLAAEGAGDRGRGDVGEREPASSEGAGDRGRGDVREREPASSGKGGAAGIAQPGSKSGTTSSAVLPEVEIGGTPRWDVDRVKGFVGVSGAYDLEALAAHLDGRGLNRDMFGSIMSLHGTPALRALSPTHVAAGLGPGVARHLPPVLLLHGTADRSVPVDNALGYAAALESAGARVRLKLYRGKTHTQPIVEDPMRGGRDELMDDVLELVRTGLLLCVTVCMFVGGEXXXXGEDRAALVCRCAHVCGQGXXXXLRALSPTHVAAGLAPGVACHLXXXXLFSQAVEAATMWGRGLGPAKAAGPRVCIRVIPLHALPIKLSR

SEQ ID NO: 16841 - protein, 287 aa, Chlorella protothecoides
MSTGQSCPSRLSGASLMTSGRGHTNREGGSGGKDTCGSRKAGPSPLGAPQETIAWSAAGIFGQARAQCGGNGEGLAGLMGDWNLIDSLASQVVSYSSHSFFQLANVEGAARQKRLFDTLKQGAAALKQLQKDVSLEDVEQLMSDTAEAKEYETRVQSMFGESWTGVDEEAAHAELAEMEAQLLDEEVLDLPSVPQTKVADAAAVPGPPAQGLRILMPFHVLDCQDKAEAALSPKSNIQGGSKHDVSSDGVPRLGDLGGQSCVAHRQRGPLQLAHQLIQPPRCPVRDG

SEQ ID NO: 16842 - protein, 273 aa, Chlorella protothecoides
MSTADESQTSSHLWTPKIQRNDASKPPSPATQAERGEGEASLMAPLREKARLMAEAESLAARMRASQLTSFRDEARHRGAVLRKLGYVDGEGVVTLKGRVACEINPADELLATELMLNGTFNALDRHQLVAMVSCLVQVEKSNEQIRLKESLARPLQALQDAARRIAEVSVECRLEVKVDEYVESFWPFLMDVIYAWSKGASFAEICEMTDLFEGSIVSIVRWVSGGFLCGGGDVCGRLVLWGSEWGPSLDTGSSCACHLMTDRCRCGMSPSR

SEQ ID NO: 16843 - protein, 249 aa, Chlorella protothecoides
  MOD_RES (238)..(241): Any amino acid
MGIGWMHDDACAAWRRPSIPPCRTHSSHNTTEGVDWGWGVVVSAMREERGNAPPAAAPAYHMDTLLCCAGVVGGEPTPAPLDDERGSMEVIPVPLGLLHALSTLRISIPQDLRPPEARRAVLQTLKALRGRYPGGALPLLHPVADMGIEDTGVAAAAAEREEVAAALAANPISKVSWVGGGVACGKLIDWVGSGMVCCVLVAYVARDVLLRATPIPMSTVDESQPSSHLCPPRIQRKXXXXRACRICGT

SEQ ID NO: 16844 - protein, 432 aa, Chlorella protothecoides
MTPCANLQTLRLSLRNAGGPAVEGEARQGEGMRGIPSASHTVPMGRNQAPLGVGGLPGQVISSQVMHQTPRRSARRMCWWPPTPLPGRRRSQSTPSPRPSPWASAFFTPPPSRSGHWALVICAAPWGHCPGLPKSHAGIQEQPSPALICLNPPITYLQALSNQKFRELSEEFGDVGLMTGDVSINPNAACIVMTTEILRSMIYRFVWEGCDLPWAAGQLLWERVGMKEGAFSHPQWMLQGLPSGSELLRETAWIVFDEVHYMQDRERGVIWEETIIFAPKDARMVFLSATLSNATEFADWVASVHQSPCHVVYTEFRPTPLRHFAFPSGGDGLYLVSGWGGGSGRGVESGVGARGGRCVGSGGDGHGLQPSDGLEDAFRKQGTRAHALCSLSRAAREMMQRCRAVESCRAAWQLWCFATSETAGWRHSRQFT

SEQ ID NO: 16845 - protein, 115 aa, Chlorella protothecoides
MEATAEGLAKAAATREALKKKKRELELVRKTASWMAWAVVDLVTLTQDGHLSTPPCDAPLPSQIEDGPPSKKQTGAAPSAVCTHEVACPKGFDPSSITLDPERYGVKGAEGRAGN

SEQ ID NO: 16846 - protein, 405 aa, Chlorella protothecoides
  MOD_RES (2)..(5): Any amino acid
  MOD_RES (50)..(52): Any amino acid
  MOD_RES (268)..(271): Any amino acid
MXXXXDARGVRGHFGGAGDGEEEGSALRAVPASVQERQGVARVAQALRAXXXDCGRPGAMTLLLRGRYAPSIYLIRSGVHLELIKAGRGPTPGWPALEGGQGAMPNLRNLLRKRPSSSTSGAYLSPQVLEAASNAYYNNANKCVGDWGPGVECSRQGVGTPGEYPSRLAQLGIEPESVGAHALPTPLQVKLHGGDPRDLPAACAGPRQVDGAAGDGKGPAGNARGRGQKLRPFCDDGEDDIESGNVHCRLLVWAIKAPVCGWGPQPSXXXXCDDGEDDNESGNIHCRLPVWAIKASVCGWGPQPSPSSDKPLQPHESTDFFISAINQKTHVIFGVVFLLYVFLSFFWSIPYYLIMRFEPGCIYGATHYVEIWIYAFITMATIGEGELAVPAVFSMSAREQKGGLP

SEQ ID NO: 16847 - protein, 398 aa, Chlorella protothecoides
  MOD_RES (233)..(236): Any amino acid
MGRRLIKGSSVKYAPGSGPAVPQACPETGAGFTMGGPFWAEALHSAEALAGILQVLRSDRAAFPAYAKVHSILTAASEELLDAPLYVNLHDVCKTLKCSAPRAEALRSAIVNAGYSHAAWLQCVSWHGEQSHIPCMQTLCMLGYQQRQPEPAAYHFSYPQSQGVVHPRLCAGPEDRLPLERLLGHNALLDRRTPGQERPPRVMLILYCSVDQGWNGALLIPHTTVESSRATPXXXXWKGALLLPHATVESSRATPRMVAVHITQLPFKYPVSRTHFESLPMPRPHSGEDPGQSAGAQGQLCARHVCAEQGPDLQGGALPPEPRGQLGSQAQAWEGTEAGRGRGAAQPCPSAAGPPGHVSLSAVSTDMLPDILLTHCVLPATCGAYWPGSLFLLTDICN

SEQ ID NO: 16848 - protein, 207 aa, Chlorella protothecoides
MGVGGTAGQYPRGHPAQRHRAEQGGRRPGAHDSHVLSLCRGTPGQRAAVVLLDPQGRRGWHPDGCPQGRAVVRGLQRHRPLPRAHGPAVLRAGSGHGQASGEGGRYSCMFDAGLKRLQKYTRFSLLHAVRLSCTITAWPFPPQAEHDTTHKPCRPALLPVPDFAIRLLLGEGATVVLDGQRVLPLRAQEAGYDFKFSQVMRGPGTGG

SEQ ID NO: 16849 - protein, 418 aa, Chlorella protothecoides
MAAPPEDLFVRGVEAAVRSNASYVPPQGKGSLYLRPLLIGSGPILGVGPAPSYTFIVYAASVGAYFKGGQLSPIDLLVETRFHRAAPRGTGGTKCAGNYSPGLGSLAAAKAEGYSDVLYLDAKHDNFLEEVSSCNVFAVYGKTIRTPPLAGSRPRHHPAGRHAAVGDRAGAGQGVHRGGGPRLRGRGPGRRRGVHHGHGRRAVLGGVADLPGQQAALRHRGSAGARGAGAVRGADGAAAGKDGGSLWLGAPRAAVRPLGFAGTRAAVFMAPRVHLSGNAMRASEGGGAAHPQRKEMCISTVKRRPCTRVRRKPWEVTLYRDGHRTSHTARRPSQGPRALPARLGWRAPPRDRRGRGPPGPPPAVPLVPRYPWPRPARRPGSWQGRCRRPPRPSGAWHPTVGGEVGRVEHVHGRKKAFI

SEQ ID NO: 16850 - protein, 449 aa, Chlorella protothecoides
MSICSGAQGRGMGSCKRGPRPACRGLLEWRHAGAHITTHEKLHHPLAGPVEAAAMADLERQVLAALGWRGPGLIGLAEADRPAGGAQEPSPGALGAGRLSPSLAAPSPRATATPGPHDIRLIALDMDGTLLDGTSSVLSSSADAIRAALARGVHVVLATGKARPAAQAALRATGIAELASAAAPGIFLQGLLVYGQGGLLLASAALDPAVVQAAFEYSAAGCGMAWAGEVQPCTVHSCPGSEGRPPRRGLLTPPTFQNYPTPPRRTRRVAVCLSWGRVLDHQAHAGADGAAHAIPRATTLPGAHGRGRRRPARRPKAAFHGRPRARRHPAEAALGGAQGVAALGAREWIVGGRSVLRGSHWRSHPHTCGPAPTAKPPQAALAGTGAETMQALPNMLEIVPRGWNKWASLQHLLADLKVGQASLEQGWDGCDRFAPMEEGTGVGSLRRMC

SEQ ID NO: 16851 - protein, 244 aa, Chlorella protothecoides
MEDSEGPPPPTEVSVFTAEEAYVYRIPPATTVGHRAETWNVNSWLQEVRVRVVSRDEDAWVRLEELETGNLFAECPVPIHVPLSTGCWDFHSHWRNQGIQGRRLALHTPQAYKEKGLPCTHPMEPVIDSSRYFVLKIVDRDSGRHAFIGLGFREREKASDFNATLHEHMQYVRRKHTAAGLRTQYEEQLAANLAMAAPDSLPQATDFSIPEGQNLVLKVPAVCGVAIVRMRNAGRGGRGSGGLY

SEQ ID NO: 16852 - protein, 426 aa, Chlorella protothecoides
MFSTGSNILRQRTYSVLNHIKMDHRFVPIVRHPELQADKKPVVRWARFHDVASTDPKARALRTAMTQRQSCECQWCMWMEGRWEPIFHVHNPIPHHHPSSRATVRQQSPDNPSPPAPGAASAAAASLARASPGLGFSPLDAANDFTVSPIGLARYAAMVTAAGDNTLTRGAGGRREFPPIPDFQSIVDEAGADPATRHALRMLPSIAKYTLTTFDAADSLPHRVALHPAMPGASRFRGMMDDEEEDMEEVGDDLGEDLARYELDMQGSEGGKDGAGAGVATADAWAEPEAGPSDLGPVAAAVEASASSQPEASGSEATEERGGGSPSAVREDELGLEAPASGRAPILQASSPSAGGEDASSPVALIEEEVEPGMLETPGSGGSLRLLGSRTFAPSFRSQPEQDEATAEEDADEDAEEANAGPIHFK

SEQ ID NO: 16853 - protein, 198 aa, Chlorella protothecoides
MARRSFVPTDIFWGYQFVDIIVRPSPGETRYSIDLNRFHDIVPQAGLPPLPASALSRLVTNRAKRTVPYPLLGDNTLVVSDTMCLYRDEAGRLCLAARVADTYPNQMIEITAKMYLYRWAAPGSDPSFECIPLECGYKTGEDRLYLRLPMELTHVIDEASPLAAWLQGEEGRAADADSEVVVMVRESSLSQRSFTANA

SEQ ID NO: 16854 - protein, 96 aa, Chlorella protothecoides
MQIGETLTRGLGAGGKPAIGQKAAQESKAQLEAALAGSDMVFVTAGMGGGTGSGAAPVVAAIAKSLGILTVAIVTTPFSFEGRMRRNQARSGCLRE

SEQ ID NO: 16855 - protein, 394 aa, Chlorella protothecoides
  MOD_RES (11)..(14): Any amino acid
  MOD_RES (322)..(325): Any amino acid
  MOD_RES (383)..(386): Any amino acid
MHRILPPSHAXXXXRDPAACAEPLLTLPRLPGGGSPGTQSAPDPAGTPGGGTPARRPGRGERGGGIVGVQLYKEPEGRPSARRPFKGLTLRDAQVARVVIIDVLHALARPGQHEATVAAVLDASVLLMPGTVPMPSHHAPHVPPTLFFPSSLAEVWSMYAHQQHDLFLPSNTSRLLQGGGGAAALLQGARTFALPAPSATPPANRAGMRRGGDGEESAGGVQAMQSPVQPGAGVEASENPPQVHSGFSDAAHTTTKESPERAQDFAPSASDPVPSLSVSAPPFGVPATTGAAEPGVHGTRLAASDDACAAKQVDSATSKDSXXXXGDASAAKEVDSATSKDSAAGHLQDQQKATPQEAEASQEEAVGPEQPAGKQAPSPVAPXXXXQPGGSSGS

SEQ ID NO: 16856 - protein, 395 aa, Chlorella protothecoides
  MOD_RES (70)..(72): Any amino acid
MVSGLSLPDVNREDSPFAVSSPSSILNGSCCRPTPDPASEHGLLPNPVQQLFGGDVEILVATGLGRVRGXXXVNMVFPIDPGGDGLGKGEGPGPPCVPAGPVASPCLASPCQGDTTLPGLCSNAAPPIHLSPSFHDGNSYLRQLRCGVSCDAGGRASNDDRHILFSTAVAGRPRCTVVAVLDGHHAHHVAAAVRDELPRAFVAAQAAARDLAAALSSAVRALDEHVHGLYAAGAVSTGGTTLLAHVLSDGVLYTANVGDCKGMLSVRGAGEALNTCHNPDVPGERARFADAGVAVSADFILASDINVCRSIGDWDLGSPLKWRDEAGRPRGPLVGDAEVTVRALDGRDEFLVVGSDGLWDYYSPESSVVSDARRALRAFHNDPQACADWLVRDPG

SEQ ID NO: 16857 - protein, 519 aa, Chlorella protothecoides
RAALAGLLTPTLAARVAEADPRPLLRDLAAGVCTPEAVWSAEMRAELETALEGMRAGEGGGDAFDPGGAPDDPGASLGPQVAAAAGHAYAALDRQLLVAGVFVRVYVASPGSRLLVAGVFVRVYVAAPGSRVSDPAALCRGLVTHLARADLGQMAEDALLCLRALRQLLEGAARLLGVLSTRAAVEPLLRCLAFGVDAGVEGEGHARGAPGASIGAPSGVAGPPGPAPHPSLPDPPAAAALAEAALGVLATLASHAGCVDALASDRATQLALWAAAAPPTPACRDTALRVLGALASAPVAAWAAATRGGALFLLSIVLDGGAEAGKRRSAAALLAAFSTQPTHGARVRLLLGRLLPQAILASLLASTGTLDWAPEEGYAVAYPGLEDEVFIGGVYGDPAEQALATLESSCETPACIWNPAMLASARSEVGHLVRAARRAQALTGTLDWAPEEGYAVGYPGLEDEVFIGGVYVRLYLKDPQYPLRCVGRLVGGAAGGNQRATRSRGAVAGTSVFQSKSPC

SEQ ID NO: 16858 - protein, 532 aa, Chlorella protothecoides
HAGALVGVDLQCCEAACAGHPPGAAPSARHARWAASLALAGMVEGAASLGETVLAWGGERCFSPAGLSAGQLQRLLADCGRWLGMAALVCESAGWWLLGTLCAELAGRATAGVPADLVQLMGVRGMTPARARALHEAGGDGRRGVRNAGSRRPQESKLWPRPRPEVAPRGAGVHRLGCNAENPAAGRPASGPERGLATLLQHTSIEHRTDSPPCLPAQDPAALASRSIQQVARVLARALERQFRARRPAGGAPPTKAALCREDGAAAVAAARARAAAEKLVAAARLAVHTQQASAGRLGAGGCAPGADGLGDHGASLGRRHPIDWVGALGAPTSSGDGEVGLVAKAGAPALAGPAADSPWAWAGQGRAACVVLRGGAGTQEGGALLSSLQAAARCAVALNCLEGRALGLALAWEEGRAWYVSLTPALLDRAEVPGAADGAAGPALSLRQRLVHLLNARQVLVFGSAVLQGLSAAGFALTDGPADVAAEVSRRAPHTVGTCPAQCLRLAWGHVVSLVKSVFEGFGGPGVQGPE

SEQ ID NO: 16859 - protein, 538 aa, Chlorella protothecoides
  MOD_RES (490)..(511): Any amino acid
MSARCHVFQPRASLAPHGKGTRLSLHRNFAGKEMGSCTEMGASRTGSVAVATPAWPVMHPLSPFPSTSRHSAAPSPACSGPAGFPGRCTGQPLRQGGRALFQSIAHSTAAPLPFTSSRAVGGLEDPEKILEQAVSDMQNDLIRLRQAAAEVTAAQKRLQNKRDMAAQTADEWYRRAELALSKGDEELAREALTRRKAHAATATQLEGQLAQQTKAVSTIMGNMKMLEGKLQEAKLKKDTLKARAQSAKSARQIQDMVGQGKGWGHGESSSPAHTCAASSLCFPISKILSQLQVAGLNTSSALGAFEKMEEKVMAMESEAEAATMACPRGPFTTGPPSEGADGIAHWHAGCGGFVVVLGVLKFKLYGADGIAHWHAGCGGFVAVLGVLKVKLYLASPDDGLESKFQQLEAGNVEDDLASAEGGIAARGYGGYRTWAGGTGVGVYFNQGAYHVFITTNPSSTKITSSPPQQLPPGRPVRDAIDFELDEMRRXXXXXXXXXXXXXXXXXXXXXXEPACSTPASGSPASGGSAPHPRPHLRP

SEQ ID NO: 16860 - protein, 415 aa, Chlorella protothecoides
  MOD_RES (165)..(168): Any amino acid
MVGAMAAHSSTAAGCTRHGAGRLAPRAMPRPFTPSLSPCTPLIVSLLSPSHVCLMLPASPRCWQNPQDHLPPTLPSFLLQAPRRWPDCPVPQGARPHHPALHPAQPSAGRCDRPVWLHAPEPHHHGRQARQRRRGHPGKGNRVDKCRALHSPLPTFSSIPPMLHXXXXQCRALHSPLPSSSSIPPCSTTPTHPSSPQVVASLLALDSINPNEEIRLYINAGAGSPYAITGILDTIRAMQAPVSTIGVGMVGGAVAVLLAGGAKGRRFIMANSRVMLQQPNGGAMGSADEVNIQATELNRTMQLMYTCVWSPGWWSRTATASVSASGQSCWVGRRMTRSDVLPSVPSNPYHLQCPTHSFLAEYTGLPMDKVEEECDREHFLGAEESKELGIVDGIIGTPPAFMPRNGLLQFARGNF

SEQ ID NO: 16861 - protein, 815 aa, Chlorella protothecoides
  MOD_RES (327)..(330): Any amino acid
  MOD_RES (358)..(361): Any amino acid
  MOD_RES (402)..(405): Any amino acid
  MOD_RES (538)..(601): Any amino acid
  MOD_RES (719)..(722): Any amino acid
  MOD_RES (758)..(775): Any amino acid
MTRTRRPHAVVRPDPPLSQHQHASCHSNPSHPQTPDSDRHEALVAIESMEGPWAVAGLPSTLPPGSYALRPGPGRQAPDWEATASLAWALERYSFLRYKDEAARKAATAPRRLVVPPSPAQEEAGLLAAAIYLVRDLINTPAEDLSECRLAQRRGSESLLSGALSAWVWFRQHAVRPVSDAGLQIRRSGWLGAGCSARWGGMPSPSDSPNLLPCPSPPDLCSSSSPRSRGGGPGGQTPRRVPQRGQRGRPAARRFLLSHGARSRPGRSLPPTPPGPQVAACAPERLPPPARAGGQGRDVRLRWPQHQARRRHAADEEGHGRRSARPXXXXPYLALPSAARPRCRPHSFAVHPLASHPXXXXAWPTSSCRWGSGGKEESLGESGCTWKATPPHPHPQTRAAHXXXXPGPRHHAGGGQVGRRNPWGSLVARGRRTPPPSTSTNAFCARCACSHSPALTWQAQLPVRLRVLVPAVENAVGPASFRPGDVLRSRAGRSVEVGNTDAEGRLILADALAAAGEGAAGGAGAAPDLVLDAATLTXXXXXXXXXXXXXXXXXXXXXXXXXXXXXXXXXXXXXXXXXXXXXXXXXXXXXXXXXXXXXXXXRRGRGGGAGRRRGSDGGPALAPAAARALRPRAALAGGGPAVLPRGRWPGRRHHRRAVPERVCAGGVPLGALGHHGLEPEAAAGAARGRGGAGLARDLGLPQGAVWRRGRRPRRRGRAXXXXGGPRAGRRWPCARSGPSSRRGIAARTVAAAPRAGGXXXXXXXXXXXXXXXXXXGGRLWRHVRRGIHPLGTEVCSPARLWLVHPWTLPSHFWFA

SEQ ID NO: 16862 - protein, 150 aa, Chlorella protothecoides
MDPKTANKVLKAWREAVGKDIEPGTLATKHPPVRPSQQLLTQQAGKASLFVIFQILLDLAAAYGSFVAGSYLSAAASPGGIAGFFTFLLQAGAFFVTGYYLSGTRYRVEEDNLVMSRSGVAKCMVYSTLGASGHASPVMVGGRLSLNHTG

SEQ ID NO: 16863 - protein, 85 aa, Chlorella protothecoides
MQEDGALCQVCWQGHMELQEGMLVCDVCGSVDQGSQEDQRVGGCAGKNGVAREGVSASLCGNPPAPAAGAGVLARAYGVRSRACG

SEQ ID NO: 16864 - protein, 77 aa, Chlorella protothecoides
MREWLLEHVSFKEESRLPPGARGLGALGSRYGSTLSQEEVKAALDLLDTNKDGRIQFGEFVDWWVEKSGVETKATAA

SEQ ID NO: 16865 - protein, 273 aa, Chlorella protothecoides
MATLGSVSPVGVPAACRLPRLATAFRPFTPTAARAMPLVRPSTFRAEVSLIVLTCSGTGDDRMLRDRYPPRPPAQPLPQMQQQQQSAQRLARPLTRLAASSSPDALATGSPPPADTAAKEPALKGEAHLRFVRGSPLKPQLPRRGSPVPGVDGVLHRHAPQPWFMAPLVPTPAHQVRRVLDQIRGRSYEEAIMILEYMPYRACEPILATLLSAAANAKHNLGAKKAALFVHEAFADGGPSMKRAMPRAQGRADRILKPTFHLTIRLQTRAGRA

SEQ ID NO: 16866 - protein, 329 aa, Chlorella protothecoides
  MOD_RES (289)..(292): Any amino acid
MPFKIMHRLMRIHGPMVHEMVARGSRYFPPRTEVICIPGPLPCPSQAPSDTPYLRKQCAALSVLGFSCALTRDVPCPSHSRPGHSTDHAGGTSPKPKHSGPLPPAPTLQNPGMRAPPAGSCSGSWPTLASPEPRQGRTPGPEDGEAGTDPTSELDTSPTESSRVQASPQGPDAPGMEVDAAPRPTLHHLTRHWLPEEERGASVLDRFGASSLEAARHAVRCGWLGAARARVGVACCEILRVGMRALHHHALGIRTALDLGCVGPVHVSDCITPVCRYAPVRQPLLGQGXXXXVWVAGRSEGAGWSRMMWNPEGWHEGAAPSCIGHQTRA

SEQ ID NO: 16867 - protein, 153 aa, Chlorella protothecoides
MDLCDTERAILTGPQTQRGVVPVHAVHSSSHSFKCRGSARRTHILSSQHTRPAQAGINKRRVRVACKGPTQACSAGLGPRSRAPGERQTAVRMAMEVDVPNAMPPWGQAPAPAVPAKAVTPSGNSYRQREATQFRGVTKTSGTNSGLEKFDVQ

SEQ ID NO: 16868 - protein, 724 aa, Chlorella protothecoides
AGACARRRRPHRRRRPRRHGAGGRVGQVVGRGAARCSTRGPDNAWLADENCEAWCKAVAVLRARRVFGGASASSVLGTHMGSMQPLQQRSPCAHACITASRAAAQILLNVSKECCVWESKSLRWKACGPCLAASRSVPLWAWCCGGPPCLRIRMSRACPLCILQSHICSIIYTVSCPETLQCATCRPLPTYPWVPTLSLYLGTKAIIAVLALQHPHNSPQPDPPKHSATHAHQPLRQRFASVALCLPTGPVLLAIPLLGLLAGPPALAVGLTLAALDAVLLRTLGFAALSRAGNALPEALYHDDGGKYRGELSGALKDGFGVYRYASGAQYQGEVRGRAERPGWGRGWPREHGALSTLHNWAWGMFMHPWGSFGALALACSWISERPARPHSMPPHLLPPCRGVEGQCQVGARHLPLQQRGGVRRGVAGGRPGGQGHQDLGLWEGAVRHLERGKAQSAHGARGVCAGRRHGRPGRLRRQEGGGGRLQPRRGPAVPALHPGPACGGGCRRLLACGEAPLPIGERHGVADRAFCRGLLGQAASLARHHQVVSAAGRLATFQAPLALIVLGLTLGDGGVKRGARAPAPAQARAGWRGGSSEHFLPLRRLSSSDYKPTSLEGHVVGQGRGGSGRLGGVVGGEEVANRGCPVQEPRGTADLAFQVRSSSFPAPPASLALFPEDNALTACAAYLSLTASSSVPVLFPDSIPHTLPLAQSSCTVHLVFGPL

SEQ ID NO: 16869 - protein, 260 aa, Chlorella protothecoides
MSVYRENCLRVTERPVGLEKLSECIAIDVHCGSGEELATLPRALLTPYLTTNTPKHCASNPYSNQERMQRGASGSSPSASGSGVAQSSMTEPSENPEWPGTTADVGEMMVDRAVTRNAFVKFMMQKMQEVGVVTEMHACEDTTDIPSEHWQDSHAQPWPMGVSPQSRDTSNRAGRLCSRPEIHKGRTLRCASGWGLQTPRRCRGLSQPLGQSDRGGCRCHCGCCPWFLGLSRACELEAIHAQMEHITSSLDPTGGQCSDP

SEQ ID NO: 16870 - protein, 330 aa, Chlorella protothecoides
  MOD_RES (201)..(204): Any amino acid
RGGAAGAGHPGPGGPDRRQRQRGARTAGRRAGRGHGRRAVQPGADGGLRRGRRLPAARGRYPCAGGRGSHAPGRAHRVGGGGARRRGGGRGEFGHPGAPAARRGGDRRRGGGARPGKPPSAWGWELWVDDSEHTTKGSPPWVFGYAWLASDARTCPSTASSWPTRGAPGTADTWKSWATTTLFQVDGLPLPLTCLLTPLLXXXXAWTFPAQAGRQESTTTLALAELWFGLATVPPTDGVALIRGMHNPSIESQHGSSVLFAIHAVPYRGQDGNKQLGLHIDRIKYWLSVGAQPSNTVGRLLGQAGIIPKPPAALHAGVVKKPEKERNKKA

SEQ ID NO: 16871 - protein, 243 aa, Chlorella protothecoides
  MOD_RES (226)..(229): Any amino acid
MSGRKDPTDRFCPTDQFCPTDLVHPHGYHHVFLAQDEVNIMPADHLAGRARPRPGPPLQPEATRGCATRKGFIVGGTRQPQHCLRSCSSHAHKAVPQTKSALLLCWARNELNSTLHCRQAPMRGLHTLSRAATHSFHAFQKELSITWMEGTPYAPLEIAVGDTVTWTWSMGSPHDVSTATAADSCTDLTPISGDPVEEGTYSQTFDTAGTYFFACSVGDHCDEGQXXXXLAPMEVFVIRMAQV

SEQ ID NO: 16872 - protein, 159 aa, Chlorella protothecoides
MRELLDSILYSFLPAAFERLGASAPTGELSADDCRAVACAALVAAALVAAPAGFLEFLLCVPWLQLGAQLAASGGAPPPELGPWGDAPPLLRPSLAEASLLVNVRLDARLLDCTLDFLGRGLALHALPPLLAAALGAGGEVGVADDRTAGGSAAAAAAS

SEQ ID NO: 16873 - protein, 268 aa, Chlorella protothecoides
MRAFTLSRVPSNASLLRALWQTRPRRRWPQYADAGPFTTSAMDSAAHAADETPVTNKGVRCDHLAWVPGAVPRGVTECDWVLAHPHPDHACLLLMFLTAARNQTGPSSAIHAGLVTVNGQPVLKAGTGVDPASSRIDLLADPPRYVCRAGLKLEAALDHFSLDPKGWTTLDAGLSTGGFTDCLLQRGARRVVGVDVGYGQVAERVRQHPAVTVMERTNVRHLRRAALPGGEPVDLVTLDLSFISGKPVCWMVERPRRVLQGQFRRDGA

SEQ ID NO: 16874 - protein, 170 aa, Chlorella protothecoides
MRTPMQQCCPVPMAHASIRAGALRHRQHMGMKNIPRAVPSGGDLMLLAISPADAGLLLGILKPILTVLSLGMIGRIILAWYPEIDMQKLPWSFVYWPTGDDWMDLEAAGSGIVPAGHDVCPSKHQPSIADNTKPHTALPQNRCWRPRGRSSNLSMVWMCPPSPGLRSCRS

SEQ ID NO: 16875 - protein, 122 aa, Chlorella protothecoides
MARRSLDLVKHVKFLAQAGAITKPKWLDVVEKIHPAVPAKSSKKPAVLRFPEDDLLQAYYAKHPEVEGCAWHGQAKMEPVDLSSFEPTSARKFVFRQLEVMQTGVPRKEAYDIVSKEVAEAA

SEQ ID NO: 16876 - protein, 433 aa, Chlorella protothecoides
MAEDGKFDASGDSMGRSERVLQLNGRILELPGMCHMEQALASCRCCLGLTAFPKVRPFTCGHDDRRRRQHSPPSLSSYRVMPPPTSIEKTIGEQRVVNHAGVGISVGPELDVDSLLAAVPADDKAARQAALSSAAFDGVTTEYTALWRAVHAAPEDVAPEYTQPWKAEPASTAWRGSLRDLAWHERWGAVFTVLPRDCLIGGEGYVSWSMHSSGSSEQSIVGSLLSQHWTTAWLSVQVLLLVGLDDAVGGWVGHAEQRIPLLHLRGQSDDVSTIPRAGQECIIQAVHPRSMQAMPSPPSNPHPPWRTWVSSRKLWSLWSTSPVITFPTQVEQVPVVQGWLTFTQRHCSSATQFSQRHTRCKTDLDGLLLAILKLEGHFVGIASQRSSTVSQRAEEEWGTSGSCSAGARGLHPADPRSQHGGTACQSVCHSVYA

SEQ ID NO: 16877 - protein, 336 aa, Chlorella protothecoides
MEFLAGYGSEDGSEPSSPEHVAQLAPVTSAPAVESEHPGPSFRLPPPKASQVPLFSGVAPPKRQHKLPKARFGVPIDFGGVTPDVLEKMQEAPAKLAPAAPRSGRLADLLPSPKNAVLPPRSGRVSDAERCPGGPSHCGCMETGQGYVTASTFYMPQSMAQGTAYTAGGASDDEDELKALGANDGTAMTLGPGETWRLSLQGARGGDPEVSEQLGDGVHASTSGRQLEGTGAQAPHADYYASQGMPAPAGPDVAAFTAAGIQFKETEGIQEACFHQTVPILHPIRTQVNGAVLRYMDPGQRAELNAMRSALGSDYEARLRKEAGREEGFRMLAALV

SEQ ID NO: 16878 - protein, 184 aa, Chlorella protothecoides
MAHAVSEPSVLIVSGTRLLAQQRSTVSSTALDILLGVGESLRPQRSDTCLCTVRMACLFGRELCRQMFPAKTSGRPRKGRLPCGECYVPPAPSPTPPLSHPVVAAYLLAALGGNATPSAEDISKILSSGEELLKSGCTMMLYVEGSRRICSLSRRRVDDEPPPPLSPTSSQLGSRPTASVSLLC

SEQ ID NO: 16879 - protein, 69 aa, Chlorella protothecoides
MTSPWPHAHNQQLADGEGLRADLRAAKQGAEDAGRKLVGAERRVVQLQHESKRKELEYERLQEKWVESG

SEQ ID NO: 16880 - protein, 148 aa, Chlorella protothecoides
MVLDVLKPGGHLIVLIKPQFEAGKAQASRPGQFLTPAGCGMPMNVDARRRTPWDPSSFKSGDHSLSPPRNQVSAGGLVRDPAVHADVIRRVQEACMARGLVPQGHMPSPIKGANAGNTEFLAHFVFQATGAGVEEELEDGEPEEPAKS

SEQ ID NO: 16881 - protein, 171 aa, Chlorella protothecoides
MNPSPPPPPASVARSAREVETQIHSLRAELLRKEQDNERMQLDLALEKEERERAQRKIDSMTRMMLDGARGGDAEKPKSKRENRRETWCPGAGQRKRPLLPALAGAVEEGEEEGGVEDELGEAGAERPALPPSRRSEGAALLLPGQASPPHKLSRGSGGSSGVGVWGERQG

SEQ ID NO: 16882 - protein, 142 aa, Chlorella protothecoides
MTSAVAALLREVPCPNCIVWGKFDELALALRQAVPGQSVGYVVMNETAEVRWAREGWDVPLRSPEAQVTALHYAMASTQLLDLLHAAAKRVIVWTANAPHMVRLALDAGADGVVTSYPKMVQKALMQRRDACLRLYGHAPVG

SEQ ID NO: 16883 - protein, 161 aa, Chlorella protothecoides
MPSMDLEALCDEVSQRQSLLQRRLHGAAGGGDEPALLRGVVCDQRALLTGMLAAVRSSRMVRHARSGRAPSAVCGLPRACPPSAERALSMPSAPLPTTQAQEALHQADMRRLVHDHQTQLAAAKTEWERARVDKVGQGTGVVLGSKNGGSARSCVCLGDMS

SEQ ID NO: 16884 - protein, 291 aa, Chlorella protothecoides
MSPPLVTTSCHHHHRDALAAAEAATQQALMQAAEEAARLAQEHEAAVSAALAAHEEELGAALVERQELVAKRRELQDTVKSLEEKLAAAAAGLAATEELKDLRRRHKEDVARLSLALKNATQGSKGTEKASDRAQKEAEKLRSKVTELEAKLRAAVQDKNSAQNEKAAAERELKAMRSQAERLTKNMDKVGLGKVDAGLQVGVNRTILGGRGRSVRTVNGDVLGQAASAARCKCVVIPPCLLQITGVEEKKRESIMVGFNQTKSRLQVNGAGVGRVLMDGAVEERSALVSK

SEQ ID NO: 16885 - protein, 172 aa, Chlorella protothecoides
MANALASRPPVLAARVGRVQTPGASTAAPARAPFFLCTLAHRRASLACNTYKVTFQLENGEEETIEVPEDQYILDAADDAGLDLPYSCRSERPELPGRYPGAPWRVGVGRGGGHRLHRPGVNSLYDALLSCAWNGTHIVALPSQMEKGYALLCVAYPTTDCVIQTHKEEDLY

SEQ ID NO: 16886 - protein, 285 aa, Chlorella protothecoides
MGDRALRDELMTLMVAGQETSAIALGWTCAQLAGHPHAQEVVAAEAIAAARHHTSDSAAAPPAPGLAAAPLPRATEAALEAMRLHPPAYMVGRCAARDADLAQYRLPRGTTVLLATYLLHRDPAVWRAGRGSEAEARTNMNAGTGGAALPPQGHGRPAAFVPGRWAEALCAAGSATALLSDQGAAGSYVPFGAGPRVCIGTGFAMLEVPLVLSMLLARFRLEPEGGARPPAARARITLRPEEGGEPTTSGSAGKELMQASSDLPVTARLRSLFANALKPCLMALE

SEQ ID NO: 16887 - protein, 363 aa, Chlorella protothecoides
  MOD_RES (165)..(168): Any amino acid
MGQEGGDKEGVDREDLPALRNSTSDPLSPLILWKVLLLENVRFYKEEEKNDPGHAKELAKFADVFVNDAFGTAHRAHSSTEGVTKHVKESVAGLLLQKELDYLGESWWSLGGQSMAGGSAHMFDGVIPHGFWDELPDFAAVSRPQNALHGNSAREAHQQRHHGLXXXXQNALHENTAREAHQQRHHDGAVKEPKRPFVAIVGGSKVSSKIGVIESLLQKVDKIVLGGGMIFTFYKAKGLGVGSSLVEDDKVELARSLIQEAEKRGVELLLPTDVVVADKFDANANSKVVPVEEIPDGWMHEDERRGGLKQALTTAMGLDIGPDSVELVTKALDGAKTIIWNGPMGESWGRLWMVSVEWGHTAD

SEQ ID NO: 16888 - protein, 169 aa, Chlorella protothecoides
MVHLLTSQQTAQRLFSCRMCAPAGVDCESLDGPPPDSRLRPFTSLFSNRFPSTPLPPPHNQGVFEFDKFSHGTFAVANTLATKTDAITIIGGGDSVAAVEKAGVASKMSHISTGGGASLELLEGKSGQRGWDDLTTRKPPPHASPSLSKPRPPLHNVLHAPGVAALDDA

SEQ ID NO: 16889 - protein, 370 aa, Chlorella protothecoides
  MOD_RES (147)..(149): Any amino acid
  MOD_RES (291)..(294): Any amino acid
MAGRGRAAVLPAWMKGEARRSRLPEWHGPVMLLQELPVPAWLSRLLLLPAGSLHRHHPIPAPPQRPTPAAAPSLAQAAPRAAMPSAAPSGPGSAWTEHTAPDGRKYYYNAGTKQSVWTKPVELQTPEGRQGTLWQVGYAEVQCCMLXXXGLAPSACFVLWGHQGRQGALWQAGYAEERAAAGAAAAAAAAAAAGPGSAVAAAQPAAAPAATVNEWKEFTAPDGRKYYYNKTTKESRWTMPDEMKPAAAVAATPATAPSGNSLAAPAATLVGTAGPTAAAAQAALKAVEAAXXXXGRPHRVRGAGRAQGGGGRPLGRQGRRVCGPAGVHPDGPHPPLRHHRGGQGRLQGAAQRDGGVQHQQLGRGVAGHHG

SEQ ID NO: 16890 - protein, 261 aa, Chlorella protothecoides
  MOD_RES (11)..(14): Any amino acid
  MOD_RES (236)..(239): Any amino acid
MPLTRCLWRGXXXXPFSRSNPLAPYQVPVAREPDRIDVSDLPPNLARKELGQYRMIDEGFDLTLVLQLEEPVTKDQVLRVERGSCGTPVSLKAPAEEPCHLQLGPENEILKESEAAPCLCLQTVSSCPHLHPTRAGFPPARSQALGPHPAGQVRHKGECADQEAVCVPVQGDRRRVAVPQGLLACFGPDMNVQPLLLMITVLCMLAGFCDEMLLWGAFNASNLIALSHVGRCPRGXXXXLILLHMITVFCMLAGFCNEMLL

SEQ ID NO: 16891 - protein, 102 aa, Chlorella protothecoides
MGRAGGTPVGVGNLYFVEQQGLARDEIAKREKEHRYQREDFSRLLRHERRIEAETPWEDAVQLLEKEPEWKELESLEEKRELFDAFIAKLKVRVVCCERAAA

SEQ ID NO: 16892 - protein, 276 aa, Chlorella protothecoides
MPEAGPRHGPNYRAGILRRSAATAIQVRASSARTGPDLGSFLGAGLSRLQTMMTPAPPGFPPGPGGDCALRLLSDPLAFLTDVARDHGPVVGLTLAGSRVVLVSDPAAARDVLQDRSDTWVKSGTAFFPGSSLTGDGLLVSDGATWRRQRQLCTPAFRAAAVAAYAGSMARCTLRTLRELDAAVAAAGDDGAALDLYPALNRLTLDIALEALFGSALEGERAAGVTAAIQEAFDQFSARVALPLPEYLPTPGNAALARAVERLDDAVYGLIARRRE

SEQ ID NO: 16893 - protein, 302 aa, Chlorella protothecoides
MGGVFLAPAQIAGHSVYSAFHLQLAGAAIVPGGRRSLHIGLGAGTAVRGMQRAGVVADRERGQGRGPINSFIMLLLSSSSDVLELHPEILTAASAAFGLIPKGLGSTDAGLFLAGDALATASSLPNGTYDYIIHDVFAGGEVAGPLVATPFLRLLASKLRRPRGILAVNFYGEADEGLLRLACSLRSVLPHLAVLADEEEAAVRNHVLLASWSAVDPGAATPAAAAALCEDQGCAKVLAGLPSRHLPLPDLEQRCAALDQGRAGGGGGRSPSFRGWVAAGRQAADHWSVMRMQIPDPVWRCY

SEQ ID NO: 16894 - protein, 996 aa, Chlorella protothecoides
  MOD_RES (379)..(382): Any amino acid
  MOD_RES (409)..(412): Any amino acid
  MOD_RES (422)..(425): Any amino acid
  MOD_RES (969)..(972): Any amino acid
MQCGKVCPQGCGDESSGSRGPCAQAGKRCGVEGEQGAWEFVSSGGGGKEGGATVICAAGHGTQAPARSLHDVHEGRVRDDGRGLEHGVGADARGVDQEAGLLRVSTHASVLGEVVGEGGGAEADETHGAGQDQEVQQRLLLCVELRQFEGGDKLVLDDHARGQALAEQDALRVGPLLGGAVGEQARGDVQRRARIQARTAHGLGVQVPHAPHPAHDDGPVARVFLHAQVHAVEGGHAGGRHGRNRARRQRLQRGIEGEQRRHARGKGRDARGAQREEGAGQVQHQVVGGGSQAGIQVAQVPRQRGAAARHQRRQRAAGQVHVGQAQDEAGVHVTLNEGGEGRGGLRQVGGGLQAGRLCGVVEEGGFGRGGEIRAGGGEXXXXKPGVCVGWWRKEVWGGGRQIRAGGGEXXXXKRLPTQCKAXXXXHVPGCGCETPKVPGEGALPGRLHSTIRSGQAPRGCRLSASAGQRSCGSRPAVAPPGGTRQGRGWGSGHLRGCCPGQARACGTAQSARPLGSPTQARPQCRGGPHLCPQGCGQDEGGQVAVLLIDEPAAGAVPQHHPPAQAARPSKPLPELIIVTSRPSVVQKVLGDERTQQAALHGPRAACQDGVPYQAVYEQEHTCCTQEQEHRRSREAAPQDSRETRRLIMHSPRSVCTVERKVPFRWRKQRVAAVRFIYRRSELGTVGDGTHCRAPGHLAGSQCGRSGSGWPLLAAICREGGVHLRVHTGAPVLTPVVPYSWQGGVHLRIHTGAPGASGPALSSWPGIEALGCGEEPCNRCVTRTRHRRHWSAGELGPGPPTLQSPGSSWCLPLLHPPPPQISSRYGTEATKATVDFTLYDPAGRIIHSEVAVSSAEATVTGHGGQGPWRACFKVSRQQILRPSVIVRLSYFTVNSPTLVGTHFEWQRTPPEAGGIQLSPGGVTAGELGAGRGTRGWALEARGGRDGADDCEPPGAHPFPEHDPTGQRPAXXXXGGRLHQRPGPEPGRRAAAPGLLPA

SEQ ID NO: 16895 - protein, 404 aa, Chlorella protothecoides
  MOD_RES (47)..(50): Any amino acid
  MOD_RES (149)..(155): Any amino acid
  MOD_RES (176)..(179): Any amino acid
  MOD_RES (262)..(265): Any amino acid
  MOD_RES (292)..(295): Any amino acid
  MOD_RES (323)..(325): Any amino acid
MAAEPPANVSTAGGPGPSAQTHVPFAGITFTSLALSIRPIPQVTLTXXXXVCEVWPPKVHLPQMMPLLCLPALTVPFCAGDPDHPGLSIAWGSCGHVFHLDCIQRWLKTRSACPLCNKECVGGWWRAGQDGTEDFVIFFRTRVADRGVXXXXXXXPSNSPSGAPLPCLASPALLCXXXXLRTLLSFSERELLIGVWECCAICTVSIPSDCPCGAPLPCLASPALLCMLSWDLGSFPLTIMCFNQFNTLIPLLAPCIGGSSQXXXXLPGILPSLHRHACTPVMVILPHPPCAXXXXPARHSALFAKARMHPCRGDPAPPSLRPXXXLPLTMMCFKHFNELIPFLAPCIGGSSQRLRKSSREALPAQTEGAIANDPPARKAAGMAAGAIIGGGCASTMWDHGSQTG

SEQ ID NO: 16896 - protein, 152 aa, Chlorella protothecoides
APVRWAAFVRAGAALVTASPDRGVGVWDAATGARLGGLEPGQGSRLKSFAVDAEARRAVTCLWDSTVVVWDLERAQPLHTLQRWGGPSQDLQGHTAGNGGGVRGVGVKRSCVCGCVRGGGETQRAVAMREGVGMGPCQGSTCWASARTDPIH

SEQ ID NO: 16897 - protein, 203 aa, Chlorella protothecoides
MATTSYSSQALAGASNATLSRTITPVLPPRHKPAPRFRSSVVPAQEVSAVYAAPAAPTPGLRPLPREDENSVDNVNLGNPLQRAERLSPGWLGVLADLEGVVLDYDTAEVSDRSWQQLAEEEGRKPLPAWALRKAEHMKNEQAGGRSARRKAGGAVCGGPGVDVPEGQPGSPGLPGHPGAAPGAVLLWLAGVGSAYRRVPWDP

SEQ ID NO: 16898 - protein, 123 aa, Chlorella protothecoides
MDSPALFPYLSQHLKPHHPPKSKPSQSIGRPPLRCVVLASSNLSIEAAREAGMKVVALAARRPAYELTAADSVVRQVDGLSFMDLKRLFAREAGAQLVPLAEPEAQPASRWAQPTPFSDADPE

SEQ ID NO: 16899 - protein, 320 aa, Chlorella protothecoides
MDIKRNKMEWFTTPVNTLLDVPRVIENWKALGIKVYEPAPNLTQPSTAFPAFIQRDVDPRLILRLPDVYLARSPLAALVARSRATLARHLRDLDPGLAASTDYLVLDLPCTFFALRTARIPALATRVAALLPFNAALEALAARTVAAMAAAGVPAFNGVHLRVEKDAGDWTIIMGGVGRMWHLYTQTMRRAGLDARTPLYVATGLLTYGASKEWAYAQRVLLSKGLASRVVIKNQFVPAFELAELNTEQQALLDFLILARAVRFVGFGSSTFSYYLTQHRRMRGHAQEASLLVDAARIGTDAMFEAAAVITHPPLMHVVQ

SEQ ID NO: 16900 - protein, 206 aa, Chlorella protothecoides
MPPTPLGPALPPHLAAEPSEHFPTSASYELKGHEGPVYAVRFNSQGTYCMSCGKGHEGPVYAVRFNSQGTYCLSCGKVLGVDRRADRTLRLWNPHTGRLVKTYTGHGYDVRDVTVTKDNSNCHPQPPCALLGQAASVRLHLLLLPPGIPTIFPLNLTHHPYLPPGQVCVLRRRQAGLCLGRRVRKNNPEAARPRCAHQCGMCCLES

SEQ ID NO: 16901 - protein, 918 aa, Chlorella protothecoides
  MOD_RES (294)..(297): Any amino acid
  MOD_RES (763)..(766): Any amino acid
MPDLSQILLRPHAQCRTLIVAIALILLVEGALALQISPVQRALAQYLTNEELSTYLQDYQRRCRDIAKLHVIGTSVQGRQLRLDANSINGAIYAQWGHAAVLKNPGSHHVTTGGRPHSHSPQTQAAAGTGAGCIARVNECAASLQIRGQPPRQRAHRPRADSGSGRRQPRRVRPADPGKHVRVFTITSDWEANAWEDEFGACAKIDPVRVGCLEMWEQGDWDSSSHQHSHSWPRSTPEGFSKPPSLMPTGSEQAEVRALMDWSRRIGFTASAAMHEVGMQGLMDGGRPGLNPPXXXXFEQQGWVYALTCWHSGLAREAAGIESTSTSQLSSQTRSLGPDQMNCKGSMYTYNEEVLLTHIRSHTSTCITHPLQGALVANYPMDGTPDRSTQYAASPDDGTFRHLATKYAQAHTRMALPTNKVGAWVHACGAASVVLPFPAPGIDRVHGHHPITGVSEWRHHQWRGVVSHLRQHAGLGLPRDRLLRADAGGVGVQVATRGQPGGVVEGEQGIPPGSAPAGCAGRVRTIWGGWSEGLACTRVWSRGCHPGAAAAAQFGIVAAASAQEQRVTASMLVASNPLRQGGIDTPLRANVTGARMGWGCLPGKHEEKLVGGLMAGSTPLSAQTSRVRGWVGVDSLGSMRKLVGVAGIETVVQSREGTGVFARPLAPGTYELQARAHGYTTATQQTTVPDDGTGVEVLFELKRVASSGRARRAGGEEAADGAAALDSVAAWGVNPGGALRLEPLRHNVLLVSAGIVLLLVVWXXXXRLRGSLGCEPGRRPQVGAPASQRAPRLFRHRLAPRGVVWWMAAGGHPEGEESPAPHSHLHPPEQSCGESKQAGRLLPQKAVCLGPRGRPRAAMILFVPLHRSLNPYCTAVPREMPAMELAASMLHGRQPSFDHRYALFTPLVELGSGGRLPA

SEQ ID NO: 16902 - protein, 419 aa, Chlorella protothecoides
MPRASPLDPRYGASKAADASTQQAKFSVVIDAGSTGSRVHIFKFLTSAAGAQDLQFDKFEQLKPGLSSYAADPKAAAASLKPLLALALETIPEALHAQTHVSVGATAGLRMLPGTKADDILAEVRALLKTYPFQSAASDVSILTGVNEGAFAWLTLNYLLGRLGEHEDRTVAAIDLGGGSVQEAFAMTAKEAAGAPHANYTTTLSGGGRRYSVYVYSYLGYGLMAGRAGVLAAPADPAAPHPCVPVGYAGEYEYAGVKHPMRGGEAGSAAACAAVAASSLNAALECAAPQLQCSFNGAWGGGRVPSVFYISSYFWDRAVDAGLVPETAAIEARVKPAEFKKLADKACSAKLADLGTLFPNVQEAARPFFCMDLCYVHTLLLEGFRVPEETEVTIVKKVQYKKEQVEAAWPLGAAINSLG

SEQ ID NO: 16903 - protein, 347 aa, Chlorella protothecoides
  MOD_RES (220)..(223): Any amino acid
MHAHRSTPSRPQSRRALRNPCTASRAGGRQEWNIPRHEFADRALLVAVWAWAVHCRVAWSCCSGGVGRRLQTFDLPRSISLAVALPFAQERGRLRTMFTRGQFATIAAATVTTLLLEINKAMPTPYMVRSVEGGRRIHGGSHADEVFHVGQTQRYCRGEFWEWDPKITTFPGLYLIGSAVGVLADALQIGPQVCVQVASPCLCFANRHPCCLLAHRRAAXXXXFKWPVPASVLRMDTLVVLWHTGEQRPPLQCHCPLHQAQGSICSVAALRTVTVLLAVACVPVFFATAKLAVPARTETQALLIVSAGVSNVDQVVGCGLASWPRRPGGSVSAARQWASLPMPGPRR

SEQ ID NO: 16904 - protein, 272 aa, Chlorella protothecoides
  MOD_RES (38)..(41): Any amino acid
  MOD_RES (61)..(64): Any amino acid
MCRWPEGIGPECLVPRARASEPPSPPFPAHLPKLLGLXXXXALQEEREGVVCVCVYAGHAXXXXRVRALEPPSPPFLAHLPKLLGLEPGVGAGRVDKGDDREAKLVGHAHEAQGLPVAVGLGHAKVAVDILLGVAPLLVPDEHEGGLVHGSNAADQGRVVQAHAVAVQLHKLVGDVQRDVQEGGAVGVACHLQPLDGRQLGVRLLAQLRVIQGRSTEQGCRPSRPTMGAEARMKSSRQGHAPAPPQQRIVKPCTKLQNKPDCSPGGPWPPAP

SEQ ID NO: 16905 - protein, 223 aa, Chlorella protothecoides
MPTPSGRRPIRVYMDGCFDLMHYGHANALRQAKACLWANPVDFGMSLGDQLVLGLIPDSEIRRCKGPPILNEEERRKLVESVKWVDEVITDVPYDLTPAFLDELITKHKIDYVIHGDDPCLLPDGTDAYEHAKKLGRFLMVGVAVDRAAAEPRPWSAAGGLARPARVLAGSGPATSGLQPTPIPTPPATDQEDRGREHHRHRGPHAYLLPGECPQRERREAGK

SEQ ID NO: 16906 - protein, 136 aa, Chlorella protothecoides
MGNTGTRNNGTGNVGTENDGIGNKGNHNDGTDNEGNSNIGFANDGNNNIGTENNGNNNTGTDNVGLNNLGTNNFGKNNVGTNNTGSNNFGWANTGANNSGLNNTGVSNSGTNNIGAYNSGFGNVGTYLKGTNQTNI

SEQ ID NO: 16907 - protein, 155 aa, Chlorella protothecoides
MKTFALTVLLLGTAYGAAAVKPGEWWVYPFLSTAVDHQKRVLQVEGDGRLGADMFCKSKGYLKSGDFLELEEAGNIWPIGTTNLANDQFWTGANATAYLYITCLSLETQSPSIGQGENGNIGYKNSGINNIGNYNSGEANVGNHNAGDFNMGDGQ

SEQ ID NO: 16908 - protein, 163 aa, Chlorella protothecoides
MRTAQLTVGAGPSRGPTPPNRSWASPGRTRARAPFSPRRTTRAMATQDPPDLPKARDASGKQGDWFQMLLARFNPISEKASNTAVLDFEKPLVELDHKIREVRVWGGAGHWKAGIAGRGVGFGSRGRAGWEGPQLTCGCMCRCHEIIAPPPCYARHLAGAQGG

SEQ ID NO: 16909 - protein, 573 aa, Chlorella protothecoides
MASWLQQRLKEAEGLLQAVDQTAKGVKSTAGAALEGSTDARDAHHAPPIPRSVRKEVPDRENLGVRRPLRVSPATSASGRVSPSTRGRAGGPPGPQAGPSSRAVEAREETGTSPDASGSPVEQVSHPTSVEMTWEQLSQQSDGDSSVRPGVQLDPPNPSEGGEGVGESPDAASAGVPGVTEEPDSSEDSRSAERVLRSMGEEADPWGGPAPALGHLVGPESDTAAPTPHPRLDRPPFAADAATEEDERTPPLLPGSTGQGQEGLDDAEPRPDIRQVASDAREAHDSVRDVAEPDGFADAHHTPRLGGSVGAGMAAVGKVGGAESSGDLQQPTEAVPLAPGEEAAAASTAQAASGGDEGDPVPGPRAGMPSTLGAETSAFEEGDSRDAQDELGTAPLEDQPDPGVSGEAEDEPGQAASGTGDTSEAPATDGVIPSEEAGQDVAVAMAAAATTLAPASAPTGMPPAATPVDAPAPTAATALPAAPTALPAASSSGTPNPAPQQAQAREARLVRMVEQLKARLEAARSENEQLEELLARADASASGRGGEVARLEDELAALAAAKVSAEAGLQRRL

SEQ ID NO: 16910 - protein, 333 aa, Chlorella protothecoides
MNLREMFNFRVPIISIVIGEGGSGGALAIGCANRMLIMENAVYYVASPEACAAILWKSRDKAGVATEALKITPRDLVGLGVMDEIVPEPLGAAHTDPMGAFPAVREAVLRHYRDYVGRSATEIMADRYMKFRHIGVYEEFLVAGGDVEAARAQREEVGAGLVGRGVGGGGESVCGGWVGHVCGIVEAGESTSLAPGGRSRQRDSTSLAPGGRSRQSVGGAGPALYPSRHSERPPAASQPLSSPPIPPFQAPGAYTKAGTWAPTEADARYIEKCADADEKWEQGSNVREGVAATRGAAGRTAPGRAGMVRGALGEGDGATRALPACVLEASAPK

SEQ ID NO: 16911 - protein, 814 aa, Chlorella protothecoides
MCAGSRGGSWMGCLITMIFCHAAVPTQPGPPPISWHQVFGVPDARYGEELCAWVRTWCAGLTPCTPPLHCLGRRDHASASEDDIRAWAAARVSRHKVPRYIKFVHSFPQTCERCIACWSGGPQSVSALPGPCLPPAATHVTHFFLTLHSERETTEVSYAEAGHRRAGPGSGGGGGNGVMSLLDTFFDDAMLAPAPFLWLAVWTPLALHTCSQCGEQQGLGEEHLWDVCQHGLECAPMRYNATVLRGGGISAGVNSRQATVSPARPPAHPGWPPPVGRPPSTGCPTGAPSSRHSAFPGPQPPPPGHALAAAACTWGGAALECGKPGPAGLPALEDGCMQRRAVSRFRCRRASRASASEAKQYLRFAPRPRRFPAAAAQRGFSGATWRSVESATGPGKRGRRARASEPERASKLPQAHHPTSPRPFTSSSASASPGLLFPAWLVALVEADWRQALVSSRLQRSPSSLHSSSRPSRKLPQGESPLLPVTSLLCASDPRLRSHRKPVAGHPPFPGDQDYLATTAAAQARPGGTAGPDQQTAVPLGRNCGAWCGDTRCWSQGGRETRAGRGCQRDPPPVCHPGPPHEGNCGEMGGRGTRIPDAVLTGPGGNGYGARIRLHARAARTVALPSKQGARVWGASPRGWGAGMVHGHAMPHSRRLVGMHGQSLTVEGKAGTDAGDGFTVRWCLGEAAFRTSAVPSGGWVGGTASSRVAYCDKQGQSFDPGPSTDPHMALFRTQVDRYISILLVCSALAHLLISIACSDKRAFCKRAAHSAKELRILRTTLLITRFASLRLMNGSWTSMTRHVDQIDTCPRHGR

SEQ ID NO: 16912 - protein, 309 aa, Chlorella protothecoides
MPQRPLIRPGPLRQCRQSAARLSWASPPCSSGSWSLTIVRGECNQPGRDHAAAKQASAFSWVHPGGPTSPSVPFFRKLTPARPPHSFGEYRLDSLRTGIMAGSPCPVEVMRRVQSEMHMSPVTFSPSSSQEVTICYGMTETSPVSFQTSIQDPIERRVSTVGRIHPHLEAKVIDPVTQGILAPGEVGELCVRGGANSLLLRSLFGMDGRMAGLSEIHDNSAPHAGYSVMQGYYDDPEATAAAVDAEGWMHSGDLVTLDAEGYCNIVGRRGGVCCLVPLGHGAPCTQICSPEKDSRWAKEIPSCARHLTG

SEQ ID NO: 16913 - protein, 116 aa, Chlorella protothecoides
MAYLGLQVATMHHKFDLGLFVTGVPLAVFSRAANVFPCSFILNQGLQHRMPRNLQLMLWAVGLRGAVAYGLVVNLPRSDAPGETGVPAIETATLFIVVVSTLVMGSATGRSMQPIW

SEQ ID NO: 16914 - protein, 188 aa, Chlorella protothecoides
MLYNLVFGESVLNDAVAIVLFRSLAKFYDTPMGLSSLLGVLVSFVALALGSLAIGVAVALAAAFLLKRLERPAAGRSHVDGTLYEIAIVVMGSYLAYLLAELAGMSGIVALFFSGLGCYLSFAFCGGERVAGGGAGGYRCQGPSLENDPGVPRGVIGITSLGPATRMSTPCSTMLPPHNPRAQHRPTK

SEQ ID NO: 16915 - protein, 737 aa, Chlorella protothecoides
  MOD_RES (191)..(220): Any amino acid
  MOD_RES (243)..(246): Any amino acid
  MOD_RES (268)..(271): Any amino acid
MPPDCNDDALGHFVGVIQSPAAHSRDDGLVYRGGERDCGNGAAQQPSRLPMSSMCSACNDTPGRRRGATSIALARTLRRSHGNNRAVAKSWRLPVSIHSGVPVPLPVLPPPFGREWGAHVRRKPLILRPGHRISPEERPRCELDGAMVRSRGCTSACSVDSKEGVCTHALRRAPFPARPCGLTRPASQSVXXXXXXXXXXXXXXXXXXXXXXXXXXXXXXMPQPRWWSTTSSAVGPGPCVPSXXXXAAAPMVEHHGLSSEAWALRSQXXXXACSVDSKEGVCTHALRRAPSPARPCGLTRPASQTAELSSTLSTAQHHAVTLQISALLSSSMQPGGPSVPAGPALQAHPPAAPPPGLLQGWQHPSTGPAPGMPRLPAGAYARHPVPHRDLPLPAAGDHGPGAAARAGARGGRAAQPRSRWSGASPRLHPPAPGPLVSVLSGWAWHSRVWSCRWRPRCMPRAPAPKACTRPPLSPCTAHCALQGVRLSAPDGRHVTLRLNFHLACLELCDPGDGAPAGTIPPPACLRSVTSLAEAQTALQRAPVHTPGAGPSVGGPRSGGRRARAVAALPASPTLPTIPSSPPRVPPRAGPAPPPMSPLHPRCTPSPAKRPLPTAASATATVRQGLALLAQEGSACEACAVLARCAAAPGAAALAVEAGALEALVQACLRGGQPGSRQAGGGDAAKGRGGIAAGGPEGGAEGGDAAARVPDAGAGSSTDVDSPGAAAGAAERVALLAS

SEQ ID NO: 16916 - protein, 473 aa, Chlorella protothecoides
  MOD_RES (225)..(257): Any amino acid
  MOD_RES (462)..(465): Any amino acid
MAAATLAVIRAHAPTFRWGEAVVCQHGGHGVDVVSYRAPVCSLSPMLADSYPPPRNRHDRLAFAVHAYLESRGYTLVSTGAEADQEAGPGSKFDSVGREPAPLSGWTDLEERYAFRYVNEQGTASSCPSRPKLPARLHPGPLTGAHLYLKAMVLGGNLVLQWQDGGQQPGSTPASLDLALDKYTRAAEGVSAGYSDLAGLVGALAAAGLGESAAQSASGQEAPAXXXXXXXXXXXXXXXXXXXXXXXXXXXXXXXXXGGARPSLPMSGMLAACVTPGTPWGTGTGTPWAWRRPGEGPCQVSRGARGGGGGGAKEQGKYGSWRSGCAAGILRFPCRHGVSLAVAADGGPAAQGRGHARGTWRPPVRRQAGAGPGAWGTQATPRGEVGPHRPARPARLPPRRQPATGAPGEGGHPPRHHAARPWARRDRGRFRVHVMVGDGRQLCGGPPPFPPDADQCLPIAMXXXXTGADFGFM

SEQ ID NO: 16917 - protein, 699 aa, Chlorella protothecoides
  MOD_RES (300)..(303): Any amino acid
  MOD_RES (497)..(500): Any amino acid
ACAAAVVQVQRLLLAVLEGQDVQRGGGLHGAHHRPLVAAAVGAAAAAPAVHGGALGAGDGGGRRRGRRGVKHLQRGHGGGEWGGVLRRRQLLAVLPGGRLLRGRGPAPDVGRGGDGGVLRRVLRRVLAHVLQAAAGAGRGAGGGRTVVLALIRGLGGGGGRAQAGRQAVLGGGLVCHGPLAGGGGLGHPGGGGQGAAQAWVLPVPVGAAQHRGRTFRGVVLQRDRERPATPRNRQGGRGVERDVGRGGGPRREGPRMGLTGKCAGREDSTPQKPNEVWRVHPSSRGVRRRVKSLQGLLFXXXXDSLPYTLPILRFPVSLALTRARGAYPATLTPTGIELFYVRLPTCVPSIAGPGRGAPTPGGPAGTVCLYESRDSLPYTLPISRFPVFLAHTGWRGVVRISCGSSLEGGCDDPTQKHLRCTMEGPLSSYSARGASHRGDRGDQMTKGAERLGTGMPRHTPPRSRTPEAERASPRAREPVTHAPCAVPPSTPYRHQXXXXRARQRQSARAPELASPSHMHPALCPHQPHTDINSHTPSSPLLHLSPPSPPSSLQLPLPAHSPLLAIHICWKVDREDRMEPPIQTLYLRSGGATTLIFMLEGANAVISRDMRSAMPGNMVVPPLMTMLPYRSLRMSTSHFITELKVVSWMPGPSTPIMPGWNTTSGQRKRSEPRVMTWPSGSSYVFSSVEEPAAVASSCS

SEQ ID NO: 16918 - protein, 340 aa, Chlorella protothecoides
MAGVLRTACRAAAAFTSRGAFAQQLRQAFTSAVEAPTVWVFLGPPGVGKGTYSVRVAKAFGMDHIAAGDLVRAEMKSGSQLGAEVGSPGGPAARAPRCICPAACRFDDRTHAPSLCHIACSQMKSIVDTGALLPDALILKVMRERMRLSSSRGITSFLLDGFPRTAEQADALEEIGSNFGPLRHALHPATVTAGGSWWPPSCQPPALWPMLLPLPPPFSTPPQILVEKCMGRRICKKCGSNYNIADIYLPATADQPEIVMPPLDPPTACLPHLEQRSDDNEPTIRRRLEVYHAAARPVEEFYAARGTLVDFEITGGIPETLPRLLEVLKGLPSQQEAAVA

SEQ ID NO: 16919 - protein, 129 aa, Chlorella protothecoides
MASCLRSQHIMAHHHYQKVPTPSLLQCKCVPLPGYNPAPASLPRAPWGCCSMSRTLRDQGDGGVPQHEMDIIEYLESLPTVKVAPLYTSSIICRVILQHLPPLAAQYVARLLLVPEGTSEGAARAHGPA

SEQ ID NO: 16920 - protein, 288 aa, Chlorella protothecoides
MSRARGGPRGDGAREPHRPNPRASQHCPATLAPLPSHSPPSPRPSPVKLGLSWLSDRAEYHRLAGTLVLHELAIAAPAVFNVHVKVFVEAIWNGIRDPKLHIRETAVAALQACLVLIEKRETRYRVQWYYRLFEQTKAGLARAAPVEIVHGSLLALGELVRHTGEFMLARYREVCETVLRFRDSKEKLIRRAIITLLPRLAAFAPERFTKSYLDSATEHLLAVLGSPADRGAGGQGRRGCCEEEGGRGVQQHGVRARWMASGQGQAQHAHAPSACSGTHFPSARTRRW

SEQ ID NO: 16921 - protein, 100 aa, Chlorella protothecoides
MGGLVAIEELAGSKMYSGSPARLADLVKLLMEVFQPASDQQLMEFAARTLGHTVKAGGALMAGVVEEQVGPGWPGAGVGGVACAARPLAVHAGGVAMPSG

SEQ ID NO: 16922 - protein, 467 aa, Chlorella protothecoides
MPRVCFLTTSLQHRKEKPWDHDGINHWEVQPFKKEENPSGLLEESAFATLFPKYRGELALGNWLGRHALTGSHHQEAHIARSKLPAPVQPLVDTEKYLREVWSAVTRALKEHGVACELNLVEGSMSVRTTLKTYDPYIILKARDVIKLLARSVPAPQVRMQQGCSGWRLLRRTRRASLDLGEPLELTHLCNALKVLEDDMQCDIIKIGGLIRNKEKFTKRRQRLIGPNGATLKALELLTGCFILVQGNTVAAMGGWKGLKQVRKLSRSTTGRMRTDMCIVDKRVRSFPVRHIERALRCLALWLTLPSGLQLDCIKNIHPIYHIKTLMIKRELAKDPNLATENWDRFLPNFKKKNVKRRAAVIKPKAPYTPFPPAQPLSKVDRMLESGEYFLTKDQQAARARMAKSAAQASKTDERKRKREAEFVAPKEEAGARGRDVEAAPPAAQESDAAELAKSLKKKLKKKKQKE

SEQ ID NO: 16923 - protein, 76 aa, Chlorella protothecoides
MSTSLSSAGVASKLRRGDYLRPIALHIRDALLGQSKTKAPCSEALHCAGTLAVALGRDWQPYIPLLLEPMFQTGLS

SEQ ID NO: 16924 - protein, 100 aa, Chlorella protothecoides
MDIGAFGVRLLCRHQPLLPCPCQVVTDQIRLWDKELRRLQATRSVLYSNFESADLFRRFAEAVRHLAVYVGQEKQQVVVPAEHHEHCKAEIKALKLELGI

SEQ ID NO: 16925 - protein, 303 aa, Chlorella protothecoides
  MOD_RES (130)..(158): Any amino acid
MQTSATSFSGGRLVALGDRTRPHSPGCFHAPRCSSFIPPQTEHTFGRGELPPRHGSIPLQAEHTLGRGELPPGHGFPAHLARDPRPPGRPAPDLFHLHIIKTQCFGYTAPPLAASWWVQLDAYSGLGILXXXXXXXXXXXXXXXXXXXXXXXXXXXXXLLWPPTKSPLHSAPQTMASAASSEQASAGLPGSFDIPAAPILIPEGPWKVIDGGVTAPAGFKAQGMYAGLRAKGDKADLALVVSDTPAVAAGAFTLNVMAAAPVTLCREVLAAHETVRGVVINAGQANAATGAAGDRDARAATAA

SEQ ID NO: 16926 - protein, 130 aa, Chlorella protothecoides
  MOD_RES (21)..(24): Any amino acid
MPRDLSRPASPGPPHHHSGPXXXXLCRQAGCRCGGSPRGLWVSCQGIRHGLLHPDPLIITQAQLRGLIGDYTGGDEALFSQAFEALDMLNSCLADPSAAQPGADAGAPSPSEPQAAPAPSRSDAPLISFD

SEQ ID NO: 16927 - protein, 225 aa, Chlorella protothecoides
  MOD_RES (31)..(34): Any amino acid
MEHCDAEPGRQALRPPLRPGVGPRPGCFASXXXXCAWSIATPSLVGKRFGPPPRPGVGPRPGCFASRGTGQEILYCIVVHASYVAWRIMARRPQGGGWGSSVEIRPRRRRVGKGAACDGGATQQVPLSFPGVEARPRGVGEPATLASPSPSWAVCKRPSPGRPWLPAWPSPCRSCRAGTPPSWPGSRGLPRPGCGRPAARRWPRCRWPPSPPARPWASGGWCARM

SEQ ID NO: 16928 - protein, 76 aa, Chlorella protothecoides
MHGSVPLMHGLTIFPAFHQVDEIRELSVLAKDAAGILWEMVALGETGPAATEMRSTAEQLQVRAGGFWCSSLVPAG

SEQ ID NO: 16929 - protein, 194 aa, Chlorella protothecoides
MGSDSDLPTMRAAAQVLAGFGVGVEVEIVSAHRTPALMAEYAGGAAARGVQVIIAGAGGAAHLPGMLAAMTPLPVIGVPVVPAGARLDGVDALLSICQGGHPPGGDRLVGSSGPELTRSTSSHTNPQMPKGVPVATVAIGNAANAGLLAARILGVADPEIQARMVEYQRGMTDTVMAKREAMAAQGWDAYTPPS

SEQ ID NO: 16930 - protein, 84 aa, Chlorella protothecoides
MSGSAFTRRVNDFKTKFQSLLGAKSQGYDELDTLERPLFSAQDETDDYERTHGVAAPQSYRPPNTGGATGAASFTAAAAVPSQV

SEQ ID NO: 16931 - protein, 231 aa, Chlorella protothecoides
MPPRRRARPLKGGPAGRVHHISSTDQWASMLEKAGDRLVIVQYYQSTVLVCKQMRLYFTRLSGQPNFQKVIFAEVDVEELQDAWSAGMSCRANADVDAQRPSSITETGAGGGSGPDPDLHLLHPGRARRCPTPRTPLPASPQKYVGGTPALVQSLVDQCLSKYCNTSRSGKAELAVKVAVAVGAVTAGEPGLNSLRNVFWSGGRGLRIVLVHACHEHKLSEAPAPSQSREA

SEQ ID NO: 16932 - protein, 381 aa, Chlorella protothecoides
MRTSAAPKPASLPVLGRDIKVEIKTVQTASRPIRMVVPDVDQGLQGPLLVCGLALRGGDERPPDRHGSPPAQRAGDGVRPGPRRHISGPAWWGCLAVGWYGPLFLAPCCPPLGVLVCCPAPSAGQPVRLGLQHDLGAWCSLAPTPLSLPPPTAYPPLGTGAASVRLYDQEPLAVQCALLSAQLNGVPVVQQDPGPPSIELMPDSWWDCLGEGPPRPAAEGCTPVCAAQYDWNSGLGLAPADLVLACDVLYDSAFVEVGEGWQKGGEGGGGESCLGTAAGLTKSILGACDCRELWAWDPLARLLPKLLARPGSRLVLTDPTKRTPGHRRQLLERLTGPGADLALMQRTEVEALAGDPPASDVQVLVLQARQPGDTLGVPLDD

SEQ ID NO: 16933 - protein, 308 aa, Chlorella protothecoides
MGAPASAPASAQLSAGGVGGGSPHHSVRSLGDPGQLHGLPGRPPSFPGVAPAPGVASGGLPPFVSAHPPAAPSSRLPSVGSVNASAAPTGTTTGTSATSAGLGSIPSWLLHAQTGTMKVVVTSGGAFARLTSVEFDYSGGETRLVTVPVGCDLSTLRETLARVTRTSGASADNGAGRSGGEAGGAPHRAPVLKYKLPSDPSVWVDMLDDEDVQMMFDEWAEFTGGRRSAARLHLFLEWQRRGTGASAGEAGVTLSGSRSLRVSAGLGRVETVREVDEDASSGSMAAEALAVQAAIDSEEGAVAAAAAA

SEQ ID NO: 16934 - protein, 527 aa, Chlorella protothecoides
  MOD_RES (50)..(52): Any amino acid
  MOD_RES (400)..(403): Any amino acid
MRARWIRAPGDWRRCVLGALSLIQRMRPRPSPALADPWRAAPLPSCTTPXXXRPGCAQPDLADAIPSLACTRRSVEGSTSAFLYHAVCTLVFCRVWLWHLTPQAAALPGAQGFGWFFRYLTFCSFTLQTILFFSSCLSELVKSQETRTRLRAATNNLGCALFPIANTVTLMFYAVENATNVCRHVKRGVFWVSGCDVVCILGGGSLAGADRRTHPTSRHAPAYSIPSLSARVITSTSPLLLTTPPAPTPPAPTPAALHPHAAGPGGARRLQPPRLARLLGSLREQPGGLGRHPALPPPRLCAPGAQPGHCAGPGLLCLVPGSARRVRQGEHVLLLRRPAGSCRGGLAVRGRTWSRKFKHAQRCGQAAGHDGMSTLAQVVGLGCNPLTHDPPFSSAQFPYXXXXGEGPGAGNSSTPSAVARRPAMTVEHLGTCGVIWMQPPHPWTPLLLCAVPLPPPEQAAPGIRLLWLLRGRHLPSPLLLPGGGRGEVEPAAPAVACAPGADQEDRLRGRGAAEEAARRGPGRSGPA

SEQ ID NO: 16935 - protein, 441 aa, Chlorella protothecoides
  MOD_RES (148)..(151): Any amino acid
  MOD_RES (269)..(272): Any amino acid
MLLPSSRRGNSAVGTPTLSRGLGSLGGRQPAQPPASGQRDHPAHRPFHLPSPSATPGLHGDAHEGQAAAPGKGHGNQIPRAGSELPRHPRYGAYGLHGLARVCIPGSPGRACEREGPPGVPAHLFERESLCANHLVRGTLLVTPTASXXXXGVPLCKPSGLGTLLVTPTASHRIPLRSLALPPGLAIKDYWSVDDNTVVLVADPTFGNVLNFNIGINIDSFIPRVRASLVIWLGMLGLGGGTGLAAPGRPSCSAYVLACLVGEVLRGSXXXXAPGRPSCSASVLACLVGGVLRGSTQSPLSSFPPATTNLQNFWSKVAGRFGNKFYVEEQGRDVAIINAVAAVDHCLREPIDRTQCSEIRGELEQEEARAGTCWGMPRGVPTQRPCTATSHRSAQSAPACGKVRREMPGQSSTVDEQAAAAVGPAAWLASCIARDRGGCAV

SEQ ID NO: 16936 - protein, 391 aa, Chlorella protothecoides
  MOD_RES (68)..(71): Any amino acid
  MOD_RES (332)..(335): Any amino acid
MQAGEVAQAGPDAPLDAGPPEATPVVQASHASFSWDAKCEPLLYDICLEGGGVADSPLSWGRLLFLIXXXXLGTPSASRCCTTSAWKVWGWQIRPCLGTPPLPHLVCWTLERDMLCSNGVTRWGETCGGHSPCAGGPGLALSSPLGPVSPSGPSLGARAVSPDPHRLQCLAPCQAPPCHHMPHHAQYRPLPPVLPTPPHQGTSSVRGRVAYTAQEPWIQNASLEKNVTLGAARTAAYDAAVAACALGQDVAALPAGDATEIGEKGVNLSGGQRHRVALARACFADAGGDGEWATGCPGAVQRDPCSARGRNTCTEDDRSEIMLRRNHASPGXXXXPCSARGRNTCAEDDRSEIMLRRNHASPGRGRSKPCGGTAGAATCRQGEEAEVRKMH

SEQ ID NO: 16937 - protein, 450 aa, Chlorella protothecoides
  MOD_RES (252)..(255): Any amino acid
MRENGSEGWGLALLLHGRHGDCMLQDQFAGLPCPESTARHSIPTDGDSPPPHAALQSELAQQEAENFAYRNRLQQREAELEQREAELEQREAEVQEKQAGLQQGVQVTAQGHEASEARLKEREAALIEIEARVRARTARLHDWSTQLTQSRSDLLGRLAAIQDWERSTTRWGAASLAARENWVVACVGILTKREDDVSRQERGVGKQLAGVEVGGGPVETAMVCGRGRHGSRRAGSGGMIAAQGPSQPVAHXXXXVLTKREDDVRAGMDQGGQASGGCLQCKVPASQSHTSGRGSMTTRASGAPAEPGAVAPQPPAQLEPLPSPHATPGLAAHSPVPPCTPSGQGPAGIADQPGEHAGEGGGEFRCGEPAGAGIPAHHLRPPRAGAPAVEFMGRRHRDAKHAGAASSALPCEWLREEDGGQSRSELRPVHYRGRMHARRTWPRVPALVRR

SEQ ID NO: 16938 - protein, 538 aa, Chlorella protothecoides
  MOD_RES (246)..(249): Any amino acid
  MOD_RES (493)..(496): Any amino acid
MWVPLMCWIVCKSGSAAFNSVYLCPEQGSAADPASNTVSQGKLWTQSHSYTHFFPLPFHNHSLARQSATHGAGADRQLHLLCLLGALDQAQALWLDRQLCPGEQLHCAALVGWTGVTREESGEWDEVCVFLDPASTGCGPWAASFRLHPPTDPLRPAATGCGHPDDAVLHCRPGHCHRQRLQIHQRQGRRGGLCHAPALQSAEGGRCMDLCVVSRLFPKCLNCVLLCPTHQSMPAPPVIVPSGPQXXXXWALPSSTTSSPSKAGSQGRSVSRSRPAISRRRPLYGPVCCQQAVPKALELRAAQPHSPNHACPSSHRTFWAPPHLPLLPRSGDRELGLNSLPVAFGIEKAKWICAASIDVTQLGVAAYLAWGLNEPYYAAGIAACLAPQVRPCPGGVCSSFVGPCLRRDEAGRHTVNATAVQVGKGRAQSSHAVHASPTAPSPICSPPTHPNPSAGVRSGALLSPRPRGQRRQVSGHGPALPRHWPAGHGTGHXXXXYFLPDPVANDVKYQATAQPFLVIGLLVTALAIGHQATPVALG

SEQ ID NO: 16939 - protein, 351 aa, Chlorella protothecoides
  MOD_RES (343)..(346): Any amino acid
MQALEYIRLEYSGISGGLDLYKPGNNKFLRCSHGRHGVLYDLEPDDEMCRCCIQGAIIHAGTKDLVCARVKSPESQEGRVRWAESLHAKKVGKTTEAEVVPDAPPSKGSAAEDDPNRAFFLGVKGNAQMLGIRGAAVETDIWKIRLQLTKPVTWIPLIWGETCLVSCCPLNLASGKRQAILPSLRMPAILPRMIPSTQPHDSAGVICGAAASGNFEWTFRDCALSALCMLMSGPLLTGFTQTMNDYYDREMDAINEPNRPIPSGTVPEPGGRVPKDPHAVLLSFSWVGLERVVMRSSGQANSSTRNLLCTQQAPSLRGMLSRRSGSSSSPALQWHIRWIRHHXXXXCVAEF

SEQ ID NO: 16940 - protein, 133 aa, Chlorella protothecoides
  MOD_RES (15)..(18): Any amino acid
MQTDVTYSILVLAPXXXXGNLCWILFRSPAHGKSIGRSDTMQADLTYSILVLAPQEREVPLGKAGGLKKVAVTRPIGSPPPDEAEDTSRLAVPQEVTDRMLRRILTFAGLPVAVSILFLPLFYFLKVCAKCSG

SEQ ID NO: 16941 - protein, 128 aa, Chlorella protothecoides
MIFRGGRHGVLILRPHHAPSQPLNLQNRSKNRLLAKHAPGSAGAMRVEGAYDSLFMHLMRTRLAGDTAVPNKVKYADVRPRPKPKSKERVSGRHGRGMLCKRMYCGNTPFLPSGLGSIPVPHSPSHPP

SEQ ID NO: 16942 - protein, 406 aa, Chlorella protothecoides
  MOD_RES (188)..(191): Any amino acid
  MOD_RES (219)..(222): Any amino acid
  MOD_RES (303)..(306): Any amino acid
MKLVSWEWTPCMGFFAVSVIPADAPARSSFAESNPSQSSQCARNKPHPGMHPCVVPGPASPIPRCTYAHAQALGWVRSRFQKHVACARKPGILPDHCQIIPKRDESSGQILLSSVHRALQRGMLGIAGLASVILLSGASPAHAVNKNQLLYLEAWKAVDRAYVDKTFNGQNWYKVRCQEGRGGSWWRXXXXSRFQKHVACARKPGILLDHCQTISKRDXXXXIDSSIALPRDPHSRSPSPPSACTSNRLGSRSCSQSLLVTGSRRMPPSGSCWAPWGTPSRATSALTSMKHSSMRRASLLAWXXXXMARTGTSVPIREDVHNSTPSSDRIEHECPTWALLDMLRLSPHSTRPPLPADGPPAASCPASGWRWGSAAIRGRPPAAPRCSASCLAGPPTGPAWQRGTPS

SEQ ID NO: 16943 - protein, 190 aa, Chlorella protothecoides
MRVHAAARQGSWAPKPMHRPRSHIGFVTQASYGSGNYGPVGGDARIKVIGVGGGGGNAVNRMISSGLQIELGCCEPLMAGRPCTEAARCSRPHPRHDPQGVEFWAVNTDAQALESHQALNKLQIGTTLTRGLVQLKGWACDMNASPNKSRRYGWQARAGGGGGAGVSPGAGLGRPGRRHGGLQYGMGWKL

SEQ ID NO: 16944 - protein, 137 aa, Chlorella protothecoides
MGGWWLGGKHMKPYPTFLEEVEAKVPKDASIIVACQKGLRSLAACEVLSRAGYRSLAWINGGYDTAQPGELPVEGDVDVRLAGIGGLSSVLGWTEPQREGQGGGFAGGFQNILKGVAVILLLDVLLFGWELIQASKQ

SEQ ID NO: 16945 - protein, 148 aa, Chlorella protothecoides
MPAGLDSGVSEGGGSLSQGQRQLLALARALLRHTRVLVLDEATSNVDTATDSMVQVRRGFWGVVEAARGPLTPTIPGTTQGTIARAFASCTVLTIAHRLHTIMRSDAILVLDAGRVAEFGTPGDLMRQPGSAFRGLVTETEQGGKVGA

SEQ ID NO: 16946 - protein, 197 aa, Chlorella protothecoides
MFKAQSLTLLYLCQERRLLAKPSVGALGEALLFFGCRRRDQDYLYGSQLEAWAQEGSIQLFTAFSREDVREAGGGADVPEAMCLALTLHGGVTALVFPCPLIPCKSHCTSKPHSLPVQPEKKVYVQQRLVEAGAMVWAALQAGGHFYVCGDAAAMAGQVEEALLGVIAQHSARTPQEARQVLDGMTREGRYQRDVWF

SEQ ID NO: 16947 - protein, 166 aa, Chlorella protothecoides
MVWSGPFQVLRPRAEQGSRCTAPGHPVAHSPSLPHIDPGDAVPLPPRQVHPLLADLRGVPRRQRRDVLSQGASSHRGVVGSGPRRAQRHVLLQAGVLDPGLLRRVRHPSPHRRRPLVGWGGEDRGKRAVLSVVRHVMAWRSLAGGQALKAMRVRRNCPSTQTGPAR

SEQ ID NO: 16948 - protein, 229 aa, Chlorella protothecoides
MMDFHACTWSSVPGLSPADDSIARHMDSLNDPGTARVLAALDAAEAVSGVRPPLITFSHFLPDQRLLPEKRMLHHPNLAKAVGSDPLAARIARLRPAAHVFGHTHFSWDAELDGVRYVQWPLGYPAEQRRRGRPAADWRPMLPLRGRAAHALGSHARTLGRRLTARRGAARRRPGPGARPPRVPPAPPGGSRAGPAAHAAGQPAGLAGRAAAGRAPLMEWQVCGASAPR

SEQ ID NO: 16949 - protein, 214 aa, Chlorella protothecoides
MLGVGVSSGKNRAEEAAMAATSAPLIERSIERATGIVYNITGGRDLTLQEVNRVSEVVTSLADPSANVIFGAVIDDAYEGEIHVTIIATGFNQTFEDQLLSGRSVLVGLWGMRIEVRVSAEIMRGQCGEGSSNGCGIALGHVLSGQTTFQQHPPSAPHPHPSPPLHHSILQPAQPDLSRASNAKSGNGPASRQAANGHASSLGGGGGGFLGRTW

SEQ ID NO: 16950 - protein, 251 aa, Chlorella protothecoides
MDLRNNGGGVFAQGVAVAQQLLAEGTEVVLIADSEGVRERYEAEGGAMLDEKVPLIVLVNSRTASAAEARGARALWGGVGTRSPVFSVPMRVPAQVSRSADGQIATARNMKSTSPGAGRQGTTASPPPSSSPHSPFPPLHFCAQVLAGAVQDSGRGRLAGARTFGKGVVQTLTPLSDGSALAVTVARYQTPAGRDINRVGIAPDVEADLDGVPDNAAGFCALARAGKLPGALLDGTSRGGGATPALAQLPR

SEQ ID NO: 16951 - protein, 184 aa, Chlorella protothecoides
MARWRWLRRDPAYSALGAEEATSATGAPGCGRAGHAMCQRQRLLVTHLYQHGSAHRCTGGAWCPEQGAGLVSRLLFTWVDPLLAKGLHKSLDAEDLWGTMPEDAAGEVAAAFQWHLASTASSSAQPHGRVHAALWRCYRGRLLWSGVVKLLHDCVMLASPVLLQRLLVHVQQRWAGGRTLHAGA

SEQ ID NO: 16952 - protein, 141 aa, Chlorella protothecoides
MEVWQKGGPQGHASPHWRCGAVDQHELRGEAAGVCQLRDRGARCDRGAAAPPGLADPGEYRGGRRGRLSQVLSRAPHQPPSHHSDQGALAVEGLSVRYRPSLPPVLHDVSFSLPAGSKVGLARGEGGGVGRHATWHAVDAL

SEQ ID NO: 16953 - protein, 195 aa, Chlorella protothecoides
MVEAPLSWLLSHRRLGASGWRARGRARDACSDGLQGLCPHSALQAASTAPALLHDDRADALAFLSPELGSGQTKRKGWSRNRPYLATVSAVEGLCALRGPDDKNTGCLCGTAASVRLTATPPSLPVRVEISLGESGLQYLPGDALGVWPSNDPQARADGAGSLLSGRAAAGRFCVVLGRQGLAATAIAWHRAAIV

SEQ ID NO: 16954 - protein, 368 aa, Chlorella protothecoides
MSPMPALLILLEHVPVPQGKDAIPWIEKLVVGDIAGLKDGTGTLSVLTNESGGIIDDTIVTRIAEDELYLVLNAGCRDKDLAHLRKHLDGFSGDLTLEVMDDKSLLALQGPQAVDVLQHTLPGPLPPFPTIPPFPTRDAPSSLQLLPPLPHHTHQHTQPLVKEDLSKLYFGSLLKAEVKGVPCYIARSGYTGEDGFELSIPADRAVDLATAFVSDDRVRLCGLGPRDSLRLEAGLCLYGNDLNEGVTPVEAGLTWTIGKRRREDFSFLGGEVIKRQLADGVKQRRVGLLSSGPPARQHSPILDGEGRTVGEISSGAHSPCLKKNVAMGYVEKALGKAGTELKVVVRGKPYDAVVAKMPFVPNRYYKGA

SEQ ID NO: 16955 - protein, 154 aa, Chlorella protothecoides
MEGRPAWARSPLGNSCTPRVTPSTLKRSVSRQAGGLEMENAQKRWENQVRDGRVRNVRAKEVPGLLKDGWTLLDGCTPLPPVPPPRQVRDGRVRNVRAKEVPGLLKEGWTLLDVRPSSELDKVRAGAGWCGWEKDQWRITAGCAISVMNVSRRH

SEQ ID NO: 16956 - protein, 186 aa, Chlorella protothecoides
MAGAGLGAGALLYYLTRPARPPVAGPEETGFGAYLRDLSVGVPTHGVPAPQTFEETSFEAYLRAAAFKSQDHAEAGSASGEAESAPPTARPVTIVFGTEYGFSKEIAERLADRLREAGEGPVVLDMADHAEGVPPLTKQQALAVVCSTQGDGVPPAEARGFCAWLASLEAAEFKGVPFSVCALGDT

SEQ ID NO: 16957 - protein, 159 aa, Chlorella protothecoides
MRVIGVVSAVTGLAVTVALIPLLTLLGKKLASIRKESMTLTDARVKLCTEVLTGIKAIKLYAWEEPYRLLITDLRQQVMLGQEMAVLKPMGVVTRVPSQHHAAPFCPPPLQALRHHPPPQPGAGANFVVGAAEHRELARLSGRSHHHHHRCGWRGGTVL

SEQ ID NO: 16958 - protein, 246 aa, Chlorella protothecoides
MTLPFPPYPPLLHLQGPIAGRGAEAVQAAGRRADGGGRCPGAGHRAGAPRLPPASLHRQPGQEPGGRHCLLHPRPHLPHLCAREQPGRRHGQRCAIRDGSGGGGLGGGGGQGTVAEGLTGARVPGDTQSVQARRMHGALVPCHLAALPLCALAPDAPPPIACAGAGESVANLADVVGTAFGIALARAACPILPAFLALSAGYLYASRREVDSVVLPYLNRARLAYSMQHFAATGGSRCATRRGGGG

SEQ ID NO: 16959 - protein, 422 aa, Chlorella protothecoides
MQQGSAQWGVGCSSHFLYGTPKPMNSHAMPPLSMDRNPQGAKRAQQRRIPGLSTDFHGILRHELLGKTRVWCRSLEPNAPRDLPPLCLLSRCRGLCHPELILQVLALLIRMALLFTLPGQEEGRSSALVQRHQLVRTPIPKGHVDPGHPHLLLSRGVHKDRILSIAGQYSATPTLGHQQLLDTSSLTSVSGKSAADVMPGLPLSRKPEGGGQPDTGANTRGSTRSRKMLQKISAAIELVAFGRLCVSMSIRSSPPACKKLVPQGSVWHAFHHQGTALHASASSRSRKGGLHDDVVLIETIIDLLTLRPTPIHHGLLTAAIRSRMSWLARHAARYINQPGVTVRQCLPSRDLAPLAAAAPSLGSFLESMRALVPSLADMGLLAVPKRKVRCRGLALPVMEEAACMGSRSAFDGCMQRSSTSPC

SEQ ID NO: 16960 - protein, 64 aa, Chlorella protothecoides
MRVARIDMAFRDRCADKLVPLNKCRRASFFLPWKCEEERHAYEKCEYLEYKLRVAQASAARQEA

SEQ ID NO: 16961 - protein, 236 aa, Chlorella protothecoides
MPKKRVLSPQSVWDEPALRLAFDRAGVKALHLPPLYRHLLRHPDASWSDVPDLPRAAVDLLTRDFAAHTTTLVHAQTSGGGDATKLLVRLQDGLQVEAVIMQYDTTSAPPAAPDGAAPPAVTGSQRCTLCVSSEVGCAMACTFCATGTMGLSADLTAGEIVEQLVHARRQHPIRNVVFMVGKGRGWVKGGWMGWGTGGRATLKRAEMLVQGAVVTAVRSTAVRPPPDSCLVSNRRV

SEQ ID NO: 16962 - protein, 197 aa, Chlorella protothecoides
MGEPLNNYVAVRAAILTMVDPASFALRRSAVTLSTVGVAPRIRQLAADLPGVSLALSLHAPTQELRAAIVPSARAYPLDRLMAAVAEYQAASGQRVFVEYVLLGEANCRAEHAHALGALLSGRNVVVNLIPWNPILSPAMDFRGPAPGQAAEFAAVLKEQYGLPTTIRQEKGQASEGVEGGRRLAEEVGNEAMVGRV

SEQ ID NO: 16963 - protein, 200 aa, Chlorella protothecoides
MAGAGLETSLDSALSVTAPRCSSSEEGLDLSSSTSPRSSTGSGHGTPLQSNLIGDVVAPETVQWVQPSGPRQQGQGTEELEQGIVSAEPSPTGGMHLRITLLAAGFVIGPSGASIRDVCRATGAEVWSWTSPGDARCRRPTRTFRVEGPPASVRAACAVASEAVERYKDLCEGRFAGQSVPRIHRIRGVDFAYQPPPRGQ

SEQ ID NO: 16964 - protein, 454 aa, Chlorella protothecoides
MGFSKEAAGPLNALSLLSCCSTFDAIHAARSSAPAWTGYSSSDPCQLEQTKCLHQERQEGNDDGKHARLALGSCVRRVHGPERHWVHAGLAGRLQISVWSSAVRFLSSGAGLHAPCAAHDQHSNVHEHTQRGPGEVRSASLSPPRSSFRGAMAAMKPVLNREAADQKAIGVLKRIDPDIEELLATVSHVVLYRFNPEGPAWIKTDVEGTLYVVKRRGQPRFRYIVLNKTGKGGWGGRCGQRLAQLPQQCPPCSPPLPVAEDFMEDIGAGFTSEIHKPYIMYRTDIDEVSSKLEGRPCTMFESCFTPTCGGRPAPPTHRPCVHAQVVGLWCHTEEECQRLGALFSRIQSLVPGNHASGAASILMGAAPEPEEVPTEVAAILGAASAPAAAPAGAPAGAPAAAAAPRRPQAAAPQGRGAGPQGRAPGPQGRAPGPQGRGAAPQARAPAPAAPAATP

SEQ ID NO: 16965 - protein, 310 aa, Chlorella protothecoides
MWIRDACLIPAQALHRLFKYCVPSSSLPIALLLAPAGVPAGVNARRDLQVWQGLAVLPDRVPIHPPPIAGCAGGFSESASAPTNQQKPLSLNAPRSYLQRRRDQRGPYFTYEVIVVDDGSQDATVGMGADWREALAEALGPRDIIFLGVAAGLGACGRCAAKFTRKHGVDALRTLRLPQNRGKGYAVRAGVLVARGDHMGAPGGGENGMACQCRGVSLRAESLPEWHGGLKSIHSTHRSGQNILLMDADGATRVSDLERLESAAQDVMQQGDLGWSVGLGLGQPEPLAVLLRAVLRASRRVTAVLSPLPG

SEQ ID NO: 16966 - protein, 108 aa, Chlorella protothecoides
VLFSPDGRVIASASFDKSVKLWDGAKGTFIGTLRGHVGAVYQVAWSADSRLLVSGSKDSTLKVWDARTRKLAMDLPGHADEVYCADWSPDGASVASGGKDRVLKLWRQ

SEQ ID NO: 16967 - protein, 225 aa, Chlorella protothecoides
MHPSAPSFHPVSRHAGFSKVGSLRTSTLHIMGLSMSAIRVSNLEILSARSTVVLTAVECLKPGQKACSADSDGNIGSGNRGKNNFGTKNVGDDNIGNSNVGTANWGNNNKGTSNRCFDKTGNRKIVNDCSLQEFRKHKGFSKAGSVRKSTLDIMGLSVSAIRMSTLEIVTPRSTEILVAVECLKAGQKACTADSSGNIGSGSKGKNNFGTRNVGDDNIGEQSRGC

SEQ ID NO: 16968 - protein, 219 aa, Chlorella protothecoides
MLSAGQVGLRASWTAAVPIVIHTPSSTRRSWCPIRRVPHPRAAHTHPSPPPQVRFGVLNAGNFGVAQSRKRTFIWAAAPGEGLPDWPRLMHAFRTPQLTINLPNGVQYTAVPQTVRGNGVKAGGWPAAGAQNPVDLCPLHHAHCTPTPQHAPPAPPRASLSNAHTLIPPRQVGAPLRPVTVRDAISDLPVIANGHDVEEMEYQGEPVRSRGSWGGAGEL

SEQ ID NO: 16969 - protein, 326 aa, Chlorella protothecoides
MQGSHVGLRAWGIAQLIGVESSGKGKGAACTLTVRRFYRPEDIHEDKAYEAPSFHAVSWDGGPAWRVGRGSACRKLWPTTPDPSSEPPCPKNNPSHPGSASDASNAAPASAKAADKGKAAVDAFPGDDGVSLASMDIFAGCGGLSEGMHQAGAAHARWAIEYERPAAEAFRLNNPRAATFCANCNVLLHAAMVKGGGADDCQASPEAVAESEALPADQVAALPLPGEVDFICGGPPCQGYSGMNRFNKGNWSMVQNSMVMSFLSYADYYRPRYFLLENVRNFVSHNKSFTFRLTLRCLLDMGYQVRDGGRVGGGLDARGGVADHGS

SEQ ID NO: 16970 - protein, 1546 aa, Chlorella protothecoides
  MOD_RES (96)..(99): Any amino acid
  MOD_RES (140)..(142): Any amino acid
  MOD_RES (188)..(190): Any amino acid
  MOD_RES (901)..(903): Any amino acid
  MOD_RES (1084)..(1087): Any amino acid
  MOD_RES (1440)..(1443): Any amino acid
MHAWRVARHVQREDQVAKSERKGGGRDGACRSLSAANAGSMKVGPVRGSMNPHDRAPTGSSRGFSTTASRPGPTPIHLTCTPSLDSMKRTYLCKGXXXXPWCALQPLGPPASTVHQTIRTQPTGFTPRLRHTHFLAFSGXXXWEEGVTRGTKGLALSAALGFIRPDAARRAPPEHIHIHSAGPGPSGXXXSFIPPDTARRAPPEHIRIHSAGPGPSGSATTVLPGACLADVLLPPGQRLPHHLGALQGLQVCGDGGQVPLRGPVPHAHPDLLQPVQHVQLGEVEVGQAVDAHRVAQGHHVQPAHAARPPRGGPIFGAHLAQRVGQLAVDLGGVRARADARGVGLGHADGGAQAAGRQAQPHHHAADGGVGGGDVGVGAKVQVQHGGVGALHQDGPPLVRPLVERVHGVGDVGRDAGRDGAVRRDLRLHIVVKVGEAALPVQRQRAQLGGKGVRVGEVAHAQAVADGLGGVGGADAAPRRPDLLARARQLLLAPPVDLLVQVEEQVRAAADEQPALHAYAPGLGEGMETPAPQPLPTQRHGSTHEVLPGPHSMLNPRTRPPLHTHLHALNLLQEGRQVNHHAVANHAFGLGVQDAGGEQVQLPLVALRVVDGVARIGSPLCKVGCCRLRGVPDPNTVAGRGVPHGRHGCGPEAVAAWTLSLAGDRAAHNTGTLPWGFQGSLGPSVTYTGLQDSIRPTQLPKQIPQYLSTGHNLVLLGEDVHQLALPLVPPLHPEDHNDLGVKGLLRLHSGRRCTGRSAQASPGGAAGRGPPRGSNTACPLQLDSWPETAHTGGFGTRRLLMRPDKSNQHPIVVRAHIFQIVQTVGAGKQTAHIGTWNGWLSAKYELPLVLHLDFNFSTTWRPALGLQLEHDLEVELLKDSCQAHAAGERAERKFCERGNVTXXXGTCSRRTRRKEILRARGCKPRILPTPLAGAWMLQSARTSSHVIICILLLLAGPGLAAAEDAAGCRATSPQDSKCQSVRDLPADQDRCAYAETYCETDSLFDYTKAYYCHVYPTPWKQGLMIVSRVAEAKHETPTSTQSRQVLGKRARGQRTGLVIVGDVFSPPSPPSFPHSPATRLHVSSXXXXVPLWGMLVRIADADEHAEPSSSGQACKRSGHWLGHCWRGILTSLPPPPSLIPPQPDCMCPPATHPVPGDGPGRGRVLLRHPVPDLPGPGPAPAPRWGHSPCPGQWCARPLGERRGRQVWQCRVSVVGSGMLVIWDMAMGDLAWKAGQGWLSLDIARKCRLSRSNPLGQLQQTPCRPFPLPPRLALGALTGASMFVTCIVAGRVIRICGGVSARGAQIRDIAFFAAALVLIAIVGEWMELCLAFMEASLQVAPLLLPSSRPQTLPLGRSCWRSIQIPRASAQGPFLCTAVAPSQQPACILMSFTPAFRSNAPISFSCIVCSGVRQGECRRGGGPPPALHHLRGGGGAGRHQQAXXXXNAGAVAALLLLYFTYVAVVALADISKRAGVAWTRLLDPRVMCAEGGTPSPWTLSLVSRRLPPGSRLAAPAALPLPAAAWALLGSGPTGLSLAARSRHAHPRLP

SEQ ID NO: 16971 - protein, 247 aa, Chlorella protothecoides
MYGMDYVASERAEQQGLLRSALIDHVRRTPEALIVVEEYDKLDCGMRGFFRQFLENGAVGNVTLNKAIILLESNLGYLQLLGLLKASRSRAEVTAEQAQRVLKDLIFERWERQACEDRTDTLKMVGLGGSWVEAGAASHLRALFEARLERRSQALAQAGVGRLMWDAAVLDFLISHVEFDGAYPLEGAKEVAVVLTKTVSRPVRRWAEEQQRRQAPASTGKGEGADVPHCALQVVKPLGRPRQLVCA

SEQ ID NO: 16972 - protein, 389 aa, Chlorella protothecoides
MPTMRYSPARNCVRVWNSPQPATPHLAQGGANAGHTIYDTEGNKWKLHLLPSGILNPKAKCVIGNGVVVHLPSLLEEIEGMEARGVSVEGRLFISSRAHLLFDLHKEIDGRREEELAGTGKEIGTTRRGIGPAYASKAIRNGLRVGDLAHPDAFAAKLRALALDGQRRFADFDYDVEAEIASYRAIAARIAPYVSDTVHALNEWADEGRSILVEGANATMLDLDFGTYPYVTSSNPSIGGVVVGLGLAPRRLGATIGVAKAYTTRVGAGPYPTEIHGELADTLREVGAEYGTTTGRPRRVGWLDMVALRYAVRINGLTHLNLTKLDVLDGLKEIRVGVGYRTPEGDLPTVPADLETLERAEVVWETLPGWQQDISKARTWEDLPENAKK

SEQ ID NO: 16973 - protein, 128 aa, Chlorella protothecoides
MASLLLSPTVTPTTCSRRGHAACQYSTRMGCLRPAVELKRTCSIASTRRAPPCSAPRRGLRAAASAAPARVETEEPFDPQIVVVLGMQWGDEGKGKLVDILAQKYEIVARAQVLGYLLWELRWANGVL

SEQ ID NO: 16974 - protein, 322 aa, Chlorella protothecoides
GVEACRGLPVALPCAVGHLGGRVGAAATPVQGVHRWRAGCRAGAGEESAGGRGRERAGGPAARHAVPGQAQGEEGRKWGTWPVMGAGERHGWSGGWSSHVQPLASLPVLGIALGSGTCHQGIHVHHCSLLVDIPTHAFLPQEVLELVEIRLTEIAARWEDGRLSALGLAPQEVAHLVRALFEDTPARRALLTALGKARIVGMTHSGKMFMSRDRGPMYPHCAPAPATALPERGRFAAPTPRAGRSPRVTTLTPPRGYTMHARNRNATTHLKRPPAPAKASRKDCSQGNTSGPWSRPRNRPATTPTSPDALGLAAPGAFPKGL

SEQ ID NO: 16975 - protein, 530 aa, Chlorella protothecoides
  MOD_RES (200)..(203): Any amino acid
  MOD_RES (285)..(288): Any amino acid
  MOD_RES (507)..(510): Any amino acid
MRATIVLSALLLALGPVSLAAVSRLANARDVRVPPGAVGNRTGRMQVFILQPTHREVCDGNRTCRATMSLHGFCLQALPDCMVTSISVPLSQCGWSAVLDLGEERPSILPTVPGPTPPLSIHSMKGFPRGVVTSLPDTPDQLPKHLNGLDIHILDIAAMSICDGTCDLALGVECVPKGEDNCGFDGKLNIGNNNTGMSNXXXXCVPEGEDNCSFDGKLKIGNNNTGMSNEGNNNVGQHNLGARCDAGRAHTLQNHRAACQPPHPCCEALPHNAPCSPEGQPACLXXXXVMQGGLTLSNITGPPANPLTAAVKPFPTMFPALPTDSLLASALALSDALRAPPHLFLPTTPPLRLQQCRRQECWQQHCWHQEVLPQPAPGWRQVHSGHAEDCRYSGAEDRPHPTCPRELTISTNSKALPRPDSTTPTLARAGHHQRLVLQGQRQAVQVPGAPHDGTGTEGPRADLPGRYQAGRQRDGQRHGAHAVESSPSGRQRHPHHQCPCAPPSCLXXXXVLQADNAIRIASVPAPPPPA

SEQ ID NO: 16976 - protein, 112 aa, Chlorella protothecoides
MKGFPRGVVTLMFDTPDQLPKYLNGLDIRILNIASMTICDGTCNLALLVECVPEGEDNCNRDGKLNVGNNNKGMRNTGNNNVGEHNLGACCGADGRADSSLPGGLLSPWCSL

SEQ ID NO: 16977 - protein, 339 aa, Chlorella protothecoides
MTCQVLLKRGSSFPKDAPSPIIVCTRNDALEGVIESVPKDRHGGGLASATQLLVYFAVAKAGDTPVDGKTDVNPEGLTSVWGPHSEAVAQRLAAGGLACKVRARLEQGLGGSVRGACGVERGWGEGEASRFSPCMRGSRAPGPRHAASQVLDRPAFLQAMLEKLVWISAFMLVGVTHGGCSVGEVERGSHGVGGRGGGPCDGFHQYQVAAAGPPGPPVWRGRGLEVRTRSQGGCMSGRTSQLRARRQPAHLWRKPPLPQTAELVEELASAGAAALGVRLEAGAWERLAAYARSVANYPTALKEFEWRNGWFKELSREASASGKQDPCPMHTRLLAGLGY

SEQ ID NO: 16978 - protein, 138 aa, Chlorella protothecoides
MMARAPSGVSVAEVKPNRPPTVFESRLYAVCKSIPEGKVSTYGAMAAVLKSAPRAVGQALRRNPYAPAVPCHRVIAASLELGGFSGQWGLQTPNVCKKRALLEKEGVLFDARGKLVDESQCLGAEELGRACRAAGCEA

SEQ ID NO: 16979 - protein, 188 aa, Chlorella protothecoides
MSHGILLSTISPLPSPQTPQLLAAFGGMRDQMMQEDLAAWIDMNDIYPGVAEAVRRLVADHEAYIVTTKQARFAEAILHRLAGVDLPPERIFSQAETGAPKSEILHLLEERHPGTQYHFVEDKALTLHKARGGRGEGRRGVDERPGGGRMSHAAACPLEPVPCGLGLQHARGEGGGAAARPHQAHLPG

SEQ ID NO: 16980 - protein, 384 aa, Chlorella protothecoides
  MOD_RES (102)..(105): Any amino acid
  MOD_RES (252)..(255): Any amino acid
MHAAPNPVVMLKALEVGWDGAEMGLGPSSRRGTVMTHLSISTLSTPLPSTGPDLCQRRRPGTTPQLALPCVLGRRPLADPRKKAQTPPQTPAGPPTGHHLHXXXXGPVFWAEDPRPTLGRRPRSHLKHPPAHPQDTISIIQETQSQHGIAGNSLLNFCVSDGATLVATRYTSSPDEEPASLYYAEGCSYDRSKEGVEESGIASAAAAASDPGGQRDSGTANASSKAVAGMPIPALRLIPFRLPTPLPSTARXXXXEAAVDQSSRGTRWDAGMLIPALRLIPFRLPTPLPRGRLPPDLLGAGLARLPDRIGASHLQRVGLGGGAAQHCVGGLPRDQWRAVRHALAAGGRRGEPAPRGGVPLPGGGDAGRRGQAGRARAGARASRG

SEQ ID NO: 16981 - protein, 709 aa, Chlorella protothecoides
  MOD_RES (150)..(153): Any amino acid
  MOD_RES (320)..(323): Any amino acid
  MOD_RES (499)..(502): Any amino acid
  MOD_RES (559)..(562): Any amino acid
RWARWRERVARVDKDVRRTDRGAAPFAREGGAGARMLRRLLLTYAMYNYDLGYCQGMSDLAAPILAVAMAGRGGGRLARDQQAEVESEAFWGFANLMEGVGANFSTDCTAGRLGAAGAPRVDCMDGAPTPFVPGAQGDARPAGGPAAAAXXXXGAPRVDCMDGTPPPCVPGTQGHACPAGGPAAAAGAAGPAPARPPPSPRLPEPVLLLPLAPHPVQARVWLRPGAPPVGSPVDGGAHAASPPLPGRGGAGLASPRHPDRRRRLRRHAAPVPGAGGEAGPGGAAEGRRGAVRLCRGRRPGGGPGPAGAAQAGAYVRGVVXXXXGGAWGGRRCPGPARAGRHCPPFTNIQEAVCPEVCQNLWGVPPRRGRFSFPPHGRSRGANFESDEVGLKGSRAPNTIQERSTLSPFDPSTCHKYIRAQAAGPFIGQDLGLSCTMGICWCFPRTRNGWEGEGASAPAQLSEALLKQPEAPATDAPIPARIAEDSPAKSATDALESTGXXXXAEGSPAKPATDALESTGTPGRSSAQVIGDSIMSRNLEVDARPSNSITKEAAEPQPPXXXXAFASEPQEPAARSEPLEPVVPAATEQTSRSEEVLPSTPAPPAPTAEEAPASGSLLPQGSPSSASIAPEPEAPQERATAQQQGNKKNQRKRKGKKGKKAVQSLQVNGKLDTGSHVNNGTNLGISKGGIKMKSGHATRLLAQCGPAEGR

SEQ ID NO: 16982 - protein, 266 aa, Chlorella protothecoides
  MOD_RES (115)..(118): Any amino acid
MPGAGGGALTLGGKVSMDCRELAFQRPGCLGQPPCAYGVDNTHKYGACPPAAEERTCTKTMEHRAHHDDACGCHADPAPASQSLDEMAFAASACSAAQSGDLKGLQRLYDRARSXXXXCAYGVDNTHNYGAWTPVEEERTCTKTMESRSSGYTPLHFAARAGHDHIVAWLLKQGDYPSVASLEQQCLPILVTYYFHHIAISGVEVNATTTAGRATPLHRAAYMGHASICRMLHEAGASCLLRDADGHTAADKAEAQVRQPGCRVVW

SEQ ID NO: 16983 - protein, 630 aa, Chlorella protothecoides
  MOD_RES (368)..(371): Any amino acid
  MOD_RES (405)..(408): Any amino acid
  MOD_RES (620)..(623): Any amino acid
DLGLLERNSATCSTKEGTGHGVRHGLLLLYFHRFTCPGNGPSWPGPRRGAAACPPPQVRLYVWLGGTGGSPRGPIMVQAAVARQRLRHGMSPPRPRCGSRWVARAGPLTPPKLPPRHLRPGSSQVLAPSPMATSPFMRATCCPIHLPQDRVLADGAFVPAPSPPVASPLGPALGRVPSFVPAAPPVAPAALQALEDFVAAHPGVLVVTGAGVSTESRIPDYRSPAGAYSTGFKPMTHQQFMGSAAARARYWARSFAGWYRYAGVRPNAAHEGLAALQRRGWLGGILTQNVDRLHHAAGSGDVLELHGTTHAVRCMGCGAVTPRVQTQSRLAELNPEVDALARALAGAGEGDEDPPRHGVDGDRSIDDXXXXSIPRWTRWRGRWRGRGRGMRTRRGMGWMATGASXXXXGVHIGRQLARAYSSRPRATLVPRPWFPDEYPTIPLQPPSPLAPHVGRSVPGAGGRQRPGAGAAAGWRRGAGGCGVGVPSPALPRLRRHPQAGRGVLWGQCAQGRRGAGAGRRRRLPGHAGGGFQPPGVVRLQAGARRQGGGGAPGPAVRGAQPGGRPRRPQGGGAGGGGPGAAGALPPPAPAPRPLTRLQGVLRPVASYPLLTWFFCCNSFXXXXLLLPHVP

SEQ ID NO: 16984 - protein, 138 aa, Chlorella protothecoides
  MOD_RES (72)..(74): Any amino acid
AAAGGRAAAAHARLAHRGGGHARGRGPGRRLGLDGRPAQRPVPGGLKGVLLAGVCVLSPPLVASRAMPSPGXXXGPVPGGLKGVSLAGGGGFPSSPPPVASRAMPSPGALPCHGSTLRPTSHPSLAPPDARRTSSTGA

SEQ ID NO: 16985 - protein, 67 aa, Chlorella protothecoides
MLCPTPEPHSPSQQINGANWGWSALNRLCWAIGSISGSMVEDQENRCEGGWQGGTAHGLPGMGRWEA

SEQ ID NO: 16986 - protein, 374 aa, Chlorella protothecoides
  MOD_RES (43)..(46): Any amino acid
  MOD_RES (208)..(230): Any amino acid
RGGWDLGRTAPRPACDRPPPAQRTREATTAPLVPPASLRPAAXXXXTGRLATNRPPPSASARPRLPPSFLPHPSGLQRGERTVPTERPQAMLTAADLPRCELSDYIEARLTRTIAEERAARATALGVHPSTVPTAHGITGERAFRWGGIGYEAGVCLVAAEYQARGFGAGLAQALESWRRGSPPQHRAIPASATVLLPVQCPLFSHPXXXXXXXXXXXXXXXXXXXXXXXPSPSHPPHTHSACGEQRDQEERGPAALPGRVPGGGLPRGLHVPPEGPAPVPEPRWRGPLRLLPVCAGVRRRGAGAQPQVHLPLLPRLGQVPGAGGGDGGGARRGLAHHGLPRGPAGLPGTRQAARLPADVHLGLPAPAGWLIFL

SEQ ID NO: 16987 - protein, 389 aa, Chlorella protothecoides
  MOD_RES (129)..(132): Any amino acid
  MOD_RES (283)..(286): Any amino acid
MRRQVINPPPEPSARHDSRPTDNFHDTHSCNQAASASSLALKQGENVGRGTDGHDRGSEESQVAAEFRVCSRGVGLAHSERHGRRMMRMMSEMVQSDRGGCGSRRSARERFYPTLSTSLGEATTGTAPXXXXCPRKVLPDTEHLTGEGYHRYCTSTAHSIAFQEPRATREDVRGKTFRSHGNSPALPCHLSHRNMGLLSLHVTHSKPCGILKGMLCPKQTRSSLPPPGVDQSTDTISARVPRAQGARGIDCQVPVEACYILALRYYRDDQSHPGGGNTGSDGXXXXTVRYYRDDQSHPAGGNTGSDGVGPAGPGPSSMPPPPPRVRARDAEELLREAEEAAGPSDIGIVDAKGLRRLVLALERKVPLEGGGGLGWGWMPEASGAAFTSV

SEQ ID NO: 16988 - protein, 570 aa, Chlorella protothecoides
  MOD_RES (443)..(446): Any amino acid
MSVDRGRVALDAGWLHPATLPASAPLVLHARLPTSPAVSAREGDRQAALAGGRDSAQDLNADTLWAKIQEEAAELSKSEPLIASKVCCGWCVINGAAHGVFATRGKRAARRAADEGLSPRNAGYLRPVFVHACSRTRPPCSGSLSPSPLSSALCPQHSPTPSHLPFLPPAGDDGGDAPQPVQVAGVSAFQQAGQRDAAGHPAGAPLHGRLRRRRGPAGVWRGRPARRHGARPRLRHLCPVPALLQGLPGGAELPPGPLAVEEGAAHPGPGHPEPHGRGVHRGHPPRRPAGPGPPLRPRHGHCHRRDGGGGRQRVHAAPCDPGGGEDDRVAQWWSWSLVGEDPVLQGSASGVLVSAVASAVQGPVTTLPLFTIVTVQTTPLQPLHPPPLSPPGNGTLLGAGVSVLGPIIVGANCKIGAGSVVLTDLPPSTVAGTGTADPPPIPXXXXAPFVSLSQRSKLPIKRRSAVSCSICRNLAQPILPPPPHHALHSRRAGQDHQAAGLLSAPQGIHGAVSRRRFCVLGSRGLTVQQAPPNRRRVISHPTPSQDCRFHPGLDDLAPSLTRQRRAPVQF

SEQ ID NO: 16989 - protein, 294 aa, Chlorella protothecoides
MHPPAASFDEVDSTESLSAHSWSPGPGHRSVVALWDEVRQEARALARREPVLAPALHASVLRHADFAACLASVLAGKLGDATLPASQLALLAASLYGADASLLEAASADLQASVERDPACPGPLQCLLYSKGWQAVQAHRLGHALWAAGRRPLALALQSRGSGAWGVDVHPAARLGRGVFLDHGTGVVIGETCVVGDGVSLAHGVTLGGSGTGKGVRHPVIGNGALLGAGASVLGPVTVGHCARVGAGSVVVADVPAHSLAVGIPARVIRRFPVTMEPCKSMDQTLDDVLDYVI

SEQ ID NO: 16990 - protein, 150 aa, Chlorella protothecoides
MDDGTWLVHQSSDRDDTSQDSQDSNAEGHFAHDYPGGTAVKEEAGWGTVCAKMGQCWNFTRLLVVLSPAPRGNTVQYTLITSLPHSHAFRQTSIRRAQTLATTTPTWGTFLPRGTADDTWEAAAAAAATRMHAGQDCAPKTMAVATSIEP

SEQ ID NO: 16991 - protein, 233 aa, Chlorella protothecoides
AGADAGAAAGDAAAAPQRHASVPRGDFDPASTKHRGQYALRKLYHESQGLVMVLYSAPSCAPCRTVKPILNKLVDEFEGKVCAEVWGKWEAAARGFPGDVLGPPLPGRSFTKSITRSAFNPQTGQLCRDRHRGGLGDCTGGGSAQHAHAPVLQAEGAGAAPARGQDEARVPGAHRVQPVTRRLVNGRLPVLARVPDIAPGVASRSAYHPWTPPCLHVEVLYRTTSLAGTHPGK

SEQ ID NO: 16992 - protein, 414 aa, Chlorella protothecoides
MTCLRIDRCPAILAKWLWHPLGFVFERSQIRCPPPAALGPTLLPWIGSHVAQGPFPYTLPPPSSPSPTRPVCGIFGYYNYQVPRTRLEILHLLLTGLQRQEYRGYDSAGLAIDAVPMAPDAAPNAPAPPALVVKGPGKIVDLEALVSREMAAGGHDPTSRFEVHAGIAHTRWATHGVPSTANSHPHASNAAGDFLAVHNGIITNYKALRGFLQGHGEVFATETDTEVVPKLCAYIYRTARGAGGAPPALGEVVCQAMRMLEGAYGLLVKSRHHPGSLVACKRGSPLILGLRGSPGCVSVASPAKGGEATRGAAAACAPGARPGAWECFVASDAAACFVASDAAAVVEHTKRVIVLEDNDLAHIWAGGYEILNAEREGDGDGIEAPRPVPRSLQTLEMEVSQIMKVGRRGVDGVC

SEQ ID NO: 16993 - protein, 220 aa, Chlorella protothecoides
MEGVPEQDSTDEEAPHTYKDEQHDAKSAFLQVGHGSAWRSLFDPCQPIAPSHGVPTRFAMHAHPGLPCQSSLTRCTCSSTPQAVAEVDGDEELDFAARKPVARPEAGGDAGGQAEAGEDRIKGLLDGYFGADETLEDEGDRFLKRYILSKGWVDREGGEASSSGDEAGTVPDYEEEEEYLQQAEQYEHKYNFRFEYPGSETLVTHPRQATEDGQRVRPGS

SEQ ID NO: 16994 - protein, 266 aa, Chlorella protothecoides
MQLLHCHPATQSTGAALGLPQSCTPLLSRHPSRYKGVDAQSFGLSSSEILAMADKELNQVVGLKLLAPYRCTWAGVGRVECPVSWRCCLLGTPRPRLAHIWMADWSTRLNPLLLTYHPRDEHRKVRPNYGAVNALKQQVAAQAGAKRKRGSSGHGEKGPVWRHGDVREGASEGTHKARFSPSSQSAASAEELRAATYAAPRVHRPDKTGMSSSLLPPRKKKKKVEREGAPTPASKYAGLPKAHQKNLRRHEKRAKARGKAQGEAAA

SEQ ID NO: 16995 - protein, 82 aa, Chlorella protothecoides
MRQGVAAATGQPQEDLSDSSSDEEEDEGLIPDEKESRILEVLQKIRAKDPAVFDPTVKFFPDSEGEEQEDHAKGEPYSPVSD

SEQ ID NO: 16996 - protein, 493 aa, Chlorella protothecoides
MRGRVKFERSSSEVRGCGFFFCGGAGGGGGEGVRMPSLRYMFTYIETIPFTNAPPPAHWQTDRYRERRIKLGGLTEWLDTIRTGRRIIFVGCGTSYHACLAARQTVEELVEVPVALELASDLLDRRAPIFRDDTCVFVSQSGETADTLQALEYAKSRGALCVGLTNTVGSSIARATHCGVHVNAGCEVGVASTKAYTSQVVAVTMVALALSEDSIAKRDARDAVIDSLGALPGALRRALALDPELARLAGRLAGETSLLLFGRGYNYATALEGALKVKEVALMHSEGLLAGEMKHGPLALVDESLPVIVLATRDAMHAKMLSVIAQLRARRARLIVVACEGDAEVEEACGLGQTGRARARTATPPTPPTAQAPSRPPTPPRPSPSTDPLPSTDPSPSTDPSPSTDPTDPTTTTAPSLRPSTLIRVPRVADCLQPIVNVVPLQLLAYHLTLLRGHNVDQPRNLAKSVTVSEEDGSLNCSRGKRGKAVPNGFGAR

SEQ ID NO: 16997 - protein, 387 aa, Chlorella protothecoides
  MOD_RES (8)..(21): Any amino acid
MFRPDRPXXXXXXXXXXXXXXVSCTCVIAVTRCGFMKLSSTRSRHPDLVQYPTALIILLKSNPACSDHLVVCIHCNRQSSAACRITIPIRYTRKLQTTGIAAPRLASRHVAAEDRDTGHVQSGAMGHGLYWQPGQDYQVHRPSQGWWRPVSGASRGRLQAQGIGGGTPTARVAGLSAATCRTHVSSPPSFLWQLGPELEISGYGCEDHFSENDTVEHSWECVARLLAEGHTAGLVVDVGAPVVHRGVRYNCRLFLLDGRVLLIRPKLHLAGDGNYREPRYFSTWKRGAGVEEHTLPGVVRAATGQRTCPFGHAALAFSDAVLASESCEELFTPRAPHIDLALAGVEIITNGSGSHHQMRKLHTVREGRGGGGLTGEEEEGWDWEARR

SEQ ID NO: 16998 - protein, 193 aa, Chlorella protothecoides
MAVAPCKPTCGARLSVPTSLHPPHSPPPVPPPLLSQRLDLMMSGTAKAGGVYLYANQQGCDGGRLYYDGCAAAVVNGALVAQGAQFSVREVEVVLATVDLDEVVGHRGAVASLREQASAAPPPALVPVDWALCDPRVHSTAALSLPRAPRYLAVEEEIAYGPAAWLWDYLRRCVCVVGEAGGRMTRGKGEGGE

SEQ ID NO: 16999 - protein, 409 aa, Chlorella protothecoides
MGPALTRPGCDQRMSADSHPPWLGCVTAPSSMPRPQPVARGPRSSPPTHMITTSFSSNRSGATGFMLPLSGGADSSATAAIVGSMCRMVCEAAAAGDADVVRDLQSVQGAPTPHPHCTSGSQSMATGSCPGRHRSWRGASSSPCTLEQRCGCWTGRGSGHSCEVWGSVHVTYITAWLSRAMLRKGLGYQMATMHTQMDACQPHSSPAQNSSETTRGRAAALAAEVGSRHLAINMDAPVKAMVALFAAVTGFVPRFKVCMPWPAAWDGKPSPQAPHENLQGGNCTGSSRREPGRAPCTCRFLALHPWFTPMEGPTLSFPILQFSSKPPPPIPHPAQVQGGSVQENIALQNIQARLRMVVSFLFAQLWPWVGGQGGYYLVLGSANVDEALRGYLTKYDCSSADINPIGAQS

SEQ ID NO: 17000 - protein, 152 aa, Chlorella protothecoides
  MOD_RES (5)..(8): Any amino acid
MWGGXXXXGGGGEGGDVRVGNTTELGYLSKGHSRQVGYEAGGCALTHLLEGDVGRRGRSLAPPSPSVPPCVGWRACHPRNAEHLGFPSLAGISAAPPTAELEPLRDGEIAQTDEADMGMTYEVWPEEPWATARCCRAAVVEESLHERTWDTS

SEQ ID NO: 17001 - protein, 459 aa, Chlorella protothecoides
MNLPISWEDQVSWQTGLTCARSGSFCYQQEHSAYALQQSSTPAWYVSGCSQLSLAVVELCQRPDPAGPHDGAIDRAQPEDAAGGAATHPEWRHSVADVGSTPSPELPERRDAPRALPALRRVVTPLLPARGGGLLAKGLSSRHRAAGGGGQGVLFGHRHEGGPPDPPWGCVIVLRALLHTGDASPFPISQTRSFTFLIITSPTQPLQHQASALSIGGEAWDYRDIRSQQLLSRLIEKMRALPQPLVAAVDGIATGAGLALALACDLRVATSASSFSAAFVRLGLTGSDMATSFFAPRVAGLGVAAELLLTGRALGAERAFQLGMLNALAAGPAELRVEAEGLAKDMLLCSYKVLLGVARASGGCSMRQGHVYRTGAGWEDWGGHLLQQVSPPCSWPAADQGAAECRLGWHESPGHGDRRKQPPDPAGERSRGEQDRERLAEQDCQQIGQAAAQAVSSMW

SEQ ID NO: 17002 - protein, 246 aa, Chlorella protothecoides
MSALREHVPLARSASDANTYLVNDQADPLQRSLSELGMLDSPTPGPGPAAGAALGGHMPRAASEAWGALAEAEPEAGVLAHLTELLDRVQGLALSARDTGDGNDAWAEGLHRRPLTSCLATGFGVRLEDSCAGLVPLKLFQTPCALAASSLFGGLAVDEGPGPIECAALPPLDPGAALESDGSGVLLATPTTPGCPTAVPGAVDGAADAFELLDKAVPGCGSVWGQVPGPPLSLEEFQAMHDAEGG

SEQ ID NO: 17003 - protein, 80 aa, Chlorella protothecoides
MYAVHPVALSEVKALHRHAPPLGAHRIVLTLFNGVSLPPLYFQHVRRKGGGVFTGATGPPPPARRALASHPMPELSHPDE

SEQ ID NO: 17004 - protein, 154 aa, Chlorella protothecoides
MDGWQDQAKKPLLNFLAVTSKGGRFIKSVDTAGKCKTADYLVEQLEAVIKEIGVENVQVVITDNAANCKRAGEIIHERYPTIWWVSCAAHTVDLFLKDLGKMKWVTEILDPCHQICKFMTNHATAVHLLREHSDQGLLVPGETRFGSKFLMLDR

SEQ ID NO: 17005 - protein, 317 aa, Chlorella protothecoides
MGVWDPACECLTLLPSSPSPSLHPHPHLPSRQGIYSSDFVQFLINCLTFWILLSYLVPISLFVTLEIVKFWQGFVYINLDPAMKDPASGEHARCRNSGLNEDLGRVEYIFSDKTGTLTSNEMQLRAVAIKGVAYGDTSFRWELGGRPEPEWFGALTGALTASAQRCMATPLVSRGVVARCLPGPLVGSPSCYNCTTPPRPHPPRSPFPSFRLEEHEELTDLAALQRFDPRLADAAAGLAASSNALQRVVSRGGSSSRVLSQASSFKRESEEGPQRSPGDAGVGTLSSHLMDFWTNLCICQSLILEDDPKGDKPLYQV

SEQ ID NO: 17006 - protein, 113 aa, Chlorella protothecoides
MEGAIDARAHSDQRWTPHPCLEGLKAEARRQGLWNLWIPADMRVKLAPLMRGAGVSGAEAALLLGPGLSNLEYAHCAEAMARSLAGPEVFNCSAPDTGNMEVGRSRGVCVGGR

SEQ ID NO: 17007 - protein, 269 aa, Chlorella protothecoides
RPLTGAPAAAPPWPRSPGAPRPARQPSAACVRWPRARRRAPAPWPPRSWPAPRRCRRGPARARPPAPPGVRRPARGGSGPGPGAPPGVRAGGGQRRCGSLRARARTPARARPRARRCRSGACSGAGGRGPAAPARSRSRGPRPAACSRRRGRPRSRTASPRARAAHHRSRTPAARAPRSPRARRPAPAPCSAGGPPLGAVEHEVGAAPLDARLDVGGVRGGHVRLRHGKGRPDLAAQQGQQPALLLLPRPVPRQHLAGCGVWGRGGGGG

SEQ ID NO: 17008 - protein, 135 aa, Chlorella protothecoides
MPKRKHEPEVEQQVEEEQQEAEAEVEEENGAGQGSESVESGSSSDDMEGPSSAEEESEDDSDGEAFDSVTVDFDFSEPQEDDFLGLKVLLTNYLDGVTYDGSGLVDLVLKHVRCGVGCHGIFTGGVEMLGAGDED

SEQ ID NO: 17009 - protein, 510 aa, Chlorella protothecoides
  MOD_RES (28)..(31): Any amino acid
  MOD_RES (116)..(118): Any amino acid
  MOD_RES (275)..(278): Any amino acid
  MOD_RES (406)..(409): Any amino acid
MSFRPGQQHFYPHLCDTSPQSKLGTVIXXXXSGQQRFYPHLRDTLPQSKLGTVIKCEDDVLGVTTVLPLASVAGTRSLSDLGKFLLARVGPELKDRVQQVHGVEGCGERTAHQLPXXXLGVTTVLPLASVAGARSLSDLGKFLLARVGPELKDRVQQVHGVQGCGESLADKAMGLLLSERLINCPPAVAPPLQQALREDLQAHQGKPRMKHLLLLARAFRDSRPAEQPAGKKRGKGPSSSKVFMGALYDETMWSWEGVGSLIIVFLCPGNLHSHXXXXGRREGKAHHPARCAWELFMMRRCGVWEGLGSLSIVVLLQARGLDSGVCGEGDAGGPQQVLPTSAPRPLHTLRCPAQDRTGPGGSAWQPCRVSCGGGVVESAFGEGVWRGCLSHVPGCQSSQGTPTRAXXXXKCDLQIGLKKGVIVFILRLLWLSRAGWEVLSRVHLVKDFGEDAYYMYQVVGHPKARPRGHFWARQSFGYPWLYQQARGWQGGLGEEGAGGRFSCRASICSS

SEQ ID NO: 17010 - protein, 186 aa, Chlorella protothecoides
MTRPPCCPRAVEGKRTAPCQEAAPTLLRNGCSQAILHQDCPPLPHMLQAQARDGTGVVVTSIGPDAVCNACVATCHARIYLEVGVRLTPVHPGMLYCWSRPCANRVHARSQSFWSLGMLMMPSSHHAPTCGGCPTPLLGNPVPQDDKIDVRAIPIFEEVEKTSVDGSMHTMTALKLKVLIEGVQDS

SEQ ID NO: 17011 - protein, 379 aa, Chlorella protothecoides
  MOD_RES (338)..(341): Any amino acid
MGPLSTTAAPHQSAPPRLPPHELGIWKSRQVLGAGAQADRRSITSLMGFFGISLSKGAPASLWTWPGSVEPHKSDGFLWDQLVQGRSGFPLDLAGERLDLLKLYCSFGLEHWGSDARGVESTRCACGSGCRHSPIPPSEGHCMYNGTLCPTPFLSLPLPCMQTLPAGVAVVPAPLHPGRPAGCSAPAHGLEGAGLRGQIRPGDAAGLRPRRRLGAHLRDAAGPCTPGIACVSLRNGVQQDMWTGRFETIPTPMMSQQPCPQSRIHSGAGFHVHAKAQGKCILQTAGGWRFQSHEGRGAGEWLRKQGGVVGGAACPGLAVNRGACRVSMPSTHNGQQLXXXXVERLALALPWTGVLARFPCQVLTTASIYLPARSMPPGP

SEQ ID NO: 17012 - protein, 412 aa, Chlorella protothecoides
  MOD_RES (400)..(403): Any amino acid
MQACMQWVPGGWCRRASTHPPLSKRDTPGEGHLPSCLVISKPMPEPPPVIRATLPFRMSVRKGDTGGAMLPSTEPSLWTPVCNSHCDIAAGLESSRLTWCQNLKLERCTACRPHVRHSGASSSTWARNFHNKIRLDLLKIPPHPASSGKGGGELGQRPQGSLACGPGLHAETQERDLRARGKGNRMSIMDGAGNSEHKPGDVAARFWASWPRPGLCLQSRGLSPGTAARTSSFPGASLAQSLPIHFPAPPHTSPPPLCATTHHGQAPVFELGLLELEGAVVVARGEAQGVKPAAGVGPLLRVQLGVAVHLGAAHQQRLDPDQLGEGEGQGEAEVLCAVQLHLARVLPGHARGGLGHDHAQRGQHGPAPVDDLVLAEAGEAEDLAVRRQRVGGHFIGVGGXXXXKRARPKTSL

SEQ ID NO: 17013 - protein, 97 aa, Chlorella protothecoides
MTFLEQAADLFATENSNAEANKCNLKVCLWREMAFWYLRMIWMALMSGEGSDNSPDRLNRSSAQHAACPRHLLTPSLHADRANIRRAGAIPPCHRPV

SEQ ID NO: 17014 - protein, 310 aa, Chlorella protothecoides
  MOD_RES (256)..(259): Any amino acid
MASFQIQGREWLSKGEKKLKSLGWFGNKYEEAAECFEKAANQFKLAKSCARLRLRARDWVSWCMARACLSWQLWSDSMCGMQQQSRPETRIILPCQGPKLATLSPSWPRYTSSWRVHMMLPVPGWTPANPTSRSTTRNLVSCFVDSRNHMRCTEGLDALSALSQWIILSARMKTPPPLAACASPGSPTPDHNTPAASKSFHRGSAGPPKRRQHLHRHGPPGDGSAPAQGARCLGQGLGGHGDCGRTAWTHGLENYXXXXRVRGAWVKDSKGMGIVVARRGPTAIENYSLVDAHPSQILSCAPGDRRGAGA

SEQ ID NO: 17015 - protein, 246 aa, Chlorella protothecoides
  MOD_RES (89)..(92): Any amino acid
MRDLREKMQAEINQVSRSAEAIKKRLAELDRNNEAALKKGVYTPGSSAERTRTAITGALKKKLKDLMGEFQDLRTRVNAEYREARLAAXXXXGGGHKIIAGFHRLAWLLFGDGPSLTRPRGPLSSGVEGCGEGSSRPPTQMTLPWCSQVWEWGEVSHMSLAFRAESASLPITVTGQHADEEKIDQMIDTGESETIFQKAILEQGRGYVSGNMEGRRGLRRGVSRPNFMSSMPGSHCRLSLLCPCFT

SEQ ID NO: 17016 - protein, 272 aa, Chlorella protothecoides
  MOD_RES (120)..(123): Any amino acid
MACPSPAHQVLDTLAEIRERRDAVMELEMSLMELHQVCSVWKEECRGARIRQHPKRAPSLLACQALPPIPLSFCGHPPVAHPFTPFAPPPLHTSPNTPSPILPSLTAPDLPGHGGAGGGXXXXTPPSTHFTQNAFTHLSLPHCPRFSWTWRCWWRRRGSCWTTSRRRWRGRWDTCRREPTTCRRPSSTSAPSASGCAAASSPASSSSSSSCWWSSAPREASAPVERGGVVRRGPASPLPVAARTPGKGSATLDSGRDMTLLTGRLPPLGPGL

SEQ ID NO: 17017 - protein, 141 aa, Chlorella protothecoides
MCGLSVCVREGRACTGSASPATEGEGSLLDTPLLTWQATYIPEHPAACNKTHLPPGYGGRPRRQRRPPCCAPPGPAGSSAAAVRPGRARAPPRQRPGSRPPGRHRPGSWSPRGPAGREPPPGTCAAADTGPMLLADGLGPV

SEQ ID NO: 17018 - protein, 239 aa, Chlorella protothecoides
  MOD_RES (4)..(7): Any amino acid
MSMXXXXTRRTWLWSTWEVRRQRYMVKCDGVGFGDVHGAQLSHHNKTTRTRSSPPPGGELLDAVLDIGHYSENEARIIFRQIVAGVGYLHSKGIAHRDLKLENLLMAKRGDIMGVKIADFGLAKGQAATSLSTICGTPQYVAPEVIAKGAKSGFHSYKLSCDVWSCGVILFVLLGGYPPFYDESEPRLFDKIRWVWWGRRGLRCADLHHPQAAADPHQPMRPWQAGRILVQRPCVGADQ

SEQ ID NO: 17019 - protein, 413 aa, Chlorella protothecoides
MRRAPRRRSPAPTPYRHALMEKGQGQGPGTSLQSQASNSESRGRKCRRPLAGPAPTGQTMPRRGRNHAEDEAEWQDDPATLEAAALAWGERVASASESREVAAPGAPAPSPPGSPSAADLRQSELAPIATPTAAIELHSRSMAREDIRTAQMATMAEQGKKVLGLCRERPATSASSSLAPTTPWDLPADLRGLERALEELPASGPRPGDEGRSKAETPPDPRRALMHSRRASAWRLLTTIERDAITVLGAMCKVGGGPVAHAIIRNRTHPRAHSLNPPPHTLYTHPHPLSVQLGARETSWGAVETLGARETSWGAVETVLHEGKLLALELLTRVLCDPLHDWLGVRPEFAGELRAPLCLVLLRNCMSPFDEAVRAAVRLLCALAAAPRLRAGLRAELGALYPLLLLRPLEAAR

SEQ ID NO: 17020 - protein, 334 aa, Chlorella protothecoides
MWQGNRPGITCQWASKHSHPDPLTSEYLQQTPVAASVTGLPVAPPLKTEDKNGVVTAEALAAALDGASAAVIPLLTPVDPTASQVEAVRAPAAATGFPEPSSPAEQDDVDGAAQAFWRGDGTIPMRPVALLPGRVRKPAQRLHQNLPQPTRPPVRHRRYDFSTADRVLSTLGLRNSRAGQGQGKQEEEGQEGKRPRTQGPDAGALPGEAVLAKAEPEVELAAAQVLPTAKVEAEAQLCTVPAETAPGPGAELGIPVTEPETAAPAAAPPPQHPYLETAEHKRESSARAIDFRGKLYLAPLTTVGNLPFRRLAKRLGADITCGEMALATNLLQVR

SEQ ID NO: 17021 - protein, 83 aa, Chlorella protothecoides
MPAGFSVVKLATHKETGDEYACKIMSLPPPGASNAAEVTREDIFKEINILISLDHPNIIYLREYFEEGNKAYLVMEYLGGEEA

SEQ ID NO: 17022 - protein, 198 aa, Chlorella protothecoides
MQPDSADPHLPGPTDSLGGSHATLQPGDPILPPPLCQEAACSSGAPSIMDPALGTLHKLVAHAFLQGESSSSGRGDDGTIVTQAYCAAPLPAWIASPPQQTPCTLLPRRSPPGGDHGGKDGGVHHASRPAWHGPRAAHGRDGRALCAAWRLPHAGCAGGVQLGHRLLRPRHPGHRQVGPPPDAQHRAEAGGPPSHGGL

SEQ ID NO: 17023 - protein, 143 aa, Chlorella protothecoides
MAPPVSPFRTDILKGKVALITGGGSGIGFEITRQLGLHGASVVISGRRVEVLTQACADMSAQGVETHFVQASAGDVRKYEACEAMVAGAVAKFGRLDVLVNCAAGNFLAAPEQLSSNGFRTVLEIDTLGTFNMCKYDGGLLTG

SEQ ID NO: 17024 - protein, 182 aa, Chlorella protothecoides
MLATLGVIVAEASTGVAWQDAGKVELDGAQYLGFPLPFTLTQLVWIEALLVGGAEVYRNTELDTEKRAYPGGWFDPLRLASGDDNRAFKLKEAELKHGRLAMGNVSAGTAPGSPRGRTKFGLQFRDHIPRLVFRVAGTIHNRHPVPLSSGAQIAFLGFSVQAWTTGEGALGSLAKFATSFAG

SEQ ID NO: 17025 - protein, 124 aa, Chlorella protothecoides
MGRVHPLTRAQAHPPATWALCPPPRRCQVVAPDLRGHGETRSPDDADLAAETLAADVAELWHVLAARRQLTTPLVLVGHSMGGAVAVWAARRILEEGGGMFRDVCGLPGEEGSIEERPLPLGGR

SEQ ID NO: 17026 - protein, 893 aa, Chlorella protothecoides
  MOD_RES (20)..(33): Any amino acid
  MOD_RES (267)..(269): Any amino acid
  MOD_RES (647)..(650): Any amino acid
MWSFETHVMDDQAVQQEGTXXXXXXXXXXXXXXALVGAHKGAVTALQVLGSEAANGADRLISAGADGTVAVWEPSTAAYGPGPRREISPRLFFKAHEAAVSSLCLVEVFPGEGSSRVQYLATTGEASNVSGGWALGYGLVGFIVFLHESRPKAHMGWQSATALHRAGSSCRQHSTQFASLPPPHRRGQEGCFVADDRELDPAQECATAAQDHFPFRSPLPLGFRWLGRLPLPCSRIWWGLGKENSGPTVWQALRSALMVSPPSSWGXXXRSHCMTSFAISTRGESTVLMGLHPESGASSHCLDLAGWLDPGQKKAVKVYGAFGHPLRCGHCCLLHGWAAPPGRGNQYRPGPPGFQRERPPCCAGAAASGADPGRDRQHARGRAQRAVCGAGCTGLHLPGCGRAVTLDFQPAPRDDGWATRLVREECAPGPGSPGGDCKAGAQRTGAAGVQRQRAQRERGLAAAAAVLRVLPGTQRCLGGAASALVWNSLQSQYALLCSPPVVVDAPKPKKGMFAAFGRRKHSTSAPKPEESAESAPAHGARPGSHVQVHVVDESRAAQWVVNQGVSLDGLPSALHGGPMLGVVVEGRASGGEGLNAGLQLLSWTNFTAVGPRLPEPRWLRPSSASGAPHSSAASAVLGVCPTSTPQXXXXALHRAHHTGVLHLQSWVCAPPAHPRAHWRQSVSHFPTLCSWEPDYAAAVPGHPHRHPCGLHGSSPGVCAGKHCCHGTGAGTQKGAATLSARAWSPSLLGSSAMPSVSVHLATACSPPPLLLQTIPLASYEGVAASQVAPSTDSSPLPITVPRPLGPVVLMGIRHSYLWLADGLGRPYLVSLRHAGVRLRCLAARSELSTARTIAERGGCWMWGGPSIRWNVRWEVARKELAGSIPALNGAMVA

SEQ ID NO: 17027 - protein, 579 aa, Chlorella protothecoides
MEGGFWRTAAASSSSSKPPGRASGVWQGLLLRCCFNVGHPAGTDGAGPEAFPCRDARDWHDEDTANACTLHRRYVRGRADTGEKVKARVVIAPRANPSRRAPPEVYFMSISRNKYSLRLNAVRFPAADPQQGSKIDRKLGSDCEQSKLLLKGTHGGWSSFITMTAIDAQLLDIETLLQGDLSGLERSWDTLPPEQLRKEIERYRNAIIAVGNQLSQLGEEDWSSRLESLLWMRVEVLIRPTVDTESKGGSHAAPKEEDPGSIDDLDPSEWQVPPHCIPIHANVTTYDWDALIAASRFDVIMMDPPWQLATANPTRGVALGYSQLTDRDIQNLPVPRLQEDGFLFVWVRGTEGPEGERPVLTQEGAALWCHDYCSGGPHQPSDLQTPWLGCSATSGLACLSTTRPPHILCQIGGRGGVGENDSESTSGQEPRILPAACQGAAQVRSPVATLGGPTHGNDDDHPLPCHLSERRGQSQKPEEIYELIERLVPQGKGRDILRGVAFNLGSSLSKSADSIANLLWCEVKDLPRRYLEIFGRKNNLRNHWVTIGNEVTGKGPPKEDAAAMFQGSGVPGAVYGRSN

SEQ ID NO: 17028 - protein, 125 aa, Chlorella protothecoides
MEPGASGPKNLRYVHDAAHAQHSERSRKPDQRRVIDLLQGSPLPKCLVLGVAGSTMDRPKLSILMVSDFFYPNTGGVENHIYQLSQCLLSRGHHVVVLTHSRGTPPGTRYLTNGLKARMGGRFGV

SEQ ID NO: 17029 - protein, 303 aa, Chlorella protothecoides
  MOD_RES (284)..(286): Any amino acid
MHDGGMVRHAAEKGDANEVPGAVRPAGRGLGNQQEAGEPGSPVCGRSAGDNDCWRMLALGAAWGLASSCILCYPIPAQAWSKARLQAELGDKTGAALWDASRGIDTRRVAPPAVRKSLGAEVNWGVRFDSPQDATRFLGKLAEEVWTRMGAAGVQGRSLTLKLKKRKEVRARRWSRSADSPVRLSRPSDIVCLSPPVMQGVYNPVKFMGHGICDNLSRTHTFHRPAHSAATIHRAACDMLTSLHVPHADIRGIGLGVRELCHWEERIAWGQAVAWMVQPPSLAXXXQRHRAGGARAMPLGGED

SEQ ID NO: 17030 - protein, 270 aa, Chlorella protothecoides
  MOD_RES (249)..(252): Any amino acid
MQRARPRYPLPTTKPANMASGPECSWPAPNSFAPTSSSCRTTLSATRKYLSRCGVVSRRWRLNTPGWYVWGNGSACVVGRDRHPTGTRRASIFERLITCPCRAAPQAYKIMMACSACVQPLSCDEAFLDVTGLGDPFQLASRLRADIQAATGCTASVGIGHNLLIARLATKRAKPDGQCHIQEAEAASAMLVRPWWGWHALSAHSSSSRCMTVAWCGIQLRRGTQTKFRCAVGTRVHPRTTADPPPRVXXXXHIQEAEAASAVLVRPWGG

SEQ ID NO: 17031 - protein, 369 aa, Chlorella protothecoides
  MOD_RES (184)..(187): Any amino acid
  MOD_RES (288)..(291): Any amino acid
MTYPCRNPKPVVSPEWILESIKAQSLLPDWSQKALPSVSKCLPLRLIAPFLLSTLRDIPGQQRLLPFGTRADVLPAKDGCGTAHPMAASEENPATVYNQPSPMGAPVAYDPAEMRAAQAEAARLRVACDMLKGAPKSSRDDPNFVESFFSASRLHFIGALVAGAAVIFENAVHPPSDHYRNVEXXXXEQLWFGIERALRRESNLFLRMLSIPLPITTGMWKTRLESLMLSGVIGGPTPTPGPGAQVIFHVDLVSCAEQGYGVALRHTSSERMRERLESAVCFLRVYPXXXXKDMELLSGTRPRRGCPSGSRGQSAFCVFTHLTYNLSALRRTVSLLQWLKPSTPCSPENPWCGAWIMEGMATSLFIGAT

SEQ ID NO: 17032 - protein, 223 aa, Chlorella protothecoides
MHAVTNNLNSKNISSTPVPEPSASSTNAPVLEEVVKVGPISSLRKSTSDSDDLDTSKAATTGSTPSIPGPASLPDSCKATDRVPAAAPAGGAPVPKNGVGIAEEFAVNSSDSVAAHNGEQKGPVKTAEDVVPAAIREDAGQAGADTGSKAGDIRAPSHYVFETPHPTPPVPLLLPGAKVLATNAEARKPGALLDDDSDTFLKNDCKADKWVILELSAVATISV

SEQ ID NO: 17033 - protein, 243 aa, Chlorella protothecoides
MAHKPSAAADLKKPVPAELEGLAQPHIDSFDFFLGQGLENVVEGVASVEVEHPITKHRHSFWLENAVIGRPTKDDASSGADRRLFPRECRETGSTYRAPLSVDVVWQAEGLMQTQRVTRKLGQIPIMVKSRACYLRHLRQDELVEQKEEANEFGGYFICNGNERIIRMLVQNRRHYIFALRHSAFHKRGPSFTDMATLLRCVRPDESSLTNRCHLLTDGTAVFAITLRRAGANSGRTPPGRCL

SEQ ID NO: 17034 - protein, 117 aa, Chlorella protothecoides
MSTSFGSCFFAEFFIPAGILLKCFLDVSDKELFDMLVLGAAKDGGHSSFVADRAELVLHQSTRFGLHTRAQCLEYLGGLFRVALSVPARKTDYQASLVGAVQGLSERVYAGFIAMPM

SEQ ID NO: 17035 - protein, 223 aa, Chlorella protothecoides
MPLHRRVELVQNELYSSRVKDFEVYARQSNPRQDAGGDLAAGLANPLWRMVGNFTAPKTKGKSAAEELEDELAQVSARDEAREALAPEALEGVGLLRGTDVASKTGEGLEPLIAAVLDAGNASGSGPLDPVAASESSETSTRAQNTVAGSALRTPALLPDERQGKVAADTRGDATSSTAGTAREGCCGHGRGCHPQHCWHGKSFDGRQCLSRAGKSKTKCRGS

SEQ ID NO: 17036 - protein, 727 aa, Chlorella protothecoides
  MOD_RES (102)..(105): Any amino acid
  MOD_RES (246)..(249): Any amino acid
  MOD_RES (411)..(413): Any amino acid
  MOD_RES (548)..(551): Any amino acid
  MOD_RES (677)..(680): Any amino acid
MHVLLLGKERSGMAWDDILPCHPRGRAPAHCGNNTNQIDPRGTNFCPSRALSMYTCRLPELLNVDFLCLKIPNNPCRMCMEPRVVERASIFEARVYTGQVRXXXXASKPQTTRAGCAWSRWWWNAPASLRPGSTRDRLVRASIVLEFLTRPWDPRPPSDHGSTSRAPPPPHYYFPSLQWIPSPFKDANILLNVRAFDLADEHSRYDGSSAGRGGWQGAWRSGLIVPPYTHTPPHPVACWSCLRVRXXXXSPLHTRPTPPRSLLVLFESEDLDVSDPRLPTAVSQRRTIDVLPGSGIRLQALPAGPDGIPRSLADIHLDFDPHFPYVPSVLVSFLLKVLCPYLYNVIIKGPPLQPPHPAGPGFSIQWRSGLYVRGEGRLAARPVQVPGPTPAGVPAQPGSQGLTVCKLGTAXXXVQWRSGLHVRGEGRLATRPVQVPGPTPAGVPAQSGSRGLTVCKLGTAGLREGLLSQDGVPPPSWYYTKPRAQYQGCRPCDAGPHLPCPHLRPFLPPRPPSSTTKLLCPLLCPLAPSIPQHLHMSAGHFTPRSAPXXXXLSPALPTGPLRSPAPALVNRALHTTLCTFQPQPRDPRLIFLFHPLLVCARTVDQCTDAEHGALQLLLGYTAAVGQSCYGISTLAQSRGQTGMRPSPPLAAAAELGDPAAAATLGVSGLAVASLLLXXXXETLTAGRRVRRAWRPRHGRRAWSGRPGGGVAAPQQPWRALTSSCAAC

SEQ ID NO: 17037 - protein, 706 aa, Chlorella protothecoides
  MOD_RES (164)..(167): Any amino acid
  MOD_RES (310)..(313): Any amino acid
  MOD_RES (434)..(436): Any amino acid
  MOD_RES (607)..(609): Any amino acid
  MOD_RES (665)..(667): Any amino acid
MICTVLKKFPDEVVVRWADTALLPLVTRLVSDASSACRGRAGAALLTLLQRAGPALRATAADFCLQWLTGEDGRLTRAALQLAGVLVEADAEAAAGRVPALLPVVGRLVAAGDGKGAEGWQEAYHALLLLEKHITLRPQPHPSLPPLPRRKVHAKLPAALQPGXXXXPPPPGEGEAVRWFLCCHWGGSRVRCHAPDVAYYLATPTPPFSSPTTASQGARKAAGCAAAWRLTRRGRELGRRSRRAGAPPLVGAPRRGAPDPGRPGRPRREARPAPQPRVRRRPGPRFPRAAGRRARRRGSGQAGCARAGHXXXXSWTASTPTRRWPSRRCVGWSCWPLPRSRTTRLPVGCPPRCGWQSVRPAAWRARGCLLSLAARWRRPMRSRPTRAAAWRRTATPRPRPRPCPAPRRPPATTRARRTATRTAPRPPPAQHDLXXXAASSDDEGEENGDAHGGSAAAGTARPGDGYTSLAALLRGVAALADDRAFTRATARQAALRCLAAVASRLGAEGVLPFLPILLRPLARITEPGATGDGEETVGLAREVLDHLRALVGAERMLLAHAAARAGLARQRAQRRAADARRVSLGGAGQEDKGAIAQAGGGRALCGXXXQTRGGRLWILGCKSTRPSLVAGARARVERGLCMLTWRHPPGLLSSGLWGSLRHHLXXXARVERGLCMLLWRRPPGLLSSGLRGSLRHHPATHPLCHS

SEQ ID NO: 17038 - protein, 190 aa, Chlorella protothecoides
MMRESLYTAGYLGVAPLLKAKLTGHSAFEGTPGAALVVSGVSAGILATLTSHPADTIKTRMQVGCLGRAQGGWHYKDWKESVVWRDRLGSAEEGSRPSLHPTSDRVPGLWHAQLCAAMRHPATSRPGTPPRGHATHSPESPPPCIQSRRRPTQTTRHSLIIPAWPPRPATSWPPRATAASSRACSPGPSG

SEQ ID NO: 17039 - protein, 643 aa, Chlorella protothecoides
MKKKHATVVRSRPQEVVEEDSGIHSPEELSEDEGSAAGAGAAGAPGGEPRAGRPARRSASSAKLSSAVPSPSPEPRPLPSQTGWQAEGGSGADLKVKVGRRPGVHFDTAFEEFHAAPSPLQSSTPPFGPDSGGVYDKLYIILISLHGLVRGEHMELGRDSDTGGQVKYVVELTKAMALHPAVHRVELLTRQITDPGVDASYGVEEECLARGAGDTGGAFIVRLPCGPPDEYVRKELLWPHVREFADRGIAHAGRQLARMAEGGRRCELYAVHGHYADAGEVAVLMASSLDAHMVMTGHSLGRNKLEHLLKGGAMTRREIEEAYAIGRRIEAEERALDTALMVFTSTQQEIDEQWGLYDGYSPGLARVLHFRRSYGRHMPLLKVSPPGLDFSNLKVTIPADPVVKEFEAARAAFAERELAPAAPAAQTQASGDAVAGGGTPPPSPAAQTPRVPDTLDPRVALIPEGPRIWQDIARFLRNPLKPAILAMSRPDPKKNLVTLVRAFGESPMLRELSNLVLIMGNRDDIESMSTGTQKVLVQVLKLIDKYDLHGRCAKSEGSGGLKGSEGTPWPASGCAVSRAEPPAPLPCSLASPCHPLKGSRALSPPPNTNPPLFAAWRTQSITPRPTSPTSTNLPPPRAASSPT

SEQ ID NO: 17040 - protein, 379 aa, Chlorella protothecoides
  MOD_RES (68)..(71): Any amino acid
  MOD_RES (213)..(216): Any amino acid
MGRARGCHFLPFLIALVGLLAASLGQCAPVWTTEATTQRNASDCENFSSGSVDFSGGNLTFSTHPQGXXXXSSGSVDFSGGNLTFSRHPQGGAAWGSYIPGRHTDSNFGQLTITTSGLYSDSEQVYAGAVCMMSTGVGKVDGFAVLNPCAGEQQSILLMKRKSLSMDEGVLPAVSELEGVWCACCQREWARWIASLFCILPRQALSSTLPHPXXXXRNPCAGEQQSVLLMKRISLSMDEGALPALSELEGASRPAADTAEARFWSATCLAVRQFDGLKHGYWAANGGPGPGNQRPSWSEGASSDPHEDEAGKKGVGRRHRRDSVRASKPGSKAAAEQLFNQAVSNILRCMPDLPGGVVGAANSPALRQPRPHPNHHPLC

SEQ ID NO: 17041 - protein, 256 aa, Chlorella protothecoides
MGKKRAAKDRAYLTATEWKEEWGGHKAGPRGVPFKSLPFHCCAISFQPFEDAVCTADGTVFDIVHAVPYIQKFHKHPVTGEPLELKDLIRWGVEVGQGLMAKVGVQIGSAGKLGVRGCAAGRIRQELAGLIAALTAPGSPSGCTGTRTRMESTPAQPWARFSRRTRTLWPSARAAMSTATRCACGGKGARCGGNDGVGVLQQLSCVPALRSCMNVARLIEVNGVKASKTTHSLGIAPAGCARAEPEDQEPAGPAHR

SEQ ID NO: 17042 - protein, 333 aa, Chlorella protothecoides
MGTPDFLMLPHVLHAHLPSIPSASSCANSSCSLPVQDPLNLSGKNLAEFDHVKKELTVESAEERAARESTRVTLSPQAQPMNGIRAVDEDTQRVLSSLNTKEAELVFEAGGGGRKAEAERLLAKALQAATGKGDASNTAVPTQPGGTDPRLRQSGTNTPARTCEAGLVPTTSHSAPAPGRLRAPSSMCPSGRAPARGTPTSPPLPRLPPRARLARCASMCLAGQKGRAREQSGLSGALFAIYGGGESEDTQPCDLLGVRHCPSRLTIPLTPAQAPAFDASAGRPLPKPYSAKFVVGHSTTGAASRAFTSTAMTPGGWHGLRLGSGHGRRPVRR

SEQ ID NO: 17043 - protein, 352 aa, Chlorella protothecoides
MLQIRPSMNPRNRAASGGPEYSVPLASIGIWRGEPSGKSTYLGVVAACGLQRFLVLHLLFCEMGSQAQRAPSLSTMRLVLLLGLAMLAHVVPAIRTPLVPEARMEPNPNLFRRAGNGDPPSAILAGTVQMKPSKFHPKLSLSDGDISRGRTGFGFLVGRLPSSLCWREIQILCPPATAGRPATPPSAPLHSETFTIHGLWPNYNNGSHPHYGGALDARTTASVEQTPCCWIEAVLFWLRFGGGRLPMLQSGKKTKEACIPALGDGALGFWAHEWDKHGTCSTPIITSQPEFFETTMRLDKQYDINVIGDLCPSNTAPQHTHVSVLTHISLYCSESAAGCWNRSPERDPCEEF

SEQ ID NO: 17044 - protein, 189 aa, Chlorella protothecoides
MKGSLAALHASHPPFLPAQALFDLEATNAELKSDLRDLYISGAEEVDVSASRKALLIRVPFRLLKPFHKIQQRLVRELEKKFSGKDVVLVGVRRILPPARHARQSARPRSRTLTAVHDAWLGDLVYPTEISGKRIRYRVDGSKVLKVILDPVDRANIEYKVESFAGVYKKLTGQDVAFEFAPSEKADQA

SEQ ID NO: 17045 - protein, 212 aa, Chlorella protothecoides
MLRLWPSCPPPLQQTPITGWLEAFAAHPRLGDRRGLAQRSGAFSDLSRDEQSSAAGAAEATLAALADWNARYEARFGHIFIACAAGTPADRMLAMGIPPMDHVQLDAWEVPSQLGSGHTSAPRQPAAHGTAPCPDTSPAQRRHVGRAIFQRTSGALRNAVGSRRPFRARARTGTPQRRHRHAGNSRRMSSAPPAGQVRGFFNPGTASSLGHG

SEQ ID NO: 17046 - protein, 172 aa, Chlorella protothecoides
MIRIPAHRLRDLDAHGEGARRRRGPAPPGGHARGVGSDGQDRRGGTRDRWRIAFCMFANQFSGHPCSSITSMQLAQPITITGASVFVNPYKELLEEEAKAAAAKSATEAKEAARETESAAPIQPFFALPSADDGEGGVGKYLTAPAGPARGGGTAAPKKQKTGGGFANFDGW

SEQ ID NO: 17047 - protein, 95 aa, Chlorella protothecoides
MRLHTSLGDLNLELHADLAPKTCENFFALLEGGYYTGTAFHRSIKNFMIQVGSWKAGQRSRLSVLWLGMVVLQGTGRDVRAETLAVLRDTRLYPA

SEQ ID NO: 17048 - protein, 179 aa, Chlorella protothecoides
  MOD_RES (74)..(77): Any amino acid
MTSGAPKRVLLLAVDDSDVSLSMHRARMLASGGSGKVRCMRGRDSACRASQVIVRPWPPCRQGRLGERCWNRAXXXXGLAQIHLLHVVPVPLPEIVGGLGGMDTGLVSVDPDPKEDIKHVSWLPGIEISDAKEFIKRRFVTKVATKNIAYKVRQACPSIAQWGTTACVDAAPPAGSYSR

SEQ ID NO: 17049 - protein, 424 aa, Chlorella protothecoides
  MOD_RES (190)..(192): Any amino acid
  MOD_RES (308)..(311): Any amino acid
MSVPAEEVFCHVTRRITRPHRGDLGLQQFKSWQIRADCKWPCTMERCNDVKYHSEVWQIIHDRLVTEPGRIAVREYKSGTLQAIEYKCAQLLTWVEKVQDTFSHHADVSAGKELSEPPAIALYLDNSCFHSTSARDLTHKPSPGRKVPHEHHHLAHCLLGDSLFRPHPQGVAPEAWHTSPTRHQAPHRVXXXAISGSGARVLALRLGTQPPTGIRLPTVHIGPPPDAAAAPEPAQHLCHGDSGNSGPGASTPMPHIYVLFTSGSTGSPVGVLGTETGESTGSEKLCISLRCPALRMDGPGLRCPSPPXXXXHLTQVSSPASGRPGPVMSLSSRHRPLAHSEVAPPLHHSSSPGLLNRVKWAQSQGFLNPSDTYAFKTAPVFVDSLMECLGSLLGGARILAIPRALLKDPAKVRICKATLKSLWT

SEQ ID NO: 17050 - protein, 237 aa, Chlorella protothecoides
  MOD_RES (98)..(100): Any amino acid
MLHLSTCARLGLGPRGSLHPRHVQPRAQPRPARSRSAPAQTRSQVQLLAARDDVGTLRLPLDFIAILTTVSEQKGPNERDIQCAQLVPPPPPPPPLPXXXSPVARQLQPQRPDGALRDPGRRPGHATRPRQPGPLRAARAAWGGGRAGALPPRPRRAPAAAGGGSRPGCGRGGPALAVPGAQGGAGNPGRGARDGAGPLRRRRRPPGPDGARGRGGRDWEDACGWAGCGVHGATEMN

SEQ ID NO: 17051 - protein, 129 aa, Chlorella protothecoides
MRSPSNHPNPHPPRITPPDRPPAGGGRGCAAQAQGGVQPAGRHPDGGAGAGDCGGDGAAGRREGGQGGGPAPRPPNPAVVRREARRGTHLEPLGAAGPQPGVEVQVPGRPDTTRAGKPANLLRLCGRRP

SEQ ID NO: 17052 - protein, 68 aa, Chlorella protothecoides
VPGTARAPGSDAPGPADVATAVHNCHYRPYLEKQAAEVAEMARDEALHLPPDLDYAAMPVSGEGRGGW

SEQ ID NO: 17053 - protein, 78 aa, Chlorella protothecoides
MFTLPAVAVLLTPSKTKAIGEVLVSYAEKVHASAIVMGKSDRSALQELFIGSVAKVRSALHAVRVILKSATMPVIIIN

SEQ ID NO: 17054 - protein, 188 aa, Chlorella protothecoides
MRRAPLFAPVAACPGRTGLSVVAVSAVGDCARIDLNASLKDCDGCSPIALPCAPAPSGVYAPLVALGDGGLAMGCEDGRLCILQAYSGAGWQEQPLQISLPGLGSRITGLVHVTAPGTSLAQPLLVATTASGHVALLAPSEGAVRAWQIREAICLPAPIFSAPTFDVETGSLFLGCRDDHVYCLRIGH

SEQ ID NO: 17055 - protein, 191 aa, Chlorella protothecoides
MPLHRPAVNHQACKAWGLLAAGRAPAASCRAANPVHQPSSAQPQRLGQDAHALSPRDAAPPAQPAPVDPVLKRTRKRNVSNRLHITPELPPEEALRRMRISDANTGKPAWNKGRKHSEESLSLARSAETKAKIRAATAAAMQRPDVHAKVIAALEYRNPVSQEDRPLHASACSKRLGHGPARGLRPVRHPR

SEQ ID NO: 17056 - protein, 355 aa, Chlorella protothecoides
MAASTRHGGRSATSLRGPLITAHRIACAASRETSSRHQESGSLGAPVLSRRQIFLMLQTAGAASLAPMASPPQALSQGLPAEPRGTTQLLSKADMAALTPTQRQLYEYNHRLQVSNGAPAGFPGFVREGYDMRVIAEEGFQVRTQGVRTTPEGLIYKDYEAGTGELPQGEQQVLFDYTAYNEAGKMEWVVAMGVGMAFPLYAYLHPCHLPPPPLPTAGVIDSSYRKNAIAKTRLGIGSLIPGRSIGIRMVEEKAGRSGALVHVSLGYQWDGGLEQRLRFPTTHYHPPTPSGFEMGLKTMRVGGKRRIVVPPELGPPVGPATFFSAKQFEVFDVELRGTQNCRRRQTGFFSDVVCE

SEQ ID NO: 17057 - protein, 537 aa, Chlorella protothecoides
  MOD_RES (429)..(432): Any amino acid
MFACAAPAPILVPIRSHAGGCSAGSPGSVPRVRPLRRDLRAGCREIPVHSRSLSVQASASEARTHAERQASFFSSRVQDLRDGITPEIDARLHTIAGSVPGLGPASRVLDAGCGIEALIPHLQALGIQDILAVDTCPAMLAQVEARFGQGDSLGNVPCVRTWPGDVAELPLYQGPFSAVFFNAVFGNLYDQHAALLRATQLIQPGGYISISHPLGRAWLQEFRWQDEFRRQREPEVVPHELPDEVALQRLIHTLPLACREYVDQPDMYRALLQVPLRYAFPGGPLRMSGPVVSGFGRGSRQLGVPTANVPPEGFPDSLPKGVYFGWAQVDAVPDAPDADRAVHKMVLNVGERPTFGDAGFASEWKECTQTCSQHARELAHMFYHQPTSPSSSVSRPGSECGGTHHAWVLRGFLRTVHKTCDPGIYEGSXXXXVRGPGEVVKSGTNGHLPLDCSCSDLPDLHANADRRFLLGACRSCYLRYDEILGLHACSWMIQSFKPFLATSSLPPEKFLHIIRSGHLQAKSAVCTYIIPGSGSVS

SEQ ID NO: 17058 - protein, 255 aa, Chlorella protothecoides
  MOD_RES (16)..(19): Any amino acid
MFHRSSGSGIELSLDXXXXRLARSAALTPHTDLPIPPSHPPALHSHSPLPPAQEFPMFHRSSGSGIELSLDEFLDAREVVQGMSDEYAAAESADYVSLWCCPLGPRHCVVCWSGRPVDRMTRPRCSMCRALSDIEGPSSVAHPTDREGGRRGRALRPTRRSDESWHGPAGAGAVTRCDAMDPSSRSLTLCALLDLLSLWSATIHATGSCKLPSLVHQGTPHIGVRRALVPRQELSAMTHVCDRDPLPARHPGPLL

SEQ ID NO: 17059 - protein, 1424 aa, Chlorella protothecoides
  MOD_RES (183)..(186): Any amino acid
  MOD_RES (725)..(728): Any amino acid
  MOD_RES (749)..(752): Any amino acid
  MOD_RES (903)..(906): Any amino acid
  MOD_RES (1061)..(1064): Any amino acid
  MOD_RES (1103)..(1106): Any amino acid
MHLSQPWMGDREVCQTLHPTVPFILQISSYREEVAMVVGLQGEFKDLGGDVIETMARPQDLRTTRHKNTIHELESVCRGEGVGRMSRSASALPLRLQPDFQSHEPTNPKTCRVGAIPRRRAARGTSPIHSPALHLLGGHVGQNRNHTGSRSFQELDVGGRDVGVALGRTFSLMSRAIRKHAEXXXXHICRCEKSSTRSAKSRTAIPSHKKDMGGRLTGKIEPEPPAHLGDNPNDRTHVCALLVSLLVALPLVEHGAHPACLPAVWPDGQGGECPQQDNEDSPAESHPVPTQSPLPKLPPCERIFKAVHAGNLARRPAARPMLRGLTALLERISHVVVQVLETSLTAPETHAPLPEQHAARDNHAASWSMRQSGAWRVLGLAHCIGCGPLPDRHPPERIVAPCPQVGTEFWRKLCLEHGINNDGILQDYAAAGDTGDRKDVFFYQADDERYIPRACLIDLEPRSEMDDHFRGLLAFIEHDPPRAQQALRMLRCCCNPLTRLHGLLHTPSPAPLSAPKAPPALLNTPSRQPQGNQRHPELRGAQPVQPGEHLPVRPRRRRGQQLGLRVPPGRVGAGRHPGHGGPRAGLLRLVGGLHPLPLHRGWHRLRHGLLPAGGPERPLPAQAGPDLLRVSKPVREQRRGGAALQLPAHAQAPDLECRCAPRAASLAGFRCEAACTPIHPLPPTPQTPLFLTHQTRLVSTVMAASTATLRYPGIGSREEGSAWEXXXXPAPPHCDTQASAVGREGAAGXXXXLQLPAHAQAPYLECWLGMERHTSEDALQGSSKAPTAATGRAVPTFYRLPPVLVLGCGPPCACMLPMALTFPSFLEQPSAGYMNNDLVGLLASLIPIPQCHFLMAGAWEGARAGWGTRRSLPSSGSWGWGVGIAVQGGKTRLTPPPQCHGLXXXXAGAWEGARAGGGNRRSLRVSGSWGRGVGIAVRGGKPRPTPPPQCHVLSDIMPRLHPRDPGQRGKQGGGHRQEDHGAGCHAPATPGTDLDGGLGMNWREERRIVADLGTSAARFANLWLQSDIWAAVDVELRDIWAAVDVELQDSLGSIPTFPPSXXXXICVPVAAWRACPSGRCGVARRHARAQTRAQVKPQAQHFXXXXHPQPKNLMVSTPSRAKGLDQSKYISILNIIQGEVGGERDDGEEGMQEKRDWVRRLICQGMPVTAPCMGAPSPVMNLRACRCVACLPVRPLRRSPLARQCPNSSTREATGSAFPCFPHHAGRRGPHPAPPVPDAHPGAAAGQLHRVGPRLHPGAWRKAEMHRAGIPGCSASVACPGTPLPPSQRWQGAGREAEMHRAGIPGYSGSVACPGTPLPPSQQWQGGAVPQVAVHQIGTPGVGPDAGKPHLHPPPVQPHHLPVRQALPAQGLRGQLQGGVGEGLLALVGGPRVPICRAAVIRAGALEADASGEAGEERCPHAAH

SEQ ID NO: 17060 - protein, 547 aa, Chlorella protothecoides
  MOD_RES (43)..(46): Any amino acid
  MOD_RES (196)..(199): Any amino acid
MARQGMYFQASLLLAVVTLLFGNSSAQTGDARLSRFPVSVHDXXXXHFQASLLLAVVTLRFGSGSAQTGDARSSRFPVSVHDIVAALPGDVDHMDVARASRIWRKVGWESGKGGAEAMAGGPLEDGCADQGEWERATKGGEVVPTSTPSTSNPINMVPLQLERNHCNLSEAPNRISAHRTNFTIAQGVIRTYIAGXXXXRGVGKGSRRSGGSVYKHAQHVEPDQVSSGPTSLATPLPPPRLWQRASCTTRPGPTTRMTSRGGKTLAEFGVFALEQFCSRRGGPRSMYAGDTRAGLVPFLAHAHFGDTYSWLLYMDDDTVFFPPALLHLLRDFDPAIPYFITGGCQSCYQAGVGKVLMGPSGRAHCSVALPASPGSCMNHDPEVHAPLCAPSLPAASGSQIDHHATRLRRPPLVRQRHGTGDAPPSPGPALPALPLRRGAVRAPAPLLPRAARLPLHPAAALRRGAARVQRALRHPTPPRQHLFHARRRGGGALRRPPPRGGPGLHGGLLPEPAVHRRRRLHLHLPLAGRLLCHRPGAVRVHGGRARL

SEQ ID NO: 17061 - protein, 203 aa, Chlorella protothecoides
MRIAMTLVGLGRSLCASSAGPAKQAWTCRSHADLSASVSRAYPTEPRVGVGVVVLRELSPGNPETLLIRRAKAPNKGDWCFPGGSLELGETLVQCAVRETLEETGLRLRCRLPQAEHGQPNARHPPLSPDLAYPSSFIAGDAITYDDAGALAFHYAIVNVAGVPENPEAAVVPGDDAADARWFPVTDLRGLKGEEVSESGTVA

SEQ ID NO: 17062 - protein, 797 aa, Chlorella protothecoides
  MOD_RES (198)..(201): Any amino acid
  MOD_RES (520)..(523): Any amino acid
MLWAPSEVFPCDDRTGYPHQPCSASQHPGHWRRKKMIQSSGMSSRHPWLGQVLSSARALAPRQAESKSRGVHQLCMPPTPSNVLHAHHNLTQAAPEGSGRKFKVGPMALRTWWFDQRLLTLLESGKQGPGPRQVVVLGAGMDTRPWRLQLPLGEREMGEMPFTNVRADLWMSHAQYARLLTRFQDAPVLHVLCIGAFXXXXETAAASSTQDSSDASKMLLYCMCCAKKHSIPVLQVHNKIGDTWILHRHPYSGVSWYEVDRSDVLAAKRHALKKNGAGLEPGHTRKAYPLLTGSWKGVEADLEEPGWWESLLASGFDPGSPVVWLAEGLLMSWVRALLLIKRAHLQHALAGTVCLIARVSCMRKGAPYDPSMLWVLLATFLPHLSIPICPDLEGKSVASLLSTISSEAEGQGANLSPIHDHFERLSDFVMPHTQPTLHAILSLLCPRAVQPELRPADNEPHREHAEQAQRGALAPGRVDCHLEVWLPHRPNRCEAISYQGRRSCGMDCAPAVSPCFNPPXXXXHLEVWLPHRPHRCEAISSQGRRSCGMDCAPAVSPCFNPPSMGSDAVMDDHSSPQNLACLQYFAALGWEVESISTRADMATALKLDPEICQKSPSASPGAWAQGATTWGALEDLEVKALDPSASHSHQECCTHPCNHQSDTYQYITAGDQRVDTGQPPSRQTTIPGAELTARMDFQGQRLSEKLYVAILSLSGAVAFLVGYLTQSFANMLIAFSCGVGISLLMSVPDWPIYNKHPIKWLPASDAPRAEARQGGKAGSQRKQRPPSASWRNFWNLF

SEQ ID NO: 17063 - protein, 444 aa, Chlorella protothecoides
  MOD_RES (88)..(91): Any amino acid
  MOD_RES (250)..(253): Any amino acid
MVSRASFLAFIAITLVAAPCALAITDTDILNFALNLDRPQWPAPWRGKMAWWCSGTDPSVQLPLEPRVIVKIPCRLSMMRDAKTPASXXXXASSRATHDCKIPCRLSMMRDAKTPASAAVKYRLVFNPGSLRRRVGLDSDLTGGGPEVIGGEKANLTEKGAQLEVHGRCDAYASTDALSVHCSRRQAFCDFFFAEALAVDEINHVRLLRCVGVLGFSTSFLADGRLTGMRGDHPKLPTFPYFTGQFFAEXXXXFLSRRSTDWSVLGDAAVPIPAIDLGPAFAAAANAALNLTLDPPFTPYANDLFFYHGAFIFEDVGVTAYLGALPSISDTTYVPTAAGIAAVEAYHAGAVRAFLLGDIDTVTPYGVPVSTIVDAIAALRETVQGEPVDAFDLGGSESAPLFVPASANTSVAFSRDPSQILAVVYLGGTDKGGFFPEGLNGNIK

SEQ ID NO: 17064 - protein, 167 aa, Chlorella protothecoides
MGREGEGGKAGGGRRVVTLGGSGACKHPSRRHTLRQQTAAAAEAAAAEAELRRRQARTQAAAGLLARLPAEPGRGAAGCATCLLRLGDGSRHTRRFFLDGSLQPLLEWAEASGAAALPERYNLVLQYPRRTLLPPQGGQWPSLAEAGLEEGQNVIFVEALTAGDDKA

SEQ ID NO: 17065 - protein, 138 aa, Chlorella protothecoides
MKGANVLRVFAFSDGYGTQQNILTPVPFQPRLGEYNEEALKRCSGAGTGAPQELFYTDPEIRKYFKDYITKLATRTNTVTGGGCANCQARRIVGASDALKLALQTALRLQIQIQTFSLPGQRYVDDPTILAWQLGNEV

SEQ ID NO: 17066 - protein, 114 aa, Chlorella protothecoides
MALRRAILVVLLGALSALAIRPDSGEARGMSSMLYKRKRDKQTDKERTNMRPIIGVVSQSASNFSRNGIYVQEGDPAPKGHTYIAASYIKFLEAAGARVIPILADMPPEEVERR

SEQ ID NO: 17067 - protein, 88 aa, Chlorella protothecoides
MTAWTREMSAHIKSLDCNHMVSTGHEGFTTNGDCCNGHTWLNNGLTGTDWVASNLEDPNVDFATLHVYPGEQQGAQAGCGEENSRTCE

SEQ ID NO: 17068 - protein, 59 aa, Chlorella protothecoides
MENHVNGLAWTAIAENPTLVDFFDVLTLSIDRGGRTYVSTMEAIDYPITATQWCAGGRF

SEQ ID NO: 17069 - protein, 111 aa, Chlorella protothecoides
MQVPSTTYMTRRHPEKNAYEWTLDKDIPHNPEAIVITQEVGNFFVNRARRNQHNIANHDDEVDLLIYNFDLVYTGKAKFEGEEVDFDESYFFPPWEKVREVEEAKRQARSG

SEQ ID NO: 17070 - protein, 113 aa, Chlorella protothecoides
MRRRKHKQVRRALRFYRIQHGFRAPFKVLADGNFINAVSVLRNEDPTELLSELLGDKVRVFTTPCIMHEVRKMGNELSKARDACRRLALHHCGHEETTKLPAAECLAQQIGEV

SEQ ID NO: 17071 - protein, 162 aa, Chlorella protothecoides
MEGVPTNPTRPWDSREFYVKWARNSYLHCSWDTLSTLSQLAGFKRVLNYCRRVDEARARRAALSAEERELSDLQAALQEQLEEEHSRVERVVAERGGGGVGSGEDHGYGSSSGPAAGPRYLVKWRGLPYGECTFEAARDVLRVGGGDAIAAWQAREAARAQP

SEQ ID NO: 17072 - protein, 359 aa, Chlorella protothecoides
  MOD_RES (147)..(150): Any amino acid
MPPPLMPLQTFRAHSMPVYAVRWSDFHPRVFLSAGADWAVRLWDVNDPKASPESGLPWCKDMTVGGCDGQRARQLVLWSAIVLCNSLCLPAASKCPPEKHIDPLIHRPSMLDALVRVCLTRLRVVKVHESCSSLAQAWLSPVTYPFXXXXADVAWLPGASVVFAAATENGRVHVFDLSKDRRHALCVQKSWTRNALDDRRSLLDSLDDIHNTETSVIQRSHLMHDARSLLTRQNSQSWPSTPRSPCFLWETTGGAFGLGLMDEKDALVRVSLTPLRVVKRSGDLPQAVAKPATHQQGSDGWRADPAGKPQPIPHSAAADGKARVSLGSWPCGQGRPCCHRKGQGVGGAGRCDGSPQEDS

SEQ ID NO: 17073 - protein, 1113 aa, Chlorella protothecoides
  MOD_RES (279)..(282): Any amino acid
  MOD_RES (345)..(348): Any amino acid
  MOD_RES (531)..(534): Any amino acid
  MOD_RES (615)..(618): Any amino acid
  MOD_RES (673)..(676): Any amino acid
  MOD_RES (822)..(825): Any amino acid
  MOD_RES (1049)..(1052): Any amino acid
MRFTAKVGGGWVSDGCEGLGSYRVRPWWHPDHYFCYYALEYDVYMYRIAWLFICLCPGPGRPTDGEGAATHQPSAPSLRRHAGEGGAGRRLGLLRGRPAPQGDDGGALPRRLRPAHPGAAHQAAPPGPALQGPARPVRWERGPGAAGHALLGREDGGVAVGAALRPAHAHFSRCCGAVRPAGPAARLPGRRAGQGLWARASAHGVEDERAAPAPPAGGTRPERHGERAAASAVAGLHLLLRRRPGETQARSLGVQARQLGGIVGVAEECRLSALPGRHXXXXSGSRPASSAVSSGSRRSVASRPCQGVTDLSPEQQRAVALVRAGKNVFFTGACTWGGAVASLGXXXXRREERVLHRCVRAGGCNGVPWDERILPEGPQQPSRKGWHSGLWRQQRLPGRVLARVCARSSQQTPETTNPCLAPGCAGTGKSRLLAAIMSVLPPSTTFVTASTGLAACALGGTTIHAFAGVGRAEGGIDAMAARAGLGESAQRWRRAAALIIDEVGQGGGSGRRPVLDGTGRAPPHPDTLCHXXXXGGSGRRPVLDGTGRAPPHPDTPLSRPRYPCWMRTCSLLWRSWRGACGAPRPRLGASSSSSPATSTRSAFEGSWGWEAAVWXXXXPLRRLPPGQRVRVCGAGRMLYGHQGLSLACWPAGGGPCNCMQGPLHGLMHACPSXXXXEVGHVIACRALCTALCTPALYHEPPPPPCSAPWVLALPPLLMVPKHLDLHLTICLQLPPVTRGSGRRAFCFQSSAWERCVQASVVLSRVYRQAGDEGFIALLGRLRVGAATAAELEELQRRCAPRAGPADAPDPAPGTGAFAPPPXXXXAGPADAPDPGPGMGASAPPPPAVLSTRLFTHRADVDAVNAAALAELPGPGRTFHARDEGAPSEALDAACPARASLELRTGAQVMLLRSLAPREGLVNGARGVVAGFDAARGLPVVAFAAGPTRVVAPERWTLRSGGRGGAAREALPLGLAWALSVHRCQGMSLDAVEVDLARAFEPGMAYVALSRVRGAAGLTIAPGGIAPAALRADPAVLQFYEHLLSTRGGXXXXRADPAVLQFYEHLHSTRGDPVLEEDKEADTASTPPPPPSRGSKAPAGGATMGARSTPLNLR

SEQ ID NO: 17074 - protein, 387 aa, Chlorella protothecoides
  MOD_RES (170)..(173): Any amino acid
  MOD_RES (362)..(364): Any amino acid
MFNRDKLKALADQAKAAGGRLATSAQAGIAQAQQNFAAQRAANPGSGIESCVSGCKATMRLRMSLPVCYADPNATPYPKSPVHNADLAAEDAIRLLTAQNEALRMRLKAQKRLSEENEHLRAALEQLQVLGRSAPPFTPIANFQGRDEGVAAPGPASERSELESQVEMLXXXXNEVNHAILHEWELHCPWALARSAPPFIPIAILQGRDEGVAAPGPASERAELESQVEMLVAALADARAEAVSARSAAQDAAAELAAALRTVEELRSERCSLRELQAATAEAAAQAAALEREKRGLQATLGVERVERRELELAQAEIEGLRVCLGESQAAWAAHVAAQELRGREAGPEEEEGVQGAPGAAXXXAGSPRRVAGCAGSSCCDPGAAWT

SEQ ID NO: 17075 - protein, 249 aa, Chlorella protothecoides
MNPPTPPPLLPISPQDFGLKALSKGDRLDIDLKSVYVAPRYTLVSSITRDGKLAAAVTYKDLAPGLTLGLSGTVPELETAKVAVDYSLPHLTLKSVVSLASSPKVDLAATTGYEGVTLGASGTFDASKSALTRWTAGVGYTAPDYQLTALLTDTNALSVLLAHRVAADTTIGAEVSRDLGSSATSFAIGSSRRLAGGALTKAKLENSGILSLLYEQELQPKTKVALSTQLNALDLNAPPKFGVGFDVKY

SEQ ID NO: 17076 - protein, 96 aa, Chlorella protothecoides
MRSLASEPCWPYSPASPIPAASPPHPHGRRRDCRESVSLEYLKNVVLSGFYTGQLPPTSPLVPVLAKLLQFSPQESRQIAAKAAQASQAYRLLPGF

SEQ ID NO: 17077 - protein, 157 aa, Chlorella protothecoides
MGDQDALSTYDQIRLTLSSSYYTLRRALKLNRLRDLLQQSALAPDAPIWIMGQEYAASPELGQEEQEEVREWWRRGPVGDSHLRTDAGWGCTLRSGQMIMAQGLRRHLLGSDWRWPEESVASPPPGLASLLSLFHDLPQTSAPLSIHSLCEHGRACG

SEQ ID NO: 17078 - protein, 152 aa, Chlorella protothecoides
MASFADAPAGDAAKGAKIFKLKCAQCHVAEKGGGHKQVKIRGESDEGRAGIDSECVCPQTLPRRYARHCKRAACAGPNLGGLFGRVSGNAEGFSYSKANKEKAVEWSESTLYDYLLNPKKYIPGLEREGVEGERGRVVPTDQTLSSSIDWEL

SEQ ID NO: 17079 - protein, 260 aa, Chlorella protothecoides
MAKSMEAVARTSRPLLDAGLTVAVLDEPGGAHPSFRGQAGTSDPPDPPPLPSHEDLWGGPFGGEAAAGPEPGPDGGAGPSSCAKRPGLIMLVPLVLGLGKVRGGLSGVKWASLMRRAVGGYSMDLANPAPSTGRRSRVYDNIMRLDCLAEWGCPFTSPLSPSAQLNPRYIPQLQAVLTMPQSIGIVGGRPGSSLYFVGTQQDLLLYLDPHEVQEVRCWAGVLECVCIEGEWSGGRRFPHWDSSGLGCWLTVFSSSGFLMW

SEQ ID NO: 17080 - protein, 258 aa, Chlorella protothecoides
MEGVVRAWACPLSSTFGEGFADHQRCVLAPPSTHISPHTPHHPTPHCPSKNALNLQTIPTLPTQIITHVASTRVAEFAFDYAQKNNRRKVTAVHKANIMKLTDGAFLRCVRAVAERYPDIKYDEMIVDNTCMQLVTRPTQFDVMVMPNLYGDICSDLCAGLIGGLGLTPSGNIGANGLALMEAVHGTAPDLVGKDAANPTALLLSGVMMLRHLRLTDVAGNIEQAVLATIAEGQYLTRDLGGKSGTKDFTKAIIGHLK

SEQ ID NO: 17081 - protein, 75 aa, Chlorella protothecoides
MSRLRAPWRAVPAAAAAFDPRLLASGEDVDALLHCIPTPDQAAALESYVAAGGDAAALADAEALALALGRLPRLA

SEQ ID NO: 17082 - protein, 622 aa, Chlorella protothecoides
  MOD_RES (374)..(377): Any amino acid
MHPDRAPHGRHVPHRRQSLPGRRRQAGPDLHHPPRLRGVPGPPGRAAGPLGLLPAARCGVHQGPPAQPGGAQGRPGPVAPPVSLAGGALGRPVWRPGGGELPAAGVQAPPLLRQLQLHPPGPGARPAAGLLPALGAGARPAPVEPAGGGVVLPTRLRRAPLALAPQPAEVAQPGPHPPQRPLPRHGRALALVPDRVQPTHGGARPPGGLPPGRHPPRVGTGPGAGPALSSSAGRHRTHAGVGRGGREGSRGLLYNPPRMVVRRGGLPSCLLGRDGSAPRCPASSPPPVAPLAPTRPRAGGPQAHRRRECAWRTVSRAGGGGKAGPMPLRFQEGPVCAQCRGLVPPTADWGDAPRRPKHMQATPPVMHQAVLRGXXXXWDSTRVQRAPSVVGPFPQQQTGVMLLAGRNKCKPPPLSCTRLSFVVDAESGVAGPTRHSRLHDFAAEDSRPIYSFADGRSAVVDVERLPICAQFRALGQINEFEGVLVEVEGGGAWRDPLATCLPPPGGIQHGACWVDITLTNRVSVLPDIQTDSKTYKLIQRSQNTASPSRKGLWQPEWVPAVFVVYSQAQPHPAGHSCAIVAGRRLLASSRSKKRPASEQGTSRARIVEPQAVPLSLPICLGI

SEQ ID NO: 17083 - protein, 656 aa, Chlorella protothecoides
  MOD_RES (134)..(137): Any amino acid
  MOD_RES (249)..(252): Any amino acid
  MOD_RES (276)..(278): Any amino acid
MRERRVQTCANINAIAWVPSRRVLGATGAQQSPSRHGLRSESLAGSPLSGISDARTTVWRRQHGGGECAAGCGGAHRRPGGAPQVSSVSPLFSPPPACSSDAVRANLRAQGAWVGTLRPWQGLALVLLGNVVGXXXXANLRAQGAWGGDSYALAGPRARVAWKCRRGNWVGVDGAVPTGRIHGAPPHTSILLIDAQKNAVAVAHVKRGKGELRLNGGQAWSRVGNARWNDGLSLCRALRLPTVRHGTSXXXXATPAGALTLQSTPAPYCLAWHIPXXXPPPPPPPPSTPTPSRCPPGAPAARHHAPEGAGARAPAGQAALLQCGCPHPRARWRPRRPDLRYPPGHRQGHRGLLPEARGRAVQEPDQGRPADLRPHPAGRRPAPVGAQEVRWPGRPCPLPEVLPLTVPMEGGRGARLAGRVLPLLHAVTCKEEPPWLRDAREGRGQEGACRGGTLLQGRHPLVQEEPPWLSDAREGRGQEGRAEKVPSCRAGIHWCRYGAHHNAKSLTDHCLLARSVSNSQGAQAGRNSHSLTFSEAQRCHSSGGLGGACDEILHGGVYPKVRLGVTVHELAAGLEYQDAPQHGAIAGEVGILHNSALVCGTSVLESAAVNGWEGVRESRAYGSPGLMVLGLMVLEQMQNACCALSHRCSVLDPTQI

SEQ ID NO: 17084 - protein, 110 aa, Chlorella protothecoides
MADADVPLPTSAVLTAVSKHVGIRCSKVNQAYMQCKAEHSNPADCLGPGNEVTGCLVDLLKEVHAQAPAEFKKYYECLDYNRWGESGSWCSHLPGQPALVVASPRIAMLA

SEQ ID NO: 17085 - protein, 209 aa, Chlorella protothecoides
  MOD_RES (111)..(114): Any amino acid
MGAEDIRDEKVKVLRSMQTVRLEDMVLGQYRGRRVKGMSQPGYLEDPTVPPNSVESPLRPSGASDCVERFMGVASLLHQRRLLITQHPPIPALQPDADVCRMRRLPEQRAXXXXPSGASDCVESCMGVASLLDQRRPLITQHPPIPALQPDADICRVRRLPEQRAVGRRPFPAQGGESAGGAHGRDPGAVPPRPWQPLPGQAGLLGWHE

SEQ ID NO: 17086 - protein, 202 aa, Chlorella protothecoides
  MOD_RES (151)..(154): Any amino acid
MIVEKPFGRDLESSRQLATELYKHLTEEQIYRIDHYLGKELIENLTVLRFANLVFEPLWSRQYIRNVQVIFSENFGTEGRGGYFDQYGIVRDVIQNHLLQILALFAMEQPVRVWGCGGGLCLARGGREACGRWGGFHGLTSRAPPPKHNSXXXXRGGYFDQYGIVRDVIQNHLLQILALFAMEQPVRVLGWWWGTLFGEGRS

SEQ ID NO: 17087 - protein, 709 aa, Chlorella protothecoides
  MOD_RES (27)..(30): Any amino acid
  MOD_RES (57)..(59): Any amino acid
  MOD_RES (99)..(102): Any amino acid
  MOD_RES (445)..(472): Any amino acid
  MOD_RES (547)..(550): Any amino acid
  MOD_RES (558)..(561): Any amino acid
  MOD_RES (635)..(661): Any amino acid
MLPSFHPYSVDLETMWQRPHAGYPAAXXXXCPRSTHIQWIRKPCGKGHIPGYPAARXXXSSMGTSCRRMVGASVARPCAALPYLHTFVEMCPQHICSAXXXXLMALHAPTLRSNIRSGTARILGYQPGVLLSTYRTTRMESSMGTSCRRMIGASVTRPCAALPYLHTFVEMCPQHICSATCDQLLSLWHWMSIQRMDALLNSITKVSRLSLIIECSSAIPFMVQSSRIDGRTSTNSNTQLSSQAILKRYYLALSPPDSHGLGPNTALQPAQCPARNRSINPWPPRSEAHSMASFTSARVDVGRPRLHAVSLARADSRRAATGAAGVPAVQHWSGRRAQGSRGRVAIHAASSPPAIEQDAPGAGPLDSDALQVRRGDCIGLGLRLHDNKIPCLIHALCTHKRQAYDLPLEDWSQSALSICVVGASGDLAKKKIFPALFALYYDNHXXXXXXXXXXXXXXXXXXXXXXXXXXXXSLQPPRLHLPNQARWPALDLALLMQHFTIFGYARTKLDDAKFREMIAGNLSCRLSDAGDCGAKMEEFLSRCHYQXXXXAQAVGSRXXXXVRLGVGEVVANAPESRLTSCRLLGAGSAFPHIGLGPCEIVLHLAPLLPLLVPRQGQYDSLEDYGALDKRMCAAXXXXXXXXXXXXXXXXXXXXXXXXXXXPSRPTSSPPWPPRPPAQPPPSEHRWPFTFPFSGQSLLGACLVSAGTAM

SEQ ID NO: 17088 - protein, 145 aa, Chlorella protothecoides
MAVPPCKLQRAAGVGRGQQGVRRARPPWARSAVGLLEAGTGARATELLGLRPARVGDQQGAVVGQQDVLDLVLGLLVHVLLVEGHDALGDGLADSVDLGDVASTAHADADIHIGEALLAQQEHGLQHLQAHGVGLQELQGGTWME

SEQ ID NO: 17089 - protein, 123 aa, Chlorella protothecoides
MLLSINALQARPTPPRRDDYETNKTLRRALRGVRKDEGARESQRRALGLPSSVRLLPGSRADALRAAAVDYGAGGGPGGEAGFQRDWKAARARIKAADAFGGPAPKRKLRAAPGVKLALSKPQ

SEQ ID NO: 17090 - protein, 146 aa, Chlorella protothecoides
MSVLCREQTLAVWAEREKFEKLGVKLILTVHEWKQREIDAFAPEYWGGAVFYDPERTFYAAVHGGSVKIASRLSLLNPFSTGFKNGRAAYKRGVVKDSNFTGNGTVLGGVLVFKAGGELVYSHAESDFGVHPPMEDLVAGASKAAA

SEQ ID NO: 17091 - protein, 141 aa, Chlorella protothecoides
MASSRGTVMELGIGPTITAGLVTQLLSGSKIIDVDYSVKSDRDLMCVPEGFCSGSLSGFVGRGGRLGTQRNGFQAHRVRASLRLLACLVCFSASKLLGGVCRAPSVSAVPTAHPVCVTRALCAGSQVAQPCAPPLPNPLPN

SEQ ID NO: 17092 - protein, 243 aa, Chlorella protothecoides
MDGFLVHHKVRSGVWHRGRFCTACEGGEEGRWECHGGLRAQGRPDACSRGGRAAPRPPRGSRPSLSSAKGPPPLRPIPSSSTTPHLKDFARIAATCLPGRRVTEVVALYYSLQRTDVFAATRRKYQLRKRREQTEVNLRARAATFMGMGVGGEGAAKRGADRAAGGPAPGLARTVSRTEVRRLGGGLGEGENREVTWVGRISAGVSGELQSARGLSVVARGAPWPCSRVCESWPWAQGCACAC

SEQ ID NO: 17093 - protein, 329 aa, Chlorella protothecoides
MSGSTLLDVLGGSPDSPAIVVGSGGQKLTRGQFLELATQFAQSLRASGVKPSDLVTIVDSNTGRAKCMSHAHAWGLVAHASPGGLDQEHSETRKSLMPHTFRHPHYCAARVCSGVPGHDPRQGCGRPPEPELSRGMWTLCRTPWASWAPGTEWPSGRNLQQRCHAVMEELLLPWLAPLLWLLPSASLTMHGSPPMSAAGQPPPPSPLQEEFKYYQEDAGSTLVVVGASGNKGAEAAGVAPAIGVTLDFASGAPVLQLASRAGEFALKTAPAGEALADPPRGDDVALFLHTSGTTSRPKGVPLTHANLTASLENIRKVGSWAAPGGTGVC

SEQ ID NO: 17094 - protein, 360 aa, Chlorella protothecoides
MGAHHVTACIGPCNDGGGTGAEDLLGRLALPPPCPVRRARQTPPTSTLQAPTPCPPPCAGWLAPLSAGASVVFPAEGRFAAGTFWKDAAAHGVTFYTAVPTIHQILVQRAESDFPTAAPPPLRVIRSCSSSLAPATLEAVEAAFGAPVLEAYAMTEASHQMTSNPLPQHGPRRPGTVGRAQGSVALVILGPDHHPLPAGEVGEVCIRGPNVTAGYRANPAANEEAFAGGWFHTGDQGRLDAEGYLQLTGRIKELINRGGEKISPIEVDGALLSHRGVAEAVAFAAPDAKYGETVAAAVVLNEEGKRLGEGAVEDIKRHVGTRLSAFKVRGTQILVWVEREAIGGAGVVGASRLGDGHACA

SEQ ID NO: 17095 - protein, 1092 aa, Chlorella protothecoides
  MOD_RES (107)..(110): Any amino acid
  MOD_RES (260)..(262): Any amino acid
  MOD_RES (632)..(635): Any amino acid
  MOD_RES (890)..(892): Any amino acid
HVRDGGLLPGLLHPARRRGPPHLPRLPHRAGPARGHGHGGHGPGAAPGRGALSQRGRAESAAESMRLAGGDRSRARADLSSAAAHALPLRDVCCCSEALSVGKASRXXXXGTACGLGPTSPLQRRMHRPCVMYAVAARLCQWERRREASGPPQQPGACETPRPGRPGTRWCPARPAGAARWPAAPAPRPGPPAAPPGPPDGPPRAPGWTPAARPRPVARRAARPARPAWGDPLLTETCESASLSTAAPLAMSYYEIMMPXXXAQLLGSWATFTDHFMPGLSWQSPGSVTVNGSPTGHVLLQLVQLICQRRLLADGVEVGLDVDSGSMQDLGGHVQMEGNALPGCPVFAFTFGSPGAKSQPNPSHLTIALPEDLQELGLNVWKTLGELLLIGAPQCMLDGPSIRICQGAHPPALARSTLLAGCAWGRTLLHFGPGWCQAFAQKWHLRRSGEERWEWEEGGDVRASVLHRVWCSRARGITPDHTSGPRWRGNPRGAAHGQCMGQNQSAPGSGQGGPGDKQNGQEKKKKYEPPAPPPRVGKKQRKRGAGAGLGSKLPTITPTSKCKLRLLKLERVKDWLLMEEEYVTNQERLAPQEERNEEDRTKVDDLRGSPLSVGTLEELIDENHGIVSSAVXXXXVIREVTLHYRSASSQFCSHGIVSSAVGPEYYVTIMSFVDKTQLEPGCSVLLHNKVWCAEIDEGCIVLFSPSTPLPTHTLLQGMHVVGLLTDESDPAVSVMKVEHAPTESYADVGGLDQQIQEHRRSTEQTADAVARTGASALLHCSMSRARPVSPQEIKEAVELPLTHPELASSCTASPARARRCWPRPWRTPPRPPSCVWWAASLSRNTSATAPSSSASSSAPPTSSRPPSSSSVCGVGATGFCSSFQAAFPAXXXWCVNWGRLDPVPPFRLPSLPLAELLHAPPTPCTIITPLIHPIPADEIDAVGTKRYEANSGGEREIQRTMLELLNQLDGFDALSDVKVIMATNRIDSLDPALIRPGRIDRKIEFPLPDAKTKRRIFAIHTGRMALAGDVNVEEFVVAKDELSGADIKAMCTEAGLLALRERRMRVTHADFAKAKEKVLYKKKDGVPEGLYM

SEQ ID NO: 17096 - protein, 234 aa, Chlorella protothecoides
MLTDGRGHDPRLPGVWRVSSLPPVCLGAVQRPRHGAVPPGRHPRVPGRGQHLVVSIAAGVRLATLEAGLGAGVRVARVMPNTPMLVGQGASAYALGSAAGERDAALVHALLSGVGMALHVDERCMDAVTGVSGSGPAYAYMMIEAMADGGVQAGLPRATALALAAKTVAGAAAMVLGEGADGALDLTHPGVLKDRVGSPGGTTIAAIAELENSGVRGAFMRAVRAAAERSAAMG

SEQ ID NO: 17097 - protein, 304 aa, Chlorella protothecoides
MRDAHAPLAQGQQSRLGAHGLDVGAGQLVLGHHKLLHVHVPRQRHAPSVDGEDAALGLGVGEGELDLAVDAAGADEGRVQGVDAVGGHDHLDVRQRVEAVQLVQQLQHGALDLALAPAVGLVPLGPHRVDLVCGNRNPVAPTPHTDEDDGGRELVGGAEELADELGAVAEVFLDKLAAHHTQEGGRGGVRHGLGQQRLARAGLAVQDDALRRGAGVSRTFKLSTKHALSPGLPGDHACKAKVLALGGLMPMSSYSSGCVSGSSTASLISCGETGRARDIEQWSRAEAPVLATASAVCSVDRLCS

SEQ ID NO: 17098 - protein, 120 aa, Chlorella protothecoides
MQQSTPPRTASKQCAPRQGRRVSALADAYGRTIKHALRGADEEQFAECFPNIQPELLEILWQGYRQVLHGSRVHIESDFDAICEETALTDKLHQLEELCEAQGVSDDPHARQAVGWGLAS

SEQ ID NO: 17099 - protein, 144 aa, Chlorella protothecoides
MAQALESRHVSARLHKWINLVFGYKSRGQRAEEADNVFHYLTYDEMYDWFVSVGVGRRGLERVGGWRSCMFRPDAAGSNVLPLGRCGVSGGVDHGGYRGPRWLDAPASPGSNESPLGRCGVSGGVDHGGCRGPGWLDAPASRDV

SEQ ID NO: 17100 - protein, 134 aa, Chlorella protothecoides
MPPFMYGCHYSSPGYVVFYLLRADPKLMLRLQNGRFDAPDRLFWSVADSWKSVLTLPTDVKELTPEFYSNDPTFLVSLRRCWWWGAQAGPVMLVAGGWRGDASRPGSTRSSPAEWDDGAHTVTPEACEPQRVLP

SEQ ID NO: 17101 - protein, 334 aa, Chlorella protothecoides
IPSQLKVCSQALYIVPRDEAEAILRIPLAAIDSLTELEGESTPTGEDLLAALPLLRELLALESRARGGDAAAARAAGAGLRDLIAAHEAGLPFNLGWLEEDGEEVAAEALAAAVTPLVETRGRVVVTQARLYFQPFNLAAQAPVQSHRLDRVTDVQRRAYRLADLGLELFLSGRESLYLAFDDPPSRARFQAALERQPALRPLRPRSLRRWQREWVAGRVSNFDYLMHLNREAGRSFNDLTQYPIFPWVLADYTSRELDLDDPAVFRDLAKPVGALNPARLADFTERHRELKKMTQPVGGCWGAGWVLVGRRRGERRRRGEGGEKGGRRGEKVG

SEQ ID NO: 17102 - protein, 860 aa, Chlorella protothecoides
  MOD_RES (56)..(58): Any amino acid
  MOD_RES (118)..(121): Any amino acid
  MOD_RES (758)..(769): Any amino acid
  MOD_RES (792)..(795): Any amino acid
MAKSSSDSEDCRFESDLDPNTDIDNGDHSEDGGTGTELGNSSKAAKPTKVSHRTPXXXLGNSSKAAKPAKISHRTHEDTLMEVPGSLMALQARSHQDPYPAPSTPFHYPLLTHRSTVXXXXISSGSIPSSLDAFPLPLVNTQINGVLEDALADSALVGPGLSQYLEALSEHLATATPTQADSRAFMESVQLLLAAMSFLPGNRPFKYQAPILVRAIGPAALECVLLGEGGVLSVDVALEIPASCFDNKDQLNNRCGRSSRAVIRGGSLSWLYQPMALPYPSLPISTTSRYHAKRALYLAEVAARLQRHPSTWSIAWEAGSDPRRPFLALQPAATTGLGGLTLRLHAVPAEGTFPLSKLAPHRNNLRGVVGADGQPAPTPHYNHSILEVLGISTPEGIWGGGWGGRLLMGMPVSLQSSVLEKKEGKGPLSCPFLSMPYTGRCLPDGSLFPPAASGAQSRNTEQPAHDVPCHAPPPGPAAAEADRRGDRGSSQEPGPALGPRPAAGLGPGTLAGRGCRRPEPWLPRPAAALHRCQGGGGPGWVEPDGHHPREAKDVAAASNPLPPLSPFPIPHTELAAVGPGPGAGGAGDAVLQQEAARRRGADGATRRGRRAGRRAFPLRLARCTQRCAGGLCDAAPWRAQEAATRDVARRALGDRARSVRVVARLTASDPARPLPGPAAAAVLVAVRLDPVAARRGVDVGPSAEDVEGSRAFRAFWGDERAELRRFQDGRIAEAVVWTKSGGAKGSDTAPPPRHAIVXXXXXXXXXXXXGRKAAAPRAPTPPLRRDMRSWTXXXXPPHPRGARVACLGDAPGCGAGRGGGGGRGRARRGGRRRATGQAAARADGHGAARGCHTGAGPGDA

SEQ ID NO: 17103 - protein, 239 aa, Chlorella protothecoides
MTRARALFRKAKDYVTYDLVEIIAPRSIPNPPGYVPPRKRSLSEVLQVSAGNPLWQALGSSRSACPTTCLHQILQNVYKGTKLYFDSWSQEKIDRHLAEHYGEDYIREKAEKETSKKEWQELVEGFGCSINVRCGASCQLFPSPSSKGDAAKGGGKAMVPFLQNLYTSRAAAYGQALRQFVTGYREGIAEGVPAPQADPTDAAGESQQAVTQPSRVRPGQDSGDSQPETGRDFPRKPVS

SEQ ID NO: 17104 - protein, 617 aa, Chlorella protothecoides
  MOD_RES (152)..(155): Any amino acid
  MOD_RES (173)..(176): Any amino acid
MPAGHIHMQRIPWIPTLSALPSLASAFSDRTMSPCRATLSMASCSAASNSAPWADMLSICCSDVKMMPIRSWRPCWAFVGGGWVRSPHRNTEIVKMENRRDACLPTHCLHRQRGAQTYTCKAVDASWGPSIFQVHPSGIPRLRWTPVLQHRXXXXFQVHPSGIPEPAMAMQCXXXXVIRYTKLFPQQHAWLHGSIPFRFCIVHRELMANSVMAQPAMAMQCDTPDPPYPSTDLKPVAQPQIALERQPDDPSSHTPVVSLTRIDTAMTLSHNPPPTPFTRVQRESPMDAQVQSLMHDPAFAAAVSAGQVRAAAEAAVAAYKVRGVCVCGVVWWWKGGGSSAMRALWAVEGLVDRLSERPGSSSPSRSVSHPSAPTLNVCAFPATIPCLPSQRHKGLPEHAHRNGAHPSRPRGPLGYGTAARGKTLPSPASPGDGAAGLEPWQRDLLRGLTLEILAMEESVPWGLVRRYWRTKRTGWRRALRVAEGPADLVARLRVRRRVQAACPSAQGSAAAGNLLSLRASCPWCSSQRLPPACGASVDVMRQHCLGPHPAHTPHAHAGAARGAAGRRRRAGHLRRGVAGGAGRLRWPAGRAGARGGRLGRAARLRGGVAGGPARRDP

SEQ ID NO: 17105 - protein, 749 aa, Chlorella protothecoides
MSAQGAELEAALQEAIESVARQGDIVRSLKADAKDGKADKAAVDAAIEALKQLKVVQEQKQKAYEEATGKSGVQSRESFRANVVRAGRAGSSVNALERKLFVIPSFKIYGSVAGFYDYGPPGCAIKSNVTQAWRQHFVLEEGMLEVECPAVTPEIVLKASGHVERFTDFMVTDVKTGDCHRADHLLEAALEAVFEGRTTPPAGEEERRAARDLHARVGELGVAELGAALTRYGVAAPETGNELSTPFPFNLMFKTSIGPKGDLTGYLRPETAQGIFVNFKDLLYYNGNKLPFAAAQVPRLRGGWAAKLVAWLASEGHAPTSSPSHSLPHDTLPPYPPHSTSQIGNSYRNEISPRSGLLRVREFTQAEIEHFCHPEDKRHPKFGSVASLAPLLYSRALQMGEEKRALPMPLGEAVAGGVIANETLAYFIGRTHLFCERIGLDPARVRFRQHLRHEMAHYAEDCWDCEVHCSHGWIECAGLADRSAYDLRAHTAMSKVELSAYETFAEAREVDTLTVLPNKKALGQAFKGEAKAVTAALEALCEEGALAVKAALEAGGPATLEAGGKTYSLAPGSVDIRKERKRLTGRSFTPAVIEPSFGIGRLLYCLFEHSFYWRAGSDKRSVFRFSPLAAPVKATVFPLLARAELNATAARVSAALTRAGLANAVDTTGNTIGKRYARTDELGVPFAVTVDYTSLEDGTATLRERDSTAQVRVPLDELPALLRELTDLRRTWADVAAQYPAQAAPAEEE

SEQ ID NO: 17106 - protein, 102 aa, Chlorella protothecoides
MQGINISAPAPRVNFELLGQHIGKRVRLVGKVEGVQGNSLQLRAADDGIVTVALRGAAPSDLFIEVEGTVDSPTALREESSTGFGSNFGERCMADLLVDLWN

SEQ ID NO: 17107 - protein, 1065 aa, Chlorella protothecoides
  MOD_RES (162)..(165): Any amino acid
  MOD_RES (548)..(557): Any amino acid
  MOD_RES (603)..(606): Any amino acid
  MOD_RES (628)..(631): Any amino acid
  MOD_RES (749)..(752): Any amino acid
  MOD_RES (778)..(780): Any amino acid
  MOD_RES (806)..(809): Any amino acid
  MOD_RES (878)..(885): Any amino acid
  MOD_RES (985)..(988): Any amino acid
MSPSRECPLETLIITCSLPMVSERMSLPRPRAGCCKGRCGQVTPVSTSSGLARAGPGAVPPYALPSAQGTPPLQPDPILPNRDVDTGAALTSYKSSACTVNGLALVGRDHFMACQSSKGAVHAWTWSNDQVSVRSHAPEPLRCLAASPCGTFVAGGAASGAXXXXAASPCGTFVAGSAASGAVHLWSTGSGRLLRSWPAHYKAVAALCWSADAALLCSAGGDGVVSAWLVAAAADPAAAPGAAPEPWQSWASHTLGVTALALDACDAILVSVGLDRALVVASLVGDRPVLARHALPSPLHSLALDPGGHAAYAGAVNGAVYEVSLAGGAQGAEFPVLEGHSLPVVALAFAGLDAGTLISGVCVGSSLWVRVRMGSVGVRSWAVTGSCCARRHASLCSQSDAASVLPANPPRSITSSLPCRLRGRRGEVLGPTHQAADTGVGDSRQGPRRRLGHPGPAARHAGAGVSGPAAAGREEGDGDAAAGGTGQVPGRAGHAAALGGRAGSPGRQRGGGIRRGRRRLCSGERGQPRPWGRRTSGGSFAGERRRPXXXXXXXXXXGRRTPASSCSWKGRQRRSSKWWPCRARPLRDRAARARGEVMPVLEXXXXLADGAAAPAAEDNDSGALVALXXXXWPMEQQRRLQRTTSPAPCAQPASVILNSARTPAAATASSLRPGVPGDGREACGTEVWMQRAGIAMTTVAARPQSGLPPHHDARPAYALPGSSQAPSSPVALRRLPVLPVPPPPHLSVXXXXQLGLQEGGGAWWQLGGRCRARRRAGXXXSSLVCRRVGVSGGNLVADAGRAAGLXXXXSSLRPARKQPVAKLSRRLPPPSCPPCPNPIAPRRSDRRSAGSARRPPRPPPPSPAGWSAAHSAPAAEPXXXXXXXXRCRECLPPARPAPRPSWQTGQGPARATAMLCLRKASVRPHAVDQEQGQAGAASTGQPPGAARADDTHDLQSPSHHHSPTAGATPQYKSQPPFSLVPHHPXXXXHTICSRRRTITRRRLGSPRTTRLDLPLPSSHTTRLRARAAAIHAAAGLAGGVGVGAEEHGPGLALLVPSADPDCGGG

SEQ ID NO: 17108 - protein, 418 aa, Chlorella protothecoides
  MOD_RES (254)..(257): Any amino acid
  MOD_RES (350)..(352): Any amino acid
MPLFSSTPCLLISCRSSPAFVNVSPHPTGSMRDPVVTELFGSGHGTAARPSEPLPLTHRCLCRSSWTSVILRYNQRGVGASTGYRQPRGSGDFQDVLDVLDYLAGTLPPGTNKRLVVVGYSWGCCVAAHALRHPLIAAYVGVSFPLSGLSMILGTKGHFEELGGTRHLPRLLITGSQVTAQEEERECWRLCSEGGDMLTEAMSDLSCVRTAYHTIFWISWTGCESCPVTHIVCILRPPGSIQRRGAADAELDQXXXXCMRPCCGVLEALRRGGRHATEAMSDLSCVRTAHHTIFWISWTGCESCPAGACWRTTTASRWLEPAARPHPRPAAQPPRPSFFGCGPAPTTSGXXXTPAPTPGDAAAAPLLLRVWAGADHFWLDQVAAMAEYVNDWLRGTLAAAGAAEDGAAITAFSQAARA

SEQ ID NO: 17109 - protein, 320 aa, Chlorella protothecoides
MPATTLLRSQHADRAPKGTFTPWFYACIRIPRGSDNLLVYLGHPLQCTLCAERCMWGVCMTEVRARHAHHGAHRAESMRPPMGEVVMRHAWGGPGHPHRGATQVLQPPGLLGTLWNTAGPSQRLQQVHEGAGGVAGLPARGVHACTVTLRPHVAKEYAAEYGAAAVRHPSPSPRYARFITLRRLCGLVGHARGAQARRLATGAGPDLGLGATLQRAVAFGPSEVAAFVRLTGDTNPIHQSLPAAQAAGFERCLVPGIMAASLFPALIGSAVPGALYLTQTLKFRAPVQVRAGGWRLGEVTHSTLEAVRTERNVPESQSDQ

SEQ ID NO: 17110 - protein, 96 aa, Chlorella protothecoides
MELCIPSREYSHGRQAEASLDSKVLCDADCAASLADKERVRTASGLEYIDLVPGKGPSPRIGFQASAGPRHAGPQGPWLVGAVVTVVTAMIYKCLC

SEQ ID NO: 17111 - protein, 396 aa, Chlorella protothecoides
MQESTGWVPWHSPQDQELRAKVLKIMPSLGCTSGWCRVSTEALSPADPVPASRGGRTSPFLSPAPIPGAAQGRVLGHDPQQGLRARKVAGLRALSLRACFSSHRPPSSHPLLLQHNLFAARKPDILGGQPPLGQSHVPPCKAPVWCGLAAHACLASVAPYRGRGCACPPPHSLPPCATPLPPRLAAAVVGDSDDPNKLPDFLGRLEEALYKAASSREEYADFSTLEARLQAVVRRVMNKPGRSAASAAAAAAAAVGPAGPGPASSTPPPGHLAPGQAAPQHHMQNGYAAPGSAPHAAQAAQAAQYAAHHHAQQQAQQAAQHAQYTAQHGQAAQAQAAQAQAQAQQFQAQHAQQAQAQAHMRQAALAQQQALAQQAMAQHAQHMARYAAVQQQQQQL

SEQ ID NO: 17112 - protein, 143 aa, Chlorella protothecoides
LPPPPLPSPPPAGDPPPGSLPFLLPRCTDGNAQCDAWHGMGECVRNPGYMYYNCPRSCLVCNVTYLDTVPEQVEIAPGVWMPTIGFGTAGLGDATAEAVASALANGYRLLDSAQVWEGRWESVSGLVAWGDEGWRRLSGGRGF

SEQ ID NO: 17113 - protein, 287 aa, Chlorella protothecoides
  MOD_RES (126)..(129): Any amino acid
MGGNRWISRKRKSIEGQTHELGGDFPPQKDANVYNRGQCLHAAPASLLHKAHLARTSPASSHDGRCRQVLRNRQVVSVGLVSATRRQGYPESPGFVRSVEDVHTLPDPRLLPCPPALRGPLSRSPXXXXVHTLPDPRLSPCPPILRGPLPRSPQVQCHQGLRLHHPRPGCESGRLCILSCGHGMTPCLISSPLIALPAGGEDLFVHQTAIITDGFRSLKEGEPVEFFVENSDDGRAKAVQVTGPDGAAPEVRGPDWSSHEWWALERIPRWPKTSPASRFICSREAAS

SEQ ID NO: 17114 - protein, 395 aa, Chlorella protothecoides
  MOD_RES (38)..(41): Any amino acid
MRFRLPSAVPGQGKDSKWAKERSGGSRIDCTAQSMLPXXXXRARIRIRCGGHPGGQPGIHERRAGHARPRRRRGPVQALLLQPPHGAAARGCIPSQQQSTQAILAKHPSHRVKNPSAPPPLSLYAQMTGLGPSIVYGPCTPEHLHPDLDWLEAALARPSPPRMVVLVNPCNPTGAVLARGELERAARVCAAAGAWLVVDDTYEDFVFGGEAHCAVAGPHVVHLFSLSKAYGLAGWRVGYVAHGAGPALASALLRAQDTMPICAAQASQRVALAALRCGGRAWVAGRVQALAPGREAVRAALARALGDGAVRGQGAIYFWARLPGRAPDDEAFVAWAIRRHGVSVVPGSAAGGPGFIRVSYANAPPETIGAAAERLERALVEFAACEGGELPQGAA

SEQ ID NO: 17115 - protein, 238 aa, Chlorella protothecoides
MYSFHAHGLLTARPHPTVPTPVHSPRRHRQTPGDALSDAGYRALNIVIGVAISAVVAFAIFPIKARSLLRKQTAVALMQAGDLAAWVFTQVGVEPTAKDSNALPHASGTDKSMWVFGLSCGVWGHGGECMWGRGEGGWAAPQFHMVPRTLGLQGPPVLASGPTCPACINEIHAGNPHVHIHPCRRYIDDGLQVEMAPLFAATQRLAVSLAGLDDLLRSARAEVNLFSRPHRFPSKTYG

SEQ ID NO: 17116 - protein, 97 aa, Chlorella protothecoides
MARKGIHPLMRTMTVVLRNGSSFRASTVLNRHTPWKLQVDTTSHPFWTGEETGISVEGARMARIMERYGDLLKTPAEKAAAAKKAAEEEASVPAASA

SEQ ID NO: 17117 - protein, 228 aa, Chlorella protothecoides
  MOD_RES (182)..(184): Any amino acid
MCLARPVSDSLVDRVVGYLHRAGAGSRGRRGGRCQLQRLVLCNGRHGACGAGGHARPLARHGRQDARGHRGRRRAGGGLEHVRDGGGGQAPDQGTAAAGAGAPRRAVQEARAASAWVAAGFEDGGGMARPGAVGVRSLAQLGSQVGAGARAQPRCGFLAGHPLAVVVHQVHNTGGGGRRGGXXXAPQGVYQALPAPRFTLSRALRPAEYPLPESPFPAAPERSDASFE

SEQ ID NO: 17118 - protein, 307 aa, Chlorella protothecoides
  MOD_RES (162)..(165): Any amino acid
  MOD_RES (292)..(295): Any amino acid
MAAAAQAAQLPRRIIKVGCRKLGCTTPWKITSAIFSGGNHVVAPVGILLHPSLSPVDAVPGISAAPSEENLRYFNVVIFGPDSSPYQGVNLGSQWGGDEGRMDMSPGSILHPHPKGPLPDQDLPPQCGQAGSHLPGHFEGQVEPCPPDQDSPAQATPTPRHXXXXTWEDSSTRGGVWCVIGDSHPLAVPNMQVLSFHHLCSPPLPRLLHFNSIQALMSAPNPDDPLDEAVARHWKGNEVEAMDTARAWTAQTGSRGESRQPIPCSPKGDHTSSWPEFKYSVTLLLLVSARGXXXXLCIEPSRQDKLS

SEQ ID NO: 17119 - protein, 425 aa, Chlorella protothecoides
MQVIWLRTSAFPVTVAYIMSKGTEAIAGGQIRRHLPDQEPRVATLHPGICTARASGAGASSWRVICRRNATASEVNAQAYNSHDGCDSPCSGPPGTASMSAADEFVSYTRQLGSPFVSPADRSVADEWLRRFRASPGAWSVTLALLSQPHAGLAVQLQACQALTWKCRRQLEELGGEWGVVVRGVVAALAQLSALPRSSPVSLACCVTLAAMALRVRDWEEPLALLGQHLSTAQLLHLFTVLPQECEDAERETGVDQLADIHPARARLRAWVPAVLPWLRSVHGKESRPGSAIEASILAVFSAWVAWGCLEELEVGQADYFIAAACACLEPSGNPSRAQQGVDVLAEVIERASPKQSATLERLALQFASTAARGPQGSTAVASLLGLYCADSRNQGVVAGRGKTGESGRGGRAREDWGSLTRGGG

SEQ ID NO: 17120 - protein, 649 aa, Chlorella protothecoides
  MOD_RES (8)..(11): Any amino acid
  MOD_RES (295)..(298): Any amino acid
  MOD_RES (481)..(484): Any amino acid
MAPGTLHXXXXSGFAPAAGAGRWRQGRFIPPTIITPTRPPHAVQAAPEDRYTRPTCKWTVEVCAASPSPPEGAPAQAAEAGGCRAAVQSAALAAHVAIAEMEDEAALASVPGAGEMWGVGQGATPPHAHDSPARPLTARVAATRRMTAPDHWQDVRHLELEVPGAEYEPGDVLSVLPRQDPAAVVAFIERCGAGLAPGTTVEVRRLAPGPETAGPAPRHLRLGDLVAGTLDVAAASPRRTFFEVLRDAAGSGLERERLEYLCSAEGLEDLATYNQLEGERGTCDTQRSQRAPRHXXXXVWSSGVGPNESQAPVTPNALSERHGTSRPTHRAHGAGGAPGLPLRPAGPGLAAHRRAAPGAPRLLHRFLPPGAPGRGAPDPGGGRLGDALQAPAARSLQRLAGRAAAGGRAAGLDAARRAAPAPRPGHPPGPRRAGHGGRAHARFLAAPRGPEAARRPGCPWVVCFPAVEWCWAGSRCSGCGXXXXGARGSCAFRLSNGGGRGAGALGVAPARPPHVLSSAVDGSGAWAGSREPWSSSQPPHPLEKQEWRPACSSSAAATWTRTACMPRSGAGCGPVTSCPSTPLRRPATKTTRSTSRTASGRRPPPCGRPWTEVGEKRGVLKCFSPCPGAFVLRASFSQVQDASWHPLTA

SEQ ID NO: 17121 - protein, 129 aa, Chlorella protothecoides
MRMSDPATHDAAPFKPTSPPATPAHRQVGLVTNQHDGHVGVGMLPRVLQPRGQVVKRLPPGDVIHQEGPRGAPVVGPGDGAERLLARRVPDLQLDLLAVDVDHAGSELHANGEVVHRLEALVGELQQQT

SEQ ID NO: 17122 - protein, 389 aa, Chlorella protothecoides
  MOD_RES (124)..(127): Any amino acid
MANQTIADVYQKSSGLAKYPFEPYWPSKKLRICVTGAGGFIARGAVSTPALPNGPVSTGVPKLRTPFDLEPHPCSHLAARLKSEGHYIIACDWKRNEHMQVGSWCCVPLCVDPCVQILCMLGYXXXXAHAGGIMVLCASLCGSVCADPVHARLHIGAQWRHGINLGRPAQLSNPSVQRISQEELFCDEFHLVDLREFSACARVVKGADHVFNLAADMGGMGFIQSNHSVIFYNNTMISFNMLEAARQEGIQRYFYASSACIYPENRQLETEIEGGGLKEDTAWPAQVWWVCLGVLGVGGLKQHAAMEVAGTLTGQGRGWQVGDGSVASDKVLRGKALRVAVAAPGFTDTACCQGPIPCQEGAPLAAVVGTVVKARDGVHPAPQPSTCLA

SEQ ID NO: 17123 - protein, 235 aa, Chlorella protothecoides
MQPARHRCDHASQCLTLAGVGKSCLLLQFTDKRFQPVHDLTIGVEFGARMINIDGKQIKLQIWDTAGQESFRSITRSYYRGAAGALLVYDITRRETFDHLASWLEDARQHANPNMTIMLIGNKADLSVSGGGWWGGGLEWGRVHRRAVSTEEGEQFAKEHGLVFLETSAKTALNVEEAFIGTARAIHDKIASGVLDVSNESYGIKVGYGAGGNAGATGIVRPGDAAAAPRSGGCC

SEQ ID NO: 17124 - protein, 645 aa, Chlorella protothecoides
MPSCTLHVIFWLKEEWSLAWRKRVSWRWNSYYRAVPAVYTKSGWSLSEIRESPTSTRSLDTTQQQSLFQLEFTIIACNDACFRDLQPRRVRSSMEGCRYGRRNACSCTHRSKPTPAGGMSYRLECTAMRHGVPGWVHCCVRPWRMVVLWAWLLAFTDLHSYSSKMTARGGEHLGCSSFKTFKGGHGASVHKSPPRRAHRPVIPCAILTVQEPSTGVEFPLVQKFWWAGGGGREQAPAGRGDAVHRGRRTHQESGLPGHQGVCGGGVRRSREGGPRAGHPSQARIDEGRSGQTESYIPAFHVGKLFPVDPTSCGQLPHDYICIIPCRGGFFESDDDYCSALLDGGFHKALQVCRLEQAGRLTPVFFKYTPSKVSELNNCVTSSLHTAIAGSCIAPAPTAPPAQIHLVRNVEGTQFVEALAEALTPRMRLSGGSAAPAATMAIHEYAHVLAPSALSLLAEMEKLETFSSFFQGQQLSKGSVITLLYRTDATLDVALSSPERPADLAAARASLCIKSASLCRALFETFLGESSVVPEARAVWAAGARQLLASDEHSTCPVSMMHVVEPACTPLTRSGSGQMVVRRDGCTVTGVGDSMRSAGAVARRSTEPWAGRLPAWRSPTCRLDVIRCVLGLEGDKVLFSRPCSGN

SEQ ID NO: 17125 - protein, 320 aa, Chlorella protothecoides
MGVAAVEQPACLGKCVVPGEPIASLPETGTVRVGGGVQQAGRSLIAVKAGVVQQGPGDSLWVCNRQKRCGRRCAHDPHRYIPNLNDAVVGIITHRHSENYTVDIGGPGPAFLPVLAFEGVARRNRPNLQVFYACVLQVHAWTDEGGSNVSHALLGLSLNGQGYACEVQHSLLTHASLSTAGRRRRVLPGGGGGSRPRPSADMHGYCRQGACKSLFKGWEAPQRASTPAKRYCHLTLHPQHQLPPPGGRLRPTEGWNPVPGFHLPRTHPGVWSAFPRGAWALSEVRAGRGGKRAGVGGCAGARQPGPRGSPGQAGRGARCC

SEQ ID NO: 17126 - protein, 362 aa, Chlorella protothecoides
MSEYDWTDLLSSQSWEPDLEPLGPCPAPEAHLPHPPSALASCQEDDEDLSPPASTILNPATQPLIAGPPSDLPVALDAEPVPSTGRSTTCTAKTAEERVARQRERNKLAQKRYRARKQAASQARGMSLAQAREALVAARAEAAVLASQHGILERLLAVHDASLSILGEHRNHSACPACNYAEPGITPGQLAVLHAVCGDGERWRGWALGPDDARHFAALSPEVVTERWLGRRRTLVDVCDQLVQRGGRCPALEAHLQSVLDEGACLESRKQRALRYHSMAAKVCWPQVSTRATLGQVQLGSLHAPLKRRRQGLPPPGMQRLLMWRVAHYLPGRLAEVGRMRRDAPSDHWENVVVSQQGRPDV

SEQ ID NO: 17127 - protein, 446 aa, Chlorella protothecoides
MSALHMDARPLSADLDLFMDTLPVLPYDSFTQGHNIFFHEGLQADSPLDSGSLEASGSGGAQSSESPTAVIQDDHKSGSSKPRGGKKGGTKGKDQEQLERIRAKNRRAQSRYRAKLKAQAQDTVQSHDQVADELARLRLENAALAHSNDLMDRVLTVREDYMASLKGGAEDAALGDAVPGFGTVTDSRRPPSAPYPGHSPEADAAARQAAATCGVTGLSAAEVAKIKCSDPAAVVAAWQALVPRLEDALTQLRGARDADSRALAWTGIQEALHDARMYCFEHAVYKPHNIQQLLGANLGVGRDGDGPGPDHWAFVAAELELDEAQRAALAPLRDVFLRRISRVMAERRAVLGALAAATPASSLAALQQSTADWLRVNAATSELSANLQQEHMVCMEFVSRGFGGVLTPLQVRRCLGGKCGVLEGGVALGRAPGGGGSRQGGMESAW

SEQ ID NO: 17128 - protein, 605 aa, Chlorella protothecoides
MSPSCCTSTCLCVAPLCRCLPNQESWPQVWAEAQAARRLQTPDAGGEGAAPRPGPEAEPETARGDPPPATTVQGEAATEPGEALAAGSAEEDFIRLLNEPAGEPAEAVGDLTQALDAGLEGADAAAALAPSPKSDTDVVSLAAVPQASPGPEARAQGGAALPPGLAQSTVPGLTPSDAPEAVDAVLEAAMDSSPVERTAAPDSIATDPAAGPVTTAAAALPPSPALCTLGMHGAGVRLRTLSISLDGLLDYNLSDTGAGTFELSLLAEALADALALRYSGIIIGALRRDGQARTRAARAQRKRARAGEEAGAGKRERAEGAHGTAETAAGGGNPEAEADLDLNTPPLAEVTAVLATEQVHVNAGSHAKAGAAAKEASIDGAAADVEAALHARTAPGAEVGPESNEAPAAEVATPAELPLPVLVDVGPESSEPLAALSPGPSPLGPGPLASELPSGAESGVWGVTPASPGAVELEVEAPGDKSTTGEPGGSDLGGDLAGLFQDDDFVFAERLRSQGGMEVAAEEDAASAPVQPGEGGNGGAHLNDQDLAVSLTMAFRYFDAGGKGYLGWVADWGWAAEIDTPGLGKPRYTCVDRAEAHAGDEMTLS

SEQ ID NO: 17129 - protein, 259 aa, Chlorella protothecoides
MNLTKCPASTPIPLPTPTILPPRLGLDVSPIEGGLPGTRFTVRRAFLLEDGMAALLRLDAAALKARCAVTFVDALGREEAGIDAGGLQKEFLECFVAAGVDPRRGLFSAVPGTGAVYPNPLAAQLEGGWLALEALGSALGKALYEGLLLDAPLAPFFLRRLQGHVPQLEDLIALDPGVHRSLLLVKQYDGDTLDSMSLDFTAETEVFGRRVGEELVPGGANVPVTLANRLLYVHSMAHWHLSRRLGPAAGAFARGFQKV

SEQ ID NO: 17130 - protein, 1228 aa, Chlorella protothecoides
  MOD_RES (186)..(189): Any amino acid
  MOD_RES (400)..(403): Any amino acid
  MOD_RES (570)..(573): Any amino acid
  MOD_RES (608)..(611): Any amino acid
  MOD_RES (1068)..(1070): Any amino acid
MGVGAQVCRVLGCRWEGRWMSERCPARLAWRHRPPNPSAMTGNGRSLMGGKTGPAAGSQMRGVLTDSLPYPTPPPSPEPTGETSDCSSTLPESFSSVTLCNSTVTRQAPLPPFPHGQPGFIPKVRAWVGGSVSAACRGSIGMGKGDVVFDTILLCLGGASYSCVQEGPVRHWVAVKPCKEPWCACXXXXGGWVGRCLLRAGAALVWGRETWYLTRSCSGLGGQATHPCKRAQSGTGWLSSPARNPGVRAETGVGGMMSGGAHRADCWVPWCPRFLPSRLGAPAQRSTKNPTRLIAQIVPGTKMGKHAPSGFPTLGTLSVAGKIENAKCSVFGMHSKRPSLILAIKVGGGEWEIRGVGMCDGSAGSHAWAGASRAVPFAASDGRPQVPAVAAHRSSLQAPXXXXVGRPPSSPRPHGPSLLSAGPRRCRDAHSRDPGPSRYWKPGLDPLAIFDRGAHLMHRGRDRQGERSVGCSGAAPWGLTLVASKPHGAVVRAQSHPGKMGILKKLCNQLGPRMSTPGARCGGPGDRGPSVEGECGGPEDRVPGEKGACMRQAVVGGMRADGYAVANPLXXXXTPTAASPRASRRRGNWCRCSWHCGATPPPTPASTXXXXSSSWRRGCVRASSGGWRDADGWVCCREPSAGRQGSGPQAWGVGLPLLESTVAWPEPCAGRPARHSPDVSLPNTSWGERRVAARATREPRSLPPPLTLPPGRGHRAQPPVGGSASAGGAGAPRRRQLRQELCGERGAGAAAAGTAAQPLPRPPLRPGRAAGGRGAVRARQPRGGWQGALLRLPGAGSGPGRRRGGRAGTAARDERQRRAAAPHRRQRGQDRAGAAGRGAAALLPRPPGGQAGRHQPERPGPDRRVQGHSWGDQDGGPVPIPSPSACLAPAPAALPTAPSPLASPPPPGSLYLVIGESRRDRLDVGLCVRNAKLGLCVPDAVRFVPPKQPPPRPQAVGEGPPAPVPKGEERAGEGGVGQGRVQVCSASRPARATALRSCQGSLACSGGNVRGMPPHVGPTWTLAPMFVAIRVGHGIAKTGSSCLWPPQPLSAAQSGGTHPPNILTRPPXXXPRHHRPGGTIRQTSSPAHPPCPTTTPGSWEYSEALIKLLKSYKVKAPWLWAAVEQDAKAFELDASRVCPGETPEERLAAAEGLHAWLKRQPMARRPLVSQDAAVAPEAAVRMLQGALPPPGPPGPAVELTNVQPHMLIPPSDQGHVVYAEAGEWNAGR

SEQ ID NO: 17131 - protein, 241 aa, Chlorella protothecoides
  MOD_RES (173)..(176): Any amino acid
MGTRCEPCGHLAGPGVFGNWAACMTGVVVLFRGMAAQLRAPNGAMLSAEFGVRSGRHTSGFACQEAPCLSSDLISRSSTSNHFTPFLDLQWAKLAQFVPGRTDNALKNHWNSTLRRKTPVPLPTHPSVPPFLLSPSPQVEQGEFLGLRPWVDRPGDSQGKLCRDSQALYKQEXXXXPGDSQGKLCRNSQAPCVQETRSSMAWMASAGSGICTMGASGVTCPERTFMHRETHPGVSAAEVPR

SEQ ID NO: 17132 - protein, 220 aa, Chlorella protothecoides
MPAIAKQTCERGRHRETSIMPQDSPTKGGAGRLGRGKRRRSEPAGGVDRSAARSMEEPIRRSSRGAWTKEEVRGSLGNGDQGSVLWPFTWSVTPRRPGLRQVCTLYEQDAMLTEHVATNGPGSWGHIAPLPSAFMVGSLVESTLLVQLSPANYSPLPSHMLMLSAMLLPNRTEAQCFHRWQKVLNPEVCKGPWTKQDRRCSYSGVCQHPPARSRPQTATL

SEQ ID NO: 17133 - protein, 145 aa, Chlorella protothecoides
MGLLVLLQSLPGTHPCCHATRGHAPSTHISHVPSHTPTHPLRGSSTPYPLPTDELAARVQERAPAVARVDGGIGLDDVLDGAPRGARDLSPRPADHARGQRVIQAKGVADGKHALAHLEVGGAADLQGGHRLLCCVDWGVEEGGI

SEQ ID NO: 17134 - protein, 167 aa, Chlorella protothecoides
MFTLGSPQSPDPGPAMSHTHSFPTSQMPFPSPMHTHSLPTQPPGGVLPLPLIKNKKTVNPRDSGSTPVFQLETAMGAAIECFDDSGAVVVPRSRFAPVKTCADLLVLRSDAYKITQASTVELSDVAAPAVKLDDAHYKSVEGVGQGAAGAAAAVRVGGAEHGPASAL

SEQ ID NO: 17135 - protein, 290 aa, Chlorella protothecoides
MSGRLFGCFCRATPGAVTVPFPRPRARLAGLIQHHSTASRSGLFDPSVTSFSGPWTLTSARGARTGAVAGTSASMAGSTSASMAGSEDPLIQYIIIREDLWKEQAWSLGSVMAQGCHAAVAAVWESKGAKSTEEYCSSANIDSMRKVCTEGHWGRAGSVWRIPSDLHANMHGFKCTGRPLALESCTHNFTFWHVEPFDLESSAHPWPVSPVSCYQVVLQVPNEAQLLKTATSLESAGIAHKVWMEQPEAIPTCIATTPQLKSIVGSALKRLPLCKRPLYMSRGRGDGGEL

SEQ ID NO: 17136 - protein, 438 aa, Chlorella protothecoides
  MOD_RES (385)..(388): Any amino acid
MDSIEPVASRVPYMVGIGNHEYDWEHKNSHEPDASGADLPYAPDWGNFGNDSGGECGVAAAKHFMMPSFAERGYWAPGANAGNASLGPDGCRNPTLDRMPGAVPSPDAAPAAGAGADAACGAANHGGLAPNPPFWYSFGQGPVHFLTISTEHDLSPHSQQYKVGGVVGSVRGVASLGEVEGRRGRGTCWPALGSTGRTSQEACDPAKELALPPNHGPFDLTWLGATLPPLGLRVLGGWREGAGGEPAGQPRDPVAGPARRPVARPGSWRYLPLMARVTGPGVGATLPPLVLPGVARLFLTPNPSPLPNTTQWIKRDLARVDRCTTPWVVVGMHRPMGPGCRRWGVSGETLEGNGRATAYPARALWAPHVTASPCVCSPAAPRPTXXXXSWASTSGEALGLVVRRRGALGAGGGESVVKPWKATATPLRTQRVPSGPPT

SEQ ID NO: 17137 - protein, 335 aa, Chlorella protothecoides
  MOD_RES (50)..(53): Any amino acid
  MOD_RES (180)..(183): Any amino acid
  MOD_RES (202)..(252): Any amino acid
  MOD_RES (308)..(311): Any amino acid
MPPSKRPQVKHGSSVFFRAPSAPSPDAGLKFIAFGDMGESEHRAAKSPGXXXXLEDHPVQGGTAPDNGMIFSDEDPAAVSDTADCLKDEVEAGAELIYHIGDLAYANGHKTVCMDGGLRACPHCPYAEQETRVIDTAGSRRGCCCGLVVPLELVPAREAPRIRHHHAMYHAPPPPCPQPXXXXGHKTVCMDGGRVPVLTARXXXXXXXXXXXXXXXXXXXXXXXXXXXXXXXXXXXXXXXXXXXXXXXXXXXHFMMPSFAERGYWAPGANAGNASLGPDGCRNPTLDRVRGAVPSPDAAPAAGAGADXXXXVVALLYLWSSYLQGKPPESGTIMP

SEQ ID NO: 17138 - protein, 189 aa, Chlorella protothecoides
MVQGTLGLVLTLLLITSVERVASVARPLQDGLAIDSNRHDCAPHEGVRLLGHIAGVPPPACFSRLLAQPRSPLLHCQRGCPGGCTLLHQPTTLPRRRSCPSSVALWTADENAQPNEPPPGANELIGSMSSYSSRDMCSAPARDFDYSPLSLHSVVLTDLVPGARYRYKVGARGAWGGVLRARNTPKAWG

SEQ ID NO: 17139 - protein, 279 aa, Chlorella protothecoides
MQPWELFEKKMEQKGSSQAAIGAFRHNYEQLVAGVTGLLPESDIESVTELPYLESLKSSSSPDNLQELLSQTVVLKLNGGLGTSMGLEKAKSLLVVKDGKTFLDLIAEQIKYTRKQYKSNVRFVLMNSFSTSDDTKAYLKQAHKGAGAGSWGLGWGWGVRLLGQEVWSQMDKVEISVCLAFSGADLIEEEDVELLQNASTKVDAATLKPAEYPENPDMEWCAGCGGDGKRWSALGGGRCLWGDAGGLESCSCCNVTRLGSGIGPRGCYAMLPLLHHHLM

SEQ ID NO: 17140 - protein, 87 aa, Chlorella protothecoides
MLDRLLKKGLKFLFVSNSDNLGATLDLDLLAYFASSDKSFVMEVAERTASDKKGGHLAKRKSDGRLVLRESAQCPDGDKAAFEDISK

SEQ ID NO: 17141 - protein, 76 aa, Chlorella protothecoides
MHAPPAHRPGHDQPPMHILRLVLGDIIISIDGARVKTGSDLFRALDKRSVGDALDVEVLRGNDRSHVAITLAASNT

SEQ ID NO: 17142 - protein, 167 aa, Chlorella protothecoides
  MOD_RES (55)..(58): Any amino acid
MSSHPHPPPPLTPSIRSQHWLRHPHLGRPPLSARLHEVRGSGGRRGRTGVHAGAXXXXLSARLHEVRGPKGRWGRTGLHAGARGRGAPSNGAVDGSLGPRRLHPLDFSTSRTFPAHRTGTYTGFPSLNVVWQELESRTLRLACGMGPQHKGVCVCGPWSEDADGTGL

SEQ ID NO: 17143 - protein, 299 aa, Chlorella protothecoides
MKPSLGLSSWSALLSARTGDRGWPADRLGFQDGQAGVLGLAQSHARLLYVCEHEGLPGPAAETHYHLNNHSPLNPQVRDYAFDPDSGAISSLKFDVLGLPSIPQALLPCSALRWEEVVAVAPQRIVVRRGAEARAVQENDGWLAEGMGMLLGILGGLGEEAEAGPGERRAGEADAYRSDPAYREWYARHGRDYSRYYGLDLPVPLEAAQRPLPRRDAAPRRAVPPQRALPAPQTPSYAEALVPGRRTAAPAAATETQGDLLEVMQQRTRLANTRGLPLREAPPARRSAPRQAQQAQRQR

SEQ ID NO: 17144 - protein, 690 aa, Chlorella protothecoides
  MOD_RES (143)..(146): Any amino acid
  MOD_RES (217)..(220): Any amino acid
  MOD_RES (299)..(301): Any amino acid
  MOD_RES (481)..(484): Any amino acid
  MOD_RES (621)..(624): Any amino acid
MRRGKLWGTYDRSSGRVEGLSSDSEEVLVPTNGDASGLYPISILDPDVQYGLPVVHYFDTFVEYLTVSSLTREAQVGGGRGTLAANGSCGQRGAFAVSLRLLGSNLSAPKRLPSGHSLAPTSFLTSTPGLPPTPPAEQAGLHXXXXTYEFPHLNPIQFRACAGSAGPAPQHARADGAPRRHPEPQHGSPGRAECDLGCDGRGTSDRPQYRSPDALGXXXXEAGALWAGWGSAGAECGLGCDGWGTSDRPQYRSPDALARSRAPMTMCHCCWKSQSLGPCPGFPSRCFTSPQIMPSPPLXXXVAWPLPRVSLPLLHLTPDYDLPPLPPLPLGRDLDCSGGAIRRRPRIRQRRAPDRGAVCGVVGRVLLRRPRHVPPGLRPVARCVRVAAPTALPVRCPRPGADPVAHHTPARRGRRSRCPGIGGRRAARHAGTAVRLGASPGTPTLGAQGGGTLCDPPFHAPTRPRGGGCGGGGWGEDPRAXXXXPLPGGGEGAAALPLGAAAQPRTPARQCASEHPPARPRSVRRVAVPSAIHPSMHRPGPEAAAAEAAAGVRTLGPEEAPLASWHEAHEYKFALDQLGGVLQGVLEGNSVSIGGQAVAMPFNPDVSGCSGAGPWGVPWGXXXXPFNPDVSGCRGTGPWGVSWGRGLGRGVLLVGVRAWTALIARLQLVWMAGVRRAAAHMAVAMGESLE

SEQ ID NO: 17145 - protein, 409 aa, Chlorella protothecoides
  MOD_RES (306)..(309): Any amino acid
MCGHAVPWTVYAFWACTGCFCSRRCRCLSPPQASKGPPPPTPPITIAHGPQPDGRDQVPRGPARGPGSTGRRDAGPAGGAGLRPGGGFGGPPHPHPGCLCHAGLTTAGGRARRRRHRRPDRQPVDQRSQLLEHDYPGRTLTGEHLGVLALPVAEFLALRHDTTCAAPLQSTVSPQARLPHSLSHLYCLRPSPPDSHPFPSYQADIGYSVHTSSLAQHAYFNAAHRQIGPGKNDIALFTVVPATTFKDLLAKVGYWVWGAGALIALPMESHAFLHRTLSPCSSKMLAFFSFSAGLGCFFPLACICVXXXXTVVPATTFKGLLAKMLAFFSFSAGLECVFPPPACICVLSHISSEALSVLLPTSLLTVCGAPCAPRVCGGVAGAAQGVCCDHPHRRAAPGDQPGDMTRLAA

SEQ ID NO: 17146 - protein, 311 aa, Chlorella protothecoides
MASASEHARCMEVFTRPTCIASPMERFCRSVTMSCLGLHSALVGVFCSSSCTAEWSIGGVAQHAPKPGYRIPVAMPLPGRGGVHAARGRGRGRGSKLDGFARGKQSTYDPVARREKERALNAKTVNKYRKLQKRLAAAGEHEAGHRHEVSTAWCGCGRCEHHSTPVQLMSPIRHAQGVDGSAGTLSGAPSAGALFPPATDALGSHGHGRPRVSDDGKEEGEDVNSAARFPAEGRKSHGSQLLRLAEKVGATKEAAHQEAETRRAEAVERKRKLAQDKKRRAAKHQTLMKRTGRGQPVMKHRIEMLLDKLQS

SEQ ID NO: 17147 - protein, 311 aa, Chlorella protothecoides
  MOD_RES (131)..(134): Any amino acid
MLDNRNDTARHQRRNGKMSDAPPYRTKQGFLMPNGRQPSQHAVFSKTPARSPPLPPTPVKPQARTIRVWFGGRWRGAVISRIKVCRHHVHAQPLADAELWVRGGDEGGGASEDQDLGLQARTRIAHLHSPXXXXQVRFKARRKHAASSTEGPPQTPLAPSPRPPSHQLPPDIVRRLEGPCVEEVLVAPVGVAVVLLVGVVGVEQGEVVPIDMRKPGLGLVGGARGLARPHEHLWHAQRGGDAQDLVGAVEAGGGHHHLRQLGVQGELGHDGADGGEVAVVVQRAQEVGRYGAEPRFQSWRESSSRKQAAAR

SEQ ID NO: 17148 - protein, 489 aa, Chlorella protothecoides
MAFRGVWGLGRASPGPRVWPPTPDPNPALQIPQRFLMGPGPGNSDPRVLATQSLPLLGHMAACSLDHHPDRFALSTIVPPVCTTLTRPAPSPTHPTPSNIPPRHPPFLKIMDEVRQGLKYVFQTESNYTLCVSGTGHAGMESTLVNLLEPGETLLVGNKGIWGARVVDMARRMGVNVVDLKKEAGRTFSLEELTAAVKEHRPAVVFLVQGDSSTGVHQSLAGVGPMCAEHGALLLVDTVCSLGGVPMFADAWGVDAIYSGSQKCLSAPPGAAPLFLSERALAKVRGRKTPVASYYFDLNLVGDYWGWYGSRSYHHTGMVSMWYAMREALAIVAEEGLEAGWARHAAAHDQLWAGLTELGLEHFVPAPEDRLVTVNTIKVPEGVDWAALCKFAMERYAVEIAGGLGPTAGKIWRVGIMGYNAKPANIELVLAAFRDGLAAQGWAKNACGLISMAPPERSTPGVNRCQKISETGRGGRQAGLASLCRAAGT

SEQ ID NO: 17149 - protein, 329 aa, Chlorella protothecoides
  MOD_RES (81)..(95): Any amino acid
MDAAWTSLPHVPDNPGEKIPRQCMEWIGVAPLLGHAESTILIDANGTHLTPTDHAVGSWRTSVFIHGEGPMFHTCFCCASXXXXXXXXXXXXXXXLERQADRLVGDLEMAFTHLIGQMANLQDGLAGKGGHGIQLQCVDNLAKTPCERFHFALVALRVIVWRKLLVSGFTSLWHSYSMSVLACSSTRPAATPCVAGGHPRAKPSRAGPITASLRVVTPAFRRADNVQLRSVRSSAAPQGRTLGATVEAKNVALLGAAGGIGQPLALLLKLNPQITELRLYDIANVKGVAADLSHINTSVKVVTMGWQSGVYLLVPGPGRMHRRPSFCKM

SEQ ID NO: 17150 - protein, 149 aa, Chlorella protothecoides
  MOD_RES (114)..(134): Any amino acid
MRPQVPLSLPDAPTHNHPLPSQHLGQQGQDGLAGVPTDDGHLDVNDVQALGLRDKGLRADHIQRGHAQHLALVVHAGGLQRLGRDGHGGVHRVGDDVQDGARGVLGHALRQRLXXXXXXXXXXXXXXXXXXXXXGRRGSCRACVARRRG

SEQ ID NO: 17151 - protein, 204 aa, Chlorella protothecoides
  MOD_RES (131)..(134): Any amino acid
MSESRPARSADAHQPSTTAPQATPSVAFSKAEAAALTQRIQNAGTEVVEAKAGAGSATLSMVSERVEMGVVEFQLRWKLPSNVHQAYAAARFAESVLLALNGEKDVVECTFVESDVHPDFKFFASKGAAPXXXXVCEHLLPGAMPDMVILNCPTRMFQVVLGPNGVEDFLPLGELSPAEQAGLDGMNELLTKNIKTGIEFANKA

SEQ ID NO: 17152 - protein, 258 aa, Chlorella protothecoides
MVGVNSGPARARPHACANRTTPLVIAGDPCTGFPDPGAVMVRPPRSPRHPPAADKFKLAKEWGATKCINPKDHDKPIQQVLIESSPDGWGYDATFECIGHVEVMKAALEAAHRGWGQSVVIGVAAAGQELHTRPFQLVTGRQWKGTAFGGYKSREQVRAAEDLLLLLWGVPGLVELYLKGETKLDKPSQRTRDDGTVKQVQACYNRLAPPSRGEVSAAAWEPHEVLHLSFLYRHGLGIWKGVTPNMKDWTGVGAGRCR

SEQ ID NO: 17153 - protein, 393 aa, Chlorella protothecoides
  MOD_RES (236)..(238): Any amino acid
MVVSSPGSGCFGPSAGKNPAAIAWDAKQPLEVATVSVDPPQAGEVRIRIMATALCHTDSYTLDGHDPEGLFPCILGHEAAGIVESVGEGVTYLAVGVYGAAGPAAAEEAWTDLRAWIRGLGCGVLGIHLLTNCQKYGPDLAQAIRRPPVHREGCDEGRWEDQVPLQGKGHLPLHGHLHFLRWGKAMPPGNLAALSFCTPQPAHLPEQTACSKRELFTFSVRRCWGAPLTHNSHSPXXXSWAPPLSQVGEGNAPGSLPAHLPGQTACSKRELFTFSARRCWRGPLTHTSHSRPPTPEYTVVHEVSVAKINPEAPLEKVCLLGCGVATGWGAVYNTAEVKPGQSVAVFGLGSVGLAVIEAAQRAGATEIVAIDTNPGGCGGWGSASVSLCAMGGS

SEQ ID NO: 17154 - protein, 278 aa, Chlorella protothecoides
MRVLVAVKRVIDYNARGCMPGYSLLISAFLRLRTLPSPPFAGMNPFCEIAVEEAVKLKEGGSASEVVAVTIGPKAAGDTLRTALAMGADRGVHVLEDGEVQPLAVAKLLAALTRREEATLCMLGKQAIDDDSNQTGQGLAGLLGWPQATFASKVVMDREAGRASVTREVRPGKQLGVERAQSMDPACLHPKVYRLPGHTPICQVLIQVDGGLETLSLKLPAVITADLRLNEPRYATLPNIMKAKKKKVDTVTAQVARAADVHRVCFVGVWGGTSTLVA

SEQ ID NO: 17155 - protein, 107 aa, Chlorella protothecoides
MSPEPDVLCLKQTPLPPLPADTVKVRLQTQSNTKPIYSGALDCFKKTLQWEGVKGLYKGMSSPMAGQMFFRATFFAAFAESKALLSRQPDGSMKVLTDMDLFKVIGV

SEQ ID NO: 17156 - protein, 166 aa, Chlorella protothecoides
MPCMPASQGVVPCMPAEEGVWHVRDKSSTMCKSQTPDSRRECVLIRHPRHGEYAFGFITGQTKMTTPEGELELFSVYVPTNHVYVGDIFLLAAPDIIRHNLSVREGIEFQAAMHAHVTKLGLGAHQLVCYNFVVLQQYLFLAPTRPAEVVVSVGMALPGHLQATGR

SEQ ID NO: 17157 - protein, 165 aa, Chlorella protothecoides
MDVVTAEEARIAEEAGAVAVMALERVPADIRKDGGVARMSDPDMIRSIKAAVTIPVMAKARIGHFVEAQILEALGVDYIDESEVLTPADDIHHISKHNFKVPFVCGCRDLGEALRRIAEGAAMIRTKVGGGRTGGWWEGWEGLRIDSPVEACHESWVPEGSRGSG

SEQ ID NO: 17158 - protein, 157 aa, Chlorella protothecoides
MASSAHSRRASRSPLCSVNGSGWALRHPAPKGTLSSGSAGRYPCQPLQAIATKDLPRTDDDGAYGVFRLEYDLDAVCEYVITFVPTEVKPEVSLLQRNPSETKTWKKVINVAVTGAAGMISNHLVFMVRLGATMTCSDGKVRTYSSGGFCLFSRASF

SEQ ID NO: 17159 - protein, 181 aa, Chlorella protothecoides
MDDRCPSGHSESTRPRACASPRPLSCQIHTHTHTHTQGEAGTGNVVEAVRHARAVQGAIRQLATLDEDELYVYAKEIRAPVELVRQTKALGRLPVVNFAAGGVATPADAALMMQLGMDGVFVGSGIFKSGDPAKRARAIVQAVTHYSDAKILAEVSGGLGDAMVGIDVRENGFTSYAARSE

SEQ ID NO: 17160 - protein, 131 aa, Chlorella protothecoides
MTSNPDFRIGESLGTMPSTDPTQPPPSALDVLTEQRDYFLQELGVSEEEYESIKADVAADFEATVRPLLDARSDSGEAQAQALESVAQASVPEDHVHAAAIKDKLGVLERNAFWPQASKLTFAQRLVKALS

SEQ ID NO: 17161 - protein, 228 aa, Chlorella protothecoides
MEHEGGIWPFMEVKCLPVLLQWAAYADPHLPALPLDPQRVACHLLEAIRGVHEGGHLHCALSPRAFYRRGQGADHPGMLWRLSGLGSAQLQSKRQCMPRADGAGPGAYTAPNLHNPLALPEERDDLISWLFIVAEMLTGRLPWKGSGDEPGCSEQAMLKLKMEAEADPKELFPSEGGMVMPRGFYALHETVVRGEPDDGPDYARIELLVDRCEGAARGCLAWRLGGCL

SEQ ID NO: 17162 - protein, 62 aa, Chlorella protothecoides
MTPQASVPIRSEVLMNPEVPQALRLQAVLAGGVVVIQHRQVTYLLDDCNDALVSLSKNWRTE

SEQ ID NO: 17163 - protein, 104 aa, Chlorella protothecoides
MGWLPPPCPSFPPLAGSWWFPVSELKALPHANASYTYVDGDGTVPTESAMADGFDAVERVGLVGAHRPLISMQSAWDQIMTWIRAGGEPAGGAVGGGFQMVGHP

SEQ ID NO: 17164 - protein, 105 aa, Chlorella protothecoides
MARSGSVCHACLPLLGGGPLRAGIAQPPRPRLFTEGLVYSMPARSKGDGDYEIIPGFHMNDWLIEKCKASEDELLKERDCVGHLLPNATVAQCMITEDTMLPGEN

SEQ ID NO: 17165 - protein, 522 aa, Chlorella protothecoides
MAERKRKLELYDTPAAPNGTPAVQSGGVNPFTGRPYSQRYHEILAGRQGLPVWQARKDFVDMLGSHQTIILVGETGSGKTTQIAQFIAEAGYCTAGLKVACTQPRRVAAMSVARRVADEMDVTLGEEVGYSIRFEECTGPRTLVKFATDGMLLREAMTDPLLEKYSVIILDEAHERTLATDVLFGLIKEVLVKRTDLKLVVMSATLEAEKFQSYFLDAPLIKVPGRLHPVEIFYTQEPERDYLEASIRTVVQIHQYEAPGDVLVFLTGEEEIEDACRKITSEIEQLGSKVGPIKVYPLYSTLPPQQQQKIFDQVRGGAARAWAHEDPFSVQVPACRHHHLERSIPQPPLSPRPATFLTPDAPVPALPCSQAPGPLKPGGIPGRKIIVSTNIAETSLTIDGIVYVIDPGFAKQKVYNPRIRVESLLVSPISRASAHQRAGRAGRTKPGKCFRLYTEASFGKDLQEQTYPEILRSNLGSVVLQLKKLGIDDLVSGGLGGQEGYDSGVGGLGELVDIHRLEGLCQ

SEQ ID NO: 17166 - protein, 165 aa, Chlorella protothecoides
MSLMQPRPLSCAFIHAIPPADASGELQLVRSENFRPLTLPARSHGLGEAGCHAGSGQDKVPSSDNAARQMPASGSPPAPSIVDQIAERFACQRLEDAPKAQDADGAAGTAPKGADPLRWYGGLVPHDMRRAEKHFQSALQLMMRAATLRTKLAMTFETRWYEPSQ

SEQ ID NO: 17167 - protein, 194 aa, Chlorella protothecoides
MPSAGPLPGAALSGRVELATHLCHPRRTTNRHFAPFLTDSRPRDAYSSTFTPSEGRSGQRGAAGRVSASTPPTALVAAPRTPALLRSQLMDKEVVTRTSGRRLGYVHQLTVDPARLEVAALYLRTSPTGLGAQATDHVLLYSLRQIGDVILVHDESALLDPPADEAAGYCKLVGAELVSESGVKLGKVRGACVC

SEQ ID NO: 17168 - protein, 157 aa, Chlorella protothecoides
MASGRAHRRSLVPIHGELVGRHQDAVPVGVQPVPRRDQGPRHDHGYVPQARVALGALQRVGVQGLDANLHAGDVLAVANAAVDHHARPAIARAHGGQVVAQHGAALGPAGVHHQHAALPLLLQRGAHAGVALVALHCRYLAAEAGALPIVPAREGGV

SEQ ID NO: 17169 - protein, 214 aa, Chlorella protothecoides
MERRDLLDLNGQIYKEQGQALNEVASRNCKMLVVGNPCNTNALIGLENAPDLPRRNWHALTRLDENRAKVCAHHHQYGRVMSSSHCAKERKSTWRLPELLNGVLEVGYLECSPPRSSLLDPQSSIALCKTPQCQLALKAGKFYTSVTNMCIWGNHSTTQVPDFVNAKIEGVPAREYIHDDKWLKEEFTPTVRRIESVVAEHVCGLPLLLVDQRQ

SEQ ID NO: 17170 - protein, 129 aa, Chlorella protothecoides
MKFVRHQKTTLLEQQKKQREKAQEIFEKQMAVLHDTAEEDLGNQEELEAELERELLGEAEKKKVHAGHGGNIAMGMCHMVRASRLTATRLRARVDTAVLGLLVIEAVLQPTPSPGRPFPPTRPCLSFTA

SEQ ID NO: 17171 - protein, 147 aa, Chlorella protothecoides
MGARLQLYYRRKNVNDTEYMQLTGKWNRRGARTLGSLGWVGEGSGTGVDGGSWHLSRCTFSAPTAPIKHKAAGATLIADGDEARWKVGSVLPLGDDDESPFLGDLKPGARQLAVETGLFRAPAQPYDVPPTDFLLVRSPVRLGRGGM

SEQ ID NO: 17172 - protein, 260 aa, Chlorella protothecoides
  MOD_RES (177)..(179): Any amino acid
MCVAALPCPAFEGSEKRISVSFSSRAGAVGAGLRALTRAELDALMDSAACLIVSARHHASHDAYVLSESSCFVYPDRIVVKTCGTTRLLACVPLLLRLAAGLGLEPAAVKYSRASFLFPAAQPEEHASFEAETAVLRAAFAALPLASAYVLGDALAGLQWHVYAFAGRVWIALLRRXXXLRLRPGRRAGGPAVARLRRGRCARRGRSGAGPPSAPAAHPGAVHDRPVPAQGRQLLPHRGICEQPPRDMRLGHPGPPPQGR

SEQ ID NO: 17173 - protein, 317 aa, Chlorella protothecoides
  MOD_RES (17)..(19): Any amino acid
MSTQDFPVPAGPLSPRXXXSLVRRADTLPITSSPCPPKTLQSQPVPCRLDAGYVPAKLPPSSLTPVQTALFLVSSVSSLELIEKLVYNAVVSPQEPKFKKRSTPLTFPGATGQSPHQGRHHRHARCARGHAGHGLAAGPGGRGIGAPALKIFVHGSGARGSLGDRGVPVWIMWLTPGSSDLSSYQVCMYVSLDHVAILLARRLPGQARQHLHGRLTRSHPPLDPGTQVRDVQEAASRAKKAAQEAQRTAQRAAAAKPAALPGSDSRESLRAMLEADRRERAARGPVSVGSVAQPLPSAGGGGPARIRTAGEAGLNSG

SEQ ID NO: 17174 - protein, 337 aa, Chlorella protothecoides
MARGPRHWPCPTSSTCWVRDSVLVGEVLVPASALVLGRPATSDVLMCDLGEPSSTTPALGGLEGLGLPPTPQEAAPAPSPPHPAPAAVAPSGSLEAWSRRLWTQASGILYEDANLQAGVKSAFSGAAGTVTVFLGNKTGGVLAGVALEIVGAPPHLTATLPAPPPAVLEPRRQVQVPLEVGAGAPGSAPLRLRLAYHTADGAAADVQLDLPLPPAKFSQPVDVPTEVFAARWEQVAGPPFKLSADVAPASGALSDAAVQQLLASLHLRVLAGVAGVPPGSTAAACVLHVGGGAAPARQIPCMVVVAAGAGRVTVATADGAASAALLSQLTSVLGWGA

SEQ ID NO: 17175 - protein, 190 aa, Chlorella protothecoides
  MOD_RES (108)..(111): Any amino acid
MHSVPIPTSPSGVGPTRDAARRRPRRPQEPGEAGGSGARDLGGHNLCNLPGRARLRGPRTDSTCAAGGGGGGAGPGRHPPGIRGPGAGHADARPGQAAQRECPGPSHXXXXTLMRDPVKLPSGNVLDRATIMQHLLTDQRDPFSRVPMSEKDMEPMPELQAQIAAWLAEQRRARAAAAAAAEEKTDMEEG

SEQ ID NO: 17176 - protein, 379 aa, Chlorella protothecoides
  MOD_RES (35)..(38): Any amino acid
MSWSALQRHRTSCPASAALTPARHPMPERPWVQCXXXXSWSALQRHRTSCPAPEALTFARHPMPGKALGSVRATSPLRTHDPHPALLTPDSLVQLYVDIEMTDRHNTFYEKFTTRYQIGEIMAYLWQLPQDLLPHCWSSATPCGPDTCLLATASSPKEYPFIPPLSPPPAPSIVARGRQGAPLHLRTLHQHDDQRLAVPAAGSPGDAAQGWGLAQNAGRGPSCAPEQSAFLHPAASPPAQVQEVERAMEDEAAWAALPDAERTEREEQLRTDRGRLKVGCCCSQLVSCHLQLAVGHESQPGLHGKSLYQGSPPPVFLGAIFHARGEGRDKPGGASVTCRLSPTPHAQSDFYLASVCIQTMQYTAVRGRDSAPGGSLHCL

SEQ ID NO: 17177 - protein, 133 aa, Chlorella protothecoides
MGPPPIRRPAQEAWVESLADILILVAQTQRSASLAQGDMEDLMVFITFCLASPAYVRNPYLRGRLVEVLHALMPPNEDPGSGFNAPPRTQASHAEIAALFQAHPLVLDNMVKRYGCGFELPLRQGHGWRLPGE

SEQ ID NO: 17178 - protein, 226 aa, Chlorella protothecoides
MLCMASFRRSIVLPWANDAGLSRSGVIARGGLVANTPLVSTTRGIKTHMMANYVENSALERVLRVTLIAEDAEAGTGMQPPVVYLSDLAQARGCHAAHATSHWELVTEGSAPELNDLTLERALMARLAAPPPTYPQWPVHYLVGCYGTAPHPDTATFTPVPTHHRRAAWEGSGAGQAAGISQGADGVLHSPHPDPADVPAGRRRAVRVSFCMSVSLSSLPRRRPCL

SEQ ID NO: 17179 - protein, 628 aa, Chlorella protothecoides
  MOD_RES (180)..(183): Any amino acid
  MOD_RES (481)..(483): Any amino acid
MARTDYTRFSPQLTDSDGDHLLRSRNTMRGGRKPVATPNGKPSATRASGVLGALLQSVKSVGRRVTSRANNSAPGSQITPRRSSKRLARGSAPDCPDPQPVGTVIATRASSLRPRIVEQVAHGSVTRSGKRRTRSPPAERGGKGLAGAEATLPSAAKRRCRAVPLTARESVPAAGRVAEXXXXAGAEATLPSAAKRQCRAVHLTARDSVPAAGRVAETELSPFAEAARVEEPGTRLSPAALTEGLLDLGESASPSTPPGVADGDGVAGQAAVQPIPTEPPPTTPTRASAAPSAEAQETPWRQGLLPSLDRLTSIGPKPSQSVRDSILKSPTPPRRATMASAGPRIRGVVRMLVPPPDLAGMESGREPAEESGAAAGPATSAPASLPAGPDQELPGDHRPRVAEVAAPERPSDSPAANGPETAGLVAGSSGEVPAVPAVPAVPTVPASAQPFPTCDDQAWWDPLNPAKVRHGGRLGSLDQAXXXAAAQPFPTCDDQAWWDPLDPAKVRRGGRLGSLDQASHPWPESQRHPHRTPTQVRAAKAALHASADATSMLPLCRERQAAAVTDWIRECLESGTGGSCYLSGPPGTGEGSGRTAGLQRVPASATRPARPANGSQTHARCRPSQAKR

SEQ ID NO: 17180 - protein, 126 aa, Chlorella protothecoides
MPNVVDELFPLGSDARPADIRSGVQTLQAASDQLHTALHSLVLNLLRGQACFVCRAAPAGFKNGGRVSIEGNSDGLASEDTKEGTLQWLTVAVQVNAERAKMHPDLKVASTDGFMINLTGVGRRDS

SEQ ID NO: 17181 - protein, 150 aa, Chlorella protothecoides
MIIDGTRLVVSDNSGAKEVECIKHKGRYAAIGDIITCAIKKGVRNSKVSPGQVVKAVVVETKKELRRPDGRWEGHGAMGVASTHKGRMYSHPPPPPTTLAPCSTIKFDRNACVLVNPKGIPIGTRVLGFVTHELRAKQMLKIVSLAARVF

SEQ ID NO: 17182 - protein, 121 aa, Chlorella protothecoides
MVEDLFALAHAPGSRLLILGIANTVDLVQQLLRPGAAFHVSFERGARTNVWGRGVGGPKNHGWWGGQAQPWQRAAAADTFLSGRVMQCEGARLLDPDHIQCYAWGCPVLPIPTPALPRTPR

SEQ ID NO: 17183 - protein, 168 aa, Chlorella protothecoides
MPSSTLPHADAGPPVPALHGCQQCQSVAKAECPDTACEAPCKPSSNLRGVSQSPVCLPSLPCSRYLSDPEARLPLSFDETRVAATGEEVRAWATEWADVSHSRDKAGAAGPSQRPTAPKYHFMCDAFFLMARCLGLGYAKCIENLRSLGRRVSDYENALTELEAHLAE

SEQ ID NO: 17184 - protein, 292 aa, Chlorella protothecoides
  MOD_RES (275)..(278): Any amino acid
MPRGRGSVLRHALGEELITGVMVPWLYVGSALSAFAWHVEDHALYSVNYHHMGAEKVWYTVPPSATRALEDAMRDALPGLFAAAPGLIYQLVTLLSPAELRARGVPVYRFVQRPGEFMITMPDSYHAGFNAGFNCAEVWRRVWGVARGRGVSVSGWGCGGVSLVDARIDKGESAKAEACTAIHWVSQTPSPPRTSGGEFCASGVDPLRHRHPGQVPPERQAPHTEPRLAAGGARPGWGQAGRCCTRAGGRRGARAAGRWGRAGRRRGGGRAEWRXXXXLGIPNPLSPSNLRR

SEQ ID NO: 17185 - protein, 315 aa, Chlorella protothecoides
  MOD_RES (137)..(140): Any amino acid
MSPSAQPWSSWLTLLTVFGTIYVVTVSHFIDNSKRSVIFLQADCDPRIGFFSLPTIFIATRSLDCKQPILYRYDGELYLAHGGNPEAYCRAPSTGDGAVLRERSPRQRRLKGFSTSALADIRLLSNGDPFSDAAIKXXXXSTSALADIRLLSKGDPFSDAAIKTINPDGWAVCDPSTHSMKKHCPYLGIVECLPEGVSKCESWDTTIEDTIGTGNEGSANWGNNNFGDQNHGSGNRGDRNVGDNNVGDGIVCNNKRDTSPCLLSDLLTSETVVVHPRPSPPPVVPPPPQPQPPSPPPGEGGCDPSIAFFGLPTVE

SEQ ID NO: 17186 - protein, 257 aa, Chlorella protothecoides
MPRRPPHMQAEAGIRTSAGVACNKVLAKLVSGLHKPDDQTILLPPEAAAFVSPLPVRALPGIGMHGGSGGVACTQRKEQNVTATGMGISGLIAACGTAHRRRHPHPDRPQNGGAASGDGGAQCRGPALHPAAHLSGHIWGAPGSHAVPALLGQGGRGAGCAGGLVMVRCEGPLTSLASDARSPTHSRFQDDTPVTVRGPTKAVSVEDSFKSCDSWQGVERVLAVLTPDLLARLHEEAHVGSVLTERAALAFILERAL

SEQ ID NO: 17187 - protein, 239 aa, Chlorella protothecoides
MWTWGLFPAVTAAHAWCNASITPQSTTATLPGVTQKYLVVTCNYVAREFGVRKLMGIQEAQRLCPNLVLASGEDLGPYRAASRRMLEVASRFGPAELLGLDELFVDVGAEVEGRAAVCAAGLHARAAALGVIPAGPSEAAYVGHVHRAGQRRVEADSRHRVQDLRAVPCIPPPAGDAAPENEESGTGWQARLAAGSRLALEIRAAIKVGRLENDVNPGFLFDAVDDLTGPVRSVPARAS

SEQ ID NO: 17188 - protein, 412 aa, Chlorella protothecoides
MSGVPESAKGVGSPVDLESQAATAAPFPPHLKAVAGQGAEARSFTQDLWTALAPDLRRGVVQAQHAQLAVQSAVGLTVSCGVARSKLAARLASPLAKPHGLTVVPDNVAVAFVRSQPLSSIPGLKGKRGAEVCSQLGVHAVADLASIPRARLVSLFGEDRGAFLEALGAGQDPRPVVPRGPQRSLVVERSFPPASPGSDAARAALRELAAQAAARACAHAAKTGCLPRRAFLAWRAGYESGCLRRGFPVAPTLLAHLRRGAAASVLATQCRAPEVTRLALGLELGEREPVEARIAPPSAPPAQPGIRQALGGGASAPAGTSPGEPRPALERELLTLGGAALVDGAAGLLASAAPGERDSLALALALQREELAWRGSGGSVGTRPGSVPGRAKRARPAAGPLDAFFIRRSQTR

SEQ ID NO: 17189 - protein, 238 aa, Chlorella protothecoides
MHYLAARKSAKRPHPPPLPPPCPLFATNPSPPTHQNVGLAIRALAAAQAQTSHRGASAANSSLGHDSRLRENVEHLAELRALAAELGVAGAVAFLPSFTDAQRAALLASARAVLYTPTDEHLGIVPLEAAAAGRAVLACASGGPLETVVEGETGLLRDSRPESETGLLRDPRPEVWADALRALCTPGAAERMGAAARRRAAQCFSRAAFGERLESLVARLAAHGAQRAGAGGGGAKTE

SEQ ID NO: 17190 - protein, 195 aa, Chlorella protothecoides
MEKMPSRQELMATIARLINGVPTKLARSIKAVPTKLAISIKALADADEDKSQRVGDVLPRQPPTEAAYTRPSDKHVSRVRGVVERGVHLQSPLLQEAHVPAVHARWRGATGLRRRRRLPLPARPFGAGRRRRHAHARPPRLGQPLLRRGGGVHAEVAVPERIGGADALRRGEAYHARQQVQGVVGGLGGGRKWGR

SEQ ID NO: 17191 - protein, 155 aa, Chlorella protothecoides
MGSRRIGAGQPSGRCLAWPGGVAAEHGGVPLSPVFWSRTAKRTKKVGIVGKYGTRYGASLRKQIKKIEVSQHSKYFCSFCGKFSVKRVAVGIWECKACKQVQAGGAYEQSGAQGLPALRSSLQYSNLHVPSPPHSTAASVTVRSTIRRLREQTEI

SEQ ID NO: 17192 - protein, 104 aa, Chlorella protothecoides
MRQPGPLCTTIDAAPAYPTRLLPPRRPWNSDSPSPGIFARTFRRLHGRGLVPDVLYPAVVVPSDAQLAAARAGWKRTLPPDLARFIESRDAVFLSINRFERKKV

SEQ ID NO: 17193 - protein, 372 aa, Chlorella protothecoides
  MOD_RES (72)..(75): Any amino acid
  MOD_RES (280)..(283): Any amino acid
  MOD_RES (367)..(369): Any amino acid
AAAGGAGGGGDGAAPGLETPGTPLPIDVRGGAVGLFWGGDVRGVWRGGRKLMHYRAQVLLLVRPKGQGRWGXXXXGDVGGVWRGVRKLKHSEAKMNAWAEVTSTLAATFALSGAVCQTSSELGPAPAPGAPEAPGGVRLLTSSGVLLAARHELRPAFADWALRHAGVLQDGFARYEVARLQRAGAGRGPPRPAAVAEVDILGAAPRGAGEALLPLAELAAMVSVALAALPCPGAFELRVGHRGLLALALKHVGEQEGLRQGFEARWLGSGGCECTEWGRXXXXREGFEACWLGSGGCECTEWGRGCRRERGCRRERGDGRGPGAAWWESADMHGAPGAAAHPGRLLVVGAPGASSCPVPPPRCRRRXXXTAW

SEQ ID NO: 17194 - protein, 215 aa, Chlorella protothecoides
MPCAPPSLPSAGDPCFPHPTPSPHAQHASTTIPSSGAPPELHARAVQLLSTAAAASPLHTAARAARWPAIRAGLEGLGLAPDAAARCRQLLLLGSGEPEPALHWLRATLGHLAPPGAPGTNIGAPAPLDDLAALLTALADCGVPGGCVVVDPLIPPHADYFTGPLLQWHLVAPGTGAAAMVGVAGRYDRLLRAAWARRAADPDVAHPPPQLGGVG

SEQ ID NO: 17195 - protein, 127 aa, Chlorella protothecoides
MRHRPSNSLVISIRGTGELSGGGRRLGQLPACYDRQDRSPKGVTDALATTVSMEDLITDLLSQPVDVSDWLPPWVQEAQSHKDECMYAHAGVVSAATAILLDMEEKGLLKASCTDEAPPCMPVEQVL

SEQ ID NO: 17196 - protein, 180 aa, Chlorella protothecoides
MLRRAAPPELHPWCAERGLKGPCGEVLDGVGEPWADVTCLGRRGSRTDETQQQEPLAVGGLGSRRDQRLGMLPSSPAARNLTPAPSHTHTPPRPSQGRTKRARHVLLRWILDTLDGAAAAPATRARALKALGEAVRVEPGLLGTPTVRAAVEAALTVRTYAECGGRRAGGAEEGGRRGEL

SEQ ID NO: 17197 - protein, 165 aa, Chlorella protothecoides
MARRHSRFRASPNLTSTLLTSLLCRGDSPRAAPAAEPVAAAPGEPMDVNTAVQQVLKKALAHDGLSRGLHEAARAIERGQAQLAVLADDCNQPDYKKLIEALSAEQGVSLISVPEASELGKWAGLCKIDAEGEARKVVKCSCAVVTDYGEETPALVVLQEYLKSR

SEQ ID NO: 17198 - protein, 578 aa, Chlorella protothecoides
  MOD_RES (434)..(436): Any amino acid
  MOD_RES (556)..(559): Any amino acid
MSKLRSLLKSMPHLIHTGFACGISAAAPGLAKTPQRASTGPIGPLSSPLRTMATAVNATTDRIAPPTPSKSKFKLALCQLAVGADKERNIQHARQAIDRAAGEGARLVILPEIWNSPYSNDSFPVYAEEVGGGESPSTAMLSDAAAANSIVLVGGSIPERSEGKLFNTSFVYGPEGELLGRHRKVQGIGGADPRVRPDRHRHRAGSHRGGNLLRHPVPRASGPLCRAGLPAPRLPRCSEAGGTDEFQLDPLRASWDRPCRPEAQISAGPTQAIVSHPRTGAFNMTTGPAHWELLLRARAVDAQACWRSRLNACLASAGILRRGGFWPLSDPVDIPVGPQATSFVCGWSGSGTRPFRWLPLLGPFCPGGPLWAGGGCGRGKRGDHSRGGGPGPNRGAAKGGAVQRPKALGSVLPAGPHALRRLLAAWTQFTAGPXXXGAVQRPKALGPVLPTGPHALRRLLAAWVGSMALVIYDQTATSVHEALSADSDRPLPSPNLQNQWLHAAGSRVTPHDQRMHMAAYMWARVAQTPRWAANSLPSPPYARSAEVTPSQLISFXXXXAANSLPSPPCARSAEVTPS

SEQ ID NO: 17199 - protein, 62 aa, Chlorella protothecoides
MSGEAWTTIESDPGVFTELIERLGVKGVQVEELYSLDADSLQAFEWVDGGREFGPGVRCGER

SEQ ID NO: 17200 - protein, 128 aa, Chlorella protothecoides
MPATPFRPALCLIPRCPGEAIGNSETIRRVHNSFTAPHALLPENPDNDSEGEAFHFVAYTYRDGSIWELDGLQAGPICLGEAGQGFEVALGRASGARPKSPDGSTPPTPPLLVEPFSRTSGRRLQPAR

SEQ ID NO: 17201 - protein, 135 aa, Chlorella protothecoides
MRTRAQRLGPSPRTPTHPLVCTPCRCRRTALQDALTDNWVRCAALEEAAPGSSPAAQELAACRHEGARLSAALDAECSRRAAWSDENLRRRTDYVPAVFNLLTALAACGELKGLVAAAAAAGGGGASGNGESSDT

SEQ ID NO: 17202 - protein, 64 aa, Chlorella protothecoides
MSGTHCAPLLPLITCQVILGGGYDTSADIWSLACMVFELATGDFLFEPKQGHGYTRDEDHLAQV

SEQ ID NO: 17203 - protein, 496 aa, Chlorella protothecoides
MGVWAGVAEEGWGIVPPCDAGACGVARGVGGWEGGGGGLARRGATRLAQSRAPGAARGQSHPERGGRPRWILILPHTLPASSSAPGRTHLIAPCSGQCCRGAAGGPIPDLGSFEARLQPQVEPQRRVLQQRPAQRVLRPALRAGNQEEHALLRPLFGRRPAKPFFTRESCPLHPAPPTRSSRFHPHRLKTHAAGVLEARIHHAGLPLRQRPCLVEHDVAQVHRLAKHLGGLDEDAPARRHARANHHRGGRGQAQRAGAGDDQDGNAEEEGEEGGGGARRQPVSGVGAGHARAVPGGPGDQGGQDDAGDKVGGDAVGQRLGGGLGQLRLLHQAHDLRQSGVGADACRAHPQHPPAGGGPRDDFSPRALGHGHRLARDQALVGVGRAARHHAVGGDARAGQHLEQVAGLQQAGVHLALARHGVGSRVGFAKDRGGGGQLQQRGERLGGLALGRRLQILAQAHKGDEQGGGLEKGAMPHVLCRHACVKRGGCVCNGGRW

SEQ ID NO: 17204 - protein, 249 aa, Chlorella protothecoides
  MOD_RES (82)..(85): Any amino acid
  MOD_RES (189)..(192): Any amino acid
MLQDPVSIVSHLHSRLLECWIACHTNQCRSSHAECAGFVKGYALIEYGSKEEAQAAIDDLDGKELYAKPINGVQADAGSDRXXXXVSEYPDAEGVQADAGSDKSRTQPPCVAGKIPSFGGFHRSPSSFIRALGGHPCSFEGEGAVSELLAEHPSRTGLATPSRFLWRFGGSQVRGRTCSHHSCHGLAVXXXXAFRRLPGAPVRLLHAMGGDGAHDARGGAAWRLLGHRPAPCRVSACGRGPWCSSPARL

SEQ ID NO: 17205 - protein, 235 aa, Chlorella protothecoides
  MOD_RES (45)..(48): Any amino acid
MLASRGYAETRVTPRLNVEQHLQPIQLLNERALCALVTTKYTYTXXXXCRAAPATDPVAKRASTLGFSDHKVYICRVVSCASLTDGATNNRHPLPRVQKPSDGGRWRAKAEGPGLPRPDQPCRQVWSPGVIERTLSGCTEEGKRGAAQEHSVLAVEGWVLLVTGVHEEAQEEDLHEAFAEFGDIKNIHLNLDRRSGENAGLSDGNWLVPGFMVVYPMLHDPVSIVPHPLSRLLEC

SEQ ID NO: 17206 - protein, 86 aa, Chlorella protothecoides
MSWHSDNEPLYGSEPTIASVSFGAARDFILRSNEDHACKRTYSLGQGTLLVMGGSTQDHWMHAVPPRARVEEPRINLTFRQIIRQP

SEQ ID NO: 17207 - protein, 441 aa, Chlorella protothecoides
  MOD_RES (25)..(28): Any amino acid
  MOD_RES (124)..(127): Any amino acid
  MOD_RES (177)..(180): Any amino acid
MPGARFSPCPGVGATLFLPLTRKTXXXXARFSPCPGVGATPFLPLTRKTPSSLHRPCVASRSAFSLPPAPSSHHPPSLFTMAMAAAGSLKGVGIPVKLIHEAEGHIVSPSLCPDIFYCALLTTXXXXCLRASKGIASLSARALASNRSACGTGRVQESLSERAQHPHSNGLNPSQNXXXXVGIPVKLIHEAEGHIVSVELKTGEIFRGELHDAEDNWNVQLSNITATGRDGKVSHMEHIFIRGSQIRFIIIPDMLKNAPMVTRALASNRSACGTGRVQKSLSERAQHPSSHGLNPSQNALPTPVQAHRPQEQDEERGTWHGRPWTGRAAMKRRAWRGPLLIQHIVITAWKAGVFPASQAGCLSRQTPRRRQGPASHAPATHLLSSFDSLPDSLLAPRTVTAATPLAVRHSLLPTQGCLTSGRGLPRDSGTSEHRHAHCHRT

SEQ ID NO: 17208 - protein, 365 aa, Chlorella protothecoides
MTSPDQVLGPKSRADALATVSGSPYVLVGCSSFQGQKWTGGIALIRESNLSGEAAGLVQACVEMPAGVPALVCLSDRDPFTGQVIAVSGSDDGAVGMWSVSTGLQPSIQEASSVRRHDDIEGLPHLSTVIQPSLHPSTSSMPPRQVSCIAPSGQASSQVVSTSWDGTAVLWDCTSTGPRRVSELRPGQHAVHAAAWCNSSVALATAADGCVFWDPRSGEAGRSGLVGGARELQREGVAPGPAAARAGLTAVAACENEQAVYLGTDAGGLLWLDRRAAGGGRPQTLASPHTEGIRQLLLGGENGSILASSDTAGKVVLAHTTDAALQRVVHSAAVPGGLALGWQGPQLLLGGVAGVRMLALEDCTF

SEQ ID NO: 17209 - protein, 172 aa, Chlorella protothecoides
MAGFGAYQSGAYSQEGLDFQPRLSRTDVAASAGVALGVCCSVYALAAPRVVSLWFGTCMAALAGTSLACTRALLLERQHKALQRSEEEWVRLLKAGTSLVPFRRSRLHVATFPPGTGSPTSDLRIHCLHGFGSALHSWLAVGPRIAAALGATITAHDMPGFGLSERCGKFMS

SEQ ID NO: 17210 - protein, 220 aa, Chlorella protothecoides
  MOD_RES (145)..(148): Any amino acid
MCEPRRRAPRRSSAPACRRRRTQARAPWRMRRSQRTRAAASTTSWAATPRTSSSLSRARWCCWTWTCPCARRCTLCTSRVCAGEGLCGEVCLWRGPSQGSPAGRCESYVHDGRGRGIAPHAPHHSTPLHIPPPPQQPAIYAGIAXXXXTPLHIPPPPKQPAIYAGIASAPLWDSQVGAVVGVVSASDFIFMLQRLRHVVSASAALSEAEMDGYTIRAVRD

SEQ ID NO: 17211 - protein, 1334 aa, Chlorella protothecoides
  MOD_RES (246)..(249): Any amino acid
  MOD_RES (311)..(314): Any amino acid
  MOD_RES (671)..(674): Any amino acid
RGREVGAGGRGASRRGGQQQRGQAARRGAAAAPALKPPALKPPARIQPGAALHPGIGAARPQLQLRHQAHQARVLLLQRAQVAARLLVHHCAVADLLGPRREQQRAQALRGRLRGRGHACHHAGLAVPAQRLLQQESEARVAVRHVHRGALLALHQRGDDAPQHRQRLVDRPRLRQLVAARAAATHPLRPCTGADEGSLLWVGWSRRCECLCQGHVEVQAMRVLLCPVVPFRHPSSGHGPWCEDWXXXXGVTSPGGMESEAMDRGAKTGARMPPTLHHSASPSPTPQPPKTPKIPTPSPPNIPPARSMRFXXXXPPSLTFTHPPPPRNAKDPDPFPSQHPTRQVYEVQLAGAGAGDPRVGALRGLNCAGEHRVGPAAALIHARGRDVPVLAAPLDQHHHVVGCGGAGGKGVAEGLCVCRDRVSQVSFATCRGADGGLAETRAPWDEGGAPLRSSPLHTNQPPPLSPPLQGLTIEHVVLAEVLDVHSPLHVAVPDLQRRPRCQQVCDLLVVDLQEGAGDAVAQRLRPLPPLHVLDGAEQGGEDAQREAAVGVQAAGLGGAGLAHHGVGLARPRLAVGKDGGVEAGHAVLHHRRTRHCAGPRAGGRGGEGGWSGPMSGAPWADGAVATGGGRCGQEAGSHAVRRSFLSGGSHREEPPTSAHAPTCVHLLLRGXXXXEEVFLVQRVTPGGASHLGHAPTCVHLLLRGLAAEDMVVALHHRLQAGGLGEDQGSWPHEGEGGGAALPLLAAVGGPDPDHHPHALPPAGNLLPAGVVHAAADAGRGGGQEGGRGHAVGRGQAAPRHPQALGAPRAQLGVGARRAPSSGMLDLVSALPGVAMSSSARGGRAGSVGHRSEGPRALVMQGGGGFVYRSACSEVWWRPASRFGPCARGSGKAGTGGYIETGVLRMPFRDTKTYIPYRSGVPHGPRPSGAAAALQYTERASFYFEAACAWARPALPGSSCRCTSGTALSILHSTAVEGWAPALPLSSGHGLGAGGGGVEVALLEGHAQLQQLAEGLAGMMGWQGVCEVATVGAVRLQAWPRCRSPCMPLHRGRGGPMLPCQAPVTSGLMPHPPRTTTRTHRGKVLEELVLVLGVQVHVLPELLVPDHPHVGGQHHELPRLVLVLDGSVPLLLVPLALQLGEVAVGEGGGGEGPRPHEPGAVGVAAPDGMRAHQRHDLLVVEAHAVEDVAHVLVVARRVGQAPVRQRHAPILLLVGAPRAPLDLGPAHGLDGHHAGQGPEVGVGDPGELLLDGLQDVARVAQPRVGPPAGLRAEAHGGAVGAARVVVLVVGAAGVPGQAHQHGAVAAVVVLIVGLQHVLDGGAHRLVVGLEVLWEG

SEQ ID NO: 17212 - protein, 213 aa, Chlorella protothecoides
MATPGSADTCQDATSPSPPFLFFSHSANDRVRGCAGRLAHQVEHSRGRSAPGTHSHHESSPPAQGTPPLRGGPAYSGNTLRSSTSKLSTGRPERLRMARRSLPSADSMPSPSLLASPAPSVSSCVDDASGEEVASGGEGVRVMVRVRPPNRREQREGGAPALSLVGPRTLVLTEPSRLEPVVKSYDHVFGCESTQEEVYAGGGMGGGGRFLPV

SEQ ID NO: 17213 - protein, 344 aa, Chlorella protothecoides
DFKPDYQAVRAAIEDVLESNDEYDDGSYGPVLVRLAWHTSGTYDKNDNTGGSNGATMRFGPESGWGANAGLGDARDILEPIKKKFPWISYSDLWTLAGVVAIEAMGGPQIKWRPGRSDKEENGCVPLPDGRLPDASRDNKHVRDVFYRMGFNDQEIVALMGAHAIGRCHADRSGFVGPWTFSPTTFSNGYFTELKGKWHKKKWNGPIQYEDKTGELMMLPTDMWMVWDKKFRQYVDLYAKDQDKFFEDFAAVGSRGCAGRVRHEARSDGGLAGEHGPPSAPVQGHAGTAAAWPRLQPHRTHRRHLTHTLPPHHPRQAFSKLLELGVPFEKRDFNTSPSSPKPMA

SEQ ID NO: 17214 - protein, 127 aa, Chlorella protothecoides
MAGFNSSIFAYGQTGAGKTHTMMGEACASEAGGLHPDCGLTLRVFAALFRAIEDVERGEGPQTLRYRISCSFLEIYNEEITDLLAPGPALQIRDGDVKRGVYVQDLSEHNVLNGEALERRGEGGLGV

SEQ ID NO: 17215 - protein, 127 aa, Chlorella protothecoides
MVLIQRGSENRHIAATRMNERSSRSHSVFTCTIEATERADTGITSTRTSKLNLIDLAGGMLGGEGVGIFGVSGGVGGILAPVFAPRSMAWGRVPERCHRAEQNTHGLHLDVALAQTLAPPTPSHPEK

SEQ ID NO: 17216 - protein, 312 aa, Chlorella protothecoides
  MOD_RES (101)..(104): Any amino acid
MAILPQRLAVIGAGQMGAGIAQVVASSGIAVKLVDQSHQALDKALAGIESSLARLVTKGRVDAVTAEAALGRLYTSTSLEVGGMGWAGQVRGRLAWGYASXXXXVHLHITGGRGNGVGWPGAWQACMGKCIWASLPCPDLGSQASPMSRPDPTLKSPSPPPPSPPRKTNRHFVPPPFPHPAPTQDLHDVDYVVEAVPEREDLKLRLFASLDAVAPPHAILASNTSSISVTRLGAATRRPAQVLGLHFMNPVPIMGLVELVRGMRTSEDTFRASLALAARLGKQTCVSADTPGFIVNRLLMPGINEAFYALQE

SEQ ID NO: 17217 - protein, 302 aa, Chlorella protothecoides
MSSLASLRKLKVSELRDELFRRNLDTKGVKEELIQRLADADGAGEGEPKPEGEEPVTDSPEDVTEPQPTADQPAENGSQGTAPPEVEAAEAPASMVSAPAAPEEPASSQVTEAEKAKRRAERFGIAVVPPSGSAGPAPEDKERLKKRAERFGLPPPIETEEVCWDRWWRKCCPAGGDELLATLGKDELEKKKKRAARFGLPAPVIKSEEEEKRLARAQRFQAASAGVTGERHNRGGKGKAEGQGGALCTPRNPEGSGAAGCVQCVPRIRFTCTLHQASQMPSYLVWRTHLPLTDGLTRLMKE

SEQ ID NO: 17218 - protein, 126 aa, Chlorella protothecoides
MQRLTGPQVHAHLCLSPNHHLSPPPAVHAYLPAESSFGFVDELRRRSSGAASASLLLSHWERLGVDPFFVPTSLLEREEWGEEGQGVGAANLARKLIDATRRRKGLPVEEKVVESATKQRTRARKV

SEQ ID NO: 17219 - protein, 678 aa, Chlorella protothecoides
MLLDLPATLVAEPGPGGYPSPATPWRGTRYRALTPRTSLHRIASGACAETSGRALLGRAGLADGAPRSVADLEQVPTLVRSIWGRGCEGVLAGLRPGQAAARQLVRRWEDAELRLIAVANSLASKSGQKVLAVGIPLAAAQLMGLGREARAYAVPLEAQGEASSHHPRKPAGGTGADALHAARRLALCLLAAVAREALLAARAAFLGLLFLPALLSSPALWCGEAARGAWLRLACGTLARSGPAFIKWAQWAATRPDIFPADACAALASLQAGAPAHAFAHTRATVEASLGAPLERLFVRFDPEPVASGSIAQVHRAVLSTEGAAAAAPPRDGKARPVGARRGKPSPFAPGAVVAVKVRHPAVCDLIERDITLMRRAARLLELLGTGGQLRESVMQFGAPLREQLDLRQEAAHLQRFAANFSGWRGVRFPLPAGPGLVAPDVLVETFEGGQLIARFLETEGARFNKRLAGLGLACYLKMLLRDNFLHADMHPGNIMVDLERPGPSTCLGALAAWTGWDLRLPRLVLLDVGMTARLTPADQGRLVAFFGNLTRLDGRGLADAIVSFSDAPPPPRAAAAFRADLGSLFDGLDAEALRADTAGVVAGLMDAIRRHGVQLQGVVSTVVITTCVLEGWSTQLDPGIRMMESLRDILPSAWGERAGRALDSAFTKSSLAMAVAS

SEQ ID NO: 17220 - protein, 133 aa, Chlorella protothecoides
MAGPLMWSIVAMRNSLVFHDVDKVRYGGQQGQCVACLGNRERRGRVLGGFASAQAACLVFSMGGRGDGEQAQEGATQHQAPLTSCKALTSLRILPAANHVDDACLAGDLGLRGCKIVDQGGSTSTDSRQRLGH

SEQ ID NO: 17221 - protein, 382 aa, Chlorella protothecoides
MEPSSGMRLARVPRSLLTPLTRPLARPFRQHPGDGRRFGHRIPPRTPAPPTCAALTSESPCSQAPTSTPTKLYDMTTLGNLCVDVLVEVPRLPDPTAHPALLDRLRATPPGPDSLEVGGSGNASIAAARLGLRVCCTGPLGRDLYGQFMASVLAVSCLVGGGRAEGIRLARPAAPPSLTCHVLVDPAGHHAFCSAYDHGPWPLLGDAGAAFDAEALLASRAVLVSGVLLDEAPPAPVLAALAAARAAGAAIFFDPGPRSWTFQTPARAAALAALLALSDVVLLTEDEAAAVTGVRGAEAAAVAVLRRNGCAARWCAVKRGAAGAVLALRGAADGAGAVRRLLEAQAGAGGEGRGPALGALAMLSPCHGAEAGRDGRALAAEV

SEQ ID NO: 17222 - protein, 86 aa, Chlorella protothecoides
MATEAGPLCDEPMWGVGFEVEARVVGSGDEASPAPRTGEDVYGPLSGQVAAAVRAAARRALAASAPRLVEAMYLCEVGQLAGTRGG

SEQ ID NO: 17223 - protein, 205 aa, Chlorella protothecoides
MPLVHHSTIDQAFQDLSQLMSKAEEMVKLAEYFKERLHQQPGAGAPEAELDAETALDLFDLGLVTPVTKESAGRQYHRELARQGPLQKAGGMLPLPEVYCLYCRVRGSELISPDDLLHALECLPHVQAPMQVWQHGAGGFRGSIQGVVAGGMMGDGLRASPHRLGLPAHAQPHSISPRPQPSSTTYAAEGLHLWSAGGAGRLVFG

SEQ ID NO: 17224 - protein, 103 aa, Chlorella protothecoides
MPRATFFKCITLAEGAGPAIYTAVKWKGEGHILRWRQLASGEIRLEVGRRRSEGVPGSGLFVGLGVALTCRYGCAGRATQGDPCLPGRVEPVSAASHMLQGCC

SEQ ID NO: 17225 - protein, 286 aa, Chlorella protothecoides
MHGRNNPTFDLHTTLRMKRRAPLQKYGAPLYGVAWPDGPHAYMAGGGNLGIENKVVVVSCDERGKLSDEVTKYNTGDDAPYRMAMHPSGRSLVLGMTRGGVQGVDLQPSTSGRDAPELSRPGGKAWDAWRKAQAGVVNRARIHCRAATHPTGSFASRAPSIGALKCLSFSSDGRLLVMGGEDGSVRIVHWPSLEPKLHWQASEDKAIRAADLSRAHSDGILTTTDEAGMAALWNAETGDKVLQLAVPQGEEWGKEEKSWRRVLCGAGHAACGSPAPVGRSEAMRVW

SEQ ID NO: 17226 - protein, 228 aa, Chlorella protothecoides
MRFVELFTTSLAENGGILAASALMSFGRVGLTPGQPPNHSAIWINAGGQVRGGAWRIAGLGEGTGLDQVILATCRTECGNGAQDSGGERPPKDIAAARIQAKYHCFEWERAYPKSIKRVMKYVAVIIIIGSTRWDLGRKEDYLAGCSGSPFPLAALCPPPLLTRMLPPCRLAVELMLLFCPHYDEATGVTLHSCDRPSLFQAINVAFAVRNRNTALGSYLDLNSTSSL

SEQ ID NO: 17227 - protein, 288 aa, Chlorella protothecoides
MSTGRGDPTLTSMSWSSMRATSCPGCESLSCCFSGRGGGLPRTGHGPELYGNLGPVKSSGPRPIVPPPSWLERLTALSHPSTMHSPGPACLPRYLLCTVGACYIRSRQAPAKLILRDVAELCRGVQHPTRGLFLRAYLVQVCGPTWPWQRATLLSSCPSWVSRRPQPRWSSLPQPAARHRQSLREPGGRQRGGRGRLPPAQLHGDEQAVGAAAAPGRLRGPGQARDGAPGAGGPGGQEPDLHLPAGGPHLCGLPEPGPAQVGMKVLERQPASLLPPRVLGLTCLCAAE

SEQ ID NO: 17228 - protein, 282 aa, Chlorella protothecoides
MANPAHNGAAALPPMGASPDGLLFRPVPDASERPESLTLSGEEVEQDGSPESSSGVWEVVEIKNVCPFGQSGSGLFTLKDMDPVWEVRAEWVPQLQFHMLCSGEQQGPAAVGGPNAAHVAPLPAGLLQAAPPASPASVSPGPHITHPSCRPVQCPAGEPVGDPGPACLPHACGRGLRRPHEALHRAALGGGAGGAAQPASQPLGPGGQVPGPAEEDADAGAQRAGRGGAPGRPAAARMHPPHSLVPGRWAGGGGAQLTEGDSVMVTGVLCGLWASHARMGFS

SEQ ID NO: 17229 - protein, 356 aa, Chlorella protothecoides
MEQFSAWHSVHAVDVQVPVSPPSLDRRSSQSTALKDEGIVIKALDSMWTTNDRSGSWLKIKLDYVRNMDIDAVIVGGWWVAECLGVEEAEGGGRTTPLHGREWEGRRGDAISQFLLALAVPNPVSGEAPSSWLTFCRVRLLGGDGCFCCTLVVVGSAVTSSKYGCGIARIQLSTHPLPAIVDYLNPPTSRSLGASGRHRRDRRGASFTECPAEAPVPGWEECATPLPAVSTWMGICLGMASSSCCRHLPARTALTSAGRQGLVHRAVLTGFSHSPSQTHRRTTGREAPDVWIKDPSQSVVLEVHADLRTIPSSTFATKLSLRFPAVHDIRWHVCEGWRVVEEYIGGGKGSRSPGAC

SEQ ID NO: 17230 - protein, 334 aa, Chlorella protothecoides
MSETTLFKAWHPDAVEYYNKCGASLRAVFNTMIDPSTHFDTGIIPGRAVRPQLALGTGSVEYAFKRMQTKQGLARPFLLETKFDGERIQVHRDGNGVYSYFSRRGIEHGQHSRYSAFDPVLRRQLPGQARFILDGEMVVWNRKKGRFEPFGGLKTVMHAAGRRSRPGEQLEVMDLEGLGLEESDPTYSPPRIKVELAEGSGCWPEGSLCPSPPHQDVELVYIAFDIVYLDDRPTTHLALRERHRLLAALLQSRDAGAHRRMHAACSPRPLPPPSTKVTPLRIGSCDTYIWGDGASGAPAAGGDAVQRRPVLPGGQDPGGHTGGSGPGKADWAWL

SEQ ID NO: 17231 - protein, 400 aa, Chlorella protothecoides
  MOD_RES (75)..(78): Any amino acid
  MOD_RES (396)..(399): Any amino acid
MSSRRPEAVQPSDLSFDTLCSLFDILTNSANSKTKSAANRRKIIDKFIDTCVARAGGQAFCLFRLCIPAVSRLVXXXXRAGWWSGLLSLPPVHPGGESLGGHMGRPPVSLHYLADIIQCIPMQLDAERGNYRLQEGKLVDVFIKACGVARDGSVAKAAKGWKKPGVKGVGIFARVMEEIYCFQGHSGFCQTRHLIEAISHDSHAFQDSCNSFPDPNTPILQHFFSSYCERTHGTPGAKDLKIRQVNEKLDAMVACAGEREKRSRIVHVFPHDWKLRHELIAGDATASEPHSPAKILCIASASRSILSSAPLRVWRTIVAWCFGVGYWSSFFGLKKPACSEQTYTCSHIWLKPWCSETFKEQCLHALSFSKVSNTCGHPGNLFIPHLPSPDQHERDXXXXH

SEQ ID NO: 17232 - protein, 148 aa, Chlorella protothecoides
MTEQDAFGTLAGVALRVTQRHPDTLVADVAGMYAALLAFAGTVYPERLEHVDMVLGNCHDALRSRGTVPAGKAEREVVALLSTPLNKYDVVTAGRDPVHLCRVPPRPSPASAVLGLKQYPAVLSLLRPNMQREVALNIAQVRGPRGAA

SEQ ID NO: 17233 - protein, 159 aa, Chlorella protothecoides
MSTIPSLWSTVFQFLRDNATLLHPNNGLASVAPGFSRVSVTDLTVTEHTVPYTGCHYWSNFEIGSEAYQAFFAALERSGGFFYERWGDAPVHSLAALALLDARAAIHFFDDIGYRHDDAMHCPQAPDAVRHCSCMPAVDFNQHQSYCKSLQRQAGLLGQ

SEQ ID NO: 17234 - protein, 422 aa, Chlorella protothecoides
GELRVQGALSAELRASPRHGDGEVASGLLPPDATAAAAPEPMVPSGVPPPVVVSKGRNKTYRGVRQRPWGKWAAEIRDPTVGARRWLGTFDTAEEAARAYDAAARAIRGAHAKCNFPLPEEEEAAAAAAAGGAGGASGAGGLVAVHRHASTTSLELDAGPDATSCSLTGQLDGAGRGDGGPGDGRRLSAHGAEEEEDMDDDLDDDYPEVEGLASFSVTLEGFGGAEARGGCAAGHGAPTASSLDEAALISNPLLAALPTQAMRLSDAMSIPTGLPPISSVAMSSWRQSRGWGGCRPHPHACACTGICCASPALPRPEVHDPTPYPFISALAQKRKSTGLTPRAAPWAGPEWVQAQAHAGYSLGASPFGMSVDMMSVGGGGDPHLYWHMHNEGGGGQDTLSDMGSLRQSLGQASSPTTPLPVS

SEQ ID NO: 17235 - protein, 135 aa, Chlorella protothecoides
MGPHPEPQCDTVLPAHPHPPSMFLGALEREAAWGVRPVSFWVQGMAKHRNEVPRELRHFQAVAHDPTVTAPFPPPSRAQGLWSIGIFKGSGPFDLQPVEEYSPRQDTLTAWPVANPVLTCESLFLDDEVAGGEAW

SEQ ID NO: 17236 - protein, 530 aa, Chlorella protothecoides
  MOD_RES (41)..(44): Any amino acid
  MOD_RES (179)..(182): Any amino acid
  MOD_RES (357)..(360): Any amino acid
MGLGSPAVLAKRRYTQQALCTRGKGGELPLKTVREIGTLNXXXXFTAGALHTWRGGKLPLETVREIGTLNFAGSEGSPQPTDSASVISRHLAPALQARPESVAAMATAARSSLGRIALGDTALFVCDIQERFREAIQGFPAVVDVSRRMVRRLLRHSGGCIVELTSSLAAQPGGIRPSXXXXSGGCIVELTSSLAAQPGGIRPSDPLHLSYPKFPIPLTYRSIRAAEVFQIPVIVTEQYPKALGKTVSELTEVLPKDAQGGSRTSVAMDGNEQVDVRHRPPLHTMSLAVFEKTKFSMLIDEVSEFLTRRDDIKRILIVGIEAHCRTRDTFGGDTMFGLALASAQLPRPIPPSSLSDXXXXSFLSAELGIPLVVTPCLTWHWPRLNSPAPYHPHLYQILLLHAPILYPYTHIYVPLAPPPALPDRGYEVHILTDAVSSRYALDRSTALHRLSKAGAILTTSGDCRICVASVAFLMFTPGRDCSEGFHPFAHPLPTAAETASFQLMGNTTYPNFKAISALFKEKKADSLPGL

SEQ ID NO: 17237 - protein, 801 aa, Chlorella protothecoides
  MOD_RES (93)..(96): Any amino acid
MHSMYQLWVLGALDNTGGLTALGRKMGEFPLDPPLAKMLLAGAQMGCSNETGWWAGNERKGGDLGPRQKRGAVKAGDREHSAVGTQERCMEGXXXXTGWWAGNERKGGGSCADAEERGSEGRRPGTQCCWNPGALHGGSSPWHDIERQAEPSTPHGHLPTLAGRRRATPRVKSSSFQSRTTSPSCTSTSSGRATATAATGARPTSCRCRARAGGGGPGVGFASAAHALEEGARMWDLLVCQKSVTLRAGSLALTHSSSVASNPQISMQSKGLKKAKEVRTQLLDIMQQQRIPITSCGNDWDVVRKVGKAAWAETIAPAGTLARIVIRSPHPPTPLSAALQAICSSYFHQAAKLKGIGEYVNCRTGMPCFLHPTSALYGLGYTPDYITYHELVFTSKEYMQNRGPTARTPIHPPTQCVTAVDPEWLAEMGPMFFSVKETHSSRLEQRQKERTARAVMEGELEKSQAEARVLQAAQAEREAAIREKQRKSIATPGSARPGTGQRKFGLRMPASLVRGWGEARPLRSNVEDRTAPMRQISPVAHSVQSRPHGEDQDPPVLAAWTPILERGEHADGTHTLPEGHHLHPVWGGVRQHYPLQPSGIQRLPVQFPGLRNPHPAPGLHSLYLYTQVLWSPTSGCPDHRGCTTGAWVTPGSCSRLVLHAGFEQASLCRVQTDQEAPSHPPHHQVAPLALFWWLYVVSGVTALRFLNVPMYRWGPVFKGSTQVDLYRSCAIKPYTSPLSFHPSVLRRSTTLVVVAGEYLAFHKVPTGLSLVSGDGGVDANRRTLFGGCAEYHVLPHRARVI

SEQ ID NO: 17238 - protein, 689 aa, Chlorella protothecoides
  MOD_RES (19)..(22): Any amino acid
  MOD_RES (102)..(105): Any amino acid
  MOD_RES (310)..(315): Any amino acid
  MOD_RES (392)..(395): Any amino acid
MDVGSIVKGIVCVTPTSKXXXXSLNTDVLFGILKKVMGRWGRVVERWGQNAARDAPPCSLGGERTWHRRGGLRPTCSRRIPSRLSTNQPVQVVARRRDFRLXXXXVVQPPEEARRMISCPRRACLEPTVMKPIHALPVSQGRRAVEAGCCPGCPFLLTWRRENLASARRAPTSMLPKNVDTLMRHCHAPVVARRRDFRLIVTSATLDSQKFSDFFGSVPIFKIPGRTFPVDVLFSKTPQVGGRRGHVVPSSAAAALGMGGLCGSCREAGHCRAPWPSSGGHPHLHDGAGGDRGHLLLHRGVFSGFPAWVXXXXXXQERLEQLGEGVPDALILPIYSQLPSDLQAKIFERAPEGTRKIVVRRGRDDQWAPEGSVEDASEPPHRPPSPHTSTSXXXXTSEGLRKEVGTISGAVAVQALCADGRVSYCAHARSRPAPQILTSLPPCLKVSTNIAETSLTVDGIIYVIDTGYAKMKVYNPKMGMDALTVSRESGGGGVKTGWVRRRVGLRQWLQAWQKDAVTVEGQGSATYSIGDWPYICDPLRPIPSFLSPPDTRRRRSSPSPRRRPIRGLGVRDGPGRAPAGACSQRAPFATVSLHRVPSRRLSHRYVFLGPADRAGCTSQGLNSVCCVVTAGDCSSPVCPASHPMCAPLPIPPSRSCRDAASHRARDPAHQPLKHRAPAQVPEHRQPVGV

SEQ ID NO: 17239 - protein, 111 aa, Chlorella protothecoides
MLLLGTNELAGVAAYPRLADPRFLVFLLVSCSQAFLLNVCIFRCTLVNSALATNVSGQVKDILTTALGATLFSDVPLRPLNALGLALGLLGSTAYSYISYREANPRKVVVK

SEQ ID NO: 17240 - protein, 385 aa, Chlorella protothecoides
MPVILCTSGLPVASAPILAAPRPGAWGPNRRKSRRPAPSSAWRPGTLGGDSVPPGAEYGEVGREPPGAVAGAGCHRDLLLLPGPTPSPTPTQGLLQFLTPGGTTRLDVDRLNEKLRPEGAARCRQSMFPDEAHGLIFDWDDVIADTAGLQLAAWHDLAAQEGLSLEAGMRRRGALLDLRPERAILEVGLEYERVLGWTRDWVRAQALARQLAALYLARVEASPAPLPGAAAWLAAAARHRMPCALVTWLEEGCAARLLEAWGLTSAFQAVIGARMGAETQAERLLCAACALRRPPERCVAFSACPGAVTAAHNCSMRAAAVAGKHPAYALAAADVTVASLADLSVVNVRRLFADAGTQRMDLCKQEARAEGRSRPRRATTGETPT

SEQ ID NO: 17241 - protein, 382 aa, Chlorella protothecoides
DGPGQPLRPRSSVRFAAGPAASPATTPSWRSAAWNRAPGGQPTLDRSPDLHGGEGTARGSEDAQLDRDWYDQDDAGGTVDETHNPFLGDAEVDPALRRRAEAAQRRLTRRDGSLMTLAQSKRAGELQKDMNAWEENRLVQSGVVRLREVATEFDDAADLRTVLLVHDTRPPFLDGRFLFTRQRGPVLPLKDPTSDLAVIARAGSRLVKEVREKKEAGKSRARFWEVAGSKMGSITGLTGGEREEKARQEELMRLEQGSDDEGDYRGKSQGKGGIESSRAEGDWLWLPQVPARHEGGGCCMHEARGRASMALFDTPEWCGSMIAPAFPHPHLQFRTHMKTNEAASEFARTKTLAQQRRFLPVYSVREEMLQVLVLKGSRRRGS

SEQ ID NO: 17242 - protein, 197 aa, Chlorella protothecoides
MSISWTCSDAPFPLSTAPASFKEAERLKAELAAAGGERAPPPPAFHLGQLVCEQGRGYTGVVAGWEQVCGEGPAWLAAAGHDRAGAPGPWYFLLVEEVAGRGPRSGLPPVALVPEGALEPAGDPSLVPGGAHPLLSLLFLGKDAEGNHLPCRQLRQRFGAERRDVHPPGGPLAGCLCEVRLDRRGSGWRGRGEKWGR

SEQ ID NO: 17243 - protein, 111 aa, Chlorella protothecoides
MPRAGQILSPSHPPPSKYPTRQVVNIEAPEAFVGALCHSTCLPRLALRAAALREALCFLGHAGEEGREVVTLAAFHHPEAFSAAEAAELLAFERGAAVLEMQQRERRMQAL

SEQ ID NO: 17244 - protein, 704 aa, Chlorella protothecoides
  MOD_RES (580)..(583): Any amino acid
MHLPLCARTTVTDMSGLEVSVPSTDLDARGGVGHGAGALPKLSADLVSHAFELEQASLAPRPLGVGRRWRPLIPPRLAWNDGRDSPPPCYDQERREESPQSNDLNRGRDFVWSAYALVRAVFSGQGYPSSWDWEVHRVPPGSTDGRGSRSNLGAISAPQVNADHNIFLESRLAMGKEIEMKDAESPSPLVGKDEAAVEEASVLEQLAVTVSVIDRAVRAKETRTVFNRVLRQVAGVRRRMQSKDLRDFVTAHIPPGNPSLEPLLAALDEPYRAFWGEGGSHSRRVFVECPEQAPPCAAAARAWSASAITGHSLAQNSHQPHRCIPAHPQADTAAMSTLTPSSSPPAPATSPPLPEVEALAFLLVTLLLVNGRQWAAAHDLASSALARLAAFNRRTLDVLGARLASLLSLCAARAGRGGAALRAALLAAHQTAALRRDEVGQETLLNCLLAGLLDEGLYEQADALRARAQRPDTARDVQQLARYLYHLGRIHAVRLDYSEAKECLQQAVRKVERGVQGGWVGEGSSRGESGPQGESGPRGASTPRGESSPRGERGGGGEKRGSRAGGDVEQPRPGNLHRPXXXXCVCVKGGGALEGRVVLDGRVVLDGSGGAAVRKEGAARAATLINLAPEISTAHPCAGAADSHRLPRGRHQVADRCAAAAGRVAGPRGADARGAGAAPGALPGADPGRALRRPRRVRGRAARA

SEQ ID NO: 17245 - protein, 188 aa, Chlorella protothecoides
MLELVFAPAEEWIGRSDEDIIHATMKVGGGTSVWTTGCGVPACAWIGSSDPGPAAALPTPPPPSQPLLVLIQELENLFPGEIKADGSLAKVRKSHVVKTPLSVYKTVPGCEAARPSQRTPIPNFYLAGDYTKQRYLASMEGAVLSGKLAALAVAEDALERAGEAPAPSLNAAQRDAKESAVEAPPVAV

SEQ ID NO: 17246 - protein, 403 aa, Chlorella protothecoides
MSSTSRSCATPPTSCATLGSHAGALRRTHIKPFTPVTGNTPRSKRNLQIQCRDFPKPAFENEKSFKEAASLSSAATALPRPQRSLRVAIAGAGLAGLSAAKYLVDAGHTPILLEARDVLGGKDKDGDWYETGLHIFFGAYPNLMNLFKELGIEDRLQWKSHSMIFAVRESPGEFSRFEFPDLPAPLNGIVAILRSGAGGWDLDVYSHDVFGPHDGMICVLVPWFWREGPQSLKQLQAGSESRPQPAHSRNNQMLSWKEKIQFALGLIPAILGGQDYVEAQDHLTVKQWMLKQAVGAGPTKALGRWTSRKAGSPVQGQRPAPPPPSPLSLPSPCPLPQGVPERVNDEVFIAMAKALNFIDPEDLSMVCAMPVPRNGWLDPQGNARLEPLRWVWSLPGVPGRAAA

SEQ ID NO: 17247 - protein, 72 aa, Chlorella protothecoides
MRAGATRDVYGSGEPAAAFHARIAFCMDIHNEALKAMRYESLGGLQLEDADKLRERQEQELQAALEDDGMDF

SEQ ID NO: 17248 - protein, 183 aa, Chlorella protothecoides
MAFLDGAPPERLCQPVVDYIRERGGEVRMQAGIRRIETAPDGRVTGFKMADGSSLQADAYMSAMPVDIVKKLVPEPWADQPFFRKMDKLVGVPVINIHLWFDRKLSTVDHLLFSRSPLLSVYADMSTTCKARLGFGTLGGAPGRRNFQEQPSSRSPLHWAWFCHPHHIPHPPICDPALPTGVP

SEQ ID NO: 17249 - protein, 136 aa, Chlorella protothecoides
MRSHTGLGPPFTKRSGPHRADAVQAALAQLTGIEQADQILMHGGNRVDGAKTLAQYNLPEVRAFAVWLEQGGMWGEGAMPLCNSSPRGGSTPIPSQDPASAQPVFLYSRRLMRPGTPAPPLDPVPETHVQCECCRG

SEQ ID NO: 17250 - protein, 200 aa, Chlorella protothecoides
MAGPSLPSSEIAEEVVHEVAALVAQGLVSVTPAPWFGNAQSHGNCPQAGSINPTPATLCQQEDVRIPRNICVEKEAASTVPPGRVSVDVFGVPASSLPIDPVSCPNCARRVASSRFAPHLDKCMGRGRIGAGRQDPPVPAAVRRQVSEPDRHLVEHCAQQGTWVPRLGLAFLCKFLPALGPTIQGGTRFLPCGADRQLVK

SEQ ID NO: 17251 - protein, 178 aa, Chlorella protothecoides
MTDADPAPQSWSAPGAGVGQWEPGTDFIPILESQLEAATAIWQASQQRQAALAVVFEAGCLLLGGRHFRPSTCLRLIPTSPACFALRGMLHVLTCTLTTCAPCICCCRVAAAAQYLGEVEAQGLSVDAACTNVELHYPKTAAAWEEFSTRFASQHAAAEGGARRAGGLPAAPADMFLD

SEQ ID NO: 17252 - protein, 400 aa, Chlorella protothecoides
  MOD_RES (64)..(67): Any amino acid
ARGAAGEAAAAAALAASAIELLRTELRAYSPLLLPVEPRARGVAARALQDAFGAAFLPWVVGVXXXXRARAAGRLWRRLPALGGGRDRAGQGHAGGAAPGRGAGGVSQEGGARGPRRALGPAGPHQSPALPVGGGPGQHAARLDHSHPGLRGLAAPREAAGARGQARRVWGRGLQRRTTAQLRGCSWAKTGTSTSQYPSANKFGRAGRPAKASTRDFALVHPLTHPHVHTPPLIHPPTTTTRSTTEAVKAATDTLEGLFDLGISPLPTGVLRCLVDGVDGALGAYAAGVRASLPSVATLRPPRPALTRYKREVVAAAQEAEAADGRVGLESLSWVPPVSRAEAEGVLATPWDALLLRANAAAALLDALDELERLVLDRWQAGTPRGGTGGGSGADGASAS

SEQ ID NO: 17253 - protein, 301 aa, Chlorella protothecoides
MRGLCRQIEPTGPICLARCHRPGHEAPDPGIPSLLSPIPTAEPVDGSFPVVVTSYEILLADIRNFQKVSWKYLVVDEGHRLKNHNCRLIRELRTLRVDNKLLLTGLPRPGARTCPSTGPQAPAPGGRDRTIHFRPFLLRIGTPLQNNLTELWSLLNFILPEAFSSLSDFESWFESMADAGGQQEDEVRQQTAKVGSSGGGALGTLHAWARQPCAAQTGARVGVSCPGAMRSCSCWHSPILSPAQTRQVVEKLHAILKPFLLRRVKSDVETSLPGKLEVVLYAQQSAKQQELNKQLKDKTLR

SEQ ID NO: 17254 - protein, 223 aa, Chlorella protothecoides
  MOD_RES (189)..(191): Any amino acid
MTDEQREEQRGVGIEQQEEQVGDAVGELTNQRASRSAHPASSKPDASQAPPPPGPKSRFHSKASRRAAMLGVAAQRAQHAEPGSDGLCVEARGATKKPGMPAWLRETLARLLAAPPDTLEAAAMVTACRPEALDSLTASPREARGRGFGEGMGGPSSHPPANVVESSNQSRSQPLSCRSFLQLAGPTPXXXVWRAAIEAGASPCPALPSSNWPAPLLCSAGCA

SEQ ID NO: 17255 - protein, 314 aa, Chlorella protothecoides
  MOD_RES (118)..(121): Any amino acid
  MOD_RES (151)..(154): Any amino acid
  MOD_RES (276)..(279): Any amino acid
MQALMQALTRPERVLGLPGPVGLNAQTEDACLAWQLFEADANCQNVADWFQSFADVRECHGPRKKGRKTGSKAADAKVRLSFPSTGQGWARRFWVGLAREGAAVHQPRNTCLGSFQSXXXXPELPRILAEAGQDVHACHAGHQEMCNSSAXXXXFTPSQADACADGGARMQVAARFSQAVSELQFVGLIRHATRRKGDYVQRCMYMPAIIRSFTHFWSGDYEFVRRSQGVCVEGSSGRGPHICMGVSLLEVGRFERGSASIAFRRVIGEIKAHAEXXXXFGNRKVRAWLRHHRVPSHDWRNKSSRRTRSITHSH

SEQ ID NO: 17256 - protein, 279 aa, Chlorella protothecoides
  MOD_RES (146)..(149): Any amino acid
MSMVAIPNAMTTVRPSAASARPSRAASRLVVARGCGPGYRSQGSPRNWSYGQPGSYGASCSPRFWGPSMGMGIGLEGAFRDFEKMMNAFKETEVPTERAAFRLPIDLQQEDKRITISADLPGLKKSDVKTPLFSGRGVSRGCPDHXXXXFTRARDHNVLTGRRISRESLHNPARPLNFRHRSSQVEVSPEGVLTITAERKEEAGQRSSRSFGERFRGRFRRSVRLPKSAAPEGITAKLEDGVLTLVVPKLETESPENRIINIGDDSGPESMEFPPSPAE

SEQ ID NO: 17257 - protein, 429 aa, Chlorella protothecoides
  MOD_RES (107)..(110): Any amino acid
  MOD_RES (257)..(260): Any amino acid
  MOD_RES (339)..(342): Any amino acid
MATVMRAAGSARTPPSTIHDGPHPCPMQRKLPTKPCNMGRMRHTGPMVCCMAEAPDSSEHPIPHDLRMGRRAILGYGMALAAFGASPAFAVENLSKLPSPPAIPVLXXXXRREPVQASFTTWYVMMAILYRADVFLWSLLEACDLNVSLAIPVLDRFQASSGHPGWLQLPSANSMAVCDGQHPHKCHTAVPPPPQTSGNDVFYRNPYDVEQTLFVDVSSPTSTKFTAVTDLKSPQDAAEGLLTVALRHPTVHPSQPXXXXAACSDSAVQHCFVIAQQLHCGIPQCTHPSHRLAAVQKGVHVHPAGSEAECRDHECHGAHCRRRQDLLRHQAACPVLRLXXXXADDGRIYYDIRLRARSYASRNQLAVSQREIDAGTELEWDRQYLTVLGTANGRLYSMRLQAPISAVEGPGGETLQKVADSFRCTTVES

SEQ ID NO: 17258 - protein, 139 aa, Chlorella protothecoides
  MOD_RES (122)..(125): Any amino acid
MGGGPCRNWACRNERRETAPELRLPPTKRRFLLSALVSDLLILRLFLFAAYIFLFAAALTGYPRFPRWGWQGGAPTRRSQRREVGVWHPPGQGTALPSSVPLSTPTFLPPQPPSTDAISVDXXXXHSAGRWECGTLPGR

SEQ ID NO: 17259 - protein, 380 aa, Chlorella protothecoides
MGGLGLGAAPPFEGGGLGFARAGLEADPSISNRPHGAPADDGGSEDDDGVLPEAFGRQLAAAARQRAAAAAAAAAATQAASWRAPASRPGIGGGAAPAPEATGTFESHTRGIGAKLLSKMGWQAGKGLGRDGKGIAKPLEAQMRPKGMGMGFGSRPEPKLVQPEPNAQAHSAGPSAATASPPPGAATPSAEARAWKRRDAAARERRAFRTAQEVLDAGGAPPATLLSQPVIDMRGRGGARVLRDLAGLEVVEDRDGGGESATLGPMPELAHNLRLLVELAESGIQRLDARLRGEQDSALLLGREAARLEEEARAAEARVQAQAALLDACERGERETDAIALAGLYASLRTELREEFEARDVAAVAAAQAAPLLARLEPAG

SEQ ID NO: 17260 - protein, 202 aa, Chlorella protothecoides
MLEGWMANGVAPGGQLTTTTDLENFPGFPEGILGVEITDKFRAQSERFGTKIFSETVNKVCARGRREHHTVPVWHAACGLPCCSIDVDQVDLSRRPFVISTDERQVVADAVIIATGAVARRLEFPGSEEGTGYWMKGISACAVCDGAAPMFRNVPIAVIGGGDSGQCDRVRPWVDRRKGRGARKQCKTVLRRGLSKRLPPIG

SEQ ID NO: 17261 - protein, 485 aa, Chlorella protothecoides
MVWLDDEQRAYLRSFTYKHVPAAGPQVVCAGWAGGWGFLGGMGFPTRSRPSQDILLTCMCAHWWEGCAGRHRNGAVGPPRPRLTPTGLRQVGPVEPFQTSPSPPSPPSPTPQKPVLQSPPSRPCGAVTPRRLTLQEMLDRMEDWERFDVFVLEKLTGGEPLHAVCMELLRRRGVLEALPIPEDRLSSFLRAAERAYCPNPYHNSTHAADVTQALGAMLAMDAYGAALTPLEQLALLIAGAVHDLGHPGVQNAFLVRTEADCAKQCGGKSVNESMHVALAFELLRRPENDFICRLPPEDRAEFLRLVEAMVLCTDMAYHAAALDDFADTLAELGPDLVAWPGEARVKALQMLLHTADISNPARPLHHCMVWGRKIHDEMYKQGDLERALGLEVTAVCDRASAPVACGQLKFINIFLTPCLKLVEGLAPNFVAAAMPHIEGAAAYWRSQIGEGGEEATACAPACATFPGSAALGSHEIPDPKPAKGA

SEQ ID NO: 17262 - protein, 59 aa, Chlorella protothecoides
MSSDEQENDRFDVDNDYEGGEFIEGEYFYRNKRFKKQQTAEDRIYGVFAESGVGSGLWG

SEQ ID NO: 17263 - protein, 205 aa, Chlorella protothecoides
MEEANFLTKYGSKVYIIHRRDEFRASKIMQVGGGSRKRVLDNPKIEVLFNSVVTEAFGNEKGNLGGLRLKNTVTGEESSIDVSGLFFAIGHDPATKFLDGQFLSGAFVCPAAALMPNDEHYSSQRPALLPTPTPSNSSDPSPHTLQLELDSEGYIVTANESTATSVEGVFAAGDVQDKKWRQAITAAGTGSVEGQAGGTGWGSQA

SEQ ID NO: 17264 - protein, 118 aa, Chlorella protothecoides
MVQHPDPKYMRRAIELSAKAGIEERTGGVFGAVLVRKETGEIVGEGYNREWVWGPEGFGAALPTQLPHMLAPSSPQASWPTMIPLRRSRGWFLSYSGCAACAATLLRRMPPGGEAPRW

SEQ ID NO: 17265 - protein, 80 aa, Chlorella protothecoides
MERKGAVGVLDKPRKPGGQARGRGATYDDVKKYGQFEDADFLAEINASDEDKNVKIKQYLREEAVVPWKTYSELTDRIHY

SEQ ID NO: 17266 - protein, 891 aa, Chlorella protothecoides
  MOD_RES (40)..(43): Any amino acid
  MOD_RES (140)..(143): Any amino acid
  MOD_RES (432)..(434): Any amino acid
MGGEGCAPGGEHGGQAEQSISGPRFRPEQHQFPPSSLQHXXXXLTQKSELAKEFENSGSGESGNAWAGRSARLVGHTAARLSRASLDPDFPQSNTNFPPSPCNIAIPRLQLRLHCLSLHPAADSERHYGTDFDEDQEEFXXXXGGLPCPRQVGICHLGPHRRYPPRTKPSQAGNVHQPHHPPWHTIQTRGAVTRKEVIRTLELSLCQRLSAWSGPAHQMTPRLRQRRVSCRMMCMTFAPWQSLQACRRCVWPAPVTEPAETVHTKHVGHSIEREQCASAMSSAEENLPFYMGYPFDPGAMDTNPRSAWHGIRARARPAAALTPEMEKVTGMVLDHALQRAAGPLTEPVPCLARAAAAASLAPERPRLEGAGPADHHRVLVQACHPGPACPPGREVGGDAVQPGCSVTPPASRAAVPPGLPDPGPRAGPAPPXXXSLGAVLPHPHCAQLSRLDHLILGRWQGLPPPPNAMNVKVTKHSFIATPFCREILLRLCPPGTFQAAWRSLWPSTQVSAFAAAAAVACVDDAADAPRLALAAGSHAPHHPADAEWWITESDWQVFRDACEGEGAPGQPRWEDMCRKEFPDCIYTAQRRTLHCGRTEYRSTTVLRDAGAEAVMDFYLDDDVRAVWDPMISEHSLVESRAVAGNPGARCQVVRWLRTFPFAFISSREYVLGRRVFRDAATGALYGITRSVDHPGVRRCGRHVRMEDCHSMWRSRSVEWPGEPGRRAAETVLLHFEDLGIPEHVARFAIRHGMVGFLKRMLPEARAFLARRAEKLDVDEPDPDAYARRVAAGADGGCLLLSQAHGVASQAHPLPPRADADGAADSTEASSWSSRGSSVSMPSMRRLGTMVLASSVAVLLARSGAKSSASRRRRHRAEAVRLDALCLESVAA

SEQ ID NO: 17267 - protein, 290 aa, Chlorella protothecoides
MASPHAWIAARLGLSLRATTGLFFVVCVASIWVAASFVVQDIQAAGAKPAVLTYIANSLFALYLPLYYFKAWLSGRAGRLAAGLPQDEEERGRLVATRAAPERVLLDGPPGIEGGAQQRHALLVVEEAAPAQITAWQTFNASVVTLSPPHPPPKQTTPSRPGRARVVPGSVHLQRLPALHLRHQQHPHLLHLRALHLPTQRRAALRALYAAQAGLHRPAHPGHSRRGAGRRAGQPRRRGGSGQPAGRRAVPAERPALRHLHRGDSQDAGRGRDGEAGEERGGESCMTLQP

SEQ ID NO: 17268 - protein, 136 aa, Chlorella protothecoides
MGSIIFVCGAALGLVALLAGAGLGTLTWPVFWAIVAKGLLDNVLSDYLWARAILLIGPTLATAGLSLQIPLAVTADALFRSPAWLRAFWPLLLTAAGGLTILVGFLAMTLVPARPPAQELPVAEMTRDPSPKAPAR

SEQ ID NO: 17269 - protein, 296 aa, Chlorella protothecoides
  MOD_RES (41)..(70): Any amino acid
MLPISMHLLQRDGQFLNGHDLFLKRVGAAYHAFIEDSETAXXXXXXXXXXXXXXXXXXXXXXXXXXXXXXCLEDLQSTTRYVTWSLHTKSRSSLKAMLGKVTTPAGGAPRAGKAAAGAAGGAGDAPMLEVLENTLWSRTLGAMSEEIVAALVCQIFEGIRDHFVQAVELKFNCFFLMPLIDAFPTRLREELEAAYAEDLDERKFAMIHSTLAQQQSGGGGGGMAGGGGGTAGGAKEAARSSAENALLAEALRAEAVRASAETNPLNLSQSSLPGRAGKAGTEAARTVHRAPLSTLR

SEQ ID NO: 17270 - protein, 721 aa, Chlorella protothecoides
  MOD_RES (137)..(140): Any amino acid
  MOD_RES (290)..(293): Any amino acid
  MOD_RES (352)..(355): Any amino acid
  MOD_RES (381)..(384): Any amino acid
  MOD_RES (530)..(532): Any amino acid
  MOD_RES (652)..(655): Any amino acid
MHSQNSLTPSYHALVPGEGRDGVTQGRDRQADEQGNGKRIKIIVDVAKQGTDAGQRSRCKLVVHKPEVRGHSVQHHTDVVIAAHSGVMLGIATPFNACRRCARAQSAFHGKSNCACRASGAPGSGLIYYLEIELTKXXXXDARAHSPHSTDRVTALAEHQVLQDQLCRLGVAFILHGAHPGAVGYSGCAGISDCKTERVVHHTCTLVQVRDPTPGRCHQGERPLPRTITRISRRPRVGCCSQGNTVPGCSGAVPQVRIHVQLSGVSAVPQSGGTGSQSDIKSAGERGEPXXXXALGRSLTSSQRVRREAIHSMLCDVPGWALSLMQASHNYRRRLPPLNAVSFSGTCLSDPXXXXASRAPPVRRPGCCSSRAGVLPAGQLXXXXRSPAIEALLEILGSLQRLVDSHPPAERSLRYGNPAFRHAGMMRMLAVNWPPGNVWDWMEGMRSAAPQLLEPLLSGAQAAALPELVSYLQDSFGNSTRIDYGTGVRECVGQPTGQTPDTRCAFSGLWDVCSVCSLVGAMSRQSEEVXXXARRVAWGLGPGRLPNPPFPLGFRTGAVRGVHRDVCSVYSLVGPMSRQSEESYPSSPVLPDACLERGSRVRDMPAKNNLLCWSHPTTAVKLQVRARDPDPLSRIPLSTAGGPWGHHTGEHXXXXGTLILFLASPPLQLVDHGDITPGSIHNPAVLQDGKEEYMYLSAVAFVKQASPPGQGKGTVRLRSTA

SEQ ID NO: 17271 - protein, 439 aa, Chlorella protothecoides
  MOD_RES (420)..(422): Any amino acid
MTADHCCSCFGNSSLQFADMTDISAWHPVSLTPKKQINVSIGSGYPQDWSGDLLALGVFEGDLPSKGHTLTPSDAEGSLSGCLATLDASLDGAIEDIIQTYEFKGKEVSSWCSSILCYELSSLTWSGSQQAVRVGGKIKNVVLIGLGKVEDAALEAKWGLSLFQTLGAAAAAAAKTTKARTLALALTQLPPVDEAEALLSVTHHECLKLRSPSRTPPPIPPRQGEASGKAANGLLHAIYETSRFKSSETGPKLESAELLFGGKDGAAAVQRAQAFVAGATLTRYLVEAPPNVCTPAHLAQAAEEIAESAPDVYQLKPTSLSSPSLGDLAAFSVHARKSSAKLTRLLPSRRAAGAGEGRLRGAEDGSVPRRGRGLCPSAQVHPPDLHRCRQAATRVCAPHSSTHLTCSRFSTSSSPMPMSXXXPLSSPSPGDLAAFLSTC

SEQ ID NO: 17272 - protein, 275 aa, Chlorella protothecoides
MSAQHSQEIAGHDEMVGQYESYQSFTMPHLYRVVNGIDIYSPKFNIVSPGADSDIYFPFSESSRRLTSLHADLEELLFSPNSKEAMGTLSDPGKPILFSMARLDKVKNLTGLAEWYAGSERLQGLVNLIIVGGVTDPSKTMDREEAVECQKMLDIMNSGRVDGKFRWINAQKNRVRNGELYRFIADRRGAFVQPALYEAFGLTVIEAMTCGLPTFATNRGGPAEIIKHRRSGFHIDPFHGEASANVIADFFEATAKKPDEWDRISKGGLERIFSR

SEQ ID NO: 17273 - protein, 337 aa, Chlorella protothecoides
MSHLYTSGGHHPSPLRTRLIQSSQPLPRPTPPRPQNPYPQASPDTRDTPTVPLGGEEGYDVYVYEAEPLEEGVAKHTLSVFVGDEAGMINRVAGVFARRGANIESLAVGLTQDKALFTIVATGTEATVANLCKQLAKLVNVRYVEDITASEHFQRELFIAKVAAPPGATRTELQQVAEVFRARVVDVAERTLTLSATGDPGKIAALQRALGRFGIVELVRTGRIALKRGENLFTGPQVYRKRPAISNADAGEPVNVEASMDGDVYTSSGSGSAAHEGVWNVRNVLDAYYENEGSEFEPYTLLLEVQDRPGVLNQVRAGLGMERGTRHDRLWVGPSGS

SEQ ID NO: 17274 - protein, 86 aa, Chlorella protothecoides
MWIEPDRPAAQPSAHRTTHPLSSCPPPLTYYNRKYISNLEHSEAKRYLEMFYILKMRALIEKMSEHPNKATEEAEEQLKKKEQASA

SEQ ID NO: 17275 - protein, 101 aa, Chlorella protothecoides
MVVPGNATGIEKLMKQVQKLVYVDRVTNLNANPFVARELMLIKVRATAAQRGELLNLAQIFHGSVLDVSLTTLTIEVTGKEDKMRALQSVLEPYGGSWCWG

SEQ ID NO: 17276 - protein, 259 aa, Chlorella protothecoides
MTFHLPGPPHGGPALHRKGGGQGAGRCCDQGRVTPAAACQAWQQGHLLVLSLSLVPINIPYQIVYDELVTLMGGKQIVYDELVILMGGKQVSLNVPEGGDPQVGEEEPEGPCTLVILMAGLQGTGKTTTAAKLAAFLKNKGGRVMLVATDVYRPAAIEQLVVLGGQVGVPVFERGLNVPPADIASAQALGGLHMAPLSSAREGVALAKEEGMDTVIIDTAGRLQIDATLMQELQEVRVVPHMVGCNACHPSRPSLGDAV

SEQ ID NO: 17277 - protein, 327 aa, Chlorella protothecoides
MLVHTKYPCHLFTTGCRPEKLGLEHHTCKAEVHWDPQILHHGCGRSLVQYLRSASFQCAKGSSTSTCEAMCSPLSHHHRPCTLTLTAETSEKVVRSSRLEEIRLTILNNMLRVSMSGWTPGLHAPPLTTSGTNAVPPGDQPAAGMGLPVCLQWHERRRRLLPPGREELRHQDPGGGQGGQERADQQAPGQHPGPTGPAHRHRPHPEGHQPERHLSRGGHHWCVGRSRGSRDGSVKWAGGASFGRMAVTAAGETPKISSCIRPGRNAFDIFQITYHGEPLPPPMCQLVVNSLQVRPARMCCTSRGIEGSGSWTPLHVHGARAIPEDPK

SEQ ID NO: 17278 - protein, 72 aa, Chlorella protothecoides
MLDFLRYRRITTNMDARFPDATAEDLVRADHTCIICREEMVVGGRTKRLPCGHVFHLHCLRWVPGVYLGVSP

SEQ ID NO: 17279 - protein, 95 aa, Chlorella protothecoides
MSTRHAGAIVTKLDGDARGGAALAVKEVSGCPIKFVGMGEKTDALELFYPDRMASRILGMGDVLTLVEKAESMVKEEEAAALTKKMLTGRSFWQL

SEQ ID NO: 17280 - protein, 267 aa, Chlorella protothecoides
GGRWSWSPLAHSALQTVPLWRRCGDLRRRPPRQLTPTDLLSTSPRRLPGGGHMVVVGTTSSPDSLDPALRRPGRFDTEIPVPVPDGPARVHILRALAAGLGAAAGLDLDELALGCFGYSGADLAALCREAALSALGRVAGGAGEGSGMEPGPRSPRQGAGSPGPREEDVVVTMEDFESARSKVVPSITRGLTLDFVPVAWDQIGGLPDIKRRLRCVAGWRSCMGGGQERRISTGHSGTGRQCRHLPLGYSLVPRGSGRPTFCWEQGL

SEQ ID NO: 17281 - protein, 97 aa, Chlorella protothecoides
MPLAPGVDLRALAARTQRYTGAELAQVCREAALAAVREDGPERWVGPAHFEAALEEVAPALSQHDLDRAAAWRRRPAPTPLPSRAPGPRNEPTATAP

SEQ ID NO: 17282 - protein, 90 aa, Chlorella protothecoides
MAQPQGRANSFVGTEEYLAPEIIAGVGHGAGVDWWSLGVLIYEMLTGTTPFRGPRRDITFDNIVRKAVAWPEDVEASEEVRDLVGRLLVK

SEQ ID NO: 17283 - protein, 494 aa, Chlorella protothecoides
MPPPSFRVPEPAETRCDPATYPPESRAAINTFCEKITGSVRNDRRALSLMGIFHAWSLQKRDEGTLLRREQPACILPWNRRKIAHIPVFCAPGPEGTYVVRLMAAVADPPELRVEWDMAIVEAVGEGHQQRAERATQRVGWQDGAQSVHPLPHRHGWHAWPACWSMQLFLVGELPDLPAMRTVADMRARLVATHAPQAPEGEAGLGMQAPPPKNRGRPKGSESGGVWGMCAPPTCWPALLSTPAPTHGAGKNDPPVVMASTKGRRDLKSLGLSYLDQGPSSVQGPACQQGDGSVQGARLPLVPGLAVEEEAGATREGGEAGATMEGGRAAAPRPMEEEEEGAGPSRPVVEEAAPAPMEVEAAPAEEQQPGPASGHGSQTPPTSTGRQQSPGARVAVPAPRPGGADGPPPAGDHGPAAAMVGASTHPDQGEGRAVGRSDVQRVAEALHGKATTRALQMAIAAEGASSVCVCGEGGGGANQQEGPKRPAIRLCTWL

SEQ ID NO: 17284 - protein, 356 aa, Chlorella protothecoides
MVWQATSSTILTSIHGNFVRCGAEQQSATGSQFWRRRLLHFQSWRLYIYIEQEPPAAPLAFRSPVSPNPCRKGRARGGRMRTAPAVPAAAKLPPPRPPSSPPCSSSHTVWSGRGRGTCGMVQRAGGLWKPPSRCHWLGAVHPSSLHIAAATSPDCHQHMTAAIARHAVFHTSASTPPQKKSTTQAMHGVMAGTGPAFAPCLDPELHGVLMRAAVHANRFVREAAHNALADACVVLAARDVSRLESAAGDYAGRIALGLADSWNRVRYAAVAAARALLATLPRDGWQAVLPAILPGLALNRHCDAEGVRAAAQAAWREALGDQGRAWLARCALGVATYYVEQARAASHGVREAACAC

SEQ ID NO: 17285 - protein, 394 aa, Chlorella protothecoides
  MOD_RES (290)..(318): Any amino acid
MPRRSSHFSGAAPALTALSILPTGCPRTTFSPPRATRRQRACRPCPRGRRCEDGLASWVLVWPGFGGGRTGAGRVDGSVVATLPCKALAPRKGSAGTPAPSGNQRALLTCQPTTHPPNKTKTQWPPADVALIPAFPPELGGTEAGPGLLEAWSFLTSFSGELGLEPAPLDSLLAALARGSRSPALAAVHCGLLRTLQADAEEAWAAGPASTYGGLESSAAAARLLEEAWAWGFDPDAWRAHLGAATWPEVARQLATAAGLGRPRPRPRREEKPKMGREGEDVADDGAAGXXXXXXXXXXXXXXXXXXXXXXXXXXXXXGLGTVKAAAWAVLAEVGAAGLKVDEIARRIQRRGLRDLRSSRTPEASVAGALGRDVLFARVDLGTYALAAIVAYEA

SEQ ID NO: 17286 - protein, 507 aa, Chlorella protothecoides
  MOD_RES (14)..(17): Any amino acid
  MOD_RES (205)..(215): Any amino acid
  MOD_RES (361)..(364): Any amino acid
MPIVRLSTPYSHRXXXXPSLEARTPRNPPPRRRRSTRTTTRTARWAGCAGSKRSEAGEGREGRLASALPMPIIRLSTPYSHRPRRPPKKKFHPGQDRGGLRRRLGGGPAALRLRRAFLGAPCGHAALAVPAGDADALHPRHHGAAAGGAAAPQAPGLGGRQGGEAAAPSGGRRASACRGRGGGEGRGAVPPRRWRRRGQHSGLGXXXXXXXXXXXAPVPGEMAGPPQEEPHAGAEAADAYAGQAVEAKAGEPTRQEQSDGPAPMEIDGTAPEAASAALVEASPVKAEDGAGGNAPAPQQRLPEGASPPAAGAREDPASDQDPGAVAERERVAAAIAAAERAATERETEDREAARARQGARXXXXDMERCAVRLEPLGADRRFNHYWRLVGAGGAAHPSACCGAGYLRVAGLRPALVPPHTTTTAHCTSMSRAAAPGISGPRHIHHLARPRRGPHLLRVGGGRRAQHRARRGEPGRAGGRAGAARRARGGALRLAAAPPRRAGGCHAP

SEQ ID NO: 17287 - protein, 447 aa, Chlorella protothecoides
MQPRIPATFPHLNRLASQRAPRSCPPWTYPRAPAATGARPASAAPSQRPSCVPTTSSSPSSSMTARPTSPSTPCLASPAWAGSRACWRRSPGPAPTASTPWSCFPRSAGEWVGGWVEIECATAHRMVANGGAIQGRCAAGQLPYACWGNGLLTPDHLKTRTGEESFNPDGLVQRSIRLLKDKFPDLEVFTDVALDPYNSDGHDGIVRDDGVILNDETVEFLCRQAVSQRAGWSLRQCSAPARNQAPTPHRTFPSLTPASPTTPRPQAAAGADCVSPSDMMDGRVGAIRAALDREGYSHVSIMAYTAKYASAFYGPFRDALASAPAAAAPGSRRVIPADKRTYQQDPANYREALREARADEAEGADIMMVKPGMPYLDVIRLLRDNSPLPIAAYHVSGEYAMLAAAARNGWLDEREAVLEALTCLKRAGADLILTYYARQAAQWMAGE

SEQ ID NO: 17288 - protein, 115 aa, Chlorella protothecoides
MDVDLSGTDASLSGHPGMPLRCRRTHASARLEQPPPPPPPALTPAAYLPFTPSPSQVPEEDLQRVAEATGAAVQTTVNSLDAERALGTCARFEERQIGAERYNIFKGVQEWVVRP

SEQ ID NO: 17289 - protein, 413 aa, Chlorella protothecoides
  MOD_RES (84)..(87): Any amino acid
  MOD_RES (248)..(251): Any amino acid
  MOD_RES (394)..(397): Any amino acid
PPPPPPPPPTGRSDHLQRRRHHHEDPGHSAPGCKDPGGHLAVPGRGGGRRHHHRGAPGRRVPARGAVLRGGGCAPTPHHARLPXXXXLAAEFLREARSFVEEGVHPRLIMRAYRQAAELAVARVRELATDIAAGRGEQERNELLEKCAQTSLNSKLVSGERDFFARMVVDAVGSLDPALLDLRMLGIKKVQVGFDACTWFGGEGRVRVCVAGLLQQERGMGMVLLDGPDLRCNGRRRGRNSGAGEKPXXXXIKKVQGGALKDSFLVDGVAFKKTFSYAGFEMQPKSYHDPKILLLNIELELKSEKENAEVRLDDPTQYQSIVDAEWNIIYDKLDKCAQSGAKIVLSRLAVGDLATQYFADRDIFCAGRVSGFTYPQRLWLAWGWREGIGVFELXXXXSTTVAGLGMARGDWCA

SEQ ID NO: 17290 - protein, 70 aa, Chlorella protothecoides
MPPSLPTLAAAGCPRAQTATIMLRGGSDQFLDEADRSLHDAIMIVRRTLKSPLIVPGGGAIDMEVSKHLR

SEQ ID NO: 17291 - protein, 167 aa, Chlorella protothecoides
MRHLLAGLRVHRCQDPSLQRAGITGSDKGGGDHARAIPGKAQLFINAFARALEVIPRQLADNSGFDATDVLNKLRQKHAAKDGAGARIGLDVNTGGVTDTHAAFVWEPALVKINAIASAAEAACLVLSVDETIRNPRSEAPDAAAAAGGGGRGGSGMRGRGRGRGRR

SEQ ID NO: 17292 - protein, 712 aa, Chlorella protothecoides
MKGSGGSGDGLDAWLGGVAPWDAGLVQQVSQAHCSWMGAAKRPTPAPLIVHETAMHRVRHAPFPRSLTAAMRPTPSPPPSPPPQVSTYSLLFTWPGSDPSLRPVMLYSHQDVVPAPPTNWTHPPFSGAVEGGFVWGRGTLDTKGSLVAILEALEQLRGSGWRPLRTVLFVAGHDEEVGGGEGAGRVAALLAARHGALELLLDEGGFVLGDGLGAGAGALLPPLRVAVLGLAEKGTATWDLGVEGRGGHSSLAPPAGTTTTALTARLVAALDAQRLPSRLQSPTLDFLKALAPYAKARPLGLLLSHAGHPVRRGSASVCGAWLSVFLARVEDTSTHPPAPTTHRLTGPVAPAGPPDVREHGAELHGADREGRGGCGDRGPGAQRAPHPRQRHRQLPHPARCASGGRGGGGRVTGECKAASGRFDVLCCPPRPSLPCQHSAWKSCSIPISSTTHPIPPTSIPPGDGEAEVAAYLDQVSRPLGKHVTRTQRPGTRAPSQVTPAHGPRFDLVRRAVLETLAAPRGAGDAEAEASPPLPLIVVPYLVSGATDSRHFQGLAAGRTFRFEPFALDNSDVPRIHGVDERIAIPTFLDGIRFYTRFIQLSAGEEGRAMQPHSVGATLCTQSPLPIALPSLHPKLPSIQSTQKPKISSCHAIKFCEAARCNQQEGYFRQVLTEMCKDTRQRKIYGFRDAQGSIGSSWRRMAQPGSWGAAPLQ

SEQ ID NO: 17293 - protein, 482 aa, Chlorella protothecoides
MLAWAQQYAASSRHAGLPRIPSGSVFQGGCEAVGGDWGPFQCWHPLLVLGAPERPRGTRVSQILYCYSFVTALDGPGVLSGGCLMVCKMHRCMLPSVLINPPPLRTPSFLALAAADAAEVTHAAFHAAVQGALYVLCYHLDVLVGSFRAAAPALGAALRLNPGAPAASPGPAPASDPGEQLAWVLDAALPALLAHPLDPLSSCARSVSAEFGRQARRLRLRALAAAVSAWDARAAAARLVHRPLEVFFPFDPYLLARSAQLLDLDSTFLAWRRGQGADRVAGDSGDEEDVEDQGSGPMRWVERAWAPADKPFNIEELFLRPTKRQATRFPDAHTLQEIDSDACTSASGSESESDSDSSSTSDASSSDSGADEDDPKRTRFGSLPLSSGASGEQRWEPIKFVRRPRAGPPAQHPSNLPAASPVLSGAMLGSSAEAAPGAFVAGASMSSDGGFGSLPATERGAAWAALRWPRDGPVPMSCTPGT

SEQ ID NO: 17294 - protein, 353 aa, Chlorella protothecoides
MSQHAADPLLAAGAGDPDAGVALLGVLRPLTGSVSCVSTSAHEALLREALDLPLWRVAPEVRAAALDLVLHLAAAVGAAVQPCLQTLVHGLLPPPGPPAPDTLGQAWAPAPGSLQIQDEVIETLGKVGWVDGMGGQFWGRGLPAWCLWGPSRKGEGACPGVRRLPRTRPPHHNYDQGNLAYLCGTALLPLPPSLTHPHPPPHQVLVLVPTAAPRVLPVLTEGFPHVLRDRAVHCLYVRALLRISEGPAGGLVREALLAAVVQHLLSLDVEIRCAGGAMSCAWVGARVVPWHGGCSSGAHLHLRATGCISAPRCPCARRGGALPPGAASHGLPCSALITQPPALPLPDGRTSWM

SEQ ID NO: 17295 - protein, 197 aa, Chlorella protothecoides
MAMAESATTEPRADAVPRHVQAEREEARKRRRAQHAEAEHLRRCWDVRRRVEDVAQEVEAVAWEALRLRGDPQIPLPPASALPPGRRTALEAAASRRMRDIVSTHCKKVLAGVTAHKWCWPFLAPVDVAVYRDYRDRIARPMDFGAVRASLEGGAYAHPDAFVADVRLVFNNARAYNPPGSDVHVMADTLLVGGWGL

SEQ ID NO: 17296 - protein, 100 aa, Chlorella protothecoides
MLGLRGPLALLIPAVLLGLLFLPGQGPEPAANPPPVHIDLRREKEAIQSLSDAIRCPTVGSETASNHISNPGPFQRLHETLETHYPALWRTLTVEKVHGG

SEQ ID NO: 17297 - protein, 277 aa, Chlorella protothecoides
MTAQEAEMGGRNALPGSRGGWEGGAALAPGLRRQVCRVVHASANRPPHLTTDHPHPTQDSSASARRLTSNGQPLRAVNEMADKLDSLMELVLEHLAARAASGGLPAAFRTLLAVFERRILHAHRSKFVQFVVFAAAARDARASGGAAGQLLDSLLGTLGDEGAAGITRTAAAAYTASFLARRAGGLRGIVIHDRLPLAKRFGGESGCRKLAAASAAGEFEMALHTCDLASLWHRTGCPWPSPRAWQHPRISQPTKDTTPPLPCAGRASCPSHRWWRR

SEQ ID NO: 17298 - protein, 320 aa, Chlorella protothecoides
MSVCSPNPVWSALSLDPVVATPAIALLLFYWSSAVSLGMGKSPLQITAEVMLSSSSGALVAAGLSYLAVSINGGSQLESVTRVTPALRSPLCLHLLEPHFLHPSLRPLFPPQAAATAAFSGAYIFVGMVCRFRWPSLNVFFTSHLVAVAMLVGASYHNHSSFLLFSRLWITFCAIASATSLLVCSLVLPMTGGFLIRRGLAEGLEALGSCVLGTLRLLCGEVDERGLLRARSGDNISHFGMDSGLGNAGVAEVHRQADAAAAAVTVSAARSALQPCGKNTEGLGCIGGEEKRGCGPRNGRLGRKTGSRMSLQSPYPSPPP

SEQ ID NO: 17299 - protein, 317 aa, Chlorella protothecoides
MEWVDGQRLRTAGGRGGSGDAGGAASSDDLRLVDIGVRCSLEQMLEQGYYHADPHPGNLLKTRDGRLAYIDFGMMGEIDGTIRRRGLECVLFACVGVGLPPQRPHKYPYLKPSPQCPNPTYRGLLQATLHLINREYEALADDFAMLGMLPSEGRKEEVVAALTGVFAEALSGGVNNLSFGELSNDLGGRARLRRVFTSSFSLHSLTTPCRSKHDVPVQVPDPFLLHPAGPLPVCAGGMEDAINGWGDWDLGQLGTYKECWTQQHPLCGVELTVCHGVASSGADSRRSPPYISALFTSTQGIALASNPDYKVLGATYP

SEQ ID NO: 17300 - protein, 592 aa, Chlorella protothecoides
  MOD_RES (198)..(220): Any amino acid
  MOD_RES (254)..(282): Any amino acid
MRGSVDVDRSITLDTRILAQASICGCLLFLGGAALPRPGESATIARPRTSCSDAMILLYEPPFVTLQFRPLGTGISTGSMPGAPPSLSHARSSGLAARRRGDPLGGFAPHPHPPTPRPRVRPAPATFRVAPGAAPLPACLLDVHPEVAAALAAGEAVVALESTIISHGMPHPANVETAARVEAAVRAAGAVPATIAVXXXXXXXXXXXXXXXXXXXXXXXRHGGPDPRPAGAAGARGDGGAQGQPPRPGGGRGXXXXXXXXXXXXXXXXXXXXXXXXXXXXXTVAATALLAAAAGIQVFVTGGLGGVHRGGHLSLDVSADLAELARSRIAVVCAGPKTLLDIPRTLEVLETAGVGVAALGTDEFPAFFTPRSGCAAPLRVENAAGFARMVLAQERLGLTSGLILGVLLGGRGYGMLGRGRSGGGGLAACLHVCVLRRSVVLLRAAYLPAVHPPRLPPLKTVLPPLIHPGVPIPEHLAAEGQEIEAATATALAEAEAQGIQGAEITPFMLDRIQVLTQGRSLAANIQLILNNARVGAEVAVELSRLRRGGQGQATEGDASRGARKEAPARGNHTAVAAHAQPGRPLWPMQGYA

SEQ ID NO: 17301 - protein, 1115 aa, Chlorella protothecoides
MGKRLCLCKSATPTVSGTLNPSSSHCNLINHLPPPLASCITTSTRSCPWSFRPRIWVYIAASRSAQREGIELHPPNGTCHLLRHVDEFVAHGHPLTGLLQFGQGSIHGVICCEVPSVTSGIQALWSPVLHRMQVDVDLAASLPDLTGVEGGVDNHRKSIQRLTQLVGVCDQHLPLCPVKGSLGLFVEQRPQQGQHRSGPAQDLQDGLGYVGVCPAQGQLLRLTAAALLRLLPTRPLPLALSPARAGVPGLLTGSARLCQLAPGILRHTGNLIAGCGAGGGEQHSLWLSKTYAQTSSGPSPPRPPDPTSEPPPLDAHRVQAAPQRLPVGPCCTLRVIARLHGEGGSAEHGLRVGRGHARAGQHPFGGLDHGGHRAHHLLAQGRTTAPRALCGGRPQRPRGVSHLVHQGPCGLGRRRGRPPVPEHRQLHQAHLERLHRAPDRGDLQLADLNALRHAVGALVVHPPQGLVQGGHHLIVQVLHGDPLVPHFAPRPQLELKASTCSLHWSGPGGGWGLVKGWHGSADTSALFPQACVPHLAVVTLVRLQTLLKGVHGTGTLDLDDAGSLREDPGGRMGHGGKRGCRRLRSGSAGLYCQSPPVWRAAITAPWRPLNNKMEGVRCPYDLLLATNRNEGGVVRRERLHAGRATANSTCAQPCIRRWENDSNDHSPSQSTLTHSNFDPAAGLEAMAEAAAPSGLADAISRWQRRERDRELHSADRAVLAAQEADPREATDVFLARHAREKAAAEALVGAVKGDKSGETPARDAIMGLQQACWGAGIWGRLREPAWYHTLLRVIVMLRVLNMPCRWGLAEASYWLPQYDLRRLTAELTDMSEALEETLRASGPRRRFAFAPTPEPAGTVEQSATPAAQAAEGEPPPPASAAALQGATPAQPPHRPSTLHFNSSTLPSGSPLVVSGEEVSLTGLRDQAIMLLGCPAALYIDDLERCSVTAGPVAGACLIEGARAGIARWGGEPHCSTWARRLGGFNTVIDVAQASHHTSSPSHRPFPSLDTSQGRGRAPSTWRRTRSGSMPRTTPDFTCAPPVRPSSSTAPASALGPCRHRQGRGPPRRQVRRGGVEVAGCAMLGQRSADWAFRGMAYEYITVSGQPSDQTIAAAC

SEQ ID NO: 17302 - protein, 101 aa, Chlorella protothecoides
MSSAVWSSFRQKRPGSEAARPESKAGSGTKPAAAPSIESLDAEEVEALLRQFDMTSKYGPSMGVTRLERWERAVDLKLNPPKEVKELLDLPTSNPKSCFDW

SEQ ID NO: 17303 - protein, 85 aa, Chlorella protothecoides
MAFVNETVVCIVNMAYNLRHGYPFSSYGDAATCGVQNTVILGLMFRHGDALLARESRQANACVGDGAVVELHMLPPPSATPLTAC

SEQ ID NO: 17304 - protein, 108 aa, Chlorella protothecoides
MPHPHHPARCPATELQASSVLLLALGGRLPQIWMNIKNGGSGELSMGSAALSVAGNLGRLFTTLTLVDDKLVLVASVSQLLLNAILLWQTAQTAWRKKQGTGPVYKAA

SEQ ID NO: 17305 - protein, 326 aa, Chlorella protothecoides
MAFSPMRGDPATLDPHPREDVTLRCGDTCITLNSRLAGATWSMTYRGQELILPQPGNGGSLQSACAFDVRPGTSPEAENPTEAGNVNDNAGATSSEWKVCRVNADHTEAYTETLMAYFWPPGRPMESGPDRGPPRNTSVLSRVTLAKHLVFLAPDLLRYTVAFCLPADEPHWFAQVEALTGYMHPSTLPCRWKVAAERGMGGPFAAWTPVPSGDAPAARPGTPAEGMVYASRDGAFAFGVAAVDWPPGGHVYAGDEAAPPWAGTWQDPYKWNYVHHFNAQVSPEDSRIPTGALGYSFLLATGDLERVRGVIAQATLLAAAKCRPPA

SEQ ID NO: 17306 - protein, 204 aa, Chlorella protothecoides
MGGLLEDVQEELCAISAIYGDDAVDVDLDSGICTVRLSSGSASLTAGVLLPADYPAVSPPHLEVASTGMDDAVLDDCIAGLVESFSPGATPGGHTEGNVGEPVIFQWLEALRMCMEDWVAEQTPPSPGEGGDEATEASDDAKPGDELPSQAHPEASPGPDLGIVHGEPFTERRSTFQAHLAVVHSREEVRIRKGTWVGAALLGS

SEQ ID NO: 17307 - protein, 636 aa, Chlorella protothecoides
  MOD_RES (13)..(15): Any amino acid
  MOD_RES (382)..(385): Any amino acid
  MOD_RES (564)..(567): Any amino acid
MPPQPTPATHPPXXXCEFHQAPCHHHPPDHTPSTTQGGRAAGPDAAKLPGGPRPGHRLPRHRRRCRAGRALGAPAGPGCRGPLLLGLRYRSLGVVEPWTAPGRAGMRAPCSLQAEHVLRGGIASGLVDATSQLLAWQRLRIRLPKPGRKTAKPPRPEQTSGPPDAYAPAPQPPRLAARVNSTIRSLTAFRSGAGARKPNRTGSCSPLSSSASRSMPSSSTASRRAARAGRRAQCRTMATQASPWSAFMCRAMGAEKAATGSGAVARYSSAPARPARAKPPTSRTPRKLAMRASAAAASPPARRSMLPVNVARASGRPWGCALWVCSVTLVTPSCQINQRHVGKAMRLFPRGVKEVTLSGTVRLTRSSRWTSRVWGLRVLSAXXXXVGHGEADTAVALNVSRVGAEGAQREVGQPAVVHGILHHAAGGEALAVGAAGDGGQHPPPGEATWRRACSASRAASHQGPGLDGDGEAWSLGLTGRVRGFCRRRNDRAWSWHGTGTSHQIDRRARRPCPCAPGGAVWSAHEPSACCVPQRKRTGQWRSPSDIESFESLDHWMGGRQGRCXXXXSKALKVWITEWKAGGAFARAWRSHYMRGQIKREQGLPPDVPARQPPFTKHVPIMTATLCLGCVVPLGSH

SEQ ID NO: 17308 - protein, 469 aa, Chlorella protothecoides
  MOD_RES (358)..(411): Any amino acid
MPWTVFDSTRDISQIKWCSIAMATAARQCRALASLASQSCDGLLGARCMATLPAALASQVATRSPGSIDLPADVNDALLAAAKGARKKHLRGQGAALTDELKHMSRSRHRGGVHPNLHGVPEAQAQRPTRGKARQQRRTLLAELAGEVPGLPMVGTLTGNRGPARMSRRARAAAEAAQEWEDLEEADEGGGMMDSTAAARPSELADAGPAELSDTVDTQGASGVAALDQPVIGPPAAKSESASQWAAPPPLPLDRPARSSAVAAGRRYGDEATALAYAATRMPACYAALRRALGEVAARQGAAWAPATMLDFGAGPGTAAWAARDAWPAAALRVTAVDASGAMAWLGRAVQAARTRSXXXXXXXXXXXXXXXXXXXXXXXXXXXXXXXXXXXXXXXXXXXXXXXXXXXXXXRAGRAGRRRGAAPAGGRPLGQGGAGRRAAAGGTRHAGRQPRRRSGPHPGPGGGSGRGG

SEQ ID NO: 17309 - protein, 558 aa, Chlorella protothecoides
  MOD_RES (4)..(7): Any amino acid
  MOD_RES (133)..(136): Any amino acid
  MOD_RES (340)..(342): Any amino acid
MSNXXXXLNPGPHQHFTRGEVQLGLSMSNDVGIFPTKPHLALGDAHDLVHGVERVVPPDLIFLPDPQMVVGGDEDAEHILPAGSGNVLGNEASKSLMTMPSHGRATEVILGALDSRCALNRMEVSSVTMHSYXXXXQPMRPQPHGGIIIYHAQLLQLVMRSINGGSWCVCAPASGPRIETPCSRESAHDSGVPRWNTLCHGRHLPSRQSYLGTGGDQVPFSLTPIRYVMTSPGLHTALAGCAYLVVYVLPLYVVRGPRDSPPVIKARLAATAITSALLTWVPIILAFSQSNGRVSRCLLQAHGAVRAGMRLACLCGLIPHQNWKADIAITSHSRPWVDLXXXCPAGPDGPRLLEQRRPGPWVDRPPLCWAPCVPGAGRCAGAWAPPPRQPAQCAAGPARPLPRPPQRGARLPRQPAGLPAPAGPGRRRGGGCLPGPLCRRTRSPLGGPGLARRAQRARRAARRCAAGRLHRRLRPARRRALDGGAQRGRARGGAPGLQPGGPAAPGRHAAPPPGPAPAAPDRDGRGRVGAQHRLALPPPRLVAARHTPGADTPCAREP

SEQ ID NO: 17310 - protein, 232 aa, Chlorella protothecoides
MQSQSLTLFITFHVPHPHRLAIWMHRIRPADTPDYPRDEWFNLFVLHQNRTPHSQSQHLPGLRATRIRPVALKPLLSPSPTCSCQGAKNYVKESHLARFLDLVIWGHEHECLADPWVCGLVVAWRGVEGRRFVSSVSPHVGDVTDLWPNEQAGLIPPPPYSVGRHPAATPSPHRIDPLPSAGLGGDGGCLQRPAARVQRGHRALRGRGQKKACCGARDHGAPCEEAWDGAGF

SEQ ID NO: 17311 - protein, 264 aa, Chlorella protothecoides
  MOD_RES (254)..(257): Any amino acid
MSTALSTESHQLHPLLTHMQWRTIKHPLETVRRFEFETVVLAEHTKKLDPEDPELSREEVGDQQNAPELSDFLPSCGTLTSHLRRTCAKALLVACPAQMYSSLKSNTIALPPQTVTAFLDARVSAMIARAVRGRPPASPKLPLVRLRVDYTGFSTINTQRFGTRFVGQVANPHDIVLWQKPPARRARVGEGNGGGRRKGWCRPGLPMVDSVTPQNSTPTLTHMRSVQEESATRAGNAPVVPIRPEALDEAHIEXXXXMEHGTIM

SEQ ID NO: 17312 - protein, 639 aa, Chlorella protothecoides
  MOD_RES (297)..(300): Any amino acid
  MOD_RES (548)..(551): Any amino acid
MASTWESAHPLSHGPSWDAAPSLDIAAAPPQSGVSGLYALALQGQWRQVIGRCKELRPASRADSLTIATFHVLALAQLNQTMDALQELERVGNLDGSGSHAARRRHAVVSRPQDVGWDKGNALSACFARTDHLFPRMLYSMFPLTHTLSSAGKHSAPDASEVPFALRWLAAELPGRAGRWMEAVSAFQALLGLCVTQSGIAEREGDAEASRMWGGRRARAAAALANVHAHECPRVFERGCCVLGVGCVHAQTGSWVTRMGSFNSGNPCQHIKIPDDDLFPASCPASISGPTRPSPPXXXXITIPDDDLLPASCPASISGPTRPSPPSFTRQQQYPAALAVLDAQLGADPRRIDTWLHAAQVQLRVGDLPGAEASVASAAFLAGEAEGPAAAYSARAVRHARGLLAVARQDWPAAAAAFSSCLREDARDAEAVGDLAVCQLFNRNVESGVAVLEAGFQAQPWAMLKVCAWVVERRKGRAGGGSIRGRWRRRGVLAEHGDSCLGSCPCRGACRCCAIIPGVWAFRAEESPGQPAVRGDPPSPAPSARTSXXXXRQCCAVVPGVWAFRVEESPGQPVVRGDPTSPAPSARTSYHHLIQAPLVSSLALMYDLARPDSGAKERFGAWVARMAPDDLDMSCLSPG

SEQ ID NO: 17313 - protein, 227 aa, Chlorella protothecoides
  MOD_RES (36)..(39): Any amino acid
MFTRRILARVPWRLFAKPTGVTLQPQIVCMRHFCLXXXXRVPWRLFAKHTGVKLQPQLVCIRPFCLLNDVGVRRLSSPAFSLQPGRKVVAAVAQKQQQATASPSSPPVINLPSHCIGCGVKLQQNDPAAPGFFQVPKRLLEQSSPRFDNAEVLEEEELVAHPELAASSSSPEAPDDAPPAPKRDSQMDLFDQIIDEWVVSVRDLMWDGWCYTVAQAFERLPRICQTG

SEQ ID NO: 17314 - protein, 346 aa, Chlorella protothecoides
  MOD_RES (92)..(95): Any amino acid
  MOD_RES (280)..(283): Any amino acid
METIQCISLLRVQVRMVVMHSGYGWKHPLPGSECFAHHLRASIVPQCHAVSCAPGFLLQTEHLSTNPPFPHAPAQDKVSEFELKLMDISSEXXXXLRAQVRMVVMQSGYGWKHPLPGSEYFAHHLHASIVPQYHAVSCAPRFLFRPEHLSTNRPFPHAPAQDKVSEFELKLMDISSENLGIPETEYAASVRMPSAEFQRICRDLSSIGDTGGEDVKEEVCASRLALPLMVNDVLIAGPIYPLSNCSGDERDKGRHQVLDHGTWWRGPGTLRHILAGWAVXXXXSTHCLIAVEMSVTKDGIKFSTTGDIGNASVICRQNTAIDKVGKLLGRGGEDLELCAISWLDGL

SEQ ID NO: 17315 - protein, 795 aa, Chlorella protothecoides
  MOD_RES (24)..(27): Any amino acid
  MOD_RES (411)..(414): Any amino acid
  MOD_RES (676)..(679): Any amino acid
MVGCLYQSMCLYISGLAQVKQPSXXXXSRTALAASPLTSPASSPTAGHMQLHIQSNSQCNVRRVFCSLSWEGLRAAPGTFLSAQSPCALGSCRAPTCFVLHSIGRNLYLLRDDSADVVCKHFGFSKAGSVRTANFEFMGNTNFHTAISAHTFEVVFYTTAQIIGAVECLESGQKPCTADSNGNIGSGNKGKRNFGNDNVWDDNRGNSNEGNANWGDGNRGNNNRCFGRVGDTSYINKCSLRVVSRNQFRLYFPAPANSPPPDMSPPPPPAISPPSPPAKKFPPFPAMHFPPHPPKKSPSPPAKKSPPPPPKNKSPLPAKKKSPPPPVKKSPSTPAKKSPPDPPKKMSPPPAKRNSPPPPVRKSPPPLTKKPPPPPTKNIPPPYSSIPISTQHPSSTQHPSSSQPLSTSQPXXXXFRKYAWVLGFPPPPAKKSPPPPATKSPPPPAKKSPPPPAKKSPPPPARTSPPPPAKSSPPPPAKTSPSPPSSPSPPPPSPSPPPSPSPPPSPPPPPSPPPSSLPPPPPSPSPPPSPPRTSATVEFSAASRGMVDITCVVTTVVEFSAASSDSVDITCAVTTVGYVPNFMKWGLYTSALSYLGGDSRVSTSAVTTIILKEQPQEIATQYSIGSASTFTSELKEVLPLTLLNPSTPPPGPSPPPPIFGAITGSVSNDGNDFSFXXXXVSTSAVTTITLKGQPQGIATKYSIGSASIYTSELKEVLPHTLLNPSPPPLGPSPPPPIFGSISGNGVPLRVVQKAYESTPMTWTITLESSEIVLASYAQVVAYKLGVGASDALTLK

SEQ ID NO: 17316 - protein, 223 aa, Chlorella protothecoides
MNSLRQFTEDDESLTADEKALLRFQKQRMQELAGGKFALPDDTQEVELTHLGRSLAESQGLGEGQGHVQECGLSSKCPVPKAWCSLHWPQRTMPVSLGTQHALSFIAPSQDWQRDDEDDGLPDYDVSAHFGGGDGEGGDLFQLKPRSESAEVEGGDGDDAPVPRRSKAEVMEEVIAKSKAFRAAKQQQREEDVEEVEKLDSVFRELGAAGALSRLVRPKGAKG

SEQ ID NO: 17317 - protein, 228 aa, Chlorella protothecoides
MWSISYFDSKEYDWRGMSQQPSLLAKARRSLLQFTPKSFSNLKWQAFASPKRCLQVGALGFRGGAAGGRACGIERATAALLMGHARALFYSHHIRSPALRSMDAQECYEYIEASGSPQGADMLKLGAFAWLGLALALERREGKCCAAVDAGLARLVREPVQGMSRSGVCPPPHLPSSPFPRRSMFPAPWPTHILIGWGLAAACGLTLFTVWSLRYYSRQRAGTKAKAA

SEQ ID NO: 17318 - protein, 235 aa, Chlorella protothecoides
MGQDRSGISGETVTSISGRLADLPDLRLPGQLTRNGEVGVAKRREYLTRNGEVGSAKRREYVAALLQRDPGVFLERHGVHLSADELMHFESLRSDHEVDFYLKALGDARGDSKSSALIRNRRLAHMQRLMAEGQYFSESAMEQRQPWLYHQYIGQYRPSADASDQASTGVSPGLAYADRLLDHAREATLAEAREEEQLAYDAATEEEDGEDGHEEVDEDGRDQQSPAPVEPLPER

SEQ ID NO: 17319 - protein, 154 aa, Chlorella protothecoides
MERLAGGEAAAAEALYRARHPGSYWVGFGDFAMYRMASLRGVRLVGGFARAGRAGAEEYLATAPDPVAAFSAPIARHMNADHGEACVAMVRHCARLPARAALLLAVDELGMDLEAELESGEQLPVRLGFLAPAPDRKAVKDRIVELTRAASRGG

SEQ ID NO: 17320 - protein, 331 aa, Chlorella protothecoides
MRVAYEGERLTPSRCGRMDQAVALGRAPALMTFDGDAMQVESVALREPLHLVLADLRAGKDTVQILSCLQVEWRAMLGLGICWGGGVSRQRTKRRGLYSVKVLGRRPRLPGKQGPWVACRSPFSFRLLRLWQLETFQRPSLPHALPPPHPFPPPPFAKQAYPVPSTSAHHALVRCLGPLNESLTASAAASMVRGDVAELGRLMTAAQAEFDAAAGPLCPSQLGEAGSPVLHRVLRLPAIQPHLLGGKGVGSQGDGTAQLLCRDADAQRAVVAVLTQELGLECIAFTVPATAAGEAGEGRRESSHREAGGRRRLASRDPTPKTYPGRPCSAP

SEQ ID NO: 17321 - protein, 79 aa, Chlorella protothecoides
MSAQGSDVPDIVSAQWLKDRLADVKVLDASWSLPVHKRDAVEEFKASRLPGAQFFDLDAISDTSVGEPGRGCPGGETVT

SEQ ID NO: 17322 - protein, 199 aa, Chlorella protothecoides
MAWADDDAFLLRLAEGRGLLSDLDEDTLQLIRDSIGEDAELGTEDMELRRIGKGELGNEVTAADAPHSPADIRGSQRQTADSLPTSRPAPTVPASSSNGHDPDLDLETLAQASASTWSRVLRPPLKRGGHVVLDLCSAVESGTRGEAVRQTVSRLGSERALGGRGAYRLARGLGWGDLWPADYQDRLPLQRGGAWKKGE

SEQ ID NO: 17323 - protein, 141 aa, Chlorella protothecoides
MAPSNAVVLWTVPPGLRAPAMSFSVVALHVLGDVPSPPALGFLQGRLRDWRLSLSLASLLLAAGAACYALATAPARSATDYRAQDAATRPPLEVQDLRDASLADSTAGAGVGGVEGMRLRLLAGQSTPNLAMLRELEENRE

SEQ ID NO: 17324 - protein, 210 aa, Chlorella protothecoides
MSTIPLEAALNSTVADVRGGEGGGEGLGGGGGSDDGGGLGGGGGLGGGEGLGGGEGLGGGGLGLEGGEGDVLAGGGGDDLAGGGGDVLAGGGGDFLAGGGGDFLAGGGGDFVAGGGGDFLAGGDFLVGGGGGFLVSGGGDFLTGGGGEFLLAGGGDIFLGGSGGDFLAGVDGDFFTGGGGDFFLAGSGDLFFGGGGGDFLAGGEGDFLGG

SEQ ID NO: 17325 - protein, 649 aa, Chlorella protothecoides
  MOD_RES (31)..(34): Any amino acid
  MOD_RES (334)..(337): Any amino acid
  MOD_RES (378)..(381): Any amino acid
  MOD_RES (582)..(585): Any amino acid
  MOD_RES (614)..(624): Any amino acid
QPHPPAPRPPARSVEAAVDAGAGDALQRFDXXXXARSVEAAVDASAGDALQRFDEGRGAQVEPVGLVDLPDGLEGVGHDHVQLGVHLRLGPLEVLQVLHPLEEGDGDAAAVGIDVGQRDDAAVAQDLVGLGRGGAVGRLHHHLALQVPGVGLGDDAADGGGDEHVAGHGEDGLLGHSGGAREGGQRLAVGQVLAQRGDVQPRLAVDGAGDVGDGDHPPAVLVQDLGGPGAHVAKALDDKGLAPDLAHADGAQELTHREHRAAPGGGFAPQRPMQPHRLLEWVGDGGGGEGGGAEGGEGGGAEGGEGGGAEAGSAAWPSRACRSSTHLYTRMYAXXXXAARPSRACHRSTHLYTRMYAHQPLSLLLPPTPFPPFPTLPXXXXPTPFTPAPPAPPLPPLSYLAGDDARGVALELGVLVEDPGHLARTRVHVRRGDVLVGAQDGAQGLHQLAGQDLQLALGEGGGVHGDAALGAAKGDVHHRRLPGHERGQRSHVVDVDVGVEAQAALVGAAGVVVLHAVCIKGRHLAVVAQDGQLHGNLALGCQQQLLQALRVLQIEHPARRVLDGGICNKGTTAGSSERERAXXXXIEHPAGRVLAGGICNTDTTAGSSERERAXXXXXXXXXXXTFGPNSTVAVLRHHPNSGMRQDKIT

SEQ ID NO: 17326 - protein, 522 aa, Chlorella protothecoides
MALMLARRSLARSLLSRMAPAMSGGMQQGGSLDPQNSQTRYKSSHAENTNKFIVEALQHLEYPERLQKLLLTPEREVSVELAILRDNGEVATFDAYRVQHDNSRGPYKGGLRFHPDVDIDDVRSLASLMTWKTAVMDIPFGGAKGGVTVDPSTLSERELEILTRKLVQALRPILGTYEDIPAPDMNTGAREMAWIFDEYTKFEGYSPGIVTGKRWVLLRHARLGHAALPASAPPPSPPSAPPPSPPSAPPPSPPPPSPTLPHSRTTSHPPLPLTPTPQPLQQPVWLHGSLGREAATGRGTVFAVRELLRAIRMGEIRGKSFVIQGFGNVGAWAAQILHEHGGRVIAVSDVSGAIHCETGLDVPALRQHLADRQALTTFPGASTVPKEAILTVPCDVLIPAAIGGVITEANAGDLQCKVVVEAANGPTTPEADQILRDRGIVALPDIYTNGGGVTVSFFEWVQNLQNFKWSEAEVNTKLDVVMTDAFKAIWEIHEADGLNLRTAAFVKALQRVTRARVHRGFD

SEQ ID NO: 17327 - protein, 433 aa, Chlorella protothecoides
  MOD_RES (37)..(40): Any amino acid
  MOD_RES (326)..(329): Any amino acid
EQGPGKEVLRVAGVGRRGGERERSGRGGLPACALWLXXXXGGWSVGCPCDRRNRGPARRSSEWRAWASRRRAGALRAEWPPCMRPLARDVSPLQPDVPLPNTAGTSPTGRSLGSAHAPQAGSYMERFAAGRQHGRAPNGASLHEGAGGSAPRRGDSSPLLGTSPGSSPGPARLLGTPGNAGAGAAGAEGDAPPEILPERVNRLPGATAVAVGEKHTLALHEWYALELPDADGDGGSGGACTERRGADACRGAPGALDETAGGEADPPVGAESGDALGAARATCPGAPGAPTPSSRDVASSPAQGGEGEESSTARGPPPLQHLCERXXXXGGCAGGCPSRVPWGPHAKPQGPGNETCAGGGGRGVQRRAGPAPPAAPLRAAGGRGLRDPGQRAARAGHGRRHGRAPAARARAVCGAGQPARVPGGRRRGPGPPA

SEQ ID NO: 17328 - protein, 1432 aa, Chlorella protothecoides
RAGAGRRAGHGRGAGPGRGRRPGRAARRPRGCRGAGAPRGQALCRVGAGRRGARPRGAANHPGGPLRPAGGDGARRPGTPRLHRRAAAAGYAAPGHPDQSGKWRARPAQGRPMRLEGVVDRGSPGTGADVTAEALGPRAALTHRKGADPGEIGEVVSALRREAAVDPCYLGGPARPTQELRHSTPAVDLADEVQARVRAAALKLYAELGLHGPAQFRGWVTTPGGGGEEEEEVEVHVPAPAELEAVRRAGADAQARRPRAFGDLLEFDGLVRAEPAQRAPAPESITPLRIVGSTAMQAAAANPELARAMLREELTEDRPSRARYGAWQGLELDDRVAVGGEAAEEGPCEEDAVAGLATEEPLPPVVERLVPPSELDALPALCAPSGDGAGAHRIGFSRLTLGLDLSGARSIWLQQAAAAGLAPGRLVCAGLAQGELDPAALAGGAEGGTVGALAAGAATRGGQVAAAAGQGGDDDGASPGACVPAAAPWPPQDWAAQLRGLGSFLENLEVDDGEGFEAAMAAAGVEVPAAPGSAPALPDSYDALLDEREGWDERETIWGGDSVWVSGREGSLLPRPEDAGPGDAGAGEAWSGEGGHQATPPDPAPAARTPLWVLFGGDGAGGEASLRSGLEAAAALGQTGEYDVRSFFLEPCNAGEQAEGRRSALLQRRLQMLKLGADDDELLREMGPLHPTRIKGLEGKGQLSCCSCIHCWTSSVHLTITTTRSSTHSMPPKSELVALQRGVWELTGTGLLRQTPAELQHACEVGEVLYWPCGTCTAAPVVAWPLPARAMTVCLARFSVPHTPHPPSPLAIPSSPCPPHRLTPKQQRALAQYNTPWSQRGPDRLVPGQAAASQAAQELVLGGWAAPDEAAAIWGAGLEAGERTPQPSYRFLDRWAAAAHEAGAVVVLACQAQPVALGPIQRVLEGKGVPCTLSSSATLEAVTDRAVMMRQVSVCLSDGTVVDGRGFRDVNGRMGVHTLDERGNRWMALRFRNEQGSVSACPPAPLRALAQTPHPMPTPPNSQLADLEPHGVSAAPWHKMSLAELSAKVEGEAEADALFDQLRGFLGAGEADLVLRPACTTRGPELGQVTITCGADLAIVAAALSQGREAIEAGELGQGDGVRLPQPPPSHVLLEPDVAVEDLILMREPEGGSGDGSGGHGAWSRGSVSARLALPEGWEEAERSLPPPDPAQPGARRHPAARFVHWPPGEPSWVAVRACLVGGAGHMVCLGPTADVLEVAPRPAGLPRATREALTHVSRLAAKEARAAARALGNAAAEVADLEDGADAEAADVEASSDEEEEAATVVGCYQFTPPPERWVSGEAAAQARLRLQLVAGRLGLSGAASMEAFVHTATGEVVVTEVDPLPDLSLGGLLMKQAAAGVPQPLTPAQVWREVVRAAQQGGGGAGGAGSATQGEADYGFFDVADMAGGW

SEQ ID NO: 17329 - protein, 361 aa, Chlorella protothecoides
  MOD_RES (119)..(121): Any amino acid
  MOD_RES (183)..(186): Any amino acid
  MOD_RES (253)..(256): Any amino acid
AAPAPRRPAPAPRSGAGARKPAGKLGGGLGIRKAAVRVDDSLFEQEPAAPEEAPGATNGEGRATGPKGQAHGSKDFDDEDFGGAQAPSSRFDLDAMEERARPPAQRSLRSNGLAMPQGXXXTPVFRLGWWQRSSRSNGLAMPQGICLPLSQAATVSPLSRIPVEKASPPRPATHHLSTTLSQXXXXCLSPESHPCREGLPPPASLSSLEHHPVAARARRPPEADRLGPSLPLRARWPPAHHLGRVGVGRPGPXXXXGSSGWGRASRSVPAGPPATTSDASGSAAQARFGSAKAISSAAYFNQDKGENDYEKQARLAKFSVSGGACGAEGRAGGAEGMEEGTHVNDNAPRSISVWLSLFTWP

SEQ ID NO: 17330 - protein, 352 aa, Chlorella protothecoides
  MOD_RES (14)..(16): Any amino acid
  MOD_RES (37)..(39): Any amino acid
  MOD_RES (192)..(195): Any amino acid
MLSSGPPWRGMDVXXXKAPGMRFWDGCMGSCQAVRVXXXAQVYRRRWSCPGTRSSVMWIWMRSMRRWRCGGPGNEIVGGLHGVVPGSQGFSYSLPSVSSKARRLPLSAPGSQAKRDPNRLAGKPLAVVQYNPQGDLRTLLPEDDRVIPASSNSIIAVSYVRPPGLPQSLTNATSPSWQTPGEVAPCHPDAWXXXXIIDECYFPSLADPWQGGPLPPRCMVIVTAAQDSGNVPAPQIDSLQPHTHARVQEARAQGVRRNMRGDEACALCPDLILVQVPTAHGKADLTLYRAAGRRVLALLAACAGACERASIDEAYLDLTEAAAARLAKLGPPPFAPPPGAERMHVGAEAPAA

SEQ ID NO: 17331 - protein, 260 aa, Chlorella protothecoides
  MOD_RES (68)..(87): Any amino acid
PAAPTRSTSPPRPRPPSPAATPRASYARPWRVGAPRPPPQPTTIRPAARRTPVRTAGRSGGGLGGGPXXXXXXXXXXXXXXXXXXXXREPPPPTDAPAPLSSTLKSAVYIDLLLGAARALGPVVRQFTSLGLNRVWLHAGDVVYRQGDVAECMYVVISGRARLLHRASRGREVGVEDDVGRGESMGAVWALAGGRHDTSAICIRDAELCRLTRGSFELLCALHPRAAARVLQGMAERLAASQSNRGRGGVAGVQRETLDA

SEQ ID NO: 17332 - protein, 282 aa, Chlorella protothecoides
MSSPSAATYMHQVENHEGVTNFDDILDKSDSIMVARGDLGMEIPTEKIFLAQKLMIQKCNLAGKPVVTATQMLESMTKNPRPTRAEATDVANAVLDGTDCVMLSGETAAGAYPVAAVAVMTKICHEAEASINYTALFRAIMKRVPLPMSPLESLASSAVRTAHKVGASLIVVLTRGGATARLVAKYRPTVPVLTVVVPVLTTDNLTWQCSSESPARQMLISRGLLPILAEGSARASDSDTTDELLHAALDHARDSRYCARGDTVVAMHRIGNASVIKLVDIK

SEQ ID NO: 17333 - protein, 71 aa, Chlorella protothecoides
MSAFSRVARQLYSTGSKTLHAAPKSNTNALQQRSFASGHGHGHDVTYEGLTLHKASPWHVNIGRGMAGVMW

SEQ ID NO: 17334 - protein, 224 aa, Chlorella protothecoides
MNVARFNFSHGSHEYHQGVLDNLREACRQTRIMCAVMLDTKGPEIRTGFLEDERPVFLDAGQEVTITTDYGVRGNKGLIAMSYAKLAQDVRPGLVILVADGSISLEVLSTDPAAGTVRARCLNSAKLGERKNVNLPGVIVDLPTLTDKDIDDLQNWGVPNEIDLVAASFVRKGSDLDYIRKVLGPRGQYIKIISKVWGGCSWLQGVKEGGTTMGRRQCGVTTWG

SEQ ID NO: 17335 - protein, 184 aa, Chlorella protothecoides
MNGQEHRAMHQFLKPPWHLMEGLLLPALIMPPHPQAVLLELERVAGAYRQAHQEHQDLLRAVEVARAGLKEADASLEARHAEVARSRKDEQGGRAAAAAAQARLDGLRQEAAAREHQIAAAEAQRAQRAQELHAAQQAEQDAQQRVEDLRLQLSRVSRPGMGGSGADGQAECMQGLPCIHPKWL

SEQ ID NO: 17336 - protein, 370 aa, Chlorella protothecoides
  MOD_RES (7)..(10): Any amino acid
MEEDGVXXXXPTQLCRNGVPRAHNSMEEDGVIRATTAENMAAATEHFNRGNGATGSEVRKSASLSGMGAEGKCTTTNPIHMIVGCIVCVCHLPKISPRVTSSANGKLTVVSTGARWENEVGYSRAVKRGNFIAVSGTSSVEQSTGNVLHKRDPYAQARTALEIVAHGLEALGATLEDVVSGNGALVAVDVLCKGCLRAAGSAASGTVTVSAWARTCPPGLLPPPPICAVVHAMLSHADIPRTPNPMQIRTRVYLRNMGRDSAAVSRAHGEVFGAIRPASSMIEVQRLVHDDILVLIEVDAIVALEHRKLDMCMGGGSLCGPRDVFCSPFAAAGSQLTHRHQSRWSPSQFTVQPAAPPPAASCSAWVLALQ

SEQ ID NO: 17337 - protein, 200 aa, Chlorella protothecoides
  MOD_RES (142)..(145): Any amino acid
MYDRRLLEERTAYLASVRAAGDLPASALAIRSDLLRNLGNLASPDLHETCRAVPEPIRAYSAEVQRHVRAIAEAPGVIWGGRTEIEKEFCGKEQCGRPARGWEDIERCKGVFGLNLCVCMGRGLVVLTVCMIDVTQFGMAQXXXXAPTPPRCSVMCAPSPRRQVRFGSKGEELRRNSVARSSVDGLPGGETSSGARACLG

SEQ ID NO: 17338 - protein, 380 aa, Chlorella protothecoides
  MOD_RES (129)..(132): Any amino acid
  MOD_RES (215)..(218): Any amino acid
MKSAGADPSSEGIDGHSSDEISYFRMAAMGLTSLASPCAFTTARPTTRRAHARPGMLPVRAAAAAPSMVPDEAKRTTMNLLLAGSVGLPVVAMAIPFFSFFVPVKKGIEGAAPFAIPPRDRVWSLMLLXXXXGTLLRQRRVIADADRQGIEGAAPLAIPPCDRVWSLMLLPPPAPWELPCLSSYAASPFTFPPLPDSHLQGCWDWRGPGGQGRPXXXXHTASSFTFPPPPDSHPQGCRDRRGPGGQGRPGQRREEVGVAGQAPAGGPLPGPGPEGRCHLPHRHQRRRRGEIRTERGVHPPGLRGALERGGEEVHLPLPRVPVQRRGIQGARSRPAFLGPGPRGRGGGPGVPHTLDRDRLPGWRQAVVVLSAGGYPSLRRG

SEQ ID NO: 17339 - protein, 157 aa, Chlorella protothecoides
MVSLREGSESLTSSLLQAQAELDQIGHRLEQEFSSRYRDSEVNPLVVLNRLHKLRRCRAGLGCAGGSVLERMPDQQGGVPAPTPVAMFQPKGRPFHSYALSPRDISAVAEDAEDLAGTRDTLAAELSGLLASNVAKLHALQRKAGIHPSLELPGVPA

SEQ ID NO: 17340 - protein, 163 aa, Chlorella protothecoides
MPAPPSPVRGTLAPAQGGVPAGAQDHHGLPPSRKSVSVQGVLHHVHVGQGQGKRGGTAHLESLCVVLGPVAGADELLLHRVPGHHAAQVGAHRVQSVFLHVAGAGDDEVGGIALQALDQGVVPRLVLGQPLRLLHVVAQGVLGHQARAGPGSPGDGSREEGGR

SEQ ID NO: 17341 - protein, 210 aa, Chlorella protothecoides
MGRGDVAGPAPPTESGIADAGVHSGARTKGVECGACKVQPALEHLTHSNTPPPALGLGHAHNKRPGVIWAKLAACLVLTHLLWMNRSVFDLVWRPLRPLLAYTNPARPEGDPLHEWFFRTGLDRYVWVHGMACAALLPRWEAALAALEALGWKARRGARAAVLAVCALVGYAWYAHVFSKPKLEYNALHPYTSWIPITGGWVWVACGREG

SEQ ID NO: 17342 - protein, 110 aa, Chlorella protothecoides
MFLALATCAALASQRPTGRPPAVLNRGQTEEWKGWMQVLFLLYHYYSAKEVYNAIRVFIAAYVWMTGYGNFAYYYKTSDFGMGRWEEGLGRGQVKWRLCPAGMVMDACVG

SEQ ID NO: 17343 - protein, 265 aa, Chlorella protothecoides
MEPNSSVKDRIGLAMVEDAERAGRIAPGKTTLVEPTSGNTGIALAFVAAARGYKLILTMPATMSLERRIVLRAFGAHLVLTDPAKGMKGALLKAEEIAAATPDSYILQQFENPANPKVHYETTGPEIWRDAGGDVDVFVAGVGTGGTVSGAGRFLKEKNPGLKVFAVEPTESPVISGGSPGPHKIQGIGAGFIPKNLDVPILDGVEKVGWGRCGCGREGRHAEVVFGGWRARRDAHHASCIVCFQGPQPPPPSKKERNTRHSPVH

SEQ ID NO: 17344 - protein, 577 aa, Chlorella protothecoides
  MOD_RES (131)..(134): Any amino acid
  MOD_RES (249)..(252): Any amino acid
  MOD_RES (513)..(516): Any amino acid
MLSAIQGRCVRLGPYTQRCSGQLWRAVWHVGSPPGCCTRRPDPGHPYAWVALFRPTHPSAFPPVIDRAVRLLVSPGRHLVTPDDDIIHQVAGAAGLQLGRLDVRVAIGDDDGGEAAGPQRAQHRRHSGGAXXXXRGRRKVEFGDCTAANDYLTTKVRWGGKITIQLKRTSSSAGGHKSACDTGGSHTKWHDSYSSPGGRGLRGRPLSAHRPGLARDAVLSNTNPRCTHLVCRIPGRLLKELAPVSQQLXXXXAHRPGLARDAILSNTTPPRAPTRCVGSQGASLKSWRQSASNFVGSTAGQCCDAAWATSSKALTSPLDVRCHQGLQFRDGSGSNTAFRYPVTDGSARQVGDFSLQERAKPVPAKWGRTSQSHEIYPSFRPDPAINPLKHSFARVQAHIGEPALWADHTGATSSARWVVGNSRCRNATGVRANAMRISWPLMNFPCSKKAGAPADPLVTVLENKPSRNLGATDTAAVPAKKHGVASNVTQLIGESPVTAGASPSPPSCGRHAXXXXSPRSRPARARPPPPSCGRHAPEPHDGMCPEALAPPALSRRRVPMHTHPHGPLPQATPPWCA

SEQ ID NO: 17345 - protein, 273 aa, Chlorella protothecoides
MDTMSAHWRAWTDVTRELGLTITPEQFLGFAGRPTSGIFASLCEEQVRQTRGLGLEGWQFDEGTNLPTTGWVIPQPGALCAPYVRLPAVDGKTIDIPAAVELKNARYHEVADDTKLVKPVVEILQAALARGEWVGLGVMGRAVRCWRGRHPTSSRLDHKACRCTTGPTHDQARPHRKPGLPCAIATGGDRFQVYPSLAKSGLWTPDNTSNFKAVVTCTDVTHGKPHPETYLKAAALLGVDPADCVGYEDAPLGMESIRRAGFLAAVDVTKIPG

SEQ ID NO: 17346 - protein, 214 aa, Chlorella protothecoides
MRFDGPAPERINGRLAMLAVITGVLEELRSGHGIIWQAQHPNPLIAVSFLAIIYASLVPILKGAVYEDFGIFTVVAEKLNGRAAMIGFASLLALEVYIDLFWGGDREIAFKLGKVAHGILELPQLRTVHCVRHRLSKAHARHVRRSPQRLPTAKPRATTSCQAQISLRHGFPNSRGVSPCSRKGWVRGHQIAVPLTSKGFGAVVIVASGTRADA

SEQ ID NO: 17347 - protein, 417 aa, Chlorella protothecoides
  MOD_RES (377)..(400): Any amino acid
MIATPDFMTFPCPALSHPRPQLCGRSQPTACQSTASLPIPKARIMLGYDPGPATLLGAQHQPPGAQREPPGIRPGTGPGRSMCGGPGEGSCRGPCPHRPPPHPLRQRVGHGVSVSVPLHPIAPSQLTLRGAYTAHRAPARRGTELGANLRLPRVLATAVLECSEDSVTGGNWRGHPKPWRVPPGCDNLDRRPHHSTAPISIRRSLQAPARAQGRDETYAETQVIRQDTCKQDFGCHFLQEYYLVSPRIMATKNLKAVVVGATGAVGGEILGQLLVNPAWGEVVVVGRREAPVPPEYKGWDPAKLQHKVIDMDNLASEASSAFEGADTVFCALGTTRATAGSAEAFQKVDLEYVRAAAEAAKQAKVSHFSLISAQGAXXXXXXXXXXXXXXXXXXXXXXXXPLTPIHQDQGTGEEVDH

SEQ ID NO: 17348 - protein, 237 aa, Chlorella protothecoides
ATRLGLPVDGVAFHVGSGAGADAAGAYENAIAVAADAAEVLRAAGHAVSILDIGGGFPGGALGGIAPAINAALEARFPGVEVVAEPGRFFAERIATLATAVFGARERSAGGDARDVDAIATPTVEDPTLHPTTRELFVTDGIYGSMNCMLYDHASPLPRALATDDRARGGLVPTTVFGPTCDGLDTLVRGHPLPAGLGVGSWLVWPDMGAYTICGASAFNGMDAVNVPRFYVWSVKP

SEQ ID NO: 17349 - protein, 471 aa, Chlorella protothecoides
MAGSLAGITGKTCVAPLERAKILFQVCPASRRRAVSCMSSHPPHASLRGTPLPLQHAQTGRLTSGSLAATLAAIYRHEGFSGLFRYAGAPGPMHIMPGRCAQLPANRFPPTRKTPPNRRGNGASVLRIVPYSAIHFTAYEHYRRLLVEHVMAAGPPGRSVPPVWDLAAGAGAGASAVLVTYPLDLVRTRLAYTSEAAGEAPRPRYLNAPGGPSAGPGAQNPAAPWAAATPSAAPTASTVATPAAPSQTLPPKAPPARARLGIGAMLATTLRHEGLRGAYHGVGASMYGILPYAGLKFYVYQSLKQQYHHRAAGASTAAGDGTAAGSTPNPGAAHPRLPVPVMLTFGGLAGLVAQTATYPFDVVRRRMQVEALQLESLHAGMTGRLSTGGLALRSTPQALLLIARVQGWRTLFVGLSINYLKVNRGWESPQALCGGWHLVGWQATTARMGMRSLGPVSTARQGLASRCRFVR

SEQ ID NO: 17350 - protein, 120 aa, Chlorella protothecoides
MGQVDVEEWRTGLWLQALQAQPSVVLEEAAATAAALQRRFCTSRIEAFRFLPAVASMLGTLRSSCLTTVIITNGHSDVQASKLEACGARNLVDYVIIGGDEVAAGRYEKPHRSIYDRWER

SEQ ID NO: 17351 - protein, 90 aa, Chlorella protothecoides
MTITPAFPRSPQHHRACQLAGCTPDQAIMVGDNYICDVVGGQEAGLLATVWINETGKAVPEGAAVMPTFTVSSVVELPALIDQLNAGPPR

SEQ ID NO: 17352 - protein, 269 aa, Chlorella protothecoides
AAALAQQLREAGVPRERVALLGTLLARCGAKERVSDLFQDRTLSSRFAVLAKQHIKESVDGGAGGCPGRAEGGGMGAARMGLSIVRMTGPPARGSRRGMTDAGGGPLCQSWHIKHGGRTPCPPLARTLLCNPSCPSAAIPPPHPLSPLSKGVENVYTQHVPPLVGTLERLAKGKLSEAEYPAADRAAGAGPPPPPPRLIVAFVVGGTTYEEAAAVAGLNAAAAKGEGPLPPGTRVLLGGTGVQNSSSFLRDLAEVAAATPAPQGRLGLR

SEQ ID NO: 17353 - protein, 114 aa, Chlorella protothecoides
MQVIGIVKAHCKLGLTATLVREDHLITDLNFLIGPKLYEANWLDLTRAGHIANVQCAEVWCPMTREFYREYLRPGTPVTQRQLLYVMNPSKLQACQFLVQYHERRWVVASHCLI

SEQ ID NO: 17354 - protein, 177 aa, Chlorella protothecoides
MKRPFIYGATGHQERTRILHAFKHNPEVNTVFLSKVGDNSLDIPEANVLVQISSHAGSRRQEAQRLGRILRKKKARLGVGEAEEFDAFFYTLVSNDTQVGGCVGGRGGEAPEERRRTDMATGRREEGCARWSEVYFTSKRQQFLVDQGYSYKVIPSLLENAGGRTRGAHAEHFVVTL

SEQ ID NO: 17355 - protein, 395 aa, Chlorella protothecoides
MPLLPLSNTSIRAEGPAVQPSPAPTSKRATCQSCRPGQVPQQRSRSSSSSAAQPGFACVPASPRKSSARKGRSSCSSTHMRPGEDTIRPVPTPAVLGNSTYGYNMHGPHSVPILGCRKPLGTVSLLRLCLQDIHVLTGRKYKVMRDAGACSGCQAREGSDVGGFMLPEIMHSPASLSVPVEGDLRRPPSEHGILTEAIQAARDGLTPLLVLFPAPGAARLDGAHVAPGLAARQAGVSNETELEGPLHSLRLGQRGAYTLLALDGTWQQAREMWGASQAHLVPPGTAVCLAPEAIGDPSARLKMEPARGCTTTCEAVAAALRVLEPRGAAVAGGVLDLLAAMTRAQAVWDPAVRARQSGTGGLYATGRARFGVGPGVARCAAAGGDQPPPPDVDVE

SEQ ID NO: 17356 - protein, 287 aa, Chlorella protothecoides
MTAGRSCHLESRDASGFPHAARAPPSPPHMPKSPSAPPPPLAPRFVVRFTNSDVICQIAYATLAGDVVVSSAYSHELPAYGLTTGLTNYAAAYATGLLLARRVLTKFGLDKAYEGNTGDVGEDYNVDAADEGPRPFVALLDTGLKRTSTGSKVFAALKGALDGGLDVPHSDKRFVGYSRETKELDSEVLRKYILGGHVAEYMESLKEEEPEKYERHFSRYVKAGLEAEGLEELYTSVHAAIRADPVQKRKERKAPADKKAWKESKLTYEARKEKLKAKLAELTAADE

SEQ ID NO: 17357 - protein, 507 aa, Chlorella protothecoides
  MOD_RES (141)..(143): Any amino acid
MGAPGRGRGPVGHGASPGARQKHLPRPSSSLPLLGDQFRQVHHALAVAPLVVVPGDDLDHVVAHDHGQRGVDGAADVGHAVVAGHQGLVGHRQDALQVALGGLPEGGVDLLGERLLLRLWWRFGKVAFWGLGWGRRDGCAXXXERLLLRLWWRIGKVAFWGLGWGRRHGCVGQDGGIHTLRGHAVQLALELRQHQGHGLGRAGGGGHDVQRCCACAAQVAVGGVQQPLVASVGVGGGHGALHDAEAVVEHLDKGRQAVGGAGGVGDDVVGVGVLVRIHAHDVGGHVGAFGRRGDDDLLGPRLQVLAGALAVHKHSSPLDHQVHAQLAPGQGQGVAGGDDADVAAVDGEGALARDLDVGVEGAHGGVVLEQVAGLLHAAGVVHGHDLQQRVLAPLHAAQELAADAAEPVDGHLDLALGGGGHARGGAGGGAAGLDRGAGLEGGGAGAAQGVPGQAGVGRTGARHPLHGAGGVGWVGEGGATKGGSPGRACCGHGPVAVLYMRVMLGFG

SEQ ID NO: 17358 - protein, 323 aa, Chlorella protothecoides
MRRSASRLLQLTKFLEAETAVMTPALGWGRAARPAGPPHLGPRASFSSLIHRPPAQPGTTGRLLPTRQMPGFQRLPCRVACSTSSSAAAFPPPNRNLTSSASSWWTSLKSREEEDSLDTRVAPEAPPSTGPTEAHKREMHAVNVAVAVNITIMIAKLGAWFVTSSGYGGKRGWSFCGQGLLIMPDEQESLGHTCLWALTDYEFLAFHLPPTCSALLAETMHSMADVMNQLLLRAGLHLSRRAPTKQHPYGFHKEKYIYALMSAVGIFCLGAGAAVVHGIQSLFDPPQLENMVWSLGGEEAWLVWWGGHVGLDCLAGDEKGERW

SEQ ID NO: 17359 - protein, 95 aa, Chlorella protothecoides
MHPDAATPSPMHGTGKVTTEDLRPQLTPAAEEAAAAWRTSPSPRPPVGRGTSQEAAGPLDLLPDWVGYSALYLVSIAPVLIAVAAIAILFYSSLR

SEQ ID NO: 17360 - protein, 633 aa, Chlorella protothecoides
  MOD_RES (556)..(559): Any amino acid
MSTGGKRLPNSPAATPFRLVMAVGEVPAREEDRLGELWRHLHRCVALSGGTVVLVLRCTGEAHNESGIHAMHRHPPPHRRGGWHQAGVGEDQAPPAARWASLVQAHLASCRPPLTQHPSPLPPYAAGIPNIRWFGMEGDYTVMVIDLLGPSLEDLFNFCNRKFSLKTVLMLADQMVGRGAFVGLAVCEKPLHRPGLCLRCGSLHALSHRVPAQQVVHPPRHQARQFPDGAGAPCKPGVGAWCLDWVGGMGSGLWRILGLDVHVTGYFHHSPALSSSAALRSDQPSHKATHTPSDPSPDTHAPPLSPLRPPSHQVYMIDFGLAKKYRDPKSHIHIPYRENKNLTGTARYASINTHLGIEQSRRDDLESLGYVLMYFLRGMLPWQGMKAATKKAKYDKISDRKLATPTETLCRGFPTEFPVYFQYVRSLRFDDKPDYSYLRKLFRDLFVREGGRFEVFWGWPGGRKESVVWEKGQSGDLSRGYRWGLGSSKGAGARHAWNEANKSRRPQVSHARALHWLDSSRWACPCGTHAEPVHERGCAPGTFPPTPTSQPRLPPXXXXCLERGQQAAAASSIARSRPALVGLQPMGLPLRHPRRACSRAWLRTGHTSPPPPLLNQGSPLSVTPVPSHVPRNT

SEQ ID NO: 17361 - protein, 198 aa, Chlorella protothecoides
MSVDEERAQLEAEAESLADAEGGEAEQRLEDIYERLEAMESEMAETRAASILHGLGFDKKMQAKPTRDFSGGWRMRIALARALFVEPTFLILDEPTNHLDLEACVWLEETLKKWKRILLLVSHSQDFLNGVCTNIILMQHKQLKYYAGGNASSGVCHPPLCSRHVQSGATPTPCPALSVLEHPPFPRIFLTLPACTLP

SEQ ID NO: 17362 - protein, 139 aa, Chlorella protothecoides
MWVLTCTEAGAWGGTLCVFLYVCTDIDAAYIHLLTEPLPPLVHRVSDRKKKQAALKKGKVAGKGSSATLASESSDAENAFGSTTQLARDVEDLELNDRSCTGILTSHPQSRDIHFQSFTLLFHGHEILTDADLELNYGR

SEQ ID NO: 17363 - protein, 570 aa, Chlorella protothecoides
MDGKGRVCVLGLRSLRSEGPCCDKSAHGHHSIPDSLIPIPAHSVPLLQLDRKLLCRDWMSQLRALQAGVAAAGGDPASYATALERAAATGVDAERSLLGGLKGQARVWDRLARAYEARKCHVAEAAQRLARAADYEAPALKRGMARAQQQLADLEKRKAEAHRAGARAEQAPLCPDLQAEGGIWGKAGGAGQVLAWHAGEVWFAGQAHLGTAEAMLAPCLVTACRLGQECKRLDISPTQDATAELRALASRRLPAALQACVAAMVTEEVHASVQCYAEFIAADDSAAAAEHSLPVLVEVLAGTTEAPLLPSIPSTGAQGAAEGDDTAGGAPEAEAVGVDDLDLSALASAGASGAAEDAGPGLISWDIGTEAGGDDAPQDAAGSPRPAGGDGGEVDPGIDWGLEVEGGEAAGAEEGEAVLQDLLTSANVFEGSDPVVQDAGGTLAGSVSKLECTPRPDLRTRISPHHLQRLGLDGAYRAALADDLHELRAFLTARRGELRAGNVGATLGAATATGEEAAAWLATVERALGALGSPDLQHLLLLHGRPQYLARQAAALEGKRAAGGKLHRWL

SEQ ID NO: 17364 - protein, 274 aa, Chlorella protothecoides
MATWLDATAFLERGCGALHPEELVHGEDFSLYEAMLAIQIGDTKMDIGLRREQGPSLAEELASGHAPLALSLATLEQLGMQLMQAEATWHLGSMLPTTVFSSLYMLDIPRCRQDSEGWGKGFTHSRPPPHRRCHSRRTFAAHTLVPTGSRLPVASWQWKASGCKLDTALPEPPAPPQAQDEDISIHTFGMRILGAPGTTALPQACAALRSAVEDLGSDAPGLAAHLSFRLHCLQVPPGGYGVRVPWSLHGCQPVRGPHRMLVSAQLLTPSKCAC

SEQ ID NO: 17365 - protein, 165 aa, Chlorella protothecoides
MGSWGGAGGHGGRSQGVSLQEQVQQWGGFASQNASDHGQSPDQSGHWLGGGTQRPYTVALLLADALALPPVLEAEAWELADADLLPYADEEALAEAEALEEAEALEEAEALEEADALAEAEALLDALAVADALDVADPFPNTEDIAVAEACGVEVPLGTVVSLAC

SEQ ID NO: 17366 - protein, 109 aa, Chlorella protothecoides
MLAANADGIDAGVAQLELALGCLEAVSAAASSDAATDTAADGSCGPRSLGFVPGINVRHMGLAPPRALAWVGARPAAAHWRGVLRALCDAARAVRAVRTWPQLRAVGAA

SEQ ID NO: 17367 - protein, 355 aa, Chlorella protothecoides
MGFREGSGWVGARIWQWQGHEEAQCHHSCKFRSRETAVVRLCLRYGPPLLHACVERLTSLTLTPSPGTPLPPSRVSPSLVVSDATSLPGHSLAATPVGRGAEGPVGTLQDSHRGSKFPHSIRAVCDSAQALMGERGEMPWSCEAALENPHLDSNCSNVPRSRPGPTLGGELGGSREAIVGPGVGQGVQAFAGGPAVHAVALHQAHENDLGDEGGHDGLGVHQGGVAQVVQAAGLEDLGAGLEPNGLAEGGGAVALQQLGGDDAQGAQQGPAGVDHLDLAVAGKGLGVGGQTGGVPAVVTGVLACQCGGGGGAGEGEKGSGWGVECDAATRFSKIELQELRGQAGTRSWQCHPIAQ

SEQ ID NO: 17368 - protein, 255 aa, Chlorella protothecoides
  MOD_RES (185)..(188): Any amino acid
MLSRLGVSVAVSAPRPLPSGLAAGGLPQDQNSLHPLVPWSARIGMYFTTYLPASHPLLHSTLSTNPIAISGRMLVDLAAVVPDGIICFFVSYSYMDSIVSRWNDMGILSALMTHKLVFIETVDVVETTLALDNYRRACDCGRGAIFFRCMTVVQGVKWAAPMAKAARRSGLCGPRGLGGNGPCSXXXXAAPMAKAARPSGLCGPRGLGGNGPCSCTSLLYACCPGPARLLPRSPFQSSLTPMQCGEGQGGGGHRL

SEQ ID NO: 17369 - protein, 332 aa, Chlorella protothecoides
  MOD_RES (67)..(70): Any amino acid
  MOD_RES (276)..(279): Any amino acid
MPRGATWLASGPRSSASSPQTPTGSSGSTSAWCRWVGMGGHRDGSRVAVSRHACSHLPPDCRPLLRXXXXWDGSRVAVSRHACSCLPPDCRPLLSNSLCPASSQGLASQGALRGGGESEQWLANPALPADILQEAVPGNIRRAGGWPGGDPRGCQVPPGCLRVTHNDPTSRLPTRLRALPRLPPALPLLPAHAAQRQPGGVRHPHLLPHPPPERERKSQWVIAVLTGEWWPCLAMEATLLCGTPTSRSTADTQGRPPPLPPLLCVFAPLPQVVAIXXXXPWRPHSSVGHPPHARQQTPSAGHHPDHPFFSFSPLLPRWLPLRARRCASATTG

SEQ ID NO: 17370 - protein, 172 aa, Chlorella protothecoides
MGEIVRRALARLGQHAGLFGRADALPAALLTPGSLGSAAVAAMDEDESADLAAAGAALATLGVARPTRRQRRVARALARLAALRSARLSAAALCALLRHLGWDERSRVVAAMDGSVFCRYAGYRAMMRDTLERLLGREAAAALELREARDGSVRGAAYLAAAASRYDHAPRA

SEQ ID NO: 17371 - protein, 334 aa, Chlorella protothecoides
  MOD_RES (24)..(27): Any amino acid
MCCHLFEMSSGIPQAATLDRQRSXXXXHWVLSGKKTQWSLRNGELVGIPTILYTFPLHWCLRTSMAGLAQYSRALIKMFAPQKLLGVKTQTHPRDLCLQFGCVRLERPVAAALATFKQRYVAQVAIAQRGTVALNKPVFVAAIFLAVAQKNKVKVDKRRLLEPLGVLPTEFAAAATAVASLMPELSTGSSAKRRRKPEGAEDEAADGSYASHSPHAGAWLLRLQRDWRSSAAVTKRCWRMAPWGAGCMPASSRSGCGVKAGLDRVLWTSGGAPGCWNAMVDVLEIGTLRTHPPAPAKRVAVLRSMMPGRRLCWSEGQRRPRPTIRPVAPCARPR

SEQ ID NO: 17372 - protein, 360 aa, Chlorella protothecoides
MLLPCRLPPAQKALMELTLGDASRTLAAQNPVPSAHRAHARPSKSCIGKSHVFRGFVLHRSVADADSASQHGDIHLNRCVEPRTLNTAHASEAKELLFNLFHHITRPMCVFSAQAAGARGGRVRNFIPYACVACHASPGVTQGVEPASAAMGEVNAERREDTGLTASNSGISIEDQSMLARVALSSGVPVKWSDLQPVVHAAIDAVLSRFAERGGTQVGPPPPMLDGSDLETFRKRLHALLDVMDGPPFTMQRLAELLLGPEKQYSSLPKLPEFIPLPSPLQASALEKLLMVVTSAPVLEAADADVQPLPPVHPAIIARINDNPPSHYVVQISDGSLDVSMDTEEDVHVPEAVNAEAVKE

SEQ ID NO: 17373 - protein, 197 aa, Chlorella protothecoides
MVPGEAAADLYHHTFLCQGEEQDIREWPIPKECFNTDSGKLLEFVADCVEEMLVEHPPASGALPVLGFCFSFGFNQTALNNGVLVRWTKGFYGKGLIGEDIVGALQCVFRARGRAVEIPAILNDTVATLIALRYAEPATQLGIILGTGTNAAYQERIDRSGIVEQWGERGFHQGTQDPPLSLKPSTHGGWTHEQQPS

SEQ ID NO: 17374 - protein, 101 aa, Chlorella protothecoides
MAYLLAGAAGLFYLLYKGKREAGDRSLLMLRSWVARMRLASFDLRSPSPSLHAQYQDLFDVSTQRLRDVQRDLILQVEAGLRGDKSGLLMLPTFVDILPTG

SEQ ID NO: 17375 - protein, 283 aa, Chlorella protothecoides
MPRQVARHAGALLAARDALCALDLASARAAHARWLGAQRPTFGAGVELEGMRHPALLGVSLGHASGGGEAGAEGARGADKGAATRSAGAIAAAAASDANGAATRSDGAIAAAAASDADAAPNGCEEASSASPTPSLPPPPVPIGLHIPPASRVAAITGPNTGGKTAALKTLGLACLMARAGLFLPAGPGPRLPFFEAVLADVGDGQGLGAGLSTFSAHMRRVAGACAGAGPSSLVLLDELGSGTEPSEGAAIATATLTWLAGRAGLTLVTTHHTAVRVSREGC

SEQ ID NO: 17376 - protein, 151 aa, Chlorella protothecoides
MLQCVTHNTRMGAVTPGARHHGMHRMAASSMPPQGAAARVDRAPWANAGWHGARPHHAGRTPVVRSAAQVTSEGTALSALKSSPLTKHDLVLDSLAMLGWQEVCVQVGRFCRTPMGMEAAHGPHGLALGSSREVSERLLRETEQALHLTTP

SEQ ID NO: 17377 - protein, 322 aa, Chlorella protothecoides
MGMPSVLPSDVRGSWAAHSLLQPLDITDRPPLLHTFQMPTGTGKTITLLSLITSYQLAHPETGKLIYCTRTVPEMEKVMVCVGGAGRPMQRQLPRRDRGSDPGVMACLLLQVYSTLALRLPPPTLFFLPSHPPQVLAEVKDLIEYRSRYFTDAPAPKLLALGLSSRKNLCIHPRVAEEGSRESVDARCMRLTASWVRERARGAARPGAETTDAGAAAAVPAAVPDIELCEFFEGLEGAGADGRLDAGVYTMHDLRALGRKRRWCPYFLARHMVAYANVVVWNYQYLLDPKVAAMVSREMERECIVVFDEAHNIDNVCIEALR

SEQ ID NO: 17378 - protein, 199 aa, Chlorella protothecoides
MGRVEGAGQKQKHAEIRVRRGRDLPREPPAPWPGPRPNIARTAPHIDPSFVHPNTNISQNLIPARLEYLRETFQIKESDFLAFDAVRQAAQCVGRVIRSKADYGLMVFADKRYQRHDKRDKLPGWISSQLRDAHLNLSTDMLLCIAREFMRAMAQPFDGGSAEGASLLSEAAVNALDTAGAGPMGQGPWSWDDPGCLVL

SEQ ID NO: 17379 - protein, 293 aa, Chlorella protothecoides
  MOD_RES (149)..(152): Any amino acid
MHVAFWVYQSMRTLAVAACPSLPHSHDHNPHQAKEEELAEARAALEAQQAEFEASATREIQEREGLLQEWQSRLQAEQRELETEARDVRAAAAAREESVLERERASLANARELEERVAEAEARDRKAARVGCGGWRWCEGSLGRAAECXXXXATERPRGWVAEGGVGVRAVWVGLLSAPAAASSTRCIPCQAVVAAGAQMTFDNANHLKPRSSWAPPPCDLVNPPLTTTLQALKARREGVEEGEARLKARRAELDEREAAAAQTRARLEGLERELSRREREVEHAQRQVGRME

SEQ ID NO: 17380 - protein, 106 aa, Chlorella protothecoides
MRLMKHSFLFTLWGQAVARSVTRDSGHAQEEAKRLASQRAEAERQAAEVRREREAVRLAQAELAEERTLMEARSTKLEAQTREARQENQERERAALEAQAAQLKAE

SEQ ID NO: 17381 - protein, 1044 aa, Chlorella protothecoides
  MOD_RES (83)..(85): Any amino acid
  MOD_RES (266)..(269): Any amino acid
  MOD_RES (660)..(662): Any amino acid
MERVEVMHRWMKDGGRSADAWHRLMCRPACANSTSCADQPVTRGGEPASPAPSQASHLDPHIIILPLAPFLASPDVPAGLHGXXXCTWILTPSYSPLPLSLSLQMYLPDFMVLALGLMETGLRSLPGAAGDAAPAAPPEERASSEEGRGARTLRTQGMRLLAEMIELSEAGAGGLAFLWPRLMAAAEGWLPRLVPEAAGQEPPALMELAAVLAQRPDLAALLADAEWRAEGPGVEAAPAVDAEDPDDHTVDGKHHSRQNSYVLTPXXXXGGAVAGGGAGQLLRADPKARGLGGRRPRRLAPAGAGGRGARQPRLLPRRPRCRAGRRRGAGRPARLRAGGAADAPPGPAAGRAAGPHRGRLAAADGAGGKPPPALRRGRRRTREARVPRRRGSAGPGRAGAGPAGGGGAGGRDPGAGLPAHRRAAAHAGGARREADRGAAEAGGPRTGRAGSALAALRRDSGRRGLGCRADPDAGASAAAPTVAEGSDLLRRVLAALGPLAGRPEPTLARVLADAAAACAGALGCPAHIAAARTLVELASLDPAGVDDPDYDRRLAAFLSLKARVWRELAEGEGVDAVPASLVLHRAASDLRNAADLGLRTAAAECLDQFLIAVVEVAGGDATAEDTAGAKDTCRNADDTAIPSIPAPPASTSPHPLVLAXXXSCRCGRPRLRPPLGRLFEPQGPRLARAGGGQRINLAAPAGAGRAARALPLLEAGVDGRVAGGAVGAPGADAHAGAGAATPVPGPGRAGQPGGPGGRLLAQCRAHPAAPARAGAGAPGARAARTRRAVHAGPGRHAGRAGAPPPGDGRGGRRLGHGHHAGRGRARAQGGRRGGHRQRDRRGGWRAGRAGRGPALDRVLAGAGAGAARAAPPRRRPGRQARGARRLLPAGQLPLSGWGGGRGGSKRHGGHPPLPGQVRRQGLWKEVRDWEGDTGGCWGGQGWKTCSYAAHTTAPPGCGINIASHPRPAQAPGGQLRDGAGPGGAGGGQGSAPAAGGRGARRVAARAAECGKPAVQTAAAHPRRRARCAGLHGGGAGARLPPLCH

SEQ ID NO: 17382 - protein, 556 aa, Chlorella protothecoides
  MOD_RES (36)..(38): Any amino acid
  MOD_RES (197)..(200): Any amino acid
  MOD_RES (219)..(221): Any amino acid
  MOD_RES (240)..(243): Any amino acid
  MOD_RES (296)..(307): Any amino acid
MEIVALACVAACWVTLSCSISPQNTVKPTNCTGGLXXXRRHHGEQCEGGVACPLRGFVAHVRGYTIHAVVEGLAAAGAPAGSLDPCVPMLLPIVEADMWGELVDAREATHFLGAYKEAKRCRAQELYALMWRLAGFETHAGELLALVHQHLDDAGGAKGRARISSLLAALVRGTLANAGADARALCVFVYATLEAGXXXXGCSCRAYQRPGAACAHPPXXXGVQLPGTPAAWRRLRAPTXXXXARWLMPAPTRALCASLSTPRWRRGWRARRARAPQPRPPRAWAGRGRWRRQEMXXXXXXXXXXXXPAPHRAHRGGGAGRAGERAAPGRHTPSVSLALATLGLLLQSALPGMEAAVPTAYEVGWWCFSLGICMPSGEEGGSARSTGGVKPLASVNPGWPGWPGSDAWPDPFSSLHQNSGGDPTAERLPWDRHPPGPGVLPAAGGPAARQLHLPAATRRPAAAAGHPPGRPGGQRGRRHLRPAQGRAGAAPGGAPGLRRHASPGAADGAQPGRVGTRGQRCLPPAVPPGLPVGHAAPGRPPAILADQPHLPARDGE

SEQ ID NO: 17383 - protein, 351 aa, Chlorella protothecoides
PVLGAGGEPSDALPSLLGIEVRGTGAQRAQHGGLGREGQVAIGRLGTLLEHGAGVPGWLAATLAAGLLGTLRVRFGPLWNGAAGALGQALRRHAPEVWPVALEELRHTQREFLEGGPSDRWAAAGAATTAGETAPETSTPLRRRFSAACVPEDAPGTDAATRLTHILRALAASEHALVEARARDWLPLFLAFSSAPVVLRRRGGEDDPAGEAEVAEELEDAADDEPSHEEARGGEDGDYVMVARPQAEAPASQAQKAPASQAQKTDESGRSANGKAGHPVDAAAPAPGPRQAMSVKEWRAGLREWLALLGTLRGIRGLHRADDLLQGIVVHVRDSDPAVQQAALLCLKVRE

SEQ ID NO: 17384 - protein, 139 aa, Chlorella protothecoides
FFDARGISREALERNGVAAETLHVPGGAGEAAVIAFPYHRAGRLVNVKYRTLDKRFWQVRGAEKVLYGLDQLVFDGPAGGDVVIVEGEMDKLAMESAGLGNVVSVPDGAPARVRDGDLPPAKDDTKFSYLWNCKQYLDQ

SEQ ID NO: 17385 - protein, 186 aa, Chlorella protothecoides
  MOD_RES (43)..(46): Any amino acid
MQLLPLAPTPWLVLGIELLQGATFALGWTAGCVYVKRTAPRHXXXXWASSSYRAPPSPSAGRRGACTSSARLPATQGPPPSRQTSIPASHSGTFSAHILPSCDPLQSVFSGLYTGIGAGVGALLAGGLYGPMGGAGVFGLGAGMLAVGWGAALCVLWWLRHTRTAHSSAYVRLEAELAPPRGLASP

SEQ ID NO: 17386 - protein, 497 aa, Chlorella protothecoides
MTSRASAQAGQQHLLAERVVQLCRLKGEHEGGVAGHVNPLLHPKVVQRPVLLLGHQQVHLLCDRDDTAPDTRRTAPAQNATSQEHVLPATPPPTLASQCPPSQVVPPSRPGPVPPPPHQPVVKLEVVARGPAHQRLGDDRGGADAGLAVVGVQADVGGPDHDKGAGSCQPHLAHEEAAGGKVHDVAHEVHDEGRAGPGGDVLHSPRLLHAPSVEQHHAVGQLPGLLLVVGDHDGGHPDLAHDVAQRALQRLAHQRVQRAEGLVQEQQARAAGQRAGQRHALALPAGQLRRVARTPRQRQELGHARLDVDAQAAHARAERDVLRHRHVLEQRVALEGEPHVAVLDGALRHVHAVERDGARGGRLQPRDQAQQRGLAGAGGAQQRGDRARRHLHVHVLHRAEQAAVSVVVLAHAAHRHVSALDVEGGGGGGVGQGHGRRGGAGAVRLQRLERRGPDRAGGRGTPTTSLGGWREGGRVRLGWVEGDCEGGPGRKWWMQGG

SEQ ID NO: 17387 - protein, 409 aa, Chlorella protothecoides
MKALTSPAHCWAPSLKAPLHTCPPRVAPVSGPGDRSSGWDGEAGRRPCERLRSTNTLSLGTRGRRRRAPPARSVGPPALESLESDGSRSPPPPVPLPHPPAASSFHVQGTHVSVRGMRKHYHTDRGLFRAVQDVDVEVAPGTITALLGPSGSGKTTLLRLIAGLETPTAGAIAFDGVDMTQRSIQDRDVGFTFQGYALFKHMTVAENIAFGPRVRRLRIDVQARLSGGQRQRVALARALACSPRLLLLDEPFGALDPLVRKALQRSLRDIVREIGVTTIMVTHDQEEAWELADSVVLFNAGRVEQAGRMEDIAARPRSPFVMNFVGDVMHLPAGCLFVRKMGLTTARPFVMVRPSDVSLHADYRQPRICPATVIAKTLVGWTARYYLQFDDGLVRGGGDWSRATRGHDL

SEQ ID NO: 17388 - protein, 310 aa, Chlorella protothecoides
  MOD_RES (88)..(91): Any amino acid
  MOD_RES (115)..(118): Any amino acid
AWGRIIVSVQGFVSVDKWLEYRDPGADRSYQLLLPPQASTSCTTCKPWSGGQKCLRLSSRITSRPSASRPSPATDSRFLLPALPANPXXXXGEAMRAGAPSLYLDPGQAYFLDYXXXXGRPCVQGRHVSIVNGNGMPSLLVLRPVHNSSQLSTLNPGQAYFLDYFTDSTPGVGGIDWDLWFYQPGECVRIDPGSLRCAIRQVTGHARFESHVNQCNCWTGRLQASADNSCNHLQAPTAIPTPCLHPFIPGMPPNVNSYDASLAESAYALAQSWHTSDLMGLGTGSTAGPAKASTTDLDGWSASQVPLLET

SEQ ID NO: 17389 - protein, 413 aa, Chlorella protothecoides
MFPCNECAKLMIQAGIAEVVFHEDKGTAAGGSGPAADNAQPAPGSIRWGQGPELPRPDDLLTTGPSETHAIVFHTHFRSRSQQYAASKKLMAMAGVHVRQHRFHRSSRRTKARDGGHTGSQWQGNEKESPACRAAMQRCGRQLSGVPSDSSGHLQVCGDHLGGNGMVHLAMGGKGVEGGLAALRVGVERTGPELPRPDDLLMPGPSEPHAIGNEKESLARRAAMQRCGRQLPRVPSDSSGHLQGPKDPHPRTHLHAALLREEGQGLWEDCQVTCKEWRGPSTCGRECPAWALRSHLRLGRQPPLVAKRPAPSHGPHLVRYVGSPPPTTWPRPPHPPGHHHTCFDAERVPGAAQLGVLGVIEVVQLLHAPCGGGGEGLHAPQLPQFVQEGHFLWTPGGNDRGDPHLSMPDAGEN

SEQ ID NO: 17390 - protein, 321 aa, Chlorella protothecoides
MQPRFETPARWIESEARSRTWARACKIGGLSMRSSSSLSIWHAHIQPQKRSRTRGRRSGGCCGVVVPDVLVSAEPVHAAVETALCTFHRVWTRCQTGFDAGLSRAMPGESLRHEATLRVGVEKVSGQGDEGAQCLPIINQARKLPPGCGGGQRPGDWKPKAPAGCWGVLDDYPLHCHWLPCLHTNISLGLAGPQQHSGIVRYPRSVPFTASTPPLSLPSPQVGACIVDRQNVICGIGYNGFPRGCPDAQLPWSKAAESGDLLDTKYPYVCHAEMNALLNKNGASVSGAVRGGRAPGVVVIMGASVWRRPRGTSPPTPLEVW

SEQ ID NO: 17391 - protein, 167 aa, Chlorella protothecoides
MREQNVIHQFSHLAGASPHLRFFGNLRLGREVQLDELRRQYHAVVLAYGAESDRSLGIPGEAAPGVYSAREFVWWYNGHPSQAGLPIDLRSVQSVAVVGLGNVALDCARVLLQPPERLASTDIAEHALRTLRRSAVTDVHVIGRRGPVQVGGGNGAKESWIFLGHEP

SEQ ID NO: 17392 - protein, 178 aa, Chlorella protothecoides
MCQGRPTPVYPHPPHPNGLSPSICPPLILSQVLKSIGYRSIPVPGLPFDAERGVVPNRMGQVLESAAADAPAVPGLFVVGWLSRGPSGIIGTNLADAEQTVEGMVRAQTDWPTPERRAGLERALAPESIAVPWAGWARIDAAEVAAGEAVGKPREKMTSVERMLACAVAGAASAPGSP

SEQ ID NO: 17393 - protein, 114 aa, Chlorella protothecoides
MGGGAPVSHPPRPRAPPHDATTLHTGIDLDEARRKREDNIVQLRKDRRDENLQKKRMVSTVAVQTGELETTRSTPSGVQQRVRGRGEPASCTGVRDVFMCEGECQECGSACGTA

SEQ ID NO: 17394 - protein, 1199 aa, Chlorella protothecoides
  MOD_RES (146)..(162): Any amino acid
  MOD_RES (214)..(217): Any amino acid
  MOD_RES (1120)..(1155): Any amino acid
MMLFSRRPAKVVLVSACCVNLMSSCFVSDTIAVWHIEVRSTRLGARLDGEFRWQPIVVPASAFVVAPCMDCMLCSLTPPPTHTSRERPRALTSPFHSLYSILDIYDEEQETSSVPKGLTLVVHLVNMLVGTLCLALVLARMGPLAXXXXXXXXXXXXXXXXXTLLAPQLLRVGSMGWLGKPGPLLAVTGSNTWKTMIPVYFMSIPLLGHFCLLXXXXDSMSDVWCSYGFQRCKDGPRARLLDVIISQPVFPRQSPVEAAAQQLMEEQHGSQRALLEERVKEMVEESLAARGIGPRARRLSQALPGWYDVGPGTRFLLEAAASVGLEGDDGSGTLGAVTPAAGAQPAEVGLAAAGAQLDAADEGREAGSLDPEPSEVQAPPLAIPPPSPDPPVPPEAHADKEPTVVIDEAPPQQPWLARAPLWLYVLIGSSGLLVLLVHLVHCTLSMLCPQPQPEQLGKGKGDPEAGHTAPGEQFLIRVGPPPEAPVSAAAAPPPGPQKGVLQTWPQQGANHPGAWGQHPQDLPSPYSSPPSMRSAVSPTGLRWEQPPVHALCCVTHGSQVGGVWPAGFDVGVCRLLTLWASSPGPPALHPGVHNAGFLMCTIPASTAPSCRPPALPSTSSPHNTHTSSPQAGDALHPHGRHLCAPEGPERHGVGHQPLSLRLRRLSQPHLPGGQQPLRRWVLVRAGEGNLWCRCVAIQGGATSLREASSSTTPAAVSPFLRDPQKRAEASLGSGDSPGTGVFSEDSSPAASPLRKASHDFALGTTVSRADSGAPASPASQESVATLHPAASIQPHEVAAAHAVLAADGEAWPRPGSPPAPDPAGAAGVGGEAETLGQGGASEDVAEPVGAVPGMPGSTPPASPSRPAPPPPPRPGAPTELLSAEQLAAEVRVLSLLGSGSTGSVYAGTWRGAPVAVKRIHPALAAAPGAALALAREVGVLSGLAPHPCIVPNLAACLAPGHLCLVQELAAGGSLHAKLHDQGRRPQYGLLLALAADLARGMAHCHAAHPPVVHRDLKSHNVLLAGEGDGAGGGGAIGPATSSPTPAARIADFGLARALPRDTACGADAADAAPEPGLGTAAYMAPEAFSGGPVAAPADVWAWALVVHEMLGGRQPWAELXXXXXXXXXXXXXXXXXXXXXXXXXXXXXXXXXXXXGAAPPRHAPGHAARTGQAAARVLAPRARAEAHQHPGAGARRGPA

SEQ ID NO: 17395 - protein, 532 aa, Chlorella protothecoides
  MOD_RES (38)..(41): Any amino acid
  MOD_RES (70)..(73): Any amino acid
  MOD_RES (237)..(240): Any amino acid
MPLPPERAGADDGADAPPTPSQRHHAASLPVHTRPTIXXXXVCVTKRHVSKNLTPAGIPAVQRTGPFCCXXXXGGAAPPRACRRRLSEPGRMTGRTPTPPLPRGTARLPCPCTLGQRWRHVPPPPPPCVRTPPALAPKPVIQGFFQACLCTFSVCVTKRHVSRNFTPAGSPAVQRTGPGCCRSTLPIRCTGDRPGTGARAEGLLTRAPCCPHHDPNNAKPSLPTSNPLNIQAFIYSXXXXDPNNAKPSLPASNPFNIQAFIYSTMNDKIALVFLALAVSCAGAQAAVTSENLEAIPASQFVYTPPTPSPNALSVGGVSQRRTAREWPALEGLGISQTSFTLEPCAVRSPHIHQNAAGLLYAINGAPGEGAALHDQPSVCPDGTWIRIILAPPPKCRRLKPTTSHPPAAESLMVGFVQENGTAVENTITSGTSAVFPQGLVHYQYNTGCSPATYTITYNDAQGATVNIVPALVNLPQAVVMASLNISEMAYAELVLGAPTTNFIAEADECMAKCMVKSQSTQGRRLLGAQPEM

SEQ ID NO: 17396 - protein, 50 aa, Chlorella protothecoides
MREFFGYCFTWACCPLDGAICCDDHQHCCPQNLPVCDTLAGRCLAAAGVL

SEQ ID NO: 17397 - protein, 183 aa, Chlorella protothecoides
MERALTSILALGLGITIGRELRRWISAPGTEEDPLSVVSDSARVIAGGESGFPCHPAAWRALEAEEPEPLVYDEFAVALAGPSALASARACAQPFTGAAGPGKPHRARKLCLSNVTARVWWFDEQIRAALSSGTNAPRQVVVLGSGMDTRPWRCSDFPPGTQDGGCGKRDLESAGGLACDHSL

SEQ ID NO: 17398 - protein, 159 aa, Chlorella protothecoides
  MOD_RES (31)..(33): Any amino acid
MMAAATLAAAPPGRPRRPPWRCGIASCRAAXXXRAARTPPPASVEVRYRLLPRGERVVLQPRAAAFQAEVGPGMREALEAALGARSTLTEGDWVRVGQHLLRVRELHPDRQVSVLDAELEADIAASLETEERIGREESEARRRLETLAAEALEAAREAE

SEQ ID NO: 17399 - protein, 483 aa, Chlorella protothecoides
MPPLQGMTFTVLGLGDSNYTQFCRVPRALRSQVLALGAGEFHPGKDADEVDGLEDVVEAWLDQMLPALKRACLPTVAAEAASEGLKETVPPEHAASTKPVPLPECRIEVEWLTDRSATQAVLDKEAAGATAEELGHRDPEGLYSPEQPFHAPLIAARWLTTSAAGDRRVLHCELGVEGSGARTHPGDSLGVKPANPPALVSALAARLGLEASAVFDVRPRPGVATQHLLPHLHTPCSIGHALTESVDIAAPPRKSLLRLLAEHCAGEEARQTLLRWTSRAGRDEYAKVTPRGRDAGWMQRPARHSHARAPPSYTSACLAVKPALQQHSPPPPPGGSGGAALAAGPADAVRLPPSPCAIAGRAAGPGPTPLLHRQCGGCAARQGETKQRAARAMNLGLVAMALSIVRFTKACGTEHEGVATTWLERKAAPLVQGSWKGAEGPTTAVPRIPIYFRRCVVRLLSRMAGRGGLMGSTWQLTALLWMC

SEQ ID NO: 17400 - protein, 282 aa, Chlorella protothecoides
MASVLVSAGEVEYVRRGFEAGVRGDGRGPLDFRQIEIETGVIGQATGSARVRLGTTDVLVGVKARHPLGWAEVGPPAEGAPNQGRISFATEFSPIASPSFQGRGGEELASDLTAMLQRTFFRSPVSGSELRGVVEGYKWGWCSGLVLASHVEGYCDECWKPSPDQGVREASNPPPHPPHGLAMPCRGDAPQPPPPACTLRRGRPGPHHPQHRVWQVLLGGVCRCPGPRCRGRCGRHRLHCGQGAAGAHDREGPGLSSLPATAHRHRGRCRMCAQCHLTPPPL

SEQ ID NO: 17401 - protein, 110 aa, Chlorella protothecoides
MVSAKGRALDALGAQKGTGPGEGARKHPLHVASWHALTADLSGPDWVQALAACGFDPGQPTLWIVEGLFMYLEPRDGTGLLHTMQGELVRWSVGTGRGWEAGAGAGTCCQ

SEQ ID NO: 17402 - protein, 262 aa, Chlorella protothecoides
MRQPPTTAQPASVKGSAGHGPGPGSPEPESDTSSTPAPSPAAAPQPPDQASRDTTASPAGPAPSKLDGGGAAPKAAAPPAAAGGAAILARLRAQRAGGRGGGAAGAAAGGGVSAPKPVTVLYGSQTGTAQEIAQNIGGRARELGLVAKGTGRLRSRKVPDLALLNGHLKGRHCSQARAKKEGLLDYASNNACQDPLVAALDEFGLDALTPATVPVLVLVSSSTGDGDPPDNAARFYGQIKKRGQQPDRLKVGVQAWGRQDHV

SEQ ID NO: 17403 - protein, 159 aa, Chlorella protothecoides
MAKCSPYTPSQTTSSGFLQDRRHRLAAADLGFEAGPSWLFFGCRHPDQDYLYKQELEEFEADGTLSRLSVAFSRQQARKVYVQHLVERHAHELAALLAHPAASIFVCGDGAGMAAGVNEALARVLTGPGAFASGADWKAGAAALAAMAREGRYVRDIWS

SEQ ID NO: 17404 - protein, 144 aa, Chlorella protothecoides
MDQHGLPPFAEEGMFQTRPPNNNPPAPRFPGHSAPGSRLVTHNVTQELVDGVQDGSITEYPPYSQDLVRTWHYGFPAPLEPALAELGWRVTTKASRAQIARSIFGAGSDEELEGCVEFDARLGCAMDRYSVFVAATVADVKPRT

SEQ ID NO: 17405 - protein, 135 aa, Chlorella protothecoides
MVAGEDPEDEPDYEIDDDPSVSVPLDTRYVPLTLTVSQVGVTPALDLDLLEEASAAAALSVGVDAEGRVVGTTQRGAGGISPETLLVRHQKLDTAPQDPSTLAAQDMLDIAEQRGIALHAAIDAHLTRQRANGMA

SEQ ID NO: 17406 - protein, 266 aa, Chlorella protothecoides
MPQCRPQPPWTPSSRPPPPPPTHPRFMEEGLRELMLAPGTRPGDPPGVVGSRNLSDVVSDLKAQVAANTRGIALVRSLIGEYTLPVVGAYMAHIQAAAEAAVRDMLRAFAATQGLGEGGVVTAHDSMDDGTPICLAVRVDAAAGSAVFDFTGTGAQVWGNTNAPPAVTASAIIYALRCMVTRDIPLNHGCMAPIQVVIPPRSLLHPSPEAGVVGGNVLTSQRVTDVVLKAFQAAAASQVGLGCCFEGMGFVMKRGAHRRAQGEGEA

SEQ ID NO: 17407 - protein, 187 aa, Chlorella protothecoides
  MOD_RES (158)..(161): Any amino acid
MDRQVAAGTGGSVSSEADCHHELCDTVPSGLTPTRPSPPHPHSVDEVPTPDAVVSAYFEIGGRQDTPAFLLGRLAPGQRVPGPAILLDDISTIVVEPGCAAFLTAAGDVRISIGDEAVGAGGKQGLSLEADPIQLAVFSHRWVLERGVGEVLGFPAGXXXXFSHRWVLERGMGEIVGFPAGSGRIVL

SEQ ID NO: 17408 - protein, 139 aa, Chlorella protothecoides
MKGHDVSRHVLACFGGAGGQHACAIAVALGIRTVFVHRYSGILSAVGIGLAQVVKEAQVACCGGVDWVAMHGSRFFGWVNGVEELRKKRWETCVPVSVHSRSCGGGGGVGRGRAALEWDHSLAWHSASDATPLVLCLST

SEQ ID NO: 17409 - protein, 475 aa, Chlorella protothecoides
MAGSSASFLRRVDPLRPGVGASPLAEVRRVWLGGRGREERGGLWQKSHCPAGFGGAAPPSAAGGPPGGGFPGASRAPNASRVVGGDLAYHSALGAAQLLGGSGTPGQTADALTKLLARRSRSELYALLAAVQELAGADRAAARDLLASNPALAKALFQSQVILGYVSNPRGDVAPKGIAPPGTMPGRGFAGAAHDAPPAQYRHADPTPAVQYQGGTGGGYAAPSGGYAQGTVPAGLAPPAAGYGAQSTGYGAQSAGYGAQSAGYGTQSTGYGAQSTGYGAQSAGYGAQSTGYGAQPAGYGAAPTSYGDGHEGAYAPMAPVGLAPAHGAGAAYGGGNGYHAVPTPRRRGVGRASRPAPEGGFCAGHDGAAAGVRRRAIAQRRPRRRAVCRGGHDARPAASLTHTALSALSSIALTLAHPPYHHLGNPNPHPFLPHSTAGASAVPDPGAARPAATGPEGAGAGAAATDGELAVREKG

SEQ ID NO: 17410 - protein, 629 aa, Chlorella protothecoides
  MOD_RES (364)..(367): Any amino acid
MAIGLLPSARGTGAANPVTESSMQPRSPDKSPYALDGSTLAKVVYDVLVSQVVGQVADCMGGKETLSMVVYVPNTAGAGSPAPCRAAIGGVPPKLQSPAPYSSLLTVCIWNGAGIPDSVHDPTFVNGAEGPRHLGDPKQSPPRARRILRRGLIRLRYSKALSDASAVPQDAGCQRSDVALQSHSQGRWVTVAGFSHVTYSPISRITPAGSPIGPSRHTFVLSFSMCRYVKRRAGEKFRELPKGGSAEAVEAAFRRGCEELEVVKRQAVVYKLYARKQKSVMVRGVGWGGVGRGVRVGPCNEGLVLHEAVVWSAHGQRYSRRRKCWLTRAWRQHPCSGGNPAVSVSVSVSVGGSMEAGFFGGWEXXXXLVIQQSQFRFQYQQGEAGRQDSLEDGKKWHCNPYAESAVWFNGWRPIRYSNVQLARPSIHALTPHAGQPRLGHARHLIQRRLDLRVAEPQRPPPPVLQWPWLARWAPVPLTRHNQDRCNMQRGRRQWARAVARSARTPRQRVAQQAQRGGQEWAGGSPRAGEREEVRVGVVHPKVEAQRAQRALLVQDEQRFGRVVGAAHQGRRRGGEGVGRGALVRGGRGAQQAGHVEQVVGHEACLAAGSGRGVGWLVWARELSCWRRAK

SEQ ID NO: 17411 - protein, 152 aa, Chlorella protothecoides
MTRKSPRYNINVELECCRRDHPCTSPALPAPMAQRPHRAGLSAMTLATAVLLAILAFVAGDMQYHNYLEKFPSGLLPLEKEHDVSIHYNATSLQHSGDWVEVSVQGVARPHRDDILALYAPADAHLHGAAPVKYEYVRADARYLKHGHATLR

SEQ ID NO: 17412 - protein, 311 aa, Chlorella protothecoides
MGTGPRDFRFSIDRGGTFTDVFAEFVDAEGNPGQRVLKLLSEDPANYPDAPREGIRRILEAETGIPHPRSSPVDTSRITSIRMGTTVCMVRGSPMFGWVGAQSRVPRPAVIRSAASWTSPHPMPRHTLQVATNALLERKGERTALVVTRGFRDLLHIGNQSRPEIFDLEISAPDVLYETAVECDEQVVLPLGDTPSIRAGRDPVGDAARHPLEGRAAVATTGEAVVVRRAPDLEDLRTRLLEVRESGIASLAVVLKHSAIFPDHERAVGELALELGFTQVSLSSSIMAMVKMVPRGYTAAADAYLTPHILR

SEQ ID NO: 17413 - protein, 151 aa, Chlorella protothecoides
MPLLRGAALARTDPGAAPLTALFLTPCHATPYWARMHGVAARMRFLDCSPARYRGEVAALNAAAQAWLPFPDGLCLPGQSELECLHRRPVDVARGLVEAGAPSHVVLFAPLGTVVGATLAEGGYALWRSLPNCWVQVDEDYPCTLQVWART

SEQ ID NO: 17414 - protein, 241 aa, Chlorella protothecoides
MNNFTFGDEGLGYYETVAGGAGAGPGWHGRSGVHTHMTNTRITDPEILERRFPLVLHRFCLRPGASAGAGTLGVPKYLILLSSGNHATPRAHPQPRTGTGGEGMWRGGDGVEREIEFLRPLTASILSERRALAPFGILGGRPGARGVNLWQRRDGTTVSLGGKATVQAQGGDRIRLLTPGGGGYGPPEDEADPTAVAELRRRAAELARARAEALGRAVGDIPRPRLAGGSLAKYHADQHSA

SEQ ID NO: 17415 - protein, 199 aa, Chlorella protothecoides
MGSSAERVARGFRTSIHGRLWRRAVVCTLPRSTHPTASQSCIPAQEGDVVMANHPQLAGGSHLPDITVITPVFNEGKVVFFVASRGHHADIGGISPGSMPPHSHLLVEEGVAVVSYKLVSHGRSGLMLGGGGAMRLVELPLEVRVSTAFHHPGLGALGDPSAEPITRAACSDNVAESSGCLGMTLRLPARLLACLLYRA

SEQ ID NO: 17416 - protein, 225 aa, Chlorella protothecoides
MSKLLHKAIGLGGHGPAGAGAYEAYLQHFRAAPVTVLRDLLELHTGAQAVDVEEVESVADIVARFCTGGMSLGAISRETHETIAIAMNRLGGKSNSGEGGEDPVRWLELDGVDKGGRSALLPHLKGLRAGDTATSRIKQVASGRFGVTPEFLVNADQVEIKIAQGAKPGVCGGGPLGGGRVGGSEAWSRERLGPWAGVVDPAPHRSLGPPTHPHSTLCPPSLPNL

SEQ ID NO: 17417 - protein, 362 aa, Chlorella protothecoides
LGDGPAQAPQGRAVGVGDVVGPADGALLVDGLLDLGVGQDDVVPLAAVVVRRRAAPLRAGGRLAGEAGQDGQVQRRGLGQADVGALAQVVAAPHQLVQRAQAQRGQPRAHLLRHKHEVVDQNTGSRGCSDTGRIREARAVRRPPAPAPLDEMHTHTHAGSLPPPPNTPLFTWESLAQLLALAGHAHGAVVGVADAGHDAARGDHGHGAEAELVAAEGGGHQHVAPGAHAAVGAQDHAVAQAVGGQGLVHLGQAHLHGAPSVLDGGDGGGPRPSVVPRHLDHVRPGLGHARGHGADPRLGHQLDRHARRRVHLVQVVDELGQVLDGVDVVVGGRGDEGHARLAAPQVRDVGRHLLAGQLPALT

SEQ ID NO: 17418 - protein, 327 aa, Chlorella protothecoides
MERWGLLTHATHTPSTATAVPGPGHLHLLDPVTGGGRGRRHPGPRHPRLQCEYHRSADPGREAVPEGHLHTVHGVLCPGLWEHALLSVASHHQAPASSAPGSWEGPGATSYSYTPSHCPTHRDSASPSKEDLATAVNLLLAAAGIDAIQVAPGRGRAAGTGTPHARDAPVTAADVSIVPTPDAGPPHKEALRELIYVYLEGDGVPYNPAIADALLHVLADAGSAEAGADVGLHTALGVRLVGPNPRGALFALSEPDLPAALARYQLAAMAGDGAAQMALGHRHLHGLGVPRSCEAAALYYIPAAGAAVALASTRQGLPPQRALRLAG

SEQ ID NO: 17419 - protein, 474 aa, Chlorella protothecoides
MIASWAAHRHIEALVDRFYTNTPAISSRHDFTPATPPPGAKDMMQTLQHPANQVLVALQPSWLQRSASHVSQRRALQQAKTFLPTQINAQCIAPVCSPTGPRTLELLGRFTCFLRLLQFGCTYGKRVGIGRGLFARRRHFHPGIHNTCNPSTIGCIFTYNVSWGLNADVYCYLRGGTKPGAVRGTGKGDCSAFTTRENLGWSPHSSTPDIWCESSYSRDWTSMLRHAARGVCRAAGLRSVSSSTAAFQELNASEQSKKGPLHPSALPPPVPNSQEFLSKFAAFQGTMNEPEFPSNFVKPVEKAENASVPDKLKFNFYIPSAAINQGSSVDLVLLPATTGDFGVMPGHVPTVAELRPGVVSVHNELDKDVTKYFVRCGQGGGRAWQGSKSSQVSSKGRCERTCGGFAFIHADSTTDVCAVEAVPLSDIDSDAVRAGLAEYTGKLASLQGKGDDYELAAAQAGVEVYSALNSALGL

SEQ ID NO: 17420 - protein, 397 aa, Chlorella protothecoides
MREPWLTVQPSPRMDISTSACAPMVLEEDDAPWTVAEHRGRPPPSKRATVVPPAQGPPSFSFHPAPFLPQRTCGKDLAGGQEARHGVDGRILVVEAEVGVGAVGQAQVALVEGTDGPDVLPVPLEQVGLDVHAQILGARDDVRPKVVLGGEALGEQVVHGTGLAQVDAHGGNVRLARGPAFTGGECQRGVEGRCGHGVGDANQIHHHYRPRAQQALHQKFSPGQRRDRDLRARAAVRSHELGVVHAVQVVAGEDEVVLHPAARGLLEQPEVLPHRVGRALEPVLLRGGLRGGQHLHEAARVVPAHVGVVGLGQVAVQRRGVELGQAVDLVHAGVDAVGDGDVDQAVVGAQRDRGLGALLGQRVQAGAGAAAQDDAQHGLGGVWGKWGRVVVVGFWAP

SEQ ID NO: 17421 - protein, 473 aa, Chlorella protothecoides
MDSSLTRRGQPCWYRQPHVGMVAINDGIILESCIYRLLKLHFRAHPAYVHLLELFHDTTHRTAHGQLLDTTTAPPGGVDLARYTEATYLRIVTYKTAFYTIYLPVACGLALAGVTDEASLALAEDLSVRMGCYFQIQDDVLDAFGEPEVIGKVGTDIQDSKCSWLVVRALAVASAEQREAIKANYGRDDAEAVEAVKAVYRELDLPAAFAAYEQESYDGLVQAIEGQDKFPPAVFMGILAKIYKRTKGKGEPGLVAPGWWRGLPRRQLLLLPREVCWCREPLATPGPPSNTLGQGAIRQWLAHDSNPIGTSLRNYHPLPTALAPPRSNWCAMQCAYLTHSTTPAGEWGPARSCWMAGGMDLEYSNPKLRRCLRVPAHTSCRRSHPSSSQGWQGARPASRRGPSPGPVHRPLLPVNLGGYAPCRVEKWPWHTRSPVRREGHTQPLSRVPPNRLHPHRPCRPAPPHSWTATWPVS

SEQ ID NO: 17422 - protein, 152 aa, Chlorella protothecoides
MQHHSHWIGDTDTEPAPSLGTGGHCVCTPSHGSPAARHQAFPNPPPKLQMLDYNVPHGKLNRGMAVLDVLLAARGGDVTEKEREAANVLGWCIELVRVQAVIAFLPVGQLGTSEMGVSRAARVPARPAPSWTVGAAPWARHTPTGCPSMPPL

SEQ ID NO: 17423 - protein, 317 aa, Chlorella protothecoides
MPRPRTPYIEPKPGLGNHTWQLRTMCRVILRPQAREQRGGAPSAVAGNFADLMTGFDPASLLEAKQESLSPDSELLETAEGFELQDTDADLLAMFQELAEEPAPELAPLAMPTSPAPSLPGPMVPFEPVQTLPVPARPAMTIFDQQLMFQQAMLQQQQAAMATAQIPVKPGYPTLRRGKTPEEVAAQVERTKQRRRESAHRSRSRRKDYMKTLEDENDALRAENAALRAKLKVQGGSLTSSVMDAASRQTSGGADSGSSSEVAAMQMRQTPLPNGCEETKTYILARSEGLECQSGQGVGECRVTVADEKPNSNQMEE

SEQ ID NO: 17424 - protein, 254 aa, Chlorella protothecoides
MPTSTFNTPLAFTTRECRAARKPYIASMGIYLCKASAMHHLLTERFTTQNDFGSDIIPGAKDLGMHVQAHLFKGYWEDIGTIRAFYESNLGLTDSPNPNFSFYDKDAPIYTMSRFLPPCKVLSAGGTTVARLDGGGLPLCSATVHGASSSSNTIGAHAEVEMSILGDGCTVNQGSRIVHSVIGLRSRIGQDCLIEDTMLMGADYYEQGAELDECARLDKCVPIGVGSGSHVSGAGLGGGWIERGVGMGRVRGCL

SEQ ID NO: 17425 - protein, 238 aa, Chlorella protothecoides
MGSGSSTTAHSSTSWAPSATADAPRRISKSGYDITPLTAEQREAAAARLTPHQRDVALASGTERAFTGKTVDGTPHDSKAKGLYVSAVGGLPLFSSDTKFDSGVQTGERRLGGAGGSLPKSLTSHGEGRDGAYKSCGPKPGRAAVLSADSELALGQIGTGWPSFYTPVDPEHVIEVTDASIPFMVRTEVLDARSGAHLGHVFNDGPRPTGKRYCMNAAALRFIPAGADVPPESKPVSP

SEQ ID NO: 17426 - protein, 254 aa, Chlorella protothecoides
MWARHMHHRQSSEGKAEHPQQGGQAHPSCAAALAAVTETSAWDSGVPRRMPVDDVPQPSHRVRGRGGMGARMDEAGPSLPATDARERVNEDIALVDRRVQGPFFPPAGVKSEEGSQGKDAGGSFLCMSPSRSRIPSDSPSSSENRKARKTDRRSRGKSSKYKKRIEKREKKKMKKRSRYDKEGFGVKPSLNYITVMDRQTSSQGRRAIRLPSKRFPMCHITPEDDVKLTLKGDCIQPKFKAPPRPFSACVEASS

SEQ ID NO: 17427 - protein, 98 aa, Chlorella protothecoides
MAHTTSKLAALILRDAEQLRRNAQDAGVSAYVQRPVQREKPNTRFLHTTLRSVEHGECVCVFPYIWRRNSKVCMLAPVKIESVDHDLLAMLIPSSPAI

SEQ ID NO: 17428 - protein, 326 aa, Chlorella protothecoides
  MOD_RES (108)..(111): Any amino acid
  MOD_RES (179)..(182): Any amino acid
MAPPPAQQREIADGGLIPTGVPGAEGPGAPIPESVLEEAGLAPVMGDEEILVRRAGWCLSGARARRVGPCWAPHALALLQGATRAVHVRALHRRTRDPPGPPKRSRRXXXXVVAQAGQAMERIVGPGPGLANDQTPGVAENMAPPPAQQREIADGGLIPTGMPGSEGPGAPIPESVLEXXXXCSSRPSTPPSNPQLPRSTKTQSAAATQGSCDAAALSFALSSTRGSLYGRALTRVLALAGPRGASTAEAAGRGVELRLLSPSRMAPEQRSATVAGLGRASAKEHVAHVGGYRYALKAFAGVVDQPKPQKAGGAGAASKGPAPGPA

SEQ ID NO: 17429 - protein, 328 aa, Chlorella protothecoides
  MOD_RES (64)..(67): Any amino acid
  MOD_RES (308)..(311): Any amino acid
MLSHACLQVLPGPSPYAWRSHPYLYPLLFSPRGRSAGGSPDREREPAASVQGTDGLPDRLGPGXXXXRQTVSVNQPLRYKGLTAYQTDWALAAVRVSALPLSDAALGPQTGTALSQTPPDEAGVSEGQGKPVPNPPRQPVQLSLPMAQLAGESPESKLFGTFLPLSTLGLPAEDGAPGSNPRGISLLARDLQTVVLYDGKGAFVGVRRPGSNLPITVEGVELRIGAITPSSGMQLKIDPGVPLVYAGFLVADCPHHRILRTNSRFMLSHPLNLVIPPPAPSVQPLDRISTSPHRCSRPVHYGGGVLPXXXXWLTALTTESSAPFLDSC

SEQ ID NO: 17430 - protein, 251 aa, Chlorella protothecoides
MERRAVPCTSGIAIGGNSSFPPRCELDRDSDRWGLARSTPTPTRSLAAIRDWAHRPLNISRSAWPWDDSDATPVTVPAMQGAESARAQAPVRTREEMLQEWREQRAVRISGKADVKLQQSSAPAPSGDAGKENHGTTRPPMASHKVTQSQPEPHSAPSRGVNSIAARLESLKRESLRPSIAPPSTSQAGIQFEAAGPVDSTALRRLAGQLFDDESWKQLYDKGMNAKLTRSRDGATEETKIKELAGMMLRG

SEQ ID NO: 17431 - protein, 506 aa, Chlorella protothecoides
  MOD_RES (368)..(370): Any amino acid
PRAAAQAEAAEAVTRAVEALAVEGQRTAPGSSATAPGAPPSELDALTAAEWPGVDPEDVLLDPPAVRAIWRQFTSDSAIAVQQAAATREANRLAGARGPPLWAIAAMAVLGFNEAMAVLRNPLWLLLLLLAFLFARTVYNVGAAGFMTAAMLSCLSLGLAPLPAARPDSSTPCLWVPPIHPPPHTSAGAGCGGGDGQRAAAWGARRGGQVLAHPAARRASDPGLGQEVPGRGRGRRGARRRRGGRERAGRLRARGAREQRRAGRSQAGLGHQALGPFTRRPGPAAGLHAGGGDDGGHRGGAGARGAGRGGGGGRAACRGRCLGSRRGRGRGGRAGLGRSPGGDAGELHSSRRGSQGQGCRLWAAAGRXXXGDAADGSGPGSFTCAEPASSDAQVVRRQDSGIRPSSRSPVGPATMPAYTREVEMTEAIDEEPEHEALAAVEEEETPHAGAGVSAAEEVEDGVGERGPAAPQEVTLESSTPPAMDPRDRDATPGQPQATPDESRKDR

SEQ ID NO: 17432 - protein, 374 aa, Chlorella protothecoides
MSRRELQFLDAQDEDDASSSQSGSPSASEDETGYPSSDDDSPAVCSDRPGPSAAPQPVTPPLQAGRKISIKLGGTSSELTCHVRGVWCEGRPALGNVCGKKGHCAGFIGARYFDCPNKPCYLCGQSGHSTMTCPFRIDPGHGCSAAPGSNPTDGVQWEVLRREQGAAGAAAPGLPPQRKRWQVESAVLRLHDRRVVCLEFHPRNQNIVLSGSKGGRIAVWDMEKVTSACLRGGLPRKRAIEDCGAHQACVLPVVVWPILCQGACACLPLPSAQAASSSPQVYERTVYRSINFWLTSALKFAPGSDGLACATCSYDSTVKIFDVETGAATTLHTATPREWRGPVEEDGSWITQMAMDVMQGEHHISGVGGTRVGS

SEQ ID NO: 17433 - protein, 199 aa, Chlorella protothecoides
MTPEGLAAALERAAAAEAAGRAAREAASAAEVRCDELELAVRALTSDLEGSRAEGAQSTARAEGLAGDLAEARRGAEALEASLGSSREECAEARRAAADASARLQRLGGELEALQECTLGLGSGDQGEMLSRLLHRVGALEGALLASETRRRALHNTLVELRGNSLTPDSCGDLALPPPPVPRRPAVCGCPCRPLRDAC

SEQ ID NO: 17434 - protein, 258 aa, Chlorella protothecoides
MLYFCDPRHSSAFATMQAHKKGTKVQLERSVAGNPVDANLLLTAGNDYAARLLDLRVLGGKQEAGAEVPRAELASLQHSKVINAAYFSPITGRKILTTSQDNRLRVWDYVYTSDQVRERWTLEGGRGLELKREGLARAPGGGDRVCGQGCTLSLRGSCYVPFTVCLGSHGCTPLGDGHRQAAFLQHVRLHPASPLQEPDRMIVHSNNFNRYLTPFRAEWDPKDLTERLIVCGRSVCQTGDGLYALRIKSGTRPGVCDP

SEQ ID NO: 17435 - protein, 25 aa, Chlorella protothecoides
MLLLSAGARETIRFLPPLNVSEEEI

SEQ ID NO: 17436 - protein, 342 aa, Chlorella protothecoides
GSGGPGWEWGPRVGVGGVGCRGRRGCGGAGVQGWGAWACTSVEGRARGSRASEPCLSSTPLRPCPAPRTVISILLDPHGGARDRPHMPRLHNPDLTPLHLPARDAEVLSLFAMLINRLKDGMRLEVPRIFEAVFEPTLQMITKNFEVGGCWNGGQGGWGGMQEQVCTRAGQHTTRPTSSVWRSICGRVRPDSTRQPRPAPLHVPARSTSSMAAHPSTTGLSGAPPPVLRPASSHHQPLLLHPLHHDAGAGAWVLGRGWAKGLTGGARLHRQGHRVRAGKQARLATTRHTTHPPLHRAQLKLVIDSIVWAFRHTERNIADTGGGMEGLWWPPHLSKAADGMQT

SEQ ID NO: 17437 - protein, 388 aa, Chlorella protothecoides
MCALCSWSLGKTIVTRLPIPSAPPATLRHACRPQPAPGNAGHVCAVRLCHAVLPVLLPPAAAGDLCGHDRWAGGGWVTGLGCFAAGTCTAALQYVPQAGVQAAGQDPAPPVLYRRGESRRGGWLRGSARLAVTAHEPLAPPTPPLTHLLNVRPRSSRARSGMPASRGTSRPTPSLCSITRELAQRGSAGGWRTACHTAGGFPPCHGGLGLPKDAHRCCSPGTFCDQLLIPLSAPHHLQATVLGMMELKEFTTFKQHLRDFLVQANQFADQNNADLYADEVAAAVRRMVSFCMEGSGWREGEHLAQPSLELAQQGTHAQLPCLLAAGGGAEEDGRHPRHGEPAQAGRTHHRCLVKSTALPVTPIMHEDIRRWGWQQGLCQGNAWGKEGV

SEQ ID NO: 17438 - protein, 230 aa, Chlorella protothecoides
MSRPMVSDLATAQVIMTPLWSAPEVLCRQRASVKASAPGMPRGMGWGWVASCLQALEPRNALALDPELTQVRCICFRWSLAPQHLLERHLELRHPHLGDCDGAGHHTVPAAVPDPGVDAAGEGWGPAGQDWDSLPTVFCTRHPWTHAGRHDGTQFSGLFVLNKTHPGPQGLQDTDTSARSIMQMDEGAPALARHIFQQCTQPSPALRPAASQIVEWLRGGTTLPQSTGSG

SEQ ID NO: 17439 - protein, 674 aa, Chlorella protothecoides
GRAAWPADEGSGAAEGGDEAPTPDPFRAHRGKHAAAALAAPESTPSPSGVVPADQGSASAATSADSAAADRGPWEAHAPRFLATRHPIFAIAEGVHSESDRSAMEGPDALGPDTSRGRGVCVGGWPCHCVGDTHCVRPRMPAARGCMAGPQVWSLSGCAVAGHPGFCSSRALHSHQTRTDVEDFFADHQDWLVADADIELCRVRDEKGLQCGTSVHAPGMQAARFVLSAMGDASSPCKNAAPPLIHRMARVAAQHAPSCVRSVQAVRDPDGWHVMRVWAGGVHQVAYPFQQPTLNAPQGLAHGVDEVAVKRIRAEQPSPAQIKVFRDEINCLRRLNHRNIVQVGWESCIGGCMPSSRWEGAFSASPDRMLPEAFFLVTEMMTGGHDWWEWRDLPAQFPYPKPRPIPITRRGLVWRPAPPPRALGLGQTGPEGRAGRRAGPPLPPVPPASRPAPGPEEPQYLTHSQGTAMSTPCPTDLTTSTPTPGRRGCGQDRGCGHVSANGQRPCHGAAHHDPALVGARGLAAGTRQRKGALRLGASCSVGWSLKRCLACRQASTTWHQGDCGQPANSPAYMPSYTYPSPINHSIAGGHVELRRAGLGDRDGAGHHQVPASGPDPGVGAVGAWGGKQSFADLGDHRCHMCSSLFGRTCRRRMGCAALSSHPVVGSLRRGAFRA

SEQ ID NO: 17440 - protein, 570 aa, Chlorella protothecoides
MPPSALATPLHPRSPTGPRASLHDAASAIIRRAQHAAAGAAAAAVLLAAPPLAGAATTIRFPLPPSPEIFAVQKTLIQAWSIVTEAFVDPHFNAVAWDAELASALAAASAAPSPEAAAETLPSLLGKLGDRFTRWVPAREYADFRVASDGELQGVGLLIASDPVSGHLVVLAPIAGSPADRAGIRPGDEVERVDGAPTDGWDDARAARSLRGAGGSAVSVGIARRLDNGGAGSPGPRDIVPGVPAAPAGSAAAAAMEHRTLRLRRERLELSPVYAAAMHGEDDRTYGYIRLAAFSQHAAADMLRALGTLGRDGVDGYILDLRNNPGGLVNAAMDVAGLWLDPRAHPVVLRIQDRGTGGDLVGRARGGAAAAEIASAPQVSEKAVVLDGDRGPAVSAPLVVLVNRQSASASEILASALQDNGRATVIGGGSRGGGGRARFCWRGGGGPVWGRVDVHLCICVPRAEAFDCPKQPLSLTRRVGKRLQPPLLSPFRTLQLPPNIKSPHPSSPSKLAEPTFGKGKIQSVYELGDGSALFVTVAKYKTASGLEIDGMGVMPSQTCRWCSCWRLLPG

SEQ ID NO: 17441 - protein, 799 aa, Chlorella protothecoides
MMEGETPITVDGGKHGLSVSKLSSIMYRVGVGRMSRLIPSLPLPQYLPPSGFSERLLNPSGPITDNWTEYTMNVNRTNFRPLNYREIRKQRKYKDLERTWKNLLRNNDTAGVVDGFLAEVEPLLNSIHLDKPVSNLLSKNPDSSPDNEDSIPKLLNWVDLILAGQVDKWACQRVVHIQVVPVTAESMPGGALLGIAHVGYIYALEHAGIRFSMPKFLSRAIGGTSAGALAAVLLAGLRPTPDAPAGRRLLDLLLGMPVQKFKDGRMLDRTLGESILSLISDLPSAWWRWLLLPALPVAMMNIRPSSNSGPPPSRCQIRVWKQGGVHPGDALEEWVHEQLAEHGAGTLAELREKCDLSGIRFEGGDQEEIQRSGRFLLQDYDSWRSPEGLVVTVATDVTCGIKAVLSWKRDKLMTGVPMTHSELYWPNAGASGSQPKGCVMGCYRQRSRSAEGKFASPVYPCRASSQSSKLVSGLTLHACSFPITDVVSPAKCVRASVSLPVFFRPMTVPSSKDERVPFAGVCADDLLFTKWTETGFTSTIPDRVRFQDGGVISNFPINLFHLPSHLDVRWPTFGVGLSPPKEAQSTSGLGQLLVASVTTATAIQDVEFNTQNKECALLTQTVNTGKVCALDFNMSILGKFVLFYNGVLAARDFLMGTKERDGFHWDTYKMVRHDLAEIGKKHRLKDPWTTPLGSVAKVLDEAENPTSDDYAGFVALVKRLSEAQDLNLAQHDSTTRAQLPEPPILIPAWILHRSISSPVYPAATCLHLDEGASPNVGIAHITPSRSLLMGNMPWQAWTE

SEQ ID NO: 17442 - protein, 724 aa, Chlorella protothecoides
MIPGAITARSLHKVPVAHAIPPSTRRLARRVIPSAASNWTPLDWEQVKDDPEWADLERKWQGYAESNSLDKIAKDFQEKVDPILAEIQLSDYVSDLRSKPPPSPASGAGPHPPTTLQWVDLVLAVAARPPHPPQEARSWALPMSAISLLLRGLASDSGSFRVGWVSDIGPTRCLDCLHPILHRRALAGTSAGAMAAVLLAGLRESPDAAAGEALLLKLLDLPVPSLKDGAPADKALGDALIGLLTGTKISWSTWFRLPLFPWALSTLVFTCNHAQRRPINRPASGRTAASIQGRRCMTGWQRLSCLHEGRAGWASLPRPKKRENCRPCHPTIIARQHHPVRAGVHSCGSVSRVPAGLTSASSTPPSAGAGCRVCGGPSLGGPSRGRGSRCDNRHQGGPELGEAIQSNYPAPDGLGALLDRPSESPATCVRASVSIPIFFQPYTVPADPALKLPDAGATANTLTNNKWSEVGFDATIPDRVQFQDGGLLSSFPINLFHVASGQQVRCPTFGVGLSEPRRAASISNLGELLAAATSTAINIQDYEARACLGEPGSSSHPLSRLHASTPHKAPLLPQAPFPPLNPVHTGVQTAGPAGECCRRAWAGFQPAHNWKVRPLPQRRSGGTGLPHGRPGTGGFQLEALQRAQGGTVQSQSDLTVRICDGCRGQLRDCPPCRMPVDALKYNCGMPCVHAQPTVVGSAPSYYCIWLSIASEYMSAYSATTVQVI

SEQ ID NO: 17443 - protein, 676 aa, Chlorella protothecoides
MAGQSPTTLRNSNPWENNARFKPLEFSVLMKSAEWEDRQEKWERLARNDKWDEVTKEFRKLVQPVLDEIRLRKPVSDLRSLNRDPLPKSAGPTSETINWVDLVLSDTTSPSSRHPAHQQGRDAWAVVPTADDKIQHPNTIDSLRLILTRMHYSQVEAFWAMLTWAMSLRWRMQVSGSGMGTATGVSIMAIGGASAGAVAAFIMGAVRKSPDAPVAEDLLRLMVEMPTSTFDDGGKAERGLLSAITSVLEKNISTLDFFSLPLFPLAVWRASSLFPQQISALKNSGLHPGKIFEDWLKNLMETYGAGTLSDLKAKCDLSKINWLKAEDGRQPKDVEGLVCCVASDITTSTKAVLSWERPVNYDQPPITHTELYMANPDGENPGHCVRASMAVPFFFYPKKFPAQPGEKIPYAGQRAASLPNTKWKEIGYEDYIPEQVKFWSIWECAEHQGQCAGESVWERYGAFAVPPLARFGQVCDLHLHACRLIAKAPTCPPANAGESPCIVLFLSAQPSIPTALQAMSRTSSSPPAAQVTLVDGGFLSNHPVDLFHVPREKVVWCPTFCVNLSPPRTARRTGNLIETTAALLSTGIQTRDFDKWACDPSSCRPPTTTRQEYKLLTASVHTGGISALNFDVSPVGKFVLFYNGVVAAYDFLVGGDGSKGPFDWEVYKSMRNSAAN

SEQ ID NO: 17444 - protein, 127 aa, Chlorella protothecoides
MQVRFQDGAVLSGFPINLFHVPPTEPVRCPTFGVALSPPREKKKTSNLLELLGATIMTATHIQDIEFIAQNKVQLEGLERGEWDWSRMAVLCSHDGLPSELSLLRSGISCSDESVKWYFTHSVATPE

SEQ ID NO: 17445 - protein, 557 aa, Chlorella protothecoides
MFVLKKAVADEDHLITFTLPISEPLPPQYFIRVVSDRWLGCESSLPVSFRRLILPAKYPPPTELLDLAPLPVTALRDAAAQAALYPRLTAFNPVQTQCFAALHSSDDNVLVAAPAGSGKTLCAELAILRMAAVAAGGGDAAPPARCVYVAPREDLVAARLADWAPRFGALGLSVARLVGDGPADAKTLERSNVVLATPEHWDALSRRWRQRRAVQAVSLYVFDELHLVGGTGGPVLEVVASRARYVGSVAPRAPRIVALAASLANAGDVGDWLGVRPACLFNFPPSVRPVPLEVHVQGFEVADLEARMAAMARPAYGAIAAHAPGAAPAIVFVPTRRHARRVALDLLAFAAADGRPAAFLHADRATLAPYLERVKDAALRHALEHGVAFVHEAQAEDERAVAQTLFDSGAVQVGLSLLGGVRRRGCWRVGWGGLVSLKTAYQEFLDCYLNLVPESRAGERLSQVHSPTRPHSILFPHPPPPHHTHTHAHTNRSHQPLQILVATAATAWGLTSVARLVVIQGTQAYDASGQGARDYAVTDLLQMLGRASRPGIDASGM

SEQ ID NO: 17446 - protein, 267 aa, Chlorella protothecoides
MQGRWLGWACASASRRTSVRRCGTAWVPTSATPTAWPRGGWQRGARTTSGNCTRPTSSRAALARAPRDACTLRPRPGESGGRADVRWMVLVNDAKAGLLAFSPAERTPLQMSVSPYGLESFEKARHDHELEVRLPGMLCVGLERGTAAVLGQAPGKGHSGGAGSSSRVEDTGAKAVMPTRPGKKRDRGLIACWSANLCDPRPRLPTGLWLHACAPGCRAHGPWRGRQLEPVGWVCGVGRARAGRGVVLDTIVDVDTAWADEGAQTRF

SEQ ID NO: 17447 - protein, 814 aa, Chlorella protothecoides
  MOD_RES (675)..(678): Any amino acid
  MOD_RES (790)..(793): Any amino acid
MTRIRKRAVRREPRKSVHTAGNSQVSASGSAAALGPGSKVSSAIDLSNNVKDKYANGATTATAEGSTALVQSAGGSFVNDNRQAVNVISSAKVICEQHAGGDGACGSRCPSAFRPLIPCRWGWGACGSRCPLVFTPLIRAERFHGCHSEHNETWPATPTPSYFPLHAPHRHWTPPSWRLPPLTTRASRRGLPPKPARRSSSEQTPPQTTSPDFIHNSHQCVSTPGPSRSSRQPHPAPLTFLLALHIGNGPPSSLSAAPKPHSPGRLVPLRGPPPPCMRRSSSLLLPEVDASCRAIVSLFCVTLEYRYYAMVALYLLCSLKVLAQLRGCLLLCPYHTLFLTLRMILLDKPYTPFGHQASALYVAHPFVVRSELGSMPPPSVVPVARDWETPGVFGINKREAHVKLRSYAAPAEALRAYTLRDGKETSTRLQALNGSDWAFQLYAKPEDVPREVLMGMATPSQGWAQVRSEPISCAAPCWALWGKGYAICDSCELISEMTSVRRSGARRDHHAHRRAVPHGRIPLSLFNSQIAVPGSWELQGHGSPQYLNFDYPFPINPPFVPETNPTGVYRREFPSVQPQGGTRSFLVVESADSAVYVWLNGRCIGYSQDSRLPAEFEVSCALLPPGGGTNVLVLQAGWLCRWSERLWGVLEPAEGVSWPAGMRKGGVQWYMCVRXXXXSERLWGVLELAEGVSWPMGMRKRGVQWYMCVRGGWRPPSRTRCASAGDEVERRELLGGPRHVETAGPAQVPARERRQTFPCDVGPACSCIPAPKDGHRLLTMDEQRRASGIXXXXCRPCMQLHPSTERRLPSPRHG

SEQ ID NO: 17448 - protein, 443 aa, Chlorella protothecoides
  MOD_RES (109)..(112): Any amino acid
  MOD_RES (368)..(371): Any amino acid
MVRDPGIPLVLRDTFREIVKQGRGPEFATFRDSNYVSEWISVSQAFLSPPWVTPVGLFRGPILGWESCAGNKHVRGPPAPRLLADHGRHSPRRDARRGLSAVKALSSPXXXXYRDRQRPGCLQTTGDIHRVGMPDGALRPAASPGGRPQTMYYHRRCVGLKWGLSAAPPPRSTQESETEPPTHFSAPLPRNHLTATVWDFELRPLATSAALASLAVAALPGMAPPLPRNPFSHIPLPRLAPRRRARPRRGLPRAARGAAQFLAGGLAGAVTKTLVAPLERVSCMLMAPAAGAAPGALAALRAAWAEGGLPAMYRGHAATLAKIAPASAVQFAVYHGLRDTLAARRGAGPGPAAAREGGLTTPERLAAXXXXAGAAGGAAATLVTYPLEATRTVRAPATVREAFGPGSGAGRPTCRTCDLTFRPNVETLCGCRSWHPSRRVRGS

SEQ ID NO: 17449 - protein, 391 aa, Chlorella protothecoides
MDSEEAEYIDMDFGCLGGIDPRSAGPDDIVNVETYLTKPTLWAEAGHTLQHDQIPLSDWAKPYAAWLATKAPKPPQAAAPKAKVPPPVKSEEGEEGEEGEEARAGPTFRVCPDTGALVSFCDPVLGELLAAPVVPCLYRAPTDNDRGGSGGTSHAARWRLAGLDRLRPEPGSVVVAADEADASHVRVTFVLVPRPAQAGEEEEGVIVEGVGVGEVRGGGCRGGGTGEVQGTCGKLDRGVRRHMRDQRPGVGVGEVRGGSCCGGGTGEVHGTCGKLDRGLRRHMRVQRLAGSLFYADIWGSSCACCYDPAASEPRPPPPRTDWRHALALRSEQGGRGPPPHPAARRCAHPGDGGVPAGRRQAPAQHGLGGGRHVGAPGGARWETVGGAGCVV

SEQ ID NO: 17450 - protein, 231 aa, Chlorella protothecoides
MDAMILHGAGRPAQLWSADRPHLYLLTLLLVDARGSALEHEACQVGFRTTSVRNKKLVHNGWPILIRGRCGHVEPREPWSDAHAGEGVPRGLCESPEADARGPGVLAAAAFVSRGHATPHTTPATPPNSAPPPYPICTGVNRHEHNDRTGRTVSFASMLEDARLMKRLNFNAVRCSHYPNEDAWYEVCALIGLYVVDEANVETHGFDATLSKPELNPTAAPAWLAAVVGER

SEQ ID NO: 17451 - protein, 460 aa, Chlorella protothecoides
MCHTPRKEYYKKFLFEPLPVDSHLDAVLHDTLAAEVVTRTVTNKQDAVDYLTWTLYYRRLGANPNYYGMTGSSHRHISDHLSDLVERVLADLEASRVIAIEDDMDLEPLNLGMIAAHYYVAYTTIELMAASLGAKTKLAGLVEVLAAASEYDDVLVRPGEERAIERLLAHAPLALAAPRYTDPHTKVDALLQAHVSRAVLGADLAADAAAAVAAAPRLLQAMVDVLSSSGWLAPALAAMELGQMLTQARWARDSPLLQLPHFTPELVEAAKAAGVEGVFDLMEMEDAERRALLKLEEPQLAEVARWCNRYPDVAVSYELAEPDAVRAGESASLVVSLEREGEGEVTPVIAPLYVDGLVKGGVVSRVACSLRAGGGRGLLLFWCVEEAWWLVVGDTSSNSLLAIKRVALQVPRERGWWSLECPGLGLRQSPRRRMTRRLQAYLGQPTPALLLIAAHPSRAA

SEQ ID NO: 17452 - protein, 160 aa, Chlorella protothecoides
MAATDKPVEKFRKDYKPSPYLISTVHLDFQLNEESTLVQSKLRIVPNHAESSPVSLFLNGHADVVLESIKVNGADLEASHYAADAQGLTIKSGLPSGRAMSAGQCQQCSSSSYSFHPAWVPRLAPLQCEAEGFRHITYFLDRPDVMAKCVVGDESAFGDG

SEQ ID NO: 17453 - protein, 93 aa, Chlorella protothecoides
MTRRLQTYLVQTTPALVLIAAHPSRATETRKSRVKLEFVAPAKAGPASLTLFFMCDSYLGCDQEFGLDFEVLPGDEEAEDAGEETAVPMDDDK

SEQ ID NO: 17454 - protein, 295 aa, Chlorella protothecoides
MESRAGHPQEGERCFAPPASLPPLTLQTPLSLPPPPHPTQIHYEGGGSRTPATDVICPMYARVHQAEELAGNADDPRPVILCEYAHAMGNSSGNVAEYWRAFDGVEGVEGGFVWDWADQALLKAGTKGGAELQYWAYGGDFGETHHDAQASWRWLVPRWWPADTLPTSRRPIPWVGPLGAAYPTSPLPPRCSPPHPQFCLNGIVWPDREPHPCAWEFKFLQRPLRITACPATSKHMAVEVASTTPFGYTCETAMKVTLQRAGEPALTRTGGWGAAADGASPRPERAQAGDVLTLS

SEQ ID NO: 17455 - protein, 499 aa, Chlorella protothecoides
MPPPFPLSSPPPRHFTVWEDPFVKPCYLFALVAGDLAVQEDTFRTMSGKDVALRIYTDVSGRCRGHAPVPPEERARGRSWVAAPEPCSRSPQQAYLSHPPLFHPRQAHNTSKVAFAMQSLKRAMKWDEETFGLEYDLDLFNIVAVDDFNMGAMENKSLNLFNSRLVLATPDTATDADFGRIEGVVGHEYFHNWTGNRVTCRDWFQLTLKEGLTVYRDQEFSADLNSRGVKRVEDVARLRAAQFPEDAGPLAHAIRPDSVIKMDNFYTATVYEKGAEVVRLYEALLGRAGFRAGLDLYFARHDGGAVTCDDFRAAMADANGADLGGLEGWYARAGTPRVEVGVEHDAGAGTLTVTATQAPPVLTAKGGRGDGGRGGDAQAGEEGDSPPPLLIPIRLGLLGADGAALPLHLRSGPGPDPAGGSEAVLRLEHQRETWVFERVPARPVPSVLRGFSAPVRLTVRGQSREELLFLLAHDADAFNRWEAAQRLGTALVLERYGTA

SEQ ID NO: 17456 - protein, 632 aa, Chlorella protothecoides
  MOD_RES (501)..(504): Any amino acid
MATLFFLMAFVNTVMDTLKDTLVITAVGGGTQVIPFITGGWRRGAWSRLRWGSERSARVAMALGPRPAWHAHCISTLRAASPTVSPHPNPSQSMACCRPPLPSSSPFRGAPSDWRAATCSTSPSPASSASWAGGYEPVFWDPGSSQRLWARRRRPGAAWTPPSHDAPPPPQLPTPAPAQIQMPLCLARMHGSTASAPPPLRPPPHTHTTAPRKPLPPPRFALFYPVHESLHLGPLAAWLGPRLPLGLAGGVGMLRNWMFTLFYCASELWGDVCLSLLFWGLANETTSMAEAPVLYPLFGIGANIAQTLAGRTMRLAFSGAARARAGYAARLQAMLGLCCGLCLAIMALQSWIAARFRASHAPPPPAGARAVATFEDPAPGDSSSDEEGGAGAGGGSPAAMSLGQAWHFLRQSPQIRCLALLAISQVCVFEGGGKRGGGDRAREWAGHSPRHAISASCPDRGAWICHAHSYKPHTHQSSHACPASEAPSLVPHPRPTLLPTXXXXWGLDLPCPLPQTPPISPPTYVQPPTPLFSSPTLIPPPFPPVPGHHLEPPGPGMEAPPAPPGHHSRGLLCHPGRHRHVDRHRDGVAHAPVAHPLRAPGLGGRGQDHASPHALRRHSLLPGLHRLQLLAV

SEQ ID NO: 17457 - protein, 427 aa, Chlorella protothecoides
MSKAVKAAATRIRVVINAGQAKPAPPVGPALGQAGLKIMDFCKDFNAKTADIKVLGVLHRLARLALDLQWRLSGIQHGLRMHAVAPNMLRILRHHAMQPDVPIPVVIFPTPDKKFTYVSDLQGAALGQPPPCVHAGAPLGPCQACWDSTQGCPTPPPSDAGHEDAASLLLHQEGSWIGVGEPEARARCGRHDLAEAHLRDRTGKAGRCAAHPSQVCLQVPGRHLQGHGRGRRGEARGGMRAGGHPPGQVGPVDRAGAFQTPPRISKLAPARELLGGPTRAAGWDTGPGAHSLPLPECIPLVRPCLSPCWQAFLAQSSAAAAGTVHGPGGMGGQARACTGHGPEDVHQARRGRAGGEAATGDPIQKAPALAWGSSRHLQIFTCPRSSPESSRFPALYPVMARTFLTPDRTPRPSKEGSSQSRMTGSPL

SEQ ID NO: 17458 - protein, 205 aa, Chlorella protothecoides
MAPHDEVVEGHAEGEIVPHNPLAGTMISIAITDPITIKVRAVLPCGTVRLRDAGHLAHCSCNSSVPSTGGTSGRQNDTYYNSGYQDQYHQGWQNGRGRGRGYFGGRGSQNPGYQQQQGYSSNRGGRGRGRGRSQPGQSQPAPEPLPDDVEFLAELKGHTGKVTVVAMDQGSGQLFTGSHDGTVRVWSCASGEVRVCSGQGWTVSG

SEQ ID NO: 17459 - protein, 113 aa, Chlorella protothecoides
GAAGGGDNSKGPASPGTTGTGPAPPSVTLLLRPFAEEQGSVLLGSPGARAVLAAADVAAFVFDATSRESFSAAVARMLAVASAADDCLPCVLIAAQDTVMDPVSLVGRKGEGP

SEQ ID NO: 17460 - protein, 1116 aa, Chlorella protothecoides
  MOD_RES (44)..(47): Any amino acid
  MOD_RES (219)..(221): Any amino acid
  MOD_RES (493)..(496): Any amino acid
  MOD_RES (672)..(675): Any amino acid
  MOD_RES (953)..(956): Any amino acid
MRGSGPLACLWWLLETALASQSTHRHDTRTLLSPFATPGPQPPXXXXLASQSTHRHDTRTLLSPFVTPGPQPPTSLLTGSGEPDAGAIGAVHQSHRRAAAGGGACAGPAHVQDGAAALRPHPRNLQEGAGQCVPGLLGARRRRAVTQQPVPPAVCQGRGPGQPLLAPDPGRTDGAPQGLEGHARGSDRGHLPHPPQAGERGAPVDVILAPDPHHPPHSXXXVTSPLVVDVISAPDPRHQPHLPLPTHQLLDLALDDVEMPGQAPASLDSPEPVFIERVASTLEVVRRNCNSFRRLTLYGSDGQPRHFLIQAQQQREEGGGGGGWKREGKGSRQRRGCVSLVVRCRVAGWGRGRGRDCEAPVARMMAPASRAGAACSSPPRPSCPSGWECASWRTIPPPSPSWTCTKTTAPGRHASLGLGRAFERSGGGSWNGEGSRCAARLESRKGKEGRRRTGRPQQPLDNQYRIPFVPLSRPFLPSVTPPPISIYTRSPHXXXXRPQQPLDNQYCIPFIPLSRPFLPIVTPSPISVCTRSPHHPAQVRPGAGRPDRGLQGAVLLSGGHHHQPGGAAVGLRGGGLQGGDGKHPEPAHAQDHDRPQDDLDREEAVCAVRRHVSIWPAVHRGTSSPNPKQSPHCVCPLPSPHSRAMLYAAADGALPWAGAGVQVNGTHQPDGXXXXSPCQHLASRIQLRRALPAGEGARDGALPPDAQHGGLHGSARAGGPVRGGRRRRGAGPAGPALAAGLPAGPLPPRRHPGLGGPALRLALRGGAQLQLWPRPNPDLRGHEREGGDRARGGGGARQQRAGGRQPADRHAQAGGRGDQPAEPVPHGAHLAALVLVLVDVAAPMSPLYCLTRMPGIDGNAPLRKKTKGVGVLGLHRVARSSEGTWALPCCQRGSCASQIGKTHGSVLQRKGFLHVRGRGPLPHSNSHDGELRGPASGSGPGLRHGARLGRPAXXXXLQRKGFLHVSGRVPLPDSNSHDGELQGPASGSRPGLRHGARLGRLAGAQQRQAVVGPPRGVPRQRGHEARAASPGGAAQRTALPPPGLQRGRVGDGELRAQRRARQRLVHAPAREGAGVGDGRGHAQPAARFPHLRRQGLRGGGWMKWRLLLPGMESEER

SEQ ID NO: 17461 - protein, 80 aa, Chlorella protothecoides
MYQALAGAALGAELTIPDTPSLQARRRQRRALRRAAWAGGAGLVATLAGYAAWRAYHGLPLLGSGKAAEARAVPEPRAAA

SEQ ID NO: 17462 - protein, 147 aa, Chlorella protothecoides
MRLILLQRSQPSTSCCRPLDPLPAPACSLQLDVVAGLSVGAMVIPQGMSYANLAGLPSVYGLYGAFVPCLVYSLLGSSRQLVRGLGSAMSGPALCIEGGVWCRAVPWAASYLLVHPPTHPPSLPTVVVISRATTRSQTTPHPPHSTP

SEQ ID NO: 17463 - protein, 1036 aa, Chlorella protothecoides
  MOD_RES (440)..(442): Any amino acid
  MOD_RES (604)..(607): Any amino acid
  MOD_RES (750)..(753): Any amino acid
  MOD_RES (849)..(852): Any amino acid
  MOD_RES (1009)..(1012): Any amino acid
MSAGLRASQRGRPALRPGLTIQCSPSEIPPPHPPNEPLHNRQADKARVKDYIHRLDNFDGPAVGEIAVGYELFEEAFEIYKKFGLRAQAIHVLLDHLEDLDRAHEYATKVDEAGVWTELADAYLAHARVSDAIAAYLRAGDTSKHVEVVAKAHESGDYAELTKYLLMVRKRVKDPKVDTEIVHSYARAGDLPALEAFVAAPHLADLRAVGDRCAEEGLHDAARLVFATIPDYGRLASTLVKLHRYQAAVDAARKANSPRTWKEVCYACVEEGEFKLAQLCGLNIIVAADDLAEVAEFYTQRGHADELIALLESGIGLERAHMGIFTELGALYARHRPERLMEHLKLFAPRCNVPALIRVCEELELWRELTFLYVAYDEYDNALGVMVGHAAAAWEHVQFKDVAVKVKAAETLMGIKGIGGHAARAAPMPGEAASWHSVLXXXGWGSKELVGMWPGPLPCPARQRPGTPSLSPSIGNWQSHHSRTTPGPVPRKLSHALVPSPFPSPLNPAPAQLAGGGVAGGPLARGGHHAPRRAVAPGQGVPGVGAEERPAGGERGGERAASARGHRVPAPGRAHLQAQPQVAQGGGSGQDRQAVRGQRWCWVXXXXRNLKWHKAVALAKTDKLYEQTGTPDGGQGLPRSSPPPSISSPVPPANTPNEQDAMETAAQSGERGIAEDLLRFFVEEGAHDRFAECLDRCRDLVKPDVALEVAWRNGLTDAVMPYLISVLRDYTTKVDTLVHERKEAQGCPDXXXXYTTKVDTLVHERKEAQVQGVGEGGTGRWLMGLERRCDWRGEAANIEAGQSRLECRKRTGWDPECTIWEGATPKAKHRSRPHPVQLTTTPSHTQEAXXXXGPGIAGTFLQVHHRPQPRQTTGHTLTQANSQPPPPTHRRPASWTRRPRSSRSRRPTPTCTSTPTWRCPHPHPTARPPPRPLATRRGLTASERTCGVAPAATLTGAGPACLNVCACDAHLECEESRSALLHGRAAGGMWAGGRVGGPGENSAAPGAHXXXXLECEESRSALIHREQLGECGRGAG

SEQ ID NO: 17464 - protein, 205 aa, Chlorella protothecoides
MLRPGLHTSPCARTLRLVSVKCTRSRGRAPTLIRGSQTGAGEIPVWGLMDMVPVCTLHGVVRPPACAMSDWQLAHPATLDPSSSQAHAQAPFPADWRARLSPDPAAGAWVALGKFDALHRGHAALAAWAAARPGVPWLISFSGMAAVLGWRERLPLVAPGDRARILSAWGKEFGVTPRELRIPFAEVRDAMQTWSCRGMQGAQGS

SEQ ID NO: 17465 - protein, 625 aa, Chlorella protothecoides
MFAASPLRSHRPSNPINHLPVPPTPPHLSLLALVDQGVHLGGVVAEHGDEVGHDGVGEAVAPGNLQGHVGLDQVAAAVQALGEAVVRALLHEEAQEVLGDAALPGLGRRLHGVLFSHRLVPLEVALVDERGQAPELGVLVPLQPPRQRQRVVVLIGGDAVAQARGVALAHKQLVHRLVHRLQVVLLHRHQVLLDQGQLPGAAHDVHHARVVHPRLHHLRVGQAPGLEGRGRGKGPGRAKVCEGRGQGLGRLHLHRHVLELDVLPGSGRVPHHDPQRVVVLVVGDVEEGELAPELQLLADADEGGDVAARRKQLEVLHEAFRAVARVQRAQLGEDAHVRALQADARLQQRDELVGVAALRVELGHLGQVVGGDDDVQAAQLGQLELALLHAGIAHLLPRAWAVGLARRVHRRLVAVQLDQGAGQAAVVGDGGEDQACGVVQALLRAAVAHRAEVGEVGGGHEGLQRGQVAGARVGVHDLRVHLGVLDPLAHHEQVLGQLRVVAALVRLGHHLHVLAGVAGAEVGRDGVRHAGVGQVGVGQLGPDARLVHLGRILVRAVQVFQVVQQHVDGLGAQAKLLVDLERLLEQLVAHCDLAHCGAVKVVQAVDVVLHPRLVGLAVVEGFIWG

SEQ ID NO: 17466 - protein, 572 aa, Chlorella protothecoides
MPFLPPFLPQAVGPVAVTSTLLGNGLEKIFGSLSTDPNNPEDPALQANINSAAIEVAFLAGVMYTGIALLNLGWIIRFLSHSVISGFMSGAAITIALGQVKYILGLKLGRGSTIQSLLDMIFSNLSGFKWREFVMGYFFIGLLYTFRWAGNRFAHKRLGFLRFLGPITVVVTSIAVMNIFGLYKNPTTASPYIKPIGKIPKGLPPFSANHWLPLYDVSRQVTLAIIICLVDVCESISIAKALAQRNKYRLNYTQELRAVGVANLFGAMFSCYTTTGSFSRSAVNNSAGAKTPFAQFVCSMLLMLTLLVLTPIFTNMSANVQVGGGTPRPLHPTTLHLPSPPTPTPTNNLQGAIIIVGVLGLFDYSEFLYLYKVNKLDWIVWLITFFVVLFAGVEIGIGVGVGVSLVLVIWRAAFPAIVKLGKLPDSAVYRNVKLFPDTQQTPGVLVMRVDAPFFFANVESIRDGIVRRVEEAQATPEAESGAAPVRYVVLDMGAVTDVDATSIHWLTEFVYDLKSDLGVQLVLSNLTRPVLRAIKNGNVHRRLGPDHIFVDTNDAVVTLSTGLKQGRVDKAL

SEQ ID NO: 17467 - protein, 505 aa, Chlorella protothecoides
MGTAPLGRRARPPPSPRRIPGEYLLGCKKYVGNDLADTPLIAFINGRSGGQMGTQLLTVLSRSLGQSQVVRGRGLGWWWCFSERGVAPGCCLPDSMCSSGHGVRGLCMWQPHGPPRSPPPPPQFDLSEDRPEPVLRTLWSNLLEREAKGDKLAAHIRRWCPGLALGEGFCARRMQAHECPLGPAGECGGKPARPQGCSSPSPCRPAPALGGIAAPANLRVLCAGGDGTVTWILKTIFDLGLEPAPAVAVLPLGTGNDLALSFGWGNAFLKKWIAADQLYHTLQRYAEAQPRALDAWRITLAGPTPGLFEHLPHSLSLAGAGSEGGGGGGAPASAGAVGGGATEGPDTPPGATRVTGMFWNYFSVGLDAEAAYGFHALRESRPWAAQTRVMNQAWYGWYSCTSGWFCAAPPLRNSVRLRGRGGPGGPAWRDIPLPASVRAIVVLNLQSYGGGRDIWGLSDGGGLRQGKRVVPIFSDGLVEVRGEVRGGASGRGGGGVSRGLGRRPA

SEQ ID NO: 17468 - protein, 126 aa, Chlorella protothecoides
MANLEVDLSKIQPGQTITVKWRGKPVFIRRRTEDDIAKANAVELSNLRDPEPDSVRVKNPEWLIVIGVCTHLGCVPLPNAGDYQGWFCPCHGSHYDTSGRIRKGPAPYNLEVPTYSFMDDDKVVVG

SEQ ID NO: 17469 - protein, 155 aa, Chlorella protothecoides
MSQVTEQSVRFQTALASIKLIQASAVLDLTEDDFDFLTSNKVWIATDRSRARRCVEACVYGTLDFVGYPRFPAPVEFIAAVIAYYVHPVNIQTACLIMEGAEFTENIINGVERPVKAAELFAFTLRVRAGNTDVLTDAEENPLRGTKGKRKGARL

SEQ ID NO: 17470 - protein, 284 aa, Chlorella protothecoides
MVLAAEGRKANDSHADCYQYFCVPEYGTANGRLHFHAVHFMRTLPTGSVDPNFGRRVRNRRQLNSLQNTWPYGYSMPIAVRYTQDAFSRSGWLWPVDAKGEPLKATSYMAVGFYVAKYVNKKSDMDLAAKGLGAKEWNNSLKTKLSLLPKKLFRIRMSRNFGMKMLTMTNLSTECLIQLTKLGYDATPFNQILKQNAKREMRLRLGKVTVADVLAAQPVTTNLLKFMRASIKMIGVSNLQSFIASMTQKLTLSDISDESKNYLDKAGITTACLRIKSKWTAGGK

SEQ ID NO: 17471 - protein, 498 aa, Chlorella protothecoides
  MOD_RES (361)..(363): Any amino acid
GAAAGPAADGALAVTAVATRTRDAALLALLPTDVITRVPLSRWDVDAPTHASLPARFGGFLDGIDAFDAGLFGLQANECDLMDPQQRMLLESAWEVLRLSPARTARVAVAVGIASAEYNNTLVPAWTTGVSAYSATGGAPSVASGRLSFTFGFKGPAVSVDTACSSSLVATHLAAGAVWGGSAGGGLAAGVGVLLSPSPTAMFQKAGMLAPDGRCKSLDAAGGEAGGVMCACCRCVQWFDNRRGQLLERQSPWPQGQMMCMTARIESLPPTQRHLQTSLACRWVHAWRGHGCAQPAVGSRGRRRPHCPADSADGDQGERGEPGWTVLEPDGSQWPGAAGRDPRRPGLCGLPADSSGFPAAXXXRRPGLCGLPASSSCFPAAARYRHAPGRPHRDGGGQRAGPGRRDPGARHHRQGLGGAHRGRRRGGGPGARHPGGQPRADPGHRALDHSEPPHRHAAGRGRGQAGRRQGRGLAAAARRGGRAPARPGRRQRLRLPGH

SEQ ID NO: 17472 - protein, 73 aa, Chlorella protothecoides
MIGVWNVGRSYDPAHPAPVPPHNSTLPTPRRPADKAQIRMGRMARKGEGDRHIPDLKPKHLFSGKRPRGSTDR

SEQ ID NO: 17473 - protein, 240 aa, Chlorella protothecoides
MPRIRDGTARPPIIPASVLAKKGLPPAAPRPTERDLQEAQGGAGVYNADLRKQYDLKDEAWRYDIMPEIADGHNVLDFVDPDIDARLEALEREEAAAAAEFEALDTGLADDHLSQAEWEDLHRIRDRKKRIVADNRRKRAAADNTPRIPRTLDAPRSRTAERMKAELGALGLDAAAAAAAAPRSRSRGRSLVRKRERAEGEGMEVDGAEGGEVKRLHSSKSRWAEGAWVCCIWKRVGGAS

SEQ ID NO: 17474 - protein, 179 aa, Chlorella protothecoides
  MOD_RES (165)..(168): Any amino acid
VKPEPSAARDAPAPAPAAARGAAVSSAQARTRPATRHGGAQPTTRMRDGFSSEEEEEEEVKVESDAEEEEGGERAGPAAGPSRKRGAASAPAPARAAKPLRIPKLPMVLQGRGSWYRARVVKDAGDRVLLGEGPGGGVSGGVEQLGLGWKVVVDRDGRRERGAAXXXXVSGGMEQLELG

SEQ ID NO: 17475 - protein, 84 aa, Chlorella protothecoides
MPHLPFPPPNIPEFTGFEDQFPALWLARATDRIWRGSYRGKDWKYLGGGAWEPKKAAGAGARHARKAAAGPGAHADAAASGEGP

SEQ ID NO: 17476 - protein, 170 aa, Chlorella protothecoides
  MOD_RES (137)..(140): Any amino acid
MRLAFPSALDGAAATPGPGWMASPGSGPARDAGVHVPRDPGEAELAFDAGTYPLGICLADVSVVGVAQHSAFPTATVRVGAGGATEDGGAEGGGAAATTPAPSAPPPCFQPLPGSQPALHCLLHRQLAGGRGERALXXXXWAWRSTAPSPRRPRGSAPAGRRRTAARRVA

SEQ ID NO: 17477 - protein, 323 aa, Chlorella protothecoides
MLRDVARLVIQKSSVTEPADRLAPPLHGYALFQPHLPRRRAVPQPLRATSPAMTPAIGTQDLEPFVALANRLADSAGAVSSRYFRTPVAVDVKADASPVTIADREAEGAMRDLLSTHAPTHGVFGEEFGHASGSDPDWTWVLDPIDGTKSFITGRPLFGTLIALTHRGVPVLGVLDQPILRERWVGVLGAETSLNGLPIHTRPCASVGDAYLFATTPHMFSGPNAEAFARVRDASRIPQYGCDCYAYGLVARGLADVVVEADLKPYDFLALVPILEGAGGVMTDWMGEALRLDPETITEAHEVVAAGDARTHAQALELLDWRR

SEQ ID NO: 17478 - protein, 174 aa, Chlorella protothecoides
MPRPPSLQDIAVFKTGAFGKVLVLDGAIQCTERDEFSYQEMIAHLPLCALAVSNFSLGWQGQVDGHCPPRGHRPMMCCSGIHTPSKTPRSTLTLTLSCPPPPSSQRPAKKVLVVGGGDGGVLRELSRHSSLEAIHMAEIDGCASFGSPGTHACNSGALKIPPGLSVEWEGQVGG

SEQ ID NO: 17479 - protein, 424 aa, Chlorella protothecoides
  MOD_RES (107)..(110): Any amino acid
  MOD_RES (239)..(242): Any amino acid
  MOD_RES (356)..(359): Any amino acid
MPFMLSWPDPRVLCDASARSIPRLPFLRAAALSRLPRSTSRAWPSASLTLVSPCTFATVSSLSRCVLGGVSRGAKDSTELVGGFGGEDLDPARVYPGTTKPRPGVIXXXXCWAALLTCPYAASPPPPPSQDAEENTYDAIIVDSSDPVGPAEVLFQQVRSQEGGRACPRHPAAGRNASLRPGILCALLVGQVILMGSALRARHNPAYMPFAPSLPPIAPETPFQASRPNTLPALLRGHXXXXLPPIASETPFQTSRPNTLPALLRGHAPRTQARRRGLHPGRVPVVPPGHHQGPGRHVPHRVRGRDGAVRLHHHPHLPLRPDRLHDLLQGRPRGPGPAGSPHAEAKRGRRRQRRPXXXXPRPSWTPARPSGAWTAPTAPPWGRSSTTARRCTPRPLCCPPLPSASCRPPYPFERSEGGGFAMCK

SEQ ID NO: 17480 - protein, 127 aa, Chlorella protothecoides
MLMADPDPARRAMWAPRLFCLESYSQHGINALMMAGEIALGCLPPDLWAAGGQGAWAGVYGVWAAVFFLRHGRPIYPFMDVKRPHAWVGFLAMFLLAWAGFGLVQGGLALRMRAERRSVALAARKVE

SEQ ID NO: 17481 - protein, 81 aa, Chlorella protothecoides
MSRTGFAHPPAPGTFLPQVTSQFVQQFYTVLHQSPKQLHRFYADSSIFSVANVAGDGLVHTAVGQRWSEDEAGASVGKDAS

SEQ ID NO: 17482 - protein, 379 aa, Chlorella protothecoides
MVGPSTAASTICYSLEIHGCLATSTFPHADARRRGDSEDDSASSSASSGSERDSGGEEEAEVIRAKGQAAAVPPPSAEREEEDEEEEEGSSEGEDENEEDDESEEDDEDENEEDEESEEDDEGGGDSDAEALSGDVELDSPLDIETIPLTTRLEDLSESDFDEEDFEAMERLAAQLRAWLSDAPAPDPARPLKCTLCRGALMLKPVTLRQHVASKRHMRRLAAERARERAERGGADAGSSSSEEDEDAAALAVAEGICFAEDYVSDSEKIETAEEGAARLAAALRAAAEGRARVEAKKARKAKQVPQPGNRAARRAAAGLGAAAAAGKGDQGSQAGSEAAAPVQAVASSEGKKREKKERKRPGKRQRQALKPAPESDSE

SEQ ID NO: 17483 - protein, 138 aa, Chlorella protothecoides
MTTIKNLSSTGIYAYTTLISVFICVPGIFFFERGVWSAIRTQVALKGAGQFYGALLSVGLLYHLYNQFAFNTLSRISPVSHGVCNVVKRVVIIATSVLFFGNKLTLQTKVGTGIALLGTYAYTEAVKRYKATPTPKLA

SEQ ID NO: 17484 - protein, 109 aa, Chlorella protothecoides
MAELIRPSLYSAYQHIELTAPHHTPKAVYDVVGPVCESADFLGKDRELATPAAGDGLAVLDAGAYCMAMASTYNLKMRPAEYWVEGGDTLKMIRRGETLEDHLKLFEGL

SEQ ID NO: 17485 - DNA, 61 bp, Chlorella protothecoides
tggctgtgaatgtaggccatgcccttggcgacctcctgcgccgtccgcagcagtgctctct

SEQ ID NO: 17486 - DNA, 143 bp, Chlorella protothecoides
caaggtgccactctaccactgagctatatccgcattaaattgatagaattgaaccctaagattataaccaatatataattattttgttttttatattataattttattataaaaattttataaataaaattcaattattttat

SEQ ID NO: 17487 - DNA, 61 bp, Chlorella protothecoides
aattgtaagtatttacttaaataaaaaacctcaaatgaataaagtgtattttttattttta

SEQ ID NO: 17488 - DNA, 230 bp, Chlorella protothecoides
aaaaaaaaataaaaccaattacaatttttaaatttatgaaagttcgtcctggagttcgaaaaatgtgcgaaaaatgtcgtttaattcgtcgtaagggagttttacgtattatttgccaaaacccaaaacacaagcaaaagcaaggttaaagcgttatatcatttagttctgagaaactcaaatgatatactattgtataaaattttgtattacattaaaattattattaa

SEQ ID NO: 17489 - DNA, 105 bp, Chlorella protothecoides
aaaaaatgattacaatttttagttatctcgctttattaattggagcttcattaataacagtaatatgttattatagtttagtaaaaattaaattaatataaaaaa

SEQ ID NO: 17490 - DNA, 162 bp, Chlorella protothecoides
aggggtttttatacttaaaattttcaattacattttctcttagtaattcacttgtggtattccaaatatcaattgttcgttgagatttttcaatactagtgatgtttccagctaagttttcatattctgttgtttggagtgcaatatttgtttgtaataaaa

SEQ ID NO: 17491 - DNA, 105 bp, Chlorella protothecoides
agctaattgagcatgccaagaagttgttaatatttcatataaacctttatgaccttgcccagtaaatggaccgctatgtgcttctagaatttctttgatactatg

SEQ ID NO: 17492 - DNA, 1125 bp, Chlorella protothecoides
tttaaaaattatttagaaagcaacaataataaatattataatttttttataattaaatatattataaaatagaaatttcaatcaatattatttagttagttgaatttaccctcgagagggaaaggagaatttttcgccatgacaattagccccccagaacgcgaatctaaaaaagttaaaattcttgtagatcaaaatcctgtagaaacgaactttgaaagatgggcaaaacctggtcatttttcacgcacgttagcaaaaggtccaaatacaactacatggatttggaacttacatgcagatgcacatgattttgatacacaaacaagtgatctagaagatatttcgcgaaaagtgtttagtgcacattttggtcaacttggtattatttttatctggttaagtggtatgtattttcacggcgcacgtttttcaaattatgaagcatggttaacagaccctattcatattaaaccaagtgcgcaagttgtatggccaattgtaggccaagaaatgctgaatgctgatgttggtggcggatttcaagggattcaaattacatctggatttttccaactttggcgtgcttcaggtattactagtgagcttcaattatatactacagcgattggtggtcttgtattcgctgcagctatgttttttgcaggttggtttcattaccataaagcagcgcctaaattagaatggtttcaaaacgtagagtctatgctaaatcaccatttagcaggtcttttaggtcttggaagtttagcatgggctgggcaccaaattcacgtgtctcttccaataaacaagcttcttgatgctggtgttgatcccaaagaaataccactcccacatgaatatatttttcatccagaatatcttgcacaattatacccaagttttggcaaaggattagtaccgttttttacacttgattggaatcaatatagcgatttcttaacttttaaaggcggtttaaacccaattactggaagtttatggctaacagatactgcccatcatcatcttgctattgctgttctttttattattgcaggacaccaatatcgtactaattggggtattggacatagtatcaaagaaattctagaagcacat

SEQ ID NO: 17493 - DNA, 205 bp, Chlorella protothecoides
ccccagcccttcaccaagcccaagtcccagcccatttgtcatgtaggccttgctgtaactatgggatcctttcatgttctgtgtgccattgtattctacacagctcaatgactgtgcagcacaatgtcccttgttcagaatctgacccacctccctccacccctccattgtccaggccgttccctggcggcacatccctactacc

SEQ ID NO: 17494 - DNA, 70 bp, Chlorella protothecoides
tttggaacattcgcatacggggactcgaaccccggtcccacgggttttctatatcctcagagatgggaag

SEQ ID NO: 17495 - DNA, 61 bp, Chlorella protothecoides
gccgcctcctcctgtgacgtgtgtggggaggggggttgagaggttgcagcatgcttagtca

SEQ ID NO: 17496 - DNA, 345 bp, Chlorella protothecoides
ttttgggttccggggggagtatggtcgcaaggctgaaacttaaaggaattgacggaagggcaccaccaggcgtggagcctgcggcttaatttgactcaacacgggaaaacttaccaggtccagacatagtgaggattgacagattgagagctctttcttgattctatgggtggtggtgcatggccgttcttagttggtgggttgccttgtcaggttgattccggtaacgaacgagacctcagcctgctaaatagttttggttgcggtttcaccccagctttttaagacttcttagagggactctcggcgactagccgagggaagcttgaggcaataacaggtctg

SEQ ID NO: 17497 - DNA, 213 bp, Chlorella protothecoides
cgcgatcgagctgccaatccgaacacttcaccagcacactcaatcggtaggagcgacgggcggtgtgtacaaagggcagggacgtaatcaacgcaagctgatgacttgcgcttactaggcattcctcgttgaagatcaataattgcaatgatctatccccatcacgatgcgggttgcgagattacccgggcctgtcggccaaggctgggctcg

SEQ ID NO: 17498 - DNA, 61 bp, Chlorella protothecoides
acccgggcctgtcggccaaggctgggctcgttgaccgcatcattgtagcgcgcgtgcggcc

SEQ ID NO: 17499 - DNA, 919 bp, Chlorella protothecoides
gactgagtggctgaaagtaccggtcttgaaaaccggcgtattcgaaagagtatcgggggttcgaatcctcccttatccgcatcaacatataggcatagtaaatccgatttattaaaaattaactattgtgggtaattagctcaatggtagagcacctcgcttacaacgagacggttattggttcgagtccgttattacccaaaaccttttttatacgaaggagcgggcgtggtggaatggtagacacactagatttaggttctagcgatttagagtcttgcgggttcaagccctgccgcccgtactaagtttttagtgttggttgtacttgttacacttggttgtatgaaattaaaatcaatataatttattaaacttactaggtttacttcgtacacgcagtaacttcgtacacgaagtaaacgaagtacacgaagtaaaagaactaaaatttcatttattaaaataaattgttcttaatggaagaatggctgagtggcttaaggcactggtttgctaaatcagcgtatgttttatgatgtaccatgggttcaaatcccatttcttccgaataactttccaaacttttttaggggatgtagttcagttggtagaacgcatgctttgcacgcatgaagtcatcggttcgactccgttcatctccaaatttaaaaccaagtagaataaatgtaatttattcagtcgtgttttggcaaatttttgatctggaataaattttgtttgttttataaaaataactaaataaattttgtttatttcaaagagattatgtcaaaaatacaatacaacacgctattatttaaagacataattatggtttataactttcatttattttactcgttattttaattataaattgaaaaataaatatcgttttatagacaaaaatcaaaaa

SEQ ID NO: 17500 - DNA, 102 bp, Chlorella protothecoides
tttaaatattcagggtatacataaaaagtcgtttcatttctatgagagacatgatattgaatccactgaggtaccattaatagtatagatttttcgaaatta

SEQ ID NO: 17501 - DNA, 353 bp, Chlorella protothecoides
gcttcaggtccagtaaatatatctacatctggtgtttatcaatggtggtttactattgggctacgaactaaccaagatttatataatggatctatttttttaattatactttcagcattatttctatttgcaggctggttacatcttcaaccttcttttcagccaacgctttcatggtttaaaaatgcagaatcgcgattaaatcaccatttagcaggtctgtttggaataagttctctagcttgggcaggtcatttaattcatgtggctattcctgaatctcgtgggcaacatgtacgttggaataattttctgactgttttaccacatccggctggattaactcctttttt

SEQ ID NO: 17502 - DNA, 142 bp, Chlorella protothecoides
ctgttaaccaaagactttgagtttcaggatgaaaccctcctaagaatgttaaaatagcactcccagcgttttcattagtattccaaacatgagtagctgcatctgggttttgagcatatacaacccaattacctgtaaaaaa

SEQ ID NO: 17503 - DNA, 469 bp, Chlorella protothecoides
aaaaaaaagtagtaaaaacatggtcccgagcctcaacgattgttccattaatgataggacatacgattgctgtgcataatggccgccaacatattccactttttattacagatcaaatggttgggcataaattaggtgaatttgcccctactcgcacttttaaagggcacgtaaaaaaagataaaaaaacaaaaagataattaatatatgggacaaaaagtacatcctttgggatttcgtcttggtattactcaaaaacataaaaattattggtgtacaaaatctcaaacatcagcactttgggttcaagatgcaagttttattcgaaattatatagaaaaagctttttttggagcaggtattattaatattgaaattcaaagacgtgaaattgaatacccttttataagcattaaaattcatgcagcacgaccaaatatttttttaaatcgtaactctttttctaaaa

SEQ ID NO: 17504 - DNA, 804 bp, Chlorella protothecoides
ttttaattggtaatttagaagctgctaattttaaagccgtacgggcactagtctctggaaccccttttaactcataaagaactttaccaggttttactaccgcaacccagtattcaggcgctcctttcccagaacccattcgtgtctctgcaggtctcattgttacgggtttatctggaaataatctaatccataatttaccaccacgacgaacttggcgtgttacagcacgtcgagctgcttcaatttgtctagatgtgatccatgaacactctaaagcctgtaatccatagtcaccaaacactaatttattaccgcgtaaggcttttccagacatgcgaccacgatggtatttacgatattttgtttttttgggactaagcatatgttatataaaatttagaatttattaatttataatactataaaatttgtaactttatagattacttaatggagttaaacgctcaccgcggaaaacccaaattttaatacctaaaaggccataaatagtttttgctgatttttcggaataatctatttcagcgcgtaatgtttgtaatggtactggtccacttcgtaaatcttcagaacgagcaatatctgccccatttaaacgaccagaaatttttactttaatacccttaacaccagcttttattgctttccgaacaacttgtctcatagcttttcgataaggttttcgttgttgcaaatcatcaactaatttttctgcaagtaccattgcatgtatatctggattattagttgaatttatagaaatcgtacaaaaaatttttccag

SEQ ID NO: 17505 - DNA, 1194 bp, Chlorella protothecoides
gggggttggggtctcttgtgctgccggcggcttcgtcatcgtcgttgtgggcagttgagacccacctcgtcctgaagaggtggccgggaggcttgttccgtggggagggcgtgcaaatgctccaccaggtgtggcgagttctcccccggcatctcggtgtcatcgggtcgtggccagttaacaacatcgctacttgacgcagcgtaaggcggcctgaggcccaatattggtgcgacgatgccgagatgtctcgaactgccggctgcacgcccttgtgtgccctccagacgacgatgacctcccatgccgtcagctcccctcgccctggtcaggaggcccgcgtctcgtctcgccctctgcgtgtcatagagacagcgtgcggtctaacaggttgttttccgggaggggaacgggaaggagccagggagagcgcgcgtgaggggggggttgggcgggggttcgccagctggcgcaacagaccttgttgccagtcatggagcgttggtgcgtgatggctcgtgtgtagaagggaacgcaggcgttaacttgaacgagagaatttatcgtggtggctgtcagttccgaatgaagatctctccttcggaagtgtaatagggcagagccagaatcttaaatgcgacagccggggattcccgtgcacatctgaaactgcagtacctgctcacctctggtaccgagcaggtggatgggcccgattcattttgaattcctgcagactgcagcagagacttgcggacgatacctatgctcataagttggggccgaagattgtactgcacctgatgacccacccaccctctcccggccgctttgagtgcgcctgtcgcagggtttggaaaaccaggaggggccgtgatctgcacattcgggtggcaaagtgcgccttgcccagcatcagccgcgcttttcggttagggtggctacataccgctgcggaggagcggaggcggcggataggccgggcccctgcagaaccttgcgcagtcggtcaagtaggcggagcagcctctgagcccctatccccggccccccaaaactgcggggcgaccgatcaaggcctaaatttcggctgtctcccagaggacgatggcaccttccctcctgatgtgagtccacccaggctgttgggcaccgacccgtgcttcagcggtcaggccgagtgcgatcgtgccc

SEQ ID NO: 17506 - DNA, 10494 bp, Chlorella protothecoides
gccacgcgccgtggcgttggccgcgctcaacgcgctgcgcgccatcgaggccaacggcgacggcgcggggccgaccgaggagggcggcgaggagggcggcgtggggccggccgcctcgcgcgtcagcgacggcggcctgctcgcaagcctggcggccaccgaggtcctctgatgatgaatggatctgcgtcgctgctccgcagccagacgcggatgctcacgtgcgagtcagtggggcccgagcctgccgggccggtcgtcagcaggagggaggaggcagcgtttgcgatggacgtccgagtaccctccttggaaccttcagaatccccattacaccccaagcctctcctcacaagaccatcatccactcacacattcccatgctccttttccggacaagcatgtgccgttttggtcggccactcacacacagggcgttcacatgaccctcagcctgcacaaggctgcgcccctcctcctccccaaacccaagcgaggctggccctactgcccctgcgctcccccatactcatgagctcgtgatcaaatagagcggtgtgactcgcgtgtataccattgcagccaggagtgcagtcccgtacgcacacctgccccgtctcaatcgttgctcgtgcatgggcattcacacgccctcccctgggcaagcccatctcaagaagactgcaagtgcgttttgagtgtccgctcgtgtttcagttgtcatgtggcccgacgcaaggatccaggccaatcccatggcttcttcccgctaaaccctttgaggtgatggcaaacagctactcatcatcaagagctgtaaagtgttgcagcaggcttgccacctagcgcattggcagctgttcaaagagggtgcacaggactgggggccattggtaccagggatggaggcactgcatgaaggcaacccaggaagcaaggaagtgatacatcagcccccgccgtcgtcctcacactcgccgtcaaaccagagaacatctttcagtaccccagagtgtcattcagcgcgaccctgccgtcgccgacttggccggacggcggcttccactcagcttcctcatcccctgcgtcgccggcggtgcgccggcgggcggcgcgcaaggcatccaggtcggcagcgagccgggcggccgcgccctcgggcttcgccgcctccacgccctccctcagcgacttctcccgcttggagtccgccaggctggccaggtgtgctgcgatgccggcacgccgagcctcaaaggaggagggggggttgggggtaatggtgagggtggggccctgtccggacggtctcacctcctgggccgccctgcccatcgcggctgcacaggcgctggaagcagtgtgtgctgggcccttcctcagctccaggccgccccgcggtccctcctccgtgcccgccagcgagtggatggacgatgaggggggagtgggagctgggtcctggacggccagagccgcaggaggctgggcattcggagcagctccagggtcgaccccaccctccttcgctcccgggggcagtggtgccgcttgctgtgcctcctgcacggaaaatgcacgggccgagagtggcacatgggaacctgcagacgcgcccaaagcccccatcagccgggtctctggcctcagattgtgcggcccgcctcagcaagcattccgtcagctcgatcatgccccctggatgtcacgagcaattctgtggatccaccaccttggactgctcccgctccttctgctgcgcttcctcgtccagcagtcgctgggtggcctttgcaattgctgattgggctgctacagaccccgaggcaaagtacctatgtgtgtgtgtagggagggattgatgcagcctggcgggacggcatctgcagcaaactttgacttcagacagtcgagtaatgcaggcatttgtgcccctcagggtggccatgccagcaaggctgttgggtgccttgaatcttctgtcctcaaacagccattgccttgcaggtccagggcccatgtcatcgagtcaagccgctcctttcacatccattacggacccggccgccacctcacccttcgggatcggcaatgtggatgagcttctgcgtctggtctagctgctcctcgacctcagccagctgccgcgtcagcacctccaccttctcgctttccagtcggctgcctacctccgtcatgaaggcatccaggctgtccactactgcttcactggacccgctcgccggggcagcctccgcggactcaggcagcgcctcgctggtcgcaacaacccccgccccgcctgcggcccggctcgcctcgtctcgccgcgccaggtccagccgctcctgcagcgccgtcctttcctgctccagcagcgccttgcgtgccagcagcgaggcggcgtccagggccgcgtccgcagcctggggtccggagcgggcgccgcgggcagccttggcccgagacttgcgggtgccctgcgttcgatcatacatgaagccgtcctctttccccgaccactctgcatgaagggtagcggtgggctgagacagatgcattgaggcccagacaggtcagcgtcagcgtcagcgtcaagacatatcgagactcgcacctctgcgtctgaaatatattggcaagggtgatcaccagcacagggaacccgcagtggatccaacccaccctggtcgtcgtcgtcatcgtcagggtcccgccgccgtcgcttcttctgcgctgcctcgccgcctcctgcagctgcagccgccttgctccttatcgagtccctgcgagtggaggagggggattgcagggtatggcgagacccacatccaagccttgggctgcagcgggtgccactgcacgagcacaggagcacgtgcagggcatggttctgatgttccatgcagtatgattgcaaccgagcaagtcatgaacctcacacacaacttgcagcagaagtataacctccaaggcccgcagctcgccctgtctctgcagcaggatatcgtcaagcatcccacccaccgcagtgactcaaggagagtctcctccatctcctccatctcagccgttgccctgtcgacctcctgctcattccgaagcagcgtggttgcctgacctgccgacagctcttccatggacccctgctttgcctgccgacatggatcatgatacagagtgggtgccaggagattgcgaatggcaaggagccatgtttcttcaccttcagggcaaatgattgacgcaagggtccactccgagagaagaccagtccctttcagtcaccttgatcctctcgctctcagtctgcagagtggcacaccgcagctccagcttacggatcttggtcgccagcttctgctgcttatcggacaggcctcggttggccgcgtgtgctctccagtccaatgcctctggagagcagtgtagcacagggggaagaagtgaccattgaatttgccacagcatgacgctgagtggaagggctcatgcccacaccgtgtataaacaggtgaagcaccccacctcgagtgcatccaagcgtgtgacattgagctgggaagcacaggtgttgtaggcaaagctcggcatatcagcactctgtgaaaagcgggagagtccctgaatttcctccttggccgtccatcctcacctaggttttccgtatcttccacggcatcctctgagaacccccagctcgctcctccaccaatcgcactctccatctgagccttggcaatggcagcctctcgttccttccgggccgccattgcctgcagaagaggggcacatgtgaggctttggctccaccagtgcagcaacagaaatgtgtggtccgtaaaacgagggccagccacacccaacggaaattgagcttcatacaagtcacgggcactgtgctgctgtccactgacatgccagttggcacagtcacagatttcaaaaatttgatcagccgctggcgctcagttctctgtgcgagccatatacgtgcctcgagcgctttgagttgcatgcgctggtctcgggagggaccttcctccggcagcagctccgctggacctgtgaacaggtacagccggctgctctgcccaaagcggactatgtcacccaccctggaaatggagggaagatagcatcatttgcgtcccagctcctcgacaggggatccagcattccacatatatggcgcaagaaggaatcagtctttcacatttcatccagggtgtcaagggcactgtccatgacatctgtgcattgtggaaaagggacatagcatgtgcaataggattgcccaatgcctctccaccctaccggcaggtcgtacctcagaggtgcatgcttcttgttctccaagcggactttgtttatgaatgtcccatgcgtgctgcccgggtcatacatgaaggctgcgccatctgacccacggtattgcagcacagcatgcaacctgcatagggtttgggggccaaggagtgacggacaacagcggtgcactgccgacgtccgcactcgctaggcgacacatgccaagagacttgccaggaagtagcatcaaccccggcaagttacccactgcacccgcaccgagaggaggtgggatgttccaaggtgatgtcgttgtttggcgtgcgcccaaaggtgtagtatgccttgtccttcaggtccagctgagtcagcagggccccgccacgcatgacctccatcccatactccatgcctctgcttgatgcatagggcagaggccattacgtcatggatggttgaggcgtgtatgagctacaaggcaatggcctgcgacaaccacccactgcaataaaaggggtgatattgcaagcaaggactcacggtggaggtggcccagaccactgtggcggggtgtactctgctgcaggtggggcttcgcccgggcgggcctgcgccgcggctttcctttcttggaggccatgcaacacctgagtgcggaagactaagtattgaattgtgcccctccctccaagcttgcactggccataggcacctggcgatgcagcagtctgcgataccacagcatgacccaccttgctggctgcttcctccatcagcctctccttctgccctggagtggaatgcctggctgcctggagggcggcggcagatgctgcaatcaattcagtacgtgtactaggggcaggtgccggcgccggcccggcatcctcgctgaaacgaggcggcagggttttggcccgggactgaggggtcccacccgacgggttttgagcggcttcgtcagccatccaaccaagtttgtcgttacgatctggctgctagaagacacagaaacatgccgctgcaccttgtaaatggacagtcaaggatgcaggcacgaagatttgtctcttttgggtgccactgtggcgcagaattgatcatggacctttgggatgctggcgcctgtcacggtcggctctaaatgctgcagggcattttatttgctggtgaatgatgaacaatttttgaatggcagcatcagtgctccatgtcgcagcgccgtgcgagccggatgccgtccagggcgcgaagcacctccgaaagccagctgtagggtgtgctccccttaccgacctcgagtaatgagctcacccatcccaaacattacctgggatcgaaggtctccaacccggagccctttcttgccctgcctcttccccttgtcaccatccccaacagcatcgattagcatgtacgtggcagggccggtcagtcgtcggcaaacttccgggcgactcgctggcgcttgtcggagcgtggcgtgccgtcatccccgccctccatcctggccgcagggcgtttgttcccagccgccagcgcctggttggtcgccagctggcgcttcagctccagcagcgccagcacctccgcctgcagcgagatgtaggccccgcaggccgcccgcgtgggcgcccgcgggaactccgtgaccttgagctccgccatgctcccctccagcgccttctgcaccctgtacgcgaccaggagagggggtgagagtgtcacctcgtggggctaaagcatgtagagactgcgagcgggaaggtcgctgtggtgcgtgacgcgcactcaacgaccccccacgcctgacacagccgaggcaaggtcatcgtgaagatcaccccatgagggcaaggtgccgagtcgtgccgggggtcgcagcatgtacgggccctgcaccactgcacagccctcctccttctcctcacttggcgggctgcaggcgggcggcaacgccctctgccagctctcggcagaaggcgccgcgcacgatggcgcgcttggggggcacggcgggcttgccggattcatcgaagaccggcggcacgcccaactccggctcgttggagaaggcggacacggggccggggccggcggccgccgccgtgcttgctgcctcctggggaacgccgccgggcccagggctgccgcctgaagagttgcggaggagggcatgggtgaaggggtgccgggcatggcgggaggcgagcagtcggcaagcagaccacaggccagcatcggcaagtgaggaacagatcgacgctcgcggtgactggagggggggaggcttttggcagtgcgacctgcagagcaatcccccaccctctgaacactcccttcgtcaccatagtgccaggaccccccaccgcccagacacgcaccatgctctgcagaggccctccgggccgcctcctcctccttgcgcgcgctttctatagcggcggcctccgcaagcacccgggactcggcctcctcctgtgcaggggaggggggaagctgagggcatgcgagcactgaggcagcgacgaagcaggaatggccgagccatgtgtctgtgtgaggcgggccataacttggggcacacgccgagagcaggtgtgccttggcccggttgatctccaacccacatccacacctgctccttcgtgcggtccagaaggagctcaagccccttcttcctttcctgttcgtgctggcgattataagggtgccgcaccaggggctcgtgggccacgggctcgggaccgcccgccctcccgacctgcacaagggagacaggtatagaaggggtttcagatcggctggcaaggctgtctcaaagccataggcacccactgagcccacatcccgtcacatggcaggggagcagcagcaggatcctgcttcaggaggacagcgcgcaagcagattgttgcaagcaactgcatggaagacaggcaggcttccagagcatgcaggcagcatctccaggtcccagcatgtcaagaggaaagcgcgccgcaccagcaaatcccgctggaccgcgtagtaccgctccttcaggtcctccatggatcgtcgcgcgccgccctcaaactgcgagagggggaaggaggttcacttgtgcaagggatcatccactcctgctcgcttgcctacaaggagtgaccagtctgatggaaaggcctctccagcacccagcagcgcccagccctgcacccaccgccctcttcccccgctccgcacacctcatagcggtcggctatgaccagccagcgaagatccagcgcctggacgacgtccagcaggtggtctgtctcctcccggctccaaccctcctgcttcgtgatcagggaggtccactcctcatcgtcgtaccgcagcactaccacctggcgatgccaatgagcagtggtggcgttggaggggagaaaagacaggagcaggtgcaacgtgtgtctgcatcagtgctgcattttcagaccgcaatgtctaaatggaaggcgccgagacagtggcatcaatcttgcagttgatggcgcatccattccccagccaaaccaaacagtgtgccactccgcccaggcccacctttttgttgtacttggcgaagctgtattcaccagggtccgcaggggcgactttgcctgcagcatcctgaaagcacttcacccagtgcttgagctggagaccgtctgcccggccagggttggcgaacggccgccactggaagacggcccgccctgtggaggagtgaggcgaaatatgtctgtattcgaggggagttccgttgcaaaaacagggcaatctgccactccaagggtgcctcgctgtcgacttgctccacccctcgtgcaagagcattcaacagagtgccaaaagtttaggcctgaaaggcatgcgggctctcgcattgctcacttcctcatttcatcatgcctctcccttcgccctaacatacctcgactcgacctcttggtcttctcccttgtcgcttttaaagctgcctctttgcgcaggtcgcccgccaggtgggaggggtgcagcgggtgggaggcgctgagcagtgcaaacgcctccctgcagatgtccaggtgaaggagtattgggtgatcgttgtgggtatcgcctgctccctaccctgccctcctggccatcgtcgacgaaagcgccacgacacgagccagctcgggtgctcacctgctcatccccttgggcttgacaagcttcttttccttgaccttctccacccgctccgccacggcactggcggagcgcgacactccgaggatatctttgacatccatggcccgcgtgccaacggcagtgcttcggccgtgggctccctcccccctcctatcgctggcaaatcgagcactgctctccttccgctcgaacacccgctcaacgtctgctgcagcttaagaacattcttctggaggatatcccccgcattcggcgtgtctgaagtgaaggtcccgtaagcatttcgggccacgacagcgttcgcgccttatactacaatgccaaccaaggttgaccatcgatcagatatgcaactgtcttatgccaatgaaaaaagcaagccgctactccacagcacctctctataaactagggatggttgaaatgagaatccgttcaagagtgtggatgggacctgcaacataacatacccgttccgtagagactgaccggtccttctaagatacgccccagagagagacacactgaatccagtcagacttacgaatgtgtacctcccgcccactgcatggagactcaagagttttggtatgtttagccaatctgggcttggaaaagatctgcagatcgaaactgcagcacctgacggggcatcactatgccacttcaatcattcacgacatgatgccgtgttgtgcgcaggtagaagctgtaatgctgaggatgcagttctcacaagcagtgaacgcctccaattacccccagcacacactatgaaaggcgataatacaaatatggctatccttgccaatgatctactcagcataccggaagatcagctcacccccaagagtggctcttcatataccagatgaggacttcctcaccactctgtatattgcaggaacttccaaacaagagggctgtcggattccttgtaccagaactgcttcaggactatttcgtcgatccgccccacttcaccataggttcggcccgggtccgccctgcgatgcaatgccccgcggcgcatatggaccaaacaccaccgcattcttttatttaagagcaaaagcgcgaaatcttatacaaaaaagcaatatatagagcgcagggttctagcagtaattcgccaaactcagacttcgtcttcgaaacccgtgcagtccccaacccaagcacaatgtccgagaccccaaagatggtgtacaagcagctgggaaagactggactcaaggtatatgtccttgggttttgtgagggctgccggtgctcaggtccactccggtcgacagggatcgcgtgtggagctcagggtgggttcctcacgatcttaacaggtttccgctctgagctacggagcctgggtttcttttggcgaccagctgggcctcgaggaggccaaggagctgctcaagacggcatacgatgcgggcatcaactagtgagtgggggtggccggtccggtgggcgggctgtccgatggtgacgtgccagtgacaatcgcttacccgaaatggggcggagatgcctacatgtttcatcatctatagctctattatgactgtctacgatgtcccatgcccgcccactcccactaaccacccccagctttgacaatgccgagaactactcctctggaaaggtgcgagaccggcgcgaggcggggtgttactgcatgcatgcatgcattgaatcatcaggtgcattggtgcacagcctgccatgccgcttgaaggtgcgcagcgggcagcgcctcacccggattgcatccccctcccccaggccgagatcttgatgggcaaggcgttcaaagaattgggctggaagcgtgaggacatcgtggtcgccaccaaggtattcccatggtggtgagggctgccgcccctgcatgcattgtctcgttcctggaacagccccgcactgcctctctcgtcctcctggatttacctgggcatgtttgtaccgccctctcacacactgtttccccccccc

SEQ ID NO: 17507 - DNA, 293 bp, Chlorella protothecoides
ttgaacgtgataaacttaacaaatatggtcgttcattattaggttgtacaattaaaccaaaactaggtctttctgctaaaaattacggccgtgctgtatacgaatgtttacgtggtggtcttgattttacaaaagatgatgaaaacgtaaactcacaaccttttatgcgttggagagaccgtttcttatttgttgctgaagctatttataaatctcaagctgagactggtgaaattaaaggtcactatttaaatgcaacagcagctacaaatgaagaagtactaaaacgtgca

SEQ ID NO: 17508 - DNA, 120 bp, Chlorella protothecoides
ttttttgacggtcaattacagcgtgcattgcacggtgaatgtgtagtaataaaccctcatcacgacaataatgcgctaaagtagtatttgtagtaaaaccaccagtaaggtaatcgtgca

SEQ ID NO: 17509 - DNA, 371 bp, Chlorella protothecoides
aaaaaaaatgtattttcagaccagactccaaaggatacagttaaaatggacaaaatccacatgaatcataatcaaagaataggtaaagggaaaataaacgaagttctagaaaagggtaaaataaattacatttatgaatttaataaaaaagctcttgaagaaattacgatacccttaaataatgattctatatctattgaaatgtcttcattacttgaggtagtatcgatagcgatagaaaatgtaacacctagtgtagaattaaaaaaagtacgaagggctggaaatacatttctaattccagctatattatcacaacacaaagcagacactctagctatgcgatggataattgaatcagcacgaaaaaa

SEQ ID NO: 17510 - DNA, 160 bp, Chlorella protothecoides
tttttttcatcaaatcagcccaaaataaataaaaaagacaatagcttagattatttttcttttatggaaacaatgaaatccactagtaaatctaatctaaaatttggtacaagtttggaaacaaaaaataatacatatttttcaaaacaaacaaaaaaaa

SEQ ID NO: 17511 - DNA, 186 bp, Chlorella protothecoides
ttttttccatacatattttaccataataaaccctgtttattctaccgtaataattatagactatatatgaaatcattatctaaaccgtacatattattatatattgttttagcgttttgcgtagcaagctcaaaacatatattaatttataatgaagagacattagtattaatttgtttttttggg

SEQ ID NO: 17512 - DNA, 228 bp, Chlorella protothecoides
aatttctgagtagattcactttgttctactaaactagctgaaaaaacagataacacttgagaaactggtataatctgtttatattgatcacgaatagataaatcttgatgaatttgagtgatatatgattggtttaattcatcgtgaatagtatcacctcgttcttggatcgatgctgttaaagtatctccaaagtaatgtttaattgcaaatataaacccaaaaaaa

SEQ ID NO: 17513 - DNA, 68 bp, Chlorella protothecoides
ctaaaaattttaatgaattgttatatttttttgttaattttttagatttaaaaagattaaatttgtat

SEQ ID NO: 17514 - DNA, 71 bp, Chlorella protothecoides
tttaaatcataaattgtcagataacaaattgagttattttggtaatcttttttatctttcttatatttttt

SEQ ID NO: 17515 - DNA, 70 bp, Chlorella protothecoides
acgtgtgttaaagcccttcagcagctctggaaaatctcgcaccattgatctgttgcgaccaccggtttgc

SEQ ID NO: 17516 - DNA, 191 bp, Chlorella protothecoides
cacaattctggtggagacatatagaccaagctatattgattaagaattttattattgttgattctttttttaacgagtcgacaataataaaattcttattttacttattatatcgaaataaatattacttccaaatcttgttatctattaaaataaaagaaatttagttattttaagatagataaaaaaaa

SEQ ID NO: 17517 - DNA, 547 bp, Chlorella protothecoides
ccatgagcttccataaatccagataaccagggcttgctaattatcaagtgaggatcactatgatatcgggtttcgccttttaaaaccttagcttgaaaatcttcttgatttaaatagtacatccaaacatgagatttataattatcaggtaacttctcctcccaaatagctgttattcgtctatccttttctgcactcgatagtgatggattgtcataaattaatagacaccttctaaatctatcatatctgtgttgttttacagtcaataaagaaaattcatcaaaaatataaatttaatttattttaggtaaaatgatatttattaaatcttctctatttgatacataaaaactgattatattatcatgtggttttgaaattgtaccaacacctaattgcttttgtatataatgcaacacttgactatttggcatggaaatagataatttaaatgtaaattttctgtttagaggatactttggatcagctttatgaactgtaaaagtaccatcaccatcagtaaagcccactaaccattgtttaa

SEQ ID NO: 17518 - DNA, 233 bp, Chlorella protothecoides
atattttggtttagtttaaaagtagtgttcttcctatttgcttttatttgggtacgtgccgctttcccaagatatcgttatgaccaattaatgcgtttaggttggaaagtactcttacccctatcgctagcttgggtaatttatgttgcaggtgtcttattatgttttgactggttagcttaatataaattgattctaatctttaaatcataataaatatgctctatttattt

SEQ ID NO: 17519 - DNA, 448 bp, Chlorella protothecoides
aagtttttcgcgagcattgggtgaatttggttctgttgttatgatttcatctaatcttccattagatgatttagtaacctcagttttaatttatcaatcattagagcaatatgattattttggagcgtctgttataggtgctgtaattttacttcttgctttaattattatttttttagtaaatacagcacaatctttctattctcgtcgttaattttatattgaatttagaaaattgtgtttttatattttgttatataatttattttaaattattcattaactaaaagaaaaagggtatatggctctttttactttttttattaaaaagaacttattatatatttagtatatgtcattaagtgaaaatattcgcgattatgttgaagtattagctggagttactgaaacgccaggtaatcctatcgagtttgaaaaatttatttcg

SEQ ID NO: 17520 - DNA, 263 bp, Chlorella protothecoides
tgggattccttgaattaataatcttctaattgaaataatatgtattatagaaaatggaagcgtgaaaaaagcactatttaaaaacccaactaataaaggattttgctctacatgtaaaatctctaaaaaatcaaataaagatcctgggggcgtttgcccaacgagtgattcataaaaagctggtatttttataggtaatagactaaaatcacgaatccattgaaaacttaaaaactgtaaaatacaagtttgacatattttta

SEQ ID NO: 17521 - DNA, 879 bp, Chlorella protothecoides
aaaaaaatatacaacataaactactcattacaatcatattagcatattctcctaagaaaaataaggcaaaccccatagcagaatattcaacgttatacccagcaacaagctccgcttctgcctcgggcaagtcaaatggagccctgttggtttcagctaaacaagagataaagaacatcactaatagtggaaataagggtatacaataccatatttgtgtttgagctaatacaacttctgttaaatttagagacccagcacaaatacatacagtgattaaaattaatccaattgaaacttcgtatgataccatttgtgcagcagatctacaactccctaaaaaggcatattttgagttactagaccatccagctgtaataataccatagactcctaatgatgaaatagcaaaaacataaagtaatcctacatgtatgtcagctaatactataccttcaccaaatggaatcgaagcccatgctacttgacttaataaaaaagttaatacgggagcaaaaagaaaaattactaaatttgcactacttggaagtacaggttcttttactattaactttaagccatctgcaataggttgaaatataccataaataccaacaacattaggaccttttcggcgttgcattgaagctaatacttttctttcagctaatactaaaaaagcaatacttaagattaaaggtacagttaaggctagaattttcaatactatactaaatattaaaatattcataatttttctattttattaatggttgtatttatatatttatataagataaaaacttattatcctaaataaatatataatggataaataaattataagctctataattttatttattgcttgtttttttt

SEQ ID NO: 17522 - DNA, 353 bp, Chlorella protothecoides
gtatcgtatttaaaataccctatttattttggtggaaatcgtggtcgtggtcaaatttatccagacggctcaaaaagtaataatactatttatactgcatctagcgccggaaaaatcactagtatagaaccaattgagaaaaaaggtggatttttaattagtattcaaacggcaaatggtgatattattacagatacagtaccgccaggtcccgagttaattgtaaaaactggtaatgaagttaagctagatcaagcattaacaagtaacccgaatgtcggtggttttgggcaaggtgaaacagaaattgttttacaaaacccaactcgaattatcggtttattagttttttt

SEQ ID NO: 17523 - DNA, 96 bp, Chlorella protothecoides
ataaaattgatttatgaaagaataaattttttaaattaattaaaaattcatttcagataattgaactttttcgtattgtttcttttttaatacaaa

SEQ ID NO: 17524 - DNA, 95 bp, Chlorella protothecoides
taggaaatcaaagctatgctttcaatttttcaattagtattatttagtttaattttactatcttttttcttagtggttggtgtacctgttgtttt

SEQ ID NO: 17525 - DNA, 373 bp, Chlorella protothecoides
aaaaaaaagattagagtttaaatactagccattgattgccggagcatcaactactgctaaatctagtgggaaattgtgtgcattacgttcatgcataacttccataccaagattagcacggttaataatatcagcccaagtgttaataacacgaccttgtgaatcaactactgattggttaaagttgaaaccatttaagttaaatgccatagttgaaatacctaaagcagtaaaccaaataccaacaactggccaagcagctaagaagaagtgtaaagaacgagagttattaaaagatgcgtattggaaaattaaacgaccgaaatatccatgagcagctacgatgttgtaagtttcttcttgttgtccgaat

SEQ ID NO: 17526 - DNA, 123 bp, Chlorella protothecoides
aataccccaacgcctcctgtatgaaacgttctcatcgttagttgtgtacccggctcaccaatagattgagctgcaattacaccaacagcttccccaatattaactaaatcacctttggctaaa

SEQ ID NO: 17527 - DNA, 146 bp, Chlorella protothecoides
gcgtacctaggttccgcaatggctgaattagaagaaggcgatatttcagctcaattaaatgactataaagaattaaaacgtctttgtttagaaataaaacaagatagaaatcctagtgtaatcgtttggattgggacttgtacaac

SEQ ID NO: 17528 - DNA, 386 bp, Chlorella protothecoides
ttttttcgtcgcattagtgtcgttgccgttctacttaaaaaaggattaataccacaaacataaacattttcgcctaaatgaggtaaatctaaataacgatgtgatggtagccaaccagaaacttcaatattatgtcgttttaattccatatttaactgatttgctactgtattaggtaaagatccgaataatactaatgaagggtgtttctttgtattttctgttaaagtttcagtgggacatcgatgaaccatagcagcaagaacagtatcttctccttgtgtaaatgcataatctaatccgttcgcccgtgctacaacaataggaattcctatttctgtttctaatctgggggccatcccttctaaatccattttaataatttc

SEQ ID NO: 17529 - DNA, 430 bp, Chlorella protothecoides
tggaaaaattgtatatatgattaaatataatcgtatagatccaacacgaattcttttagaaattaaaacgaaaaaatcaaataaatcgttttttactttatacgaaagtcaattgcctccgggaagtattttacttgttagacaaggacaaaatgttcaaataaatgatattattgctcaaactccccagataaaaacaagtaatcaaaacttaccagaatcgttacacccaatccaatcaaaaatagagggtgaggtgaggtttgaatacatgaaaatttctgtatcgcaacctatttctaaatttaacgtatcttttactgataatatacaacaaaatagttttttatctcaaacagaatctcaatctaaaggattaattaataactacttactaaattcaagtaaaacactaattccaattaaaggt

SEQ ID NO: 17530 - DNA, 241 bp, Chlorella protothecoides
tattactccaaaagaagacagatttgtttttattataagaagtagaagaatatgctgttttgtgaaaccgtattatatttgttggtatatttaaaataggacgttctataacaatttttgcatgtattcgttttaatttagcttgaaacaaaacatgaaaatttacttgaaaaataggactttgtgaggatattaaatcacctatttgtaaaaaggtatttgtcgaatatggttccctttg

SEQ ID NO: 17531 - DNA, 91 bp, Chlorella protothecoides
caaatgaatatttatcgaaaaagcaatatcattcagtacatgcagaagctcaagtaaaaaattatttaaaaatacaatctttaaaaaaaga

SEQ ID NO: 17532 - DNA, 76 bp, Chlorella protothecoides
tgcatgtaccgcgcgacgcaggttggtattcttgacagtcatgaatacagtcaagtcatgagtttgagatcgagaa

SEQ ID NO: 17533 - DNA, 156 bp, Chlorella protothecoides
taaatattattaaaatttatgtcgcttgcagattctcaaatatttatagcattatttttagcattagttacagggctttttgctgtacgattaggtgccacattatataaataaatcttttattttcaataatatgagattcttgttaaatatttc

SEQ ID NO: 17534 - DNA, 161 bp, Chlorella protothecoides
tttttttctaatttctcacaagtagaatttactataaatttaataaattgggcattaattttattattttttggttgtacttttttatttagtatgtattagaataataaaatgtctacctgggatggaaggactcgaacctccgagtggcgggatcaaaa

SEQ ID NO: 17535 - DNA, 627 bp, Chlorella protothecoides
tatttaaataaaagcaaatatcacataaaaataatagagtttatattgcgttttacaataaacctaaatttattgagcatatagcagataaatgcaagaacaatgcattgcatctaaaaatggttcgggatagacacctatccataaaataccagcaattagaggggcaaacatgaaaaattctcgacgatttaaatcactccaagtattaataaaatcaggttttgatacaccatacactaatcgattacataaccataaagcataagcagcacctaaaaccataccagtagctgcacagaaagcaacgaaactattgttttggtaagccccaataaatactaaaaattctccagggaaagaactagtacctggtaaacttatatttgccattgtaaagaatacaaataggagagcaaataatggcatagtttgaccacatccagaataataacgtaataatcgagttttatgtctatcataaagtactccaacacatagaaacagtgcaggagagactaaaccatgactaatcataagtaaaatacttccttcaataccttgagtattttgactaaataatcctatagttacaaaattcatatgagctacagatgaatatgcaat

SEQ ID NO: 17536 - DNA, 137 bp, Chlorella protothecoides
attaggtacatatggatttttgagattttctattccattatttccatatgcatgtatatattttacacctctaatttatacaatgagtatcatagctatcgtatatacaagttgtactactattcgacaaattgatc

SEQ ID NO: 17537 - DNA, 74 bp, Chlorella protothecoides
tgaattagttttagaacaccagattgatttttttggaaatacaactttagttcgagagaatagatataaatcaa

SEQ ID NO: 17538 - DNA, 89 bp, Chlorella protothecoides
ctttagttcgagagaatagatataaatcaacaaccactacaacttcaacttatctctatattcgaacaacaccgggtcgtctttttttt

SEQ ID NO: 17539 - DNA, 73 bp, Chlorella protothecoides
aaaaaaaatgaattattaattttagattgtaaattactaaatttagaattattcattttgaaatatttttttt

SEQ ID NO: 17540 - DNA, 129 bp, Chlorella protothecoides
ttaaataatttaaaaaataatttaaacacaaaagatttttttctaagtgcagggaattttttattaattaaagaaaaggtaaatcaaaataagcccaaaccactttttttaaataataaaaggaaaaaa

SEQ ID NO: 17541 - DNA, 214 bp, Chlorella protothecoides
tttaacccatgttcctttttttataatacctctggcatctaaattcaatatttgagaaatttcttttgatgaatttaaaggtatatcgtttgttattgtttctaaccctgctgctgttttctgaacctccacttgataataatcaagatgaagagatgtaaatatatcttgagatactaaattttcgcttattaaaacagcatcttcaaaatta

SEQ ID NO: 17542 - DNA, 152 bp, Chlorella protothecoides
aagcgtgaaggttcctgaacacgggcgtctgttctcaatcaggacggcagaaatcgtgcctttatagagcgtcgaacaccacatggacaacatgtcagcatgcctgacgctggtcaggactcatgctcagagagcgtaccccatgtccaaca

SEQ ID NO: 17543 - DNA, 190 bp, Chlorella protothecoides
ttaactcctaaaaaaggtggatttatttggcctggaaatacagatgagaccattcctggacaagaaaaacgtaagccaagattatttccatcattagctctaagtgaaaaaatggctatacttaatttggcgtcaaaacaatcataatattaatttttctgcttaaaatataaaatgaaatttcatttta

SEQ ID NO: 17544 - DNA, 309 bp, Chlorella protothecoides
aaaaaaaggatataattttatattttgtataccgaaatttacactaacgcgtgcttgtggaagcctaactaattttaaaaatgtatttaaataattagttaaaaaaagttctctagaaaaacacttagcgtaaaaatgatcactataccaagtactatcaaaatttctatttacattttgtaatcttaaagaaattggatttgttttttgtcccatttttaatttatttttatttatttttgttgtttttttctgcagatgatattgtcccagtatttaaaacctatatttgagttatatatagatttc

SEQ ID NO: 17545 - DNA, 64 bp, Chlorella protothecoides
ttttttaaaggaataacattatattcataaagaatatacaataacattatattcataaaaaaat

SEQ ID NO: 17546 - DNA, 140 bp, Chlorella protothecoides
aataatttgcataaattattacaaggagatagtctcgttatgactatagcaattggaaaaaatcaagaaaaacgtggttggtttgatatcgttgatgactggcttcgtcgtgatcgttttgtatttattggctggtcagg

SEQ ID NO: 17547 - DNA, 341 bp, Chlorella protothecoides
ttaacttagctttatttggttcattatctatcattgttgctcagcatatgtattcaatgccaccttatccatatttggcaactgattatggtactcaattatctattttcacacatcatacatggattggtggattttgtattgtaggtgctggggcacatgctgctatttttatggttcgtgattatgatccttataataattataataatttattagatcgtgttttacgccatagagatgcaataatttctcatttaaattgggtatgtattttcttaggttttcatagttttggattatatatccataatgatactttaagtgctttaggacgtcct

SEQ ID NO: 17548 - DNA, 66 bp, Chlorella protothecoides
ggacgccctgggccttgcacccaaagccaaatcaccacagactgtcattccacccaccgaagatct

SEQ ID NO: 17549 - DNA, 61 bp, Chlorella protothecoides
ggataatggatctaaaaggacccgcaatgtaccgagccgtggaattacccggcgattcggg

SEQ ID NO: 17550 - DNA, 61 bp, Chlorella protothecoides
gtttagatgaattatcacctgatgatcgtttagttgttgcgcgtgctagaaaaattgaacg

SEQ ID NO: 17551 - DNA, 214 bp, Chlorella protothecoides
ttttttaggttactataaaaaatctatagtaaccaaaaaattatttttttgtagatcctttttctactgcttcttcaatattacccactaaatagaaagcttgctctgataaatcatctaactcaccagctaatatcaaattaaaccctttaatagtatcagccaaactaacatattttccaggagaaccagtaaaaacttcagctacaaaaaa

SEQ ID NO: 17552 - DNA, 388 bp, Chlorella protothecoides
taatgttggtattttacttcgtggtattcaaaaagctgatatccaacgtggaatggttttagcaaaaccaaaaagtattaaaccacatactagttttgaagcacaagtttacgttttaaccaaagacgaaggtggacgtgatacacctttttttaaaggatatcgaccacaattttacgtaagaacaacagacgtaactggtaaaatcgcatctttttctactgacgctggtgagcctcttaaaatggtattacctggcgaccgtattcaaatgacagtagaattaattcaacctattgctattgaacgcaatatgagatttgctattcgtgaaggtggtaaaacagtaggtgctggtgttgtagtaaaaattttacaataaaataaa

SEQ ID NO: 17553 - DNA, 285 bp, Chlorella protothecoides
cttagcacgcgtttgtttattaagaagatttcgcaacccaaattggtggtaatttatcaaatttttcttttaatcgagttgctttacctattcgattacgaagataataaagttttgcacgtgatacttgagatcgacgtaaaatatgaatacttgtaacgcaagaagcatgtatcggaaatacgcgctcaacaccaataccttgtaaaatttttcttacagtaactgtggtatttaaacctgctttatgtagagcaattactgttccttcaaaaggttgtacac

SEQ ID NO: 17554 - DNA, 279 bp, Chlorella protothecoides
tacttctaatcgcgaaaaacaagcatttagctactatcgagatggaatgtcagctcagtctgaaggagaatacgcagaagctttgcaaaattattacgaagctttgcgtttagaaacagatgcgtatgaccgaagttatatcttatataatattggattaatccatactagtaatggtgatcacgcgcgcgctttagactattattatcaagcattagaacgaaatcccgcactaccacaagctttaaataatgtggctgtaatttttcattatcgggg

SEQ ID NO: 17555 - DNA, 72 bp, Chlorella protothecoides
ctctgccaattgagttaagtaggctttattactttaagtttaattaaaatatagaataaatattctaagttt

SEQ ID NO: 17556 - DNA, 193 bp, Chlorella protothecoides
tggctttaacagcagctcttttaaatagtgtttttgggtttttaattacatggatgatcactcgttatgaatttaggggtaaaagatttgtagatgctgcggttgatttaccttttgctttaccaacatcagttgcaggccttactttagctacagtttatggacaccaaggttgggttggtaattatctaaa

SEQ ID NO: 17557 - DNA, 67 bp, Chlorella protothecoides
aaacttaatgtaaatccggtaactaatgctggcaccaatgtaggaaaaataacccgcaaaaaagttt

SEQ ID NO: 17558 - DNA, 224 bp, Chlorella protothecoides
caaaacgccgcccagagcgacccactcttccggggtaaggtcctcggcgtaaaaaccgagcacgcagagggcctgcaagaggtgaggagggtgtgtttagtatgaccgggggaaatggcaggatctaacactccaagcgggcaggaaaggtatgggcaaaaactcgaggagcaacaaagtccatgtgtaatggggttgttgatagatagatccagagcaattcc

SEQ ID NO: 17559 - DNA, 580 bp, Chlorella protothecoides
aaaaaaaattatgaaattagcgtattggatgtatgcagggcctgctcatataggtacattaagagtggcgagttcatttaaaaatgttcatgctattatgcacgcgcctttaggcgatgattattttaatgtaatgcgctctatgttagaacgagaacgcgattttacacccgtaaccgcaagtatcgttgatcgtcatgttcttgctcggggttctcaagaaaaagttgtcgaaaatattactcaaaaagaccaacaacaaaaacctgatttaattgtattaacaccaacttgtacttcaagcattttacaagaagacttacaaaattttgtaaatcgtgcatctttagaatctaattcagatgtaattttagctgacgttaatcattatcgcgtgaatgaattacaagcagcagaccggacgcttgaacaaattattagattttcagttgaaaaagcacgcaaaaataatgtattaaatacagaaaaaactattaaaccttctgctaatattcttgggatttttacattaggatttcataatcaacatgattgtcgagaattaaaaagacttttaaat

SEQ ID NO: 17560 - DNA, 75 bp, Chlorella protothecoides
aattgctgaaattacaaaaaaagatccacttgtaatacttgaacaagcaattcgaaacacaacaccacttattga

SEQ ID NO: 17561 - DNA, 79 bp, Chlorella protothecoides
gatcaggaggggctctgttcagcttcgatgtatagtatttctaagggcccccagcgtatgccaaacgtctccagctcga

SEQ ID NO: 17562 - DNA, 71 bp, Chlorella protothecoides
ttgtcaatcttggggtcgggcgggggggggcggcatcagctcacagcctgcaggcactgctgctggggcca

SEQ ID NO: 17563 - DNA, 69 bp, Chlorella protothecoides
ttgcctttatactggaaagggcgctttgaggaatggcaacaaacaaaactcccggagttgaccttctga

SEQ ID NO: 17564 - DNA, 66 bp, Chlorella protothecoides
agaaaagacagtcagagccaccacccgaccagctcaggtgcccaggccgggcgatggccggcggca

SEQ ID NO: 17565 - DNA, 80 bp, Chlorella protothecoides
tcctcggtcgattacagcccaaaccccatgttaccacacacatttgctccaccgtgaacttgaccgctccttcacaggca

SEQ ID NO: 17566 - DNA, 248 bp, Chlorella protothecoides
taagtcttcgttcacaccatataaaaaatttcgataatatgcccgaaccaaataattaaaatttactcgagtttggtataactcacgtttattaatcgcgctttgtttatatgatagcggaacctccgaatctaaaaattgaatataatttttaatattcgggtactcataagtcacttcttttgcactagctaactttttggggagattatctaaatctaaaaatgcttcttgtatacttttatttg

SEQ ID NO: 17567 - DNA, 82 bp, Chlorella protothecoides
ttatttggaaatactcgctggttggattatatattagtaccagaagttgaggcaaataaaagtatacaagaagcatttttag

SEQ ID NO: 17568 - DNA, 404 bp, Chlorella protothecoides
tagattttttaaaaaatatattaccgcaattaggctgattttatcttattatttattatactactttttttaaagcataaaaaaattcttatttttaaatgaaaaaaatctattaaatataaaattaaatttaaattactaaatattattttatttaaaatttttaattacgttcagggtacatatttgccatattaaccacaactttatctacaatgccataattttttgcttcttgcgcagataaaaaaacgtctcggtctaaatcagctgatactttgtttaagggttgcccagtacgctcagcgtaaatacgacctatttggtgtctaatccgtactacttctaaagattcataaattacttctgccgcctgtcctttacttccaccttctggttgatgc

SEQ ID NO: 17569 - DNA, 332 bp, Chlorella protothecoides
tttatataatcgattatatagagaacgtgttctttttctgtgtcaagatttggaagatgaattagctaatcagttgattggtattatgttgtatttaaatgcagaagaagaaaccaatgatgtatttctttatattaactctcctggtgggtctgcaatttgtggtatagctgtttttgatgctattaattatataaatgctgaagttactacaatttgtgctggtactgcttcttcaatggcttcttttgtattagctggtggggcaagaggaaatcgaattgcattacctcatgcccgtgtgatgctgcatcaaccagaaggtggaagta

SEQ ID NO: 17570 - DNA, 100 bp, Chlorella protothecoides
agatggggttttataacctttaaaaaatttaaataattctatatttgtacttgctagaaaaagtttgtttaagttaatatcattttctaaggataaaaaa

SEQ ID NO: 17571 - DNA, 224 bp, Chlorella protothecoides
actccaaaacgtaacgtagaaaaaccatttttaatggcaattgaagacgttttttctattactggtcgtggtactgttgctacaggtcgcgtagagcgtggtgttgttaaaatcggggatactgtagaaattattggttttggtagtactaaagtaactactgtaactggtttagaaatgtttcaaaaaacacttgatgaaagtatggcgggggataatgttgg

SEQ ID NO: 17572 - DNA, 189 bp, Chlorella protothecoides
aaaataggaaaaacaagttctttatattttttacctggaactggcccaacaactaaaatattaggtttttccgcattatatgatgaaaaatataatttccccattttcgctttaatttcttctggtattctttccggaggtgctaactgaaaattttctggtaaaataagcacagcgcctacatttaaa

SEQ ID NO: 17573 - DNA, 67 bp, Chlorella protothecoides
aaattaaacaagttttagggaacggtaaaaaaggtgatttaaatgtaggcgctgtgcttattttacc

SEQ ID NO: 17574 - DNA, 66 bp, Chlorella protothecoides
ttttatctaatactagtggttctcccttattagttgaaataattacattagtatcttcaggtattg

SEQ ID NO: 17575 - DNA, 307 bp, Chlorella protothecoides
aaaaaattaggttatcaatttatattaatcgactgcccagcaggtattgatgttggttttataaatgctatagcgccagcacaagaagctattattgtaacaactcctgaaataactgctattcgtgatgctgatagggttgctggtctattagaagcaaacacaattgttgatactaaattattattaaatcgtgttcgtatggatatgattcaaaacagcactatgctatcagtaatggatgtccaagaaacattaggtattcctttattaggtgcaatacctgaagatactaatgtaattattt

SEQ ID NO: 17576 - DNA, 209 bp, Chlorella protothecoides
attaactgcagcaattactatggcattagctgcacgtgatggtggaaaaggtaaaaaatatgacgatattgattctgcacctgaagaaaaagctcgtggtattactatcaatacagctcatgtagagtatgaaacagaaaatcgccattacgctcatgtagactgccctggacatgcggattatgtaaaaaacatgattactggtgctg

SEQ ID NO: 17577 - DNA, 130 bp, Chlorella protothecoides
aaaaaaattaattatcagttttaatcaattgagaccaacctaatgttcctaaagcttgattccgacgtaatggtcgtgtgatcaattctaaaatatcccgagcatttgtaaatccatggatttacaaatg

SEQ ID NO: 17578 - DNA, 329 bp, Chlorella protothecoides
tttttttatgggagataatcttttagaaatatcattagcacgtttcttaataagttgtggtatgattgtttatgaaattggaattccatatatggataaacggttccaagctgctgagttagctttattagaaacaacgtgcaagaaaatgaacgttcctttgccgcgaatcgtagaaaaaccagataattatcaccaaatccaacgtattagagaactccaaccagatttagcaattactggaatggcgcatgctaatccgttagaagcgcgaggaattaatactaaatggtctgttgagtttacatttgcccaaatccatggattta

SEQ ID NO: 17579 - DNA, 63 bp, Chlorella protothecoides
tgagggggtccctatgagtgtcagattgaggcaagacacggaccaagaagcccatgtcgccca

SEQ ID NO: 17580 - DNA, 274 bp, Chlorella protothecoides
tacgataggtcaaaacaaactacatttattttgaccagatacaaacttcatttatgttgcaggaaaatagctaaataaatattatttattagtttacctggaatcaggagaaaagggactcgaacccttaacctttggttttggagaccattattctaccattgcaactattctcctaagatgtaccaagtaaaacttgacaaataaaatttatatctaatgttacaatcaatttattaagaattatagatattgaagttttcttcatttagcc

SEQ ID NO: 17581 - DNA, 73 bp, Chlorella protothecoides
tcggttttgtaaaccgaaggttatcggttcgagtccgatagttggctaaatgaagaaaacttcaatatctata

SEQ ID NO: 17582 - DNA, 237 bp, Chlorella protothecoides
ggggagtttggctggggcggcacatctgttaaaagataacgcaggtgtcctaagatgagctcaacgagaacggaaatctcgtgtagaacaaaagggtaaaagctcatttgattttgattttcagtacgaatacaaactgtgaaagcatggcctatcgatcctttagcctttcgggatttgaagctagaggtgtcagaaaaattaccacagggataactggcttgtggcagccaagcg

SEQ ID NO: 17583 - DNA, 65 bp, Chlorella protothecoides
aaaaagcttcccctacaggaatctgagcgatttttcctgtggcacgtacagaactaccttcttgt

SEQ ID NO: 17584 - DNA, 150 bp, Chlorella protothecoides
aagatcactgtgttctttttcataattgatacttaaataataattcatttgaatttttattaaattaagcacattgtttattttttcatattcaaactcaagttgtctttttaagtttattggattgtaatgcgctaatattttttcaat

SEQ ID NO: 17585 - DNA, 626 bp, Chlorella protothecoides
atgcatgcaaatggagcaagtatgtttttcattgtagtatatatccatatgtttcgtggtttatattatggaagctatacaagtcctcgtgaattattatggattgtaggtgttgccattttattattaatgattattacagcttttatcggttatgtattgccatggggtcaaatgagcttttggggtgctactgtaattacaagtttagctagtgctattcccgtagttggaaattctatagtaacttggctttggggaggattctctgtagataatgcaactctaaatagattctttagtttacattatttattaccatttgttattgcaggattaacaattgtacatcttgcagcattacaccaatatggatcaaataatcctttaggtacaaattcagctgtagacaagcttggattatatccttatttttacgtaaaagacttagttgcttgggtagcttttgctttatttttttctgtgtttgtttattttttccctaatttattaggacatccagataattatatccctgcaaatcctatgagtactcctgcacacattgtgcctgaatggtatttcttatgggtatatgctattcttcgtagtattccaaacaaatt

SEQ ID NO: 17586 - DNA, 467 bp, Chlorella protothecoides
  modified_base (205)..(351): a, c, t, g, unknown or other
cctgccttgccccccttcctctgcctagctgcccacctcctcccagccccaaggaggggctgcctggccagtacagcaagaccatcccccttcagagtcgagtatcagatgggagccatctctcggattcccgacatccagaccccccgctgcagtttcaggccaaaagccttatgggtggctctctggaggggtccaggctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacggtctgtgcacatcttgtgcgctgaaaccaaacaattcgctactaatcggacacctgatcttatgggcaatgggggatgccaagccatggaagaagcagcccatcggcataaa

SEQ ID NO: 17587 - DNA, 69 bp, Chlorella protothecoides
aaaaaaaactattactttttatttaatattcaaagtattattcaaaatataagaactaaaaattttttt

SEQ ID NO: 17588 - DNA, 154 bp, Chlorella protothecoides
atatatatatattatttataaataaattttacgggggctgtagttcaattggctcagagcgccgccctgtcacggcggaggttgcgggttcgaagcccgtcagtcccgtataaaaaacatacagtaaatttaacaaaattagagtaaattatac

SEQ ID NO: 17589 - DNA, 341 bp, Chlorella protothecoides
ctctccttagtttaagcatgaatactttatttctttgttagttataagaatatcgagattgattctaataagtaagttagttttttgtaaagtggatgatatttattctttgtcttctttctttattgattactatagtaactagattgactatttctcagattgactatttctcaaattgactttgtaactagattgactttgtaactagattgactatcactcggattgactaaataactaaaatgactaaacaagcggattgattaaatgaacgataaaaatagttcactttaaatttgcaatattatttattttaacttgaatttataatatttttt

SEQ ID NO: 17590 - DNA, 138 bp, Chlorella protothecoides
gttgatctcgtactaagaaagtaaaagcttgtgcttgtgaagcttcaggtccagtaggaccgtaaaattcactagggtatgctgtattattaaaccaagacatacaacaagcaacaatacccattactgaaatagcac

SEQ ID NO: 17591 - DNA, 67 bp, Chlorella protothecoides
agatgccatagctattgcaggaaaaagaagcccaactaatggaactaatatacttggtaaaaattgt

SEQ ID NO: 17592 - DNA, 103 bp, Chlorella protothecoides
tatacaatataatttaatattattataaaacatcgtttttgttgcaataaacgatgttttataataatattacaagtataaaataggcttttagctcagttgg

SEQ ID NO: 17593 - DNA, 72 bp, Chlorella protothecoides
aatgtgatatgggtcggagatgtcagtgagcctcgtggtactccagaaccatgtgagaatttgagacggttt

SEQ ID NO: 17594 - DNA, 64 bp, Chlorella protothecoides
ttaaaaaatcattctataattattgatgaaactgtaaacttattactcgatttttatataaaaa

SEQ ID NO: 17595 - DNA, 35395 bp, Chlorella protothecoides
ccccctccccccccttcgaagacccacccttgagggcctccacgtagtccacgtcggtggagaagaacatataaaagaaggtgccgcccatggtcatgatgagggccaccagcaccgcctccagcacgcgcatgccggcacgttctagcagcagcacgccaaaggcggagcatgcggtgatgagcacccccgcccacagcggcaccgcgccattgctcagcgtgttgagcgccaccgcgccgccgatcacctcgatcatgtcgcaggcgatgacgcctagctccaccagcacccagagcaccatgcgcgggaagatggggtagttctcgcgggcgtgctctgccaggtggcgccccgtggccaccccaagcttggcggccatcatctgcatgacaaagccctgcggaagagtacaaccgggaccaggaggaggaggctgtgtgagtgcatgtctgtggtgatgtctgcatgtgtgtaaaggtggccaggggcacgtgtgccttgagccaacagaatgtagcgaggaagggacacacaggtggcggatgaacggatgtcgcagccctgacgggacggtgacaggggcagatggcagcgcaccccgccctccccaatcccttcccatgcacgcatctgcaaggcagcactcaccaggaccgtgcaccagagggtgacccagatgagggtgtaccctgcctgcactccctggttgatgtcactggcaaggttgccggggtcaatgtatgccactgacgatggatggaggtggaaggaggagcgcatggtgagcctcagggttcgtggaggacacggatgccgtccgactctcacgtctgctgatgaacattcacttgaccctgcaccctgagaatccatccacttaattgatcctcccagccagtgacaacacaattgaatgcgaaaaagggctcactcgacacaaggaaacctgggccctgcaagggtgacgggagggtggaaggaagaccaccgtgaaattggtgaggaacgcaccgtggaagaagtttcatgcaggcacatgtcacatgcaacccattcctttctgcaatggctgggtgcatgtccttcactcccctgcttggtgtcccttggtcacagcatcccagaccgaggggggggaacacaggaagcctgccacatacaaaacacttacaatgaaggccatgagtccttttaagaagctgattctttcaggttccagaggaccagcaccgcccaattccgccacggaagcgctggtcggcacatccttgtccagcagctctgcctcggtgggaacctcggtgggtgccccgtctgtggccgcaacgctcctagcagccgacgcggccaccccagcggaggttagggcacatgaagtggacggcgcgagctccaaactggtgcgtggagtggctcccatagctgacggaggagcggcacccggcaggcccgctcgggacctcagaaaatccctcgcgggttttagatgagcgattgaatctcccaaggaagggaattttccacttatgaattatttaatgtcaatcggagtcgtgatctggtgcggatttcatgtctcatgccacgaaagcgcgagtccccgcacattggaaggtggcgcgtgctaccgtaacgttccggggcagcacatccgctaagcaaaccatcccctccaggcaaacatgagctgtgttgcggagaagaaggcaagcagccccaagggtactgcaattggggtcccaagcacttctttaatgaaggcgatcagcccatccatgcccaccacaaaccctgtcagattgacggccatgagccccgcaatgttcactgctccgccagctgcgcaaatatggcgccacacggggcgtgccttcaggccctgttgccggggcatcgcagcccaggccttgagcagcagctctggcaggaatgcgaggcacaccatccacgaccaggccagcagccgccactgtagagtgaggagagttcgagggtggagagttcaattgccactgtcggaggcggggcaatgggtgcacttcaacagtgtagagttttccgctcctgcattcccgactcccagcgccctacctccagatcgtgccagacggccacaaacatgaagatcggccagatgatcaggagccgcgcccgtgcgcctcccaggggaatgtacaggtacctgacgagccagagattgaaggaggcatgccatcctttccagaaaccctgcaggccagggggacggtatatgattgggggtccgctcacaaacagtcgtcaacacatagtcttgagagcttgcaagggccgtcacttggaatgccaggaggtgctgcacactcctcactttcccccgccgacccctctgacctccacatcaaagttgttggcaaagaactgcggcatgttctcgggtggatccaggccatccaccagcgccatcaacctgatgcatcccagcatgggtggctgagcaaaggtgtacaagcaacagccccatggggaagagagaacgctgtggtggagttcagactgtgcagaacgccgcgctcataccagccctgcagggcccttgccaggatagaggggccagcatcctccgtcctgtgatctagtgtacatttcgcttgcaccgcgattgttcctagcgccggcatccacggaacgatcccctggcccacctgaagaagcgccagatgacgtcaaacttcagccacatgaaggtgaggacccaccaccccgtcagcgccaccgggaaggcgccgtgcgtcagtccatgaggccccagcctggcgccgacgcgatgcttggccagcgagttgaagtagagcaggtgtgtcagcagctccagacacagcaggtcgccggcaaaacgcagcgcatacagtgccgcctgggagggttgtaggtggagaagttgggctatgtgtagacctcaacacggaatggcgtgctttggggccaaatttcagtctccacagatattggatggtgctctacgctttcctgtgcccacctgaagcggaggcacactcgttgctgtgcgcctgcgctgccagccaaagtcctggtaggtgattattgggccggctaggtagagtggcgggtagaaaaggtatgtcaggtagggccagagtccgtagtctttagcgctgggcagggaggttgcggcgcgctgcctggctgtccggggggaaacctcgggagcggcctgagtgggcaaaggggtggaggttaagagagtggagccctgtgcggtgtgctgatgtttgcaggacagacactatgcactctttaagacaagctagggttgaccaaatcttccagtcatcaagctgtccggctgcacggggtcagacctcaagggcggtagtcgctctgtaaatgtcagtgacttgcacatgaaggcaatccctggagatatccccacagtaccttctcggaagcagccaggactgcagccctgctcctcctccagtgcaggtccagtgagtaggagagcatgcgcaggagggtcatgttgtagcagatctcccagcgaactgggccgcggtgggccccggagtcgagcccgcggaagccctcggtcaggcgcaccgccagcagggccgccatgtgcgaggtccacagcgccagtaccctgcagtggcatgggggagggtgggggcatggagcagcagggtctgtagccctgctcgtacagcatgcaaacctgccctcccccccctttgaatccccagactccctggatctggaacccgtctcacccatgcttgcaccctgcgaggccctgggccgccccaaagcccgccagagcaagcccgagcacatatgtcagtgccacgccgtgaaggtaccctgcaggtcgcgggcaggggcatgtggtgaagaagggtcggcccgcatcaacctccgacgcccaggtgcccacgacaggcgcggctgcagcagaggtcctcccctaaaggagggcatcgcccctcctgcatgcctgcaaaagcgaggcccatgaggagcgacgtgatcgcctgccatcgcgctgagcgagtcagcatgccacgcaggcaggcatgcgccaggaggacgcaggccaggggaagcaggctggacctgaaggtgcgccactgatcgtccgacaggtcctgttgaggtgacagccagagcatgggtggaggggatggggtttctgatggaggtgtacacgtcatcaaagaaggacacgctcggactcgccatgcgagagggcaagcacgggcagggccagcacgatgcccatagggtgattgaccacttagaaaaggtcactctgccgctgccaagtgctcgtcactccatcctcaccaggagcctaccatgctctggcctggccaccagttgctgggccgcaagccgggggcacggccatcccaggttcctccttgcgcaaattgtgcagagtacttgatgccctggatcaggagtatgcctgcggagatgcccacgacctgtaggagagcggatgcgctgggtattgaaggacatgcagattttggtcgcaggcctcaccacttccctgagcattccccccgcaccccaagataagccgcaagttcagctcgtaacatggtcttgatgctttactttagataatcaactcaggaacatggtcgcacttgcatgcatcggtctcggaaacagcttgctgcttttcgaaaatgagccgcgagacggaccgcgcccagtgtacgtcgtagagggcactgcacagagaggggccccagctcctcatatgcagccatcatccgcccccccgtccgatctgatgatgcacctggcttaaaccccggcaatacgacatcgttgagcacaaggtgatcgtgggcctccttgtcacgactgtgcgactttctcctcagccggcacacaaagcgaacgcacttgcgcgacaacgcagtgccttataggccgggcctgagacaatcatgagctccatcggaggtctggtacactccatcaacgactgtatcaaccgccgaaatagtgagtctcgcaggtgcctgagtgtgagggcccactcggctttcagcgtcaaggattccacatacttgtgctcctggatgttggacaccccatcctggacacgtctggatgccatgcaggtgcacgcctgaggctgctgctccaggtgaacaacagcaccactcaggaggccgtctttgctgctaggaatgccaatccacgctgggaccccgtcgcagctgccaaccgactccccgaaggctgggccgagttcctggcgctcttctgggcttgcattgtggctctccaggaggggaagcggggagaggcgtatgataagctggtggctgccctgcagcccttcatcaaggcgaggagtgttgaggggcgggatgtgtgcgtgagagcgcacaccgctcaggctgatggactccagaagtcccccccgccctgcaggtgtttcgcgaggattcagaggactgggtggtgcccctcatgcacagcatggtgcacaacctgagaaggtgggttttgatgttgtcttggaccatctggatggtcagccaatcgggtgcctgtaggatctaggatcacccagaatgctgcacctcctgcctccgctgcacgtcccaacccacacatcgttaagaaggggggttgattggattgccgtggtaatcccgtcctaacccacctgacgagacccagctgtctgcatccccgcacacccatgccccggtgcagcgttgcccaggccgccgaccaggagctggaagccgcggggaagccagccacgcgactgggggactgcggcgaccaactacgcaagtgcttcgccgtggccctgcaggcccccgggaaccagggcaagcggctggcggcgctggatgtggtcaatgtctcgatcaagacctacttcaagctgaacacgctgcgactgtgcaagaacctgacacgcacggtgtgtgggtggtgtggaggaatgggtgtccttgtacatacctagctttgcgatggagctggggaggcatgcggcatggtaccatgcatcctgcggcgccagcgtgggctggcatttcggccctggatgctcccttgtgcagccactgtgtctgtattgcgcccggagcccactgacttcacccaatcgcacatgcaggtcgtgtcgcgtcagtttgcgccctttgagctcttccccgtgtctcagagggtgacctataagttttacgtcgggcgcctggctgttttcgacgagaactttgtgagtgggccggggaagtggatcggcgtgggaaatcgatggagacccctgccgcagccagaaccgttggcccggacatatcactcacacatccatcttgccgacgctagcccgccctccttcaccttcccctctcatcagcaagaggcacgggaaagcctggagtatgcactgcagcactgccaccgaggcgcggtcagaaacaaggctaagatcctgaagtatctcgtgccggtgaggctgcgctgtgccgccccggtgacatgtgcagcagggctagaggatgagcacgagggtccaccctgtccttgttccccatgcatgtgtcttgcattgcacgctcttgtgcttggcatggggttccaaccaggtgctgctctgcagtcgaatttgagagccgcttcatattttgctcatgtttttggcgaccctaggagttgctgcgtgccctgggcaccccctttccgttttgttggcaccgcaacagccgtcctctgctccctgttttccaccccgctctgcaggtgcagctgctgctgggcaggttcccttccgcagccctggtccagcagtaccagttgcagcagtaccagccgctcatgcaggccatgcggacaggggacatgcgcctgtttgacacgaccatggatgtgcaacagttcaccttcatccaggaggtgtgtatacagtggttgtcctgcagctgggtttggggggaagcaagaaataggaggtgctgtcactttactttgtgcggtgtactggggtgtggaggggaagccacagatgtgagccttgtctgccgctcagccgcacccgtggcatgctttcctcagggcacgtatctgctgctggaaaagttgcgcctggccgtcctgcgacgtctgctcaagcaggtatgccggcgactacccttggtggttgacatggatttgttcggatggtgtgctttccaccctgtcactgcagatgcatgctttcatgattgcccctgaccatgatcacggccctcaacccctcgagcgagcaggtgcatgctgtgcatgctgtagcggagccgggaaaggcaacccagatccccttggactgggtcctggcggccctgaggtgtcagacagctgccgcaccgcagcaggtgcgcatgttgtgctccttgccgcagtcactggaggggtggggccatgatttggaggcaatgggagttgattgtatccctgagtacccagcaagtctggctcacaggaggaggagatgaccatggacgaggtggagtgtgtgtgcgccaacctcatataccgcaagtgagcagggcgtgtggggaaccagggtgggtgcggatgctttgccctggcgcacagtgtagagagtaccccagctcatcctcctgccgttgcctgctgatgcacatctgcaccgcaccatcgcaactcaaacccaccttgcaggtatgtgcggggttacatcagccacaaaaacaaggtgatggtggtggccaaatccgagccgtttccacccctcgcctcaatcagctttgctgatgggtgaggggtgacatgttacagcaggcatgcaaggagcctgtaaacagcaaaatatgagcagagctgtgaggtacaggtgacatgagctgccccgcatccgaggtacatgtggacggcgggctgatactggcgcaggccccacaccggggatcacactgcggggcgcaattgcagccctttgagagtccgctagagcgagatggacagggcgtgggcccttgaatccgaggggcatgtgccaaggcatgccttttggtgcagcgcgggaatggtggactctgccccccgtgactccacgttgaaaggcagtggacagctccgtgcgcctgcctgcaccagcgcttcatgcgcttgcttcagctggccctgtggcatggcaactggccgatggtctctcgggttgggaagacaagcccagggtacagatgcaaactcccatgcgcagtcagatctccattcccccaccgttccttcccacccatcgcgagacaagcgtccaggccagccataccgctcacctcctgctgcagtaagcgccactgggcatcagcaagctcgaccttggtggaggccaggctctgcaccaggtccaggagggagtcatcccgcaccaccgccatgatctgctcctccaaggcttccagacgcgccgtgagcaagcgattgctccgcactgtacttgcaggtggaacacgcaggagtgtacaagtgtagacagctggcgacgaggagagcacatgcgcgcgcggaggtacggcagttttcttctctggacgaactggaaggacatgcaccaaccagcctgtggctaatcaatcctctgaatgcctctcacccagtgcatcaatctccagggactgctgcagtgcgttgctggcctccgcgtaggaaagggcttgggcctcctgcctttctgtcaccagccgcaggcacctggaagggagggaggttgtggcggcttatgccagcatattttgcacctccttaacaggtgtgccactgacacagagcctgggacataaaggcgatgactacagcacacatgcacaccagtcgagcaatgccggagccaagccagacccttcccagggaaacatctcgaccgctttgcctcacctgcggcgaagtgccgacatgcaagtctcgctctgtatggcatctcgctcggcagcatcggtggccgggatcggggtggctggcgggtgcaggcacctcctcgcatgagccgacggtggtgtcagaaggggcgtcatgtacaaagtgtggccttcatgatgcctggtcacctctgcactccgcccagctaccacgggccagctgtgggtgcgacaatggttggtcatgcgcgtcaaggtagccggcctttggggtgtgcgccattgtgaaggcgatggtgctccgcttgcctgttgatgagggagaccgagcatatgattgtttgacattgggaacatagtgcagcgccgttcaccgaaaggatcctgcatggttgctgccaccctctaaaagcattactcaatagattgaaggatgctttcatgagggggtcaaagtggtgatcgcacgactctgaacaactcagctcacgacggtgaaacatctgggggaagaccacttccctactcactccgactcctgacagctgcatttgtcctttcaaatcgtcattcagcgccgtgaattctgctggaataagtacttctggggctcttcgattgccattcatcgaggctggcctagcggtttccttcaaggccggtgcttggcaaagagactgtggccgccgagcatgctcgagaggtagcgacacagatatgcgtgcatacaacaccgttaatcccacacgaaagtcatttaactcgatccctcaacgctgcagcacacttgtaccttggtggtgggtgtcgaggagtggctcgactttcataccgccgggggctcagattcgggcagattgcatctagcacaggacttttgcgactggtggtcgtagtgctgaccacctgtcgctagaaggagcagcgtggagtgacaggtgaatcttgacgcgttcatattaccggaaaactgcactgcacgcagagcacggccggaaccgatctggtgggacaaataattcaagtgcttgccatgcagatcacataccagcgcacacgtttgtgtctgtggttatcttgctgaaatgttgcccaggatagtatgctgcactcacgtcgtcgccacatggctgtgaacctgtcctctaaggcccggcaataggagggcacccgtccgccatggcgattgccggtccagctgtcatcacacggctggatccaggggttgtgaatcgcatcgcggcaggcgagatcatccagaaaccctccagcgcccttaaggagctgctggagaacgccttggacgctggggccacctccatcacggtcatatccaaggacggtggatccaagatcctgcagatccaagacaatggacatggcatcagggtgagtgcccctttttgtacccaccctccagggccgtcgcgacatccttgtgcggttcactccaatgcccaccttcctactcatgcgggacttgccacagttgggttcactagcagcgttctcagatactgcttttccgacctcaccaccttggtcatatggtcccaccgcaggaggaggacatgcctatcctctgcgagcgtcacaccacctccaagctgcgccagtttgaggatttgcagacccttcaggcatggggagagagtgggttctcagcatgcagttcctgcaatgctggccagatggtgcagtctttcgtccatcgcgtgagccaggctgcaaccctctcatacctcccctctccgccacaccttcccttagacgcttggattccgaggggaggcgctggccagcatcagctttgtgtcccacgtgaccatcacgactcagccagccacggctacccacgccctgcgtgcaacctaccatgatggtgtgtgtgttgggggagcttgttgggtattggacaagatcctgttggctcccagtttcactgtcagcaaccctccaagtttcatttggcgacaggtgtcatggatccccctggtccggtgccgtgtgcctccaacccgggaacgaccatccttgtggaggacatgttttacaatgtgccgctccggaagaaggtgggccgacaacgctgctctatgccatgcagcatgggtagagctggaatgggaacggttcggcatagactgcccaggacgggactgctggggctcatcgaagcacagccatcaacgggcaagtgcacctgctgtataggtgcagtaagatgacactcaagttccctcgctccacacccgaactcaggctctcaagtctgctggcgaagagcatgcggccatcctggacattgtgggacggtatgcgctgtacaagccaggcatcgcttttgtctgcaagcgatctggggagagcagggcagacctcgtgacactcaggggcgcaacccggctgcaaaacatacggtgagtcgttctgtgagtgccgcatgcaacagcccaggagggacttaaggatgcatgcggcctggatggggctcccagcatgcgtatgtgtgtttaagtggtgtcagacatgtggtcacataatcatctggttttgttctggtgtcgcaccgcgggcagggagatgatctcacttccacactcatacttgtccctcacaatagaaccgtgcacggggcggcggtggcaaggaacgtggtgcccatctcctttgcacggggagatctttcgcgatttgaccgcgacgacgccctcagctgtcaagtggaggtatggggtgctggtggtatggacgctggggatgcagtatggggcgtgaagtgaaggcacgagtgctggggtgagaatctgtgagccactaaaggcgggcctgctctcttgcttgcccacagcggtgacggcgacgagaatgctcgatgaatagagagcgccgtgcacctggaacctttccaatcctcaggctctcgtcacgagcgctggctggtctgggaagaagacgatctttgtcctgttcatcaacggacgcccggtcgactgctctccgcttcagcgggccttggaggcagcgatatcagcgctcctgcagcggccaaccaagcccttcctcttcctggtgagtcgcttgtggtggggctctcactgctcccctatccttgttcactgcgccatggcccgtgcgtgccctgctgacgctctgttgttctaccccgctgcctaggacatcacgctgccctcccaccatgtggatgtcaatgtccaccccaccaagaaggaggtgggtgttgggtgccgagatcaagctccgttgctgagtgggtgacgggcagggaaatctcatctcccgcgggacatgtgcgggctctgccgacgaaaacctcggaaatacgggtccccacatccatgcgcaggtagcgttcctgcatcaggaggatctcatcgacgcggtgcgggaggaggtcgaggcggccctgctggcgtccgaccacacgcgcacctttctgcaggtgtgcttggtgtggtagggccattgccctgcagagtgctgggctcccctcctgagcgtcctcaggctgcgatgtgctgagagggagcatgggacgtgtcaactggctggctgtgtcatggcgctaccacccctgtgccagccgcaagctcagctcattctctccacacccggctaccgccacagacccagctcccaggtgcaccggtcatagacgtggcaggccccagccagtcccagcccaatgcttaccggcccgagcgcctggtgaggactgacgcaaaggcgctgaccctggacgcgtaccttggacagacgcaatcccaggctgacggcgggaatgacggacctcgcccatccgcctcaccagcgaccggcagaccgggcgaggtggctgcctgtccagaggcaaggagcggcggggtatcgcatggccgaccgatcgacacccaggaggatgggcaagtggcgctggcggccgcaaatggcagcccgtgcccctctccacacaggcccggggtctaccccgtcaggcggccccggaccatgccagcaccgcacgcactgcagtctgctacagaggcagagggcccctacgccttcatgcccacggcgctcgagatcgggggcatgctggccccagggccgacatccccggaggaagcgggcgcgatgcccagccaggcggccgcgccggggcgccagctgcagcgccgtgcggtgacgaggacggggtcggggcgccgcagcgatgcgggggagagcctggtcagcgtgcaggagatggtccaggaggtccaggccagcgcccacccaggtgatgccggcggggaatgggaatttccctgtggttcctgttcttgatttgctttggatgcagcaaaacatggattcagcgatggagttggagggggagctgcgcatgctccgtcccagcaccatgactcacaggcgaatgctcccagcaggtctggtggaggtcctgaagaactacacctacgttggcatggccgaccccacctgtgtcctgctgcagcatgggaccaggctgtacgctgccaatgtgcctgtgctgctccaagacctcgcctatcagcaggcaagcatgctggggcgcagggatcttgggttggggctgctggcagtgctcttggttatgtggactcgtggtgtgcctccatacgttgcgaagagctgtgtgccagcgatcgcagcgttgcgggctccttgacctcatggattgtgctgccttgcacttgatgacagttgaatctcatacggcatgcggatacacaccacagtcgcccctgctccagaattgtcctccttccctgcaggttttgataggtttcggggagtttgatagaatacacttggacccgccactctgtcttagtagtcttctccaaatagctctcgaggatgaccaggtgaggtgcaagtgtggaggttggggcaacacaagtgatgagtcgcgagagtttgggttgagctcccgttgctgccgattgttagcttgcacaggggagcataagctgctacattggcaagtgcgacttgctatatgcattgcaaggccctatggatcctgctctcatccctacttttcccaaacccgccttgcagaagcctctggaaggccgtgaaccagaatactgtttactgctgataactaagcgtgcagatatgcttgccgaccactttgccattgacatcaccccaggtgtggggcgcccagggttgggcagggtcagggtaggggttggggggacaggttctggccatgacactaggctgctccatggtccaaggccatgtgaactgtgcgatctgtgcttcacaaccactggagcacacattcgacccgcacatcctcctgcagacgggtgcctggccagcctgccagctcttctggacacgagcatgcccagtccccttggcctcccatctttcatcctggccctggcttgcactgtggactggttccacgagcgaccctgcttccgagcagtcgccgaggtgggcccctggcctgagggatgcagggtgtgcggactgttgtgtcccttctgccgggcctgggctgcgagcagcctgggcacaggtctgcatgagctgttgccgagaggcaaccctgctttaaacctacttgtcaccgcgctcccttgctcctcaccacaggcgctggccgcgctgtttgggcaacacaccatgctggaggaggaaggaacccccgcccccacgcagaacctgcccacccagggctcgccattcgcgtcgcacgactggcagatgcagcaccagctcctgcccctcctgcgagctcgcctcgtgccagacaagctgcgggcgcgggacggcaccgtgcaggagctgacgcggctggaacagctgtatcgtgtgtttgagcgctgctgaccatgttggacggcggtgaccccccttggtctgatggctgtgactgccacacgtggcctggggcagccccttgcccgggcagggttgggcaggagggatgcactggtcctcctcgtgccgctgcacatacctgggctggggctcgattacagcacaaatatcatggtaacaggggagtgacgcttgtctgcggccggcaacgaggcccaggctgcctctaccccagaacacgggagcaaaatcgctggcgggcaggcgtggcgagatgcacggtgctgccgcacattcaagtgggtggtgttcaggtcagtgctgggcggcgtggccctgcgagggggggggggggcggcggcaaagggctcccggcgcatcagtccatcttggccgtgcccagctcccatgtggcgcgcagcctggcccacggtccggccagcagcttggcagaccaggcctggctgccggtgatgcccaccaggacgcaggccgccatggggatgcgccagctcagcggaatggcgggggaccgggcaattagggtgtacaggaaccaggatatcaaggggacgccgagcaaggtcctcatcaggacaaaggcggctgcgtgtatttatttatttattggggggggaagaggtcgggacacggcatccatcgacgcggcggggaaacgacgcgacgctcgatgcggcgactctcaccccagcagtaggttcaagcggcacgccccattctcgaacaagcccacagaaatcaaccacgcgctggcacacaccagtgaaggagggggacaggtactcgtacagcttgaagcaggtccaggagcgctgacgcagcgtccccatgaatgtgaaggcattgaggagcggggacgtcacctctccaaggaaaaacatgatcatggaggatacggccccgaccccggtacatagagtcctgattgcatggggaggggtgtttgtgtgattgtgagcaagactgtgggtgttgatggcggtgtgcgagcgcaggcgtgtgtggggaagatgcagcgcgcagtggggcaacctgaaggctgtgcagtgccagccacccctctgacagggcagcgtcaatcaacaacaggccatgcgtcgccaccgctcaccccagcacgtagaagccggagatacagtggtggacgaggaacataaagtccccgggggtgaatgggaccaggtagaacagcacgtcagccaccatgtaggcaagggagaactgcgccagctgcgactgcacaggcggggagagggaaggcggcggggacatcaagcagtgaatgccatgtcctttggcaagcctgcggccagggatcatccttgacatactaaaggtatacaaaaaaactacaatctcacaatcaggaccccactccatctccagtcacgcctctccacctgggatggcgtgttgaccgcatccagctgcacatgccgcagctttgcaagctctggccaggccgcgacgcagcaccagacggcgtgcacgctgcataggtggggaccagggagagcgccaccatgagcgttgctcatctgaacgatactatgaagggaaaagattatcacatctgcggcccaccacggcaagcccacgcccagcccctcatgtccagccattcactcacctactcattgtacaggagccaagcagggccgcttgatcccatgacaggctggccccaaatttccatgcgaccagcgcgaatgcaaacaggactccgaagaagagtataaaggagggcagggagctccactggctgccgagggaggccagccagacctccgggggtgcgagggcgcgctccagcacgcccagtccgtccatggcagggagctcgtcggcgagctgcaaccgataagttattcttctgagggggagtgggccgtgctccacggtgaacgacacgcgctagtgccgtgtcggggacccaacttccccgtgccctactcagttgtcgggccaaccaaatctccggcagctctgctccgcctcaagtgagatgggaatcgatcatgccatgatactatccaatggtgggagtgggacaaccttccagggatgtgcgacgcaaggtgggttttggtgcggggtcgtatggttccctgagcgcgccttcgctttccgagacggtgggtgggagggaggtaggacacgccctgaggtattggcctaggcatccccttgtgatttcagaagtccttaaatagcacaccgaggctcagtgcaatttcttctttagctcgacaatgtacccggcgaagtgcgtccatgagtgagtgtcaagcccatagggcacctttcaacgccatggcggaaccgacggtcctccacacgggaagctgccactgtggagatgtcaggtagaagcacatgcgtccgccgtggtttcggcgaactgcataccgattatgcgaggagggtccgcgggaattgtcatcagccctccttcccatgtaggtttcagttccggagttcagcagacctcattggctgggactgcaattgtgagcccctggttaggaatgggacacaggccaacaagtaactcgcgtgtattgtagatttgaagttccctgcagccaatgcatggaccaggtagagggctcctctgatgagggaaggggctctgctgaatcatcacgaacatcccagacccaaccagtctcctccccaaccctaggctccatctgtgccatgaagagaaacgtgcatgccatcatccctgaggctgactttgaatgcacaagaggcaaggatgtgctgcagcaatacaccttcaacactggcgtagcaaagcacctgttctgcaagcggtgtggagtaacccccttctaccggccgcgcagcaaccccttccactatgcaggtgggtcctgggtgtgacagcgactggagataagaatcgtaccagatttgattctggctgtgcatgtcctataactctgcctcgtttcacagtccgcatctgaatgcagttctcccgctcactgtgtccagtgacgatagcctgcatcgaccctggctccatccagacgcttgtggtgagaaaggtggatggccagaactgggagaaggctgtcccggcgtgtggcattcaagatctgtgaccgcatcctcccttgtggacatactggatgtgtacacccttcctccctcctcaaagctgtgccatgaatggctaacgttatgacgactcgcaaggcgtacaatctgcacatctagtaaactctacccctcatcattcagtgaaaccgtcatgcatgaggcgcaagggatgacacagtagatcacaaaagtacacaggaggtgtgtgatatgactgcggccaaaggtggtcgcatctgacaagatgtaatatcatccatcgactgccgaggggcgtcattgcccggtgaagccccctgacgccctctcaaggttctcccgcagagccctgcaagtacatggtctgacaactcatcaatgcagggggtatgggtccggtctgaagaagccatcgataccatgcgggctcttgctcctgacaagcttctgggcatggcgcacctccccgcccccccaccccccacccgacgcacgcttcctgttccggcttgaagttcaggtgttccagcagggttgagctcaggctctgcagatcgccgagcttggtgcgtgaatactcctccaggtcttccaccgaggtgataggttcagccagctcctggtcagggaaatcagtgctgagtcgagtgcaaaggacgcagaccagatcacgccacccgagccgaagttggaatggtcgatggacgccatgatttggatgctgtgcgcattctggtgcacacatgcctccactttccagagggccctgcaccaccccggacattggccctcttgcccatactcccgggcgcccccttcacctggagcaggccgtcgttcagcgcatagatgactccatgcactgataggtgctgcccatcttcccaggccgcttggacaatgggactggagcagatgttgaacacctgtgcaggttggagggctccgcttctcagggtaggctgaaagaagcatggctgggctgcttgcagggtccatgggttggcagcaaagtctgcgagccactgggcttcttcatccaagcctgggccacagaaggaacaccaggcgttccctctcacctgtcgcagaacattcagctcggccagcttgttgacctgggatgtgtgtcagcatgatgttgagcgagcgttgattgagcaggatgggccccgcaccagttaagagctcaccgcacatgtctacaagcaattccatgatcccacccctttgtgtccacccgctccccctggcacctgctcgtctcccttgaactgtttcaggatgagcgcgtgccggtcacgggtgtcgcgaatgtcctggatccacaaattgaccagtcctgggcaggtgagtcgcaggaggacatcggtgagtgtggagggggcaacactcatggtggtagtgctgaagcagagctgcctggtggcgtgaatgaggccaggggcagcccatggcggcaatgaactgcgactcatcccctctggttggggccccacaatcccaggggtgatctggtctgttccccgaggtcctaaacaaacagtcctcgatccggtaccctgctggcggttgggcatggtgagggcgcccttgaccgcgccgcagttgtggtgcccgcacacgatgatgtgcttgaccttcagggccgtcaccgcgtactccagacaggacatggcattcatgtccttgtgggtgaccaggttgcccacattgcgctgcacgaaaacctcgccaggacccaggcccatcagctggttggcctggtggggtgtggtgggtcccgagcggagggccgcggttggtggcatgggggtgcagccactgggcaggcgagggtggctccaaacatgtccccgccccagcggctgcatcagtttgatttctcgttgcatgcatgtgacggtggggctgcgaggctcttccccaccacgccgcaactcactggcacgcggctgtcggagcaaccaatccacagccattgtggggtctggatgttggcaagcttgctgaagaaggttggctcagccttcttctgctcctcagaccatttcctgccgacgggagtgcatataagctttgaataccctttggacatagtcatgtgcactggaaaagacagcctctgccgatccgaaaaatggacatgggagtctcccctccaacacccccttccccaccttcactgccacgcccgcacctgttcctctccagaatgccctgcaggctgtcggtagcagccgtcaagtgacggtatgaggtcaggaccgtccctttctgaattccttctaccatggcggatcgcaaaggccgcgcgatctggaagcgcatggtgtcggagagggtgttccgcgaagggggaaggggtcgccgcagcgtaaccctcgacatgacctagggcttggaccttggcaactctacaagcaccctgttccagtgcctcccaacctgagatccttgaatacaattgccgggcagctgattctgggacgcgtccctgtcgtgtcaggggaagcggaccccgcggtcttgcctcgctgaccgggttccagagccgaggccttgagcagcaggggaacgctggagatcaaggatcgtataccggatctttaacacgactaaaaccggggttggcagtcaatggtccttggcgttcggattgctgtgccacaatcctgtcgacttatccgggtgaccccggactcactaaaagtactgcatgtgtggccaggaccagccgtgatgttgtcctcttgcgcaagccttctgccacgaatagcagatactaattgcgtcattggcatggatcacgcaagatcgtctgcccctttatcgttgcggccagcatacacgtgctcatgcagcttgtccaccgccatgctgctcggcgggcaaaaggaaacaggtgttggcaaactgcggcgccgtgcgtatgcaaggcaggccctgtacaggtcacacatgaataccaccagcatggcatcacccctgggcacctggcatcccctcttggctgcggcagtgggacccccacacagatctccagcctgaggttcctaccaccaccaccctgcacacacatcacctgggaggaccagatgcggtgtggtaggcctcagccgccgatgtgtcgtagcccgcagtcttctccatggtgatcaggcgcctgctgtaccgtgtgctgaggacctgctcgcagtttgccaccagagtcaaggcagggtgggccggcacctcctcggggctgtagtagcccgggatggcaggcaggaagtagaccaggcggccgcctgcaagacgggttgagggtctcgctgtgaagggatcccggttgaaaaaagactgtggcagcagcaccactcaatcacagactcctccaggcagcccgcggcctctgtccacgcaccgatcctgaggaggcgggcggcggcgtccagcaagtccctcaagcactcccccagctggtagggatcggtggcggggatgtgggtgtcgcggttgcggggcgtgtagtcccgcgccgccgtcttcctgccccccgcccgcacgccgtagggcgggtcgcacacgatcgcgtccagcacctcctccaggccagggcggaggggcaggcggtgcaggtccgcgcgcaggaggcccaccggctgggggagcccgtagtcgtcgaaattggtgcgcacgttcaccgcggagccgccgccgtccttcttgcctggagggattgaacggtgtgtggtgttggttggggaccccgggggctggagcgcgagacagcttcaaaggcaggagtgtggacgccgacctggcggtgcgggggcgcagcagtcccctatgttgcatggccactcccactgtgacaccgtgtcagggtcacaccatacctagcttgatgactcgcatgtcgatgtcggccccgagtgtgtaggcgccccggtgtgcagcagccacgaggatggaccccgtgccgacaaagggatcgaacaccaggctgccccgggagacctgacgcgtggatggtttaaaggaaagcaggttgaggtcatcgtacggtcaccagcccccccaatgctctctcatcataagcatctggtgctcccatgtccctggtgcctgcactcgtcaccagcgaggagttggtctgcgctggggaaccccgcgacggtgcaggtaattcaccgcctgcccttcaccttggcctggttgcacatgatgaaggccatctcggcctccatgctggtgggacccaggtaccgccgagaaggcagctcgtatcgcttgatgatagagcgatcagacgctgcgacctccctaccaaagtagtaccgggctgggaccttgggtagggggttgggcggagggtggagattgggcatgtcatgcgtttgcaagagagacgctcaattagacctcaggctgtcaggttcccagggcgattgttattgcctcaaggtttcagcgctggtcggcccacctttggcaggccatttgtgagctccggtgccaccaccatgatcacccagaacttgtgctgggggtgttgtaggtcaatgcggccctgtcacatgaggtcagcacattgcagggccaggtgagcgcagcgcagggcaccaccagccttgagtgagatagaaacaactgcacgattgataccaacaacaaatgcagaatgttgcaaagaatgtgcatctgaaaatcaggtgaggcacttcacatgaggtgcaagggagcgtgacttttcctcaagacccattcacaggcggatgttcatcttctcaaatacccactcgcaccttgaactgggtgggaccttccagctggttgataaatgccacctgttcaggaatctgcagcgtgccaccccagagctccaccacgaatctgaatgactgtgcaggaagtcagacaaggactccttagtcagccaagaggcagaagggcctggagcagccccttttcgcatcaacacctacacttaatgcgaagctcagccagagagcaagcctatcaacaaccttacacaccgggtcgtggccaaagccgagcatcccacctgatcttcggcggcgtagggagccttgagatgtgcgggatatgatgttatgctgtcgcacatctcctcccagctgtcgccctcaccccaaatctccagaaacaccttctttgtagaattatttcctgagttgaggtcgggcagcataccaagtatgctgcgaattctagcagcactttcccaacccccatgcagcggaagcacctcatccgtttccctgctttcatttgaaacccaccttggagagcatgatctgctgggcaagcttttggacagccccatcaccggggagatggaggtaccagaatggagagtcgagtatttctccatgtggccgttcccagatcaggttttccgtgaggcctgaggtggtgggaaatgatacactctttgagttcgatgtggtcagcgtggcttcagactgcaggcagcatgaagccgagtgcaactccatgcaaacaagagtgcagactctgccgttcaatctccgctggcatcacggtcctcctccggtgccgtacccccagggaggtcagcgattcctgtcgcagccgcttgggcctccacctccgcaagacggtactccaggtgccggtgaacaaagtacacgaggtaccgattcaaattgggtacgcaggcgcctgtaccgatcacacggcattgatgtgtctcgctcgcctcctgcgctctgccagacggggaacaatgctcctcattgccggagcgggtcccgtcctgctccagtacgtcggggttctcctgaggcaccctcatgaaatgtgttaaaagtgtatttacagattaggcatatatatatcccctatattgtatctatgtatgtgtgtagagttcatcgtctctgtctattctgaggactaggcttatgtgccaacctagatgcatgcagcgcgctcggggacgctgcgagtgctaaggtcgcttcatgcgcggcagaccaacgatgcatgaacatatgttcgcgatgatgagtcaatcagcctgaaatgctctactcttcggtgttaggcaatgcatgctctttcagcattcgccctgcacacggcccccggggcacgcaggaccggctatcggaagaggtatccaccatgcctcacatccatgcaaacaggagaactcaagcccttcaccctccgcatctacactaagcccagctgcccgttgtgctcttcattggagaagaagcttctcggcatctttgacagatctgccttccttgccagccctattagtgctggcagtcttgaagcagtagacatcaccagcaggcctggtttgcaggagagactggagctccaggtcccggtgctgacctaccgtgcagcagagggagaggaagccgaagaggtgagagctgagcgtcgtctgttgaaattggattacgaccagggagcgacagggcctggtcactgatgacacaatcacaccacatggagcatgattgaaccatggctcataccctcgctccaaccaggtgcgtctcccccacccgtctccccgtctcactgctgacgggctggaaaagtttctggtgaagtcccttcacgccgtgcagtaagcatcaagccgatgatgttgttaaaaatgcggagagcccaagccttgatgtgacctgctgtattcaccccatctgtctatgaacttgtgactactggaatttgtcttttactccctttccgcaaatgcatccaccgcaattacaaaagggatcaacggaagcgaatggaaaccagtgggacatccagatcctcgccctcctcatcttcacacgcaaccaccacgtcaaagtgccgcctgcacggggatggaaaggagcaggttgcacagggtccagaaagacaccaggcactgggttgcaactccccaggcattgtcctgccactgcttgattcagaacaaactgttcacctcggtgaatgtggtgcccttatcaccgccccacccaacccctgtgggcccacctgttctctgggatggtctgctttgcaatggtctgcaccagctcagacattcttgtccccatccgttcctgtgggtcgaggtgcagagtgcttgcttgggatcgtgtagctcttggcgtcccttccccaggtatcaatccttatgaagcagctgaccaagggacttcccgttgccacctcagatcctggcacccatgccgccgtccgaacccgccttcatccaggcacgcgccccgggcagaattccgcccaagataccagcactgcacaggaccccaactttcgcaccgccacagtaacgtcccaagagtcccagctccaccctcagccgccttcccctcccctcacacgagccatcccaccttgtgcttggggaagaggttgttgtagaggagagactggccgcaggagatgctgtacgcctccagccccttctccctgaaccagtccaggacctgctgcacggtgaggtcgccctccagcacccaccggtcccacagactccagcgcatgtcacggaaggcgcagtgcttgggcgggatgggctccgcggcggcgaagaggggcagcgccaggttggcaaaggtgttgcggtacgcctccagcggcgcgccccggaacaccttgtacagctccaggcacaccagtcccgtggccatggcggtggtggtggcgattgcggggatgatgcgccccgcgatcagcttggcctgcagcttgtccacctcggggatgtcgtagttgcgggcacgcatgttggccacccccgcgatgaactgcatgtggaagttggcgtcgttgtccttctcaaacacgatgggctgcagggccgtgccgggccggatggaggcctgcagcttggcgatgttggcctcgatcgcctggatacacacgtgggcggtgggggagggagggggtggagggaacggaagggcgcgcctggcgtgctcaggttgtcggtgtgcaaccctgcacgctggctgcagcacacacaaaaccctcaacatcgcgccagccggcgcggccccgacccctcctcctgtgcctgggaccacacacaagctcggccccacggaccaggcccgctcaccgcctcatcgctgcccatggcgtgcgccacggaagaggccttgggatcggtctcgatcttgacaccctccttggccacaaagggctcgatgggtgttgccgccgcgatggccgccaccctgccgacgtctgtcgcccaggcggggatggggatgccgtggacctgggccttcaggatcgcagcggcctgggccagctgggcgtgcgccgggtcgctcgcactgaactccaggggcttggggaacctggcgtgaagggggtggaagaggtgatgacgatcctctcagggagggaggggcatgtgctggcgcccaagaaactggtgacatggtggtcggatggtgcgatgctgctgtctgtcatcgcatgccgggaccaatggtagagtccatctcccatgagtaaccagacactgctggccactcagccgatgtcccccaggtcctacgagtccacccacaccggtctgctgcccacctcttgggcgccgaccagaagagggcacctgtagatgtcttggcgtcctctgggaaggtgaagatgagctgggcaatgcgatcatggaattgttgctgcaagggagtggagcatggtggaggggggcagcatgaccatatggtccagtaaccattgaggaaggaacaatggctcacatactggcccagacattgacccgaggtttgaaggttgtagcaatagcatgctagcttctccagtgattaatagtcctataagagcacacttgtgtccatactccagtgagtatgccagcatgttcccttgatgtacaaagccaatctcccgcactcccccacccccctccctccctccggcccacctggaatttacgccttgcccaggcaatgcactcctcaaaggtggtgcagtgctccgagacgagcacctccgtcactcgctccagctgctcgcgggcggccgcatcgctggcagaccgcacgctggcgatgtacttctcggggtcggccaagaatgcgttggcctctgctggggtcttctccaggaggccctcaaactcagacctggatgtatgcaagggctttgtgaagacgcgcggcttgggagcaggacgatggctactccggtgagcatgcgacatgggcgtgagtctggcacagtgcgcacaggggcccacccactgccctccatcgaccctccctggcatgttccatatcctcccccgcacacatatcatcacaccagcccacctcgcgtaggtcaggcagtggtggatgttgtgtggaaaggagtgcagggtgcacatgggcgcctgcttctctggcgggtcgcgggaggcacctgtatttttgaagttggatgggtgaggcagtgagatctgcagcctgtcatggataacgagtacacattgctaacccaaagcacaagtgtgacaccctgcccaccccttttctttgcatgcatcttgcgagagtgactgcagcggctgacctgcagagtgcagcacagaaataccgacacatcctgcacaatctcacttcaagcatgtgcctgaggacagatttgcctgcttagccccagcccctgctcctgatccccgccctgcttgtgtaatttcccccttactacgagccaacgattgggcgaatgtcccccccctccttccagcaaacaaggaaaacctaccgtagttctctgtgagccccgggatgacggcctgggtgttggccttgggccccagggtgccgctctccagcaggggcttctggaagtagacgcagcgcgagtcgacgtaaaggcgcgcgttcacattgtccagcgcgttgaccaccaggtccagcccgccccaaaaggcatcgtcgaacacggcctccgtctccggcgacacgcggttctgcagcgcgcgcaggcgcaggtcgggattgatgcggcgcgccgccgcccccgccacgcccgacttgctggacccgatgtcccagtcgcggaagaggaactgacggctgaggttggaacgctcgatggtgtcgtcgtccgtcaccgtcagcgcgccgccgcccgcgctcgccacgcccatcagcgcaaagttcttcaggaattcacagcccagcgcgccggcacctaccaggaagacgcgggccgctgccagcttggcttgcagctccgcgccgaacactgcgatctggtcgtcgtaccgcgagccctgaggtgaacgggtgcggtgggggggtttgtgttagggtcggtgggaaactcaacggatgggaggggcccaaggtcacatgggggctgctgcagggcgaacggagaagaacggttcacgagaagcccagacccgctcgccctcccagcgctccgcggctggaacggtcgagtgtgtgcccgtccgcatcgacccacgccgcctcaccctcggcgccagctgactggcctccgggatttcggcgggcagggactcgatgctgtcaaagtagagccactggtgcaggggatggaacttgccggaggcggctttgaccacctcctggcccacaaagcccccaatcatggccgccatggggttcagctggcccgaggcggtgctggcgagccagcggaccacctgctcctccacctccacctgggggccgggcgcggaggcggccaactcgtgcactgcggccagcaaggcgtcgccgtcctccctcgaccccggggctggcagacgcccatgccggaccgcaaaggcgtccagcgcctggaacgccaggtgcagcagggccggccgctccatctgcgaattgatgggaggtgcgagtgggtgggtggagtgggcaaggatgggtgggactctacatctgagaggcctatgatggaggaggggacggggcttggacagcatacaagggtgttcagacaatcaagccacctttgtagacaccaacaagcccccttctcccatgccctcccacacatggcccgcttcagcctcgatcctgaaaggcaatggatccacaccccgactcaccttggcaaagtctgtgagcagaaactcgccggggtcagccagcgacgcagccaggggcttgaaagctagctccttgctgggcttgaactgcacaaaatgcgggttggaagaggattcatgatcactagactccagtgcttgtatgcattgtatgcacctgtgccgccccagctcagggttgctccagggacggtattggatgtcccagcacggcatgccgttgaagccaggcttactgacttccagcccccgttcctgcacatgtcatggggattcctacctgggtgacgatgccgccacgctggtaaggctggaactcagcagagtccagctccagctcaaaggaatggggctgcagaggcagcaaaagtggaggatgggagtgagctcagtgacacgcaaggcccccaatactcggaggagggacaagccatggccaagcccagcaatggccgccaggcacactcacaccccccttttaacaaccttgcagttgcggaccctgatcggcttggaggctgccaactccggcatgccgaccacctcagtgaacaccaccagctcccctgggcatggaggacgagtcgaggcattcttgatccagtggataggcacccaccgccagttcaacacatgctggccgtgatcacccggcaagcctgctcagagcaaatggagggcacctcaccggctggcaccacccaacacccatcttcccctctcaagtccgcaccatcctggaattccaggcgatcatcctccacgcaggtgaccagggtggtgggcccctgggtgatgcccgccacaattccagtgtgtggatcctcccctgtggacaggggcagacaggagagggggagggtgatcgcgcggagaatgagcagtccctaatgtagccaggtgcgtccatggacacacaaacacgcgggactgcatgcgcgatttgtaatgctgactgctaagacatttagagaatgagtgcaggcttcgcggctggccgtgccctggtgtgcgggcatcccgcactaccagccacttccacaagccgctcaccatccacatcgtagacagtgaactgcggtccaaagtcgcagaaaacggatgcgaacacgccgcggatgtcggcctgcggagttggcaccagactgggctgaccagaggctcaagctggcatggcaagtgaagggcatcccattcggggcactgacgaagtgcgtcaccagggtcagccatttcttcccccatctcatgctgcctcaccctgatgaaggcgatgccgttggcatggcagaaagaatcgatcctgatggcctgctccaggggcacatccacagccacgaccacctgatcaggatggagggaaggtgggatgaaaagatatgaaacataggccatggacagccttgatgcatacccggcggcagttcacagtttcttaacatagcatcagtgcatgccgcccaaagtactgcgcgaacgcgaggcgcgccatccagtgtgcaagctgacctgaaaatcagccaccagctcctctgtgagaggcactggcgcagcgctgacggtaacggccgtgttgagctcctgcaactgggccctgtgcgtgaagcgatgccattctggtgatgataacatggtaaaaaaatcttccccttgcgtgtaagggaaatactctgaagcatacctcttgtagtcccaatgttactgtacatggaaggggtcctgacagccaactggaccacaatcctggctcaagctggcttcaccggctcgcggctcccacttacttgcacgcctcggcccgattcttgccaatgtcggactcggagagatagaaatgggaagacaggtcacgcagcgtgcaggacgccgtgtcctggagcgtcacactcttcacgccagccagaatcacattcttggctgcacagggaagtgagggaggctggggacccagggtggaagtgttgggagcgcccacttcttgccttcaagtatgccacagatgtgacgacagcctcactggcggcctcgatgcctactccttcttctcgagacgacatggcccagcgactcaccagcctccacacccagccccgtcactccagcgacaagaacattggcagttgccatacggcgcatggattcttttccatacactgccagctgcaggggggattgggtcgggaatgtggggttggccggcctgcagcaacctgagcgcccctttgcccagcatctacatggcttggaggtcgccgtgggaagagggatccagtcaggagaacgagaatatcattcacctgtctggagtgcaggtcctcatctatttctgtgacagtctccacgccgttggccatagtggtgtcagacatcttcgagcgcttaccaggcaagacctgcgaaggggtttagcatacgagctaggataagttctggagtatgctggaccacgaaacgatatgagagcggtgcacacgctgcctgacctgctgtgtgttctcagaactgcgcttggacataagttgatcggggtgcgctgactaatgccgtcgcgccaggacagcctcctagcacgtcgaactatatgattttcgagtccagttgatccagagcagttgtaagagcctcagcatgattgttccagggacaggttctcgagcaattcctgtgcgaaagatcacgtggtctagtgcagtcctctgtacacggggaccgatgtcattcttgccctacaggataccgcgacctaacgccatcaagacatcatacctgacaaagtgagggatcagacagaggtacacagcttttcggcaaacttgccatggcaattcttgtttgccctcgcgtggtcctggcgcctgccaaatccaaccccaggttaggatccattcggtgcgagacgggagcttccaccctatctggtggatgtaattgattcccgtttaccaacacaaaatcacaggtcggcagcctccttcattcggtgtccagtccacacaccccaacgagtccaccgtgtcgaaggcagaggtcggtaccttatttgcgcggcagggatgttcagccatggaggctcaagtgtgtgagcatgggttgtgtcgagctgcacgcattgaacttggctctctcccacgtgcccacagctggtggcaatgggtcgggtttggccaccgaagcaacaccctactcgaagctggagtccatcagatgcgacctgtctaagtttcctgacatcgatttcttccgtgtggaggtcggcgggcatgaggtgtcggtgtgtgtgtggtatgtcagtgagctggaagcctctccgagatccaaaacatatcccaacttgaacatgctcgatgactgtggcgtggaggacgctcatccacatttcccaaatccgtccaacgctgatgcaggccatcattcgtccctggagacttgaaaaggtgacgagggagctctctgctgaaggcatctgcggcatgacagtgtcgcaagtccgaggggcgggggtgcaaggcggtgagtaggacaagtgtttgagccgagagttttccgacatgcagaactgtgtgtttgccccagtagacctagttttcggccacgcagttttgctttgacgcagggtcctgcaagcacacatatgagtagctgccctttgccctagagtccggatgattggagtgtcagtgcggcctcaggtgtgctcttgcccaatcccctcccacagggcacaaggaaagatatgctgggacagagtatggtggcaagacaaacttcctggtggacaagacccgcttggacattgttgttgtcaggttagtctccagctcaccggatgagacagggctgtggtctttctagacagtcaaatggcactgctttccccgcccgccattgtcgttgtcacagcatcgcaaggtcccccccgctgctgagccatgcttctctgtctcagtgcaggtctcaggtggacaaggtgatccagacaattgccagcaccacgtacactggggagatcggggacggcaagatttttgtgcaccctgtggccgatgtgatccgagtgtgagttgtgggactcctgcgcctgtcgtctgttggtactgctgtgcaatggttgtgcgcatgccggctcaccctgattgagcttcaggacttgtgtttcttgtgggagttcctcctatgctccaccccacaggaggacgggggagacgggggcaatcgcagagcggatggaggggggcatgtcggacaggacttcgtgaggcggctgaggttgcgattctcaatattacagtgctgctgtactgctacaagctgattgcgtctccagcaagacgcacattccctgtgcatggccttcacgctgtcccttggtgaacgctggtgcgtcttgcgtgctggtgtgagcctcagacagtagttccttgtgacactctgttgtgacacaaggacctacagtgcccaccattaaaggattggcccagatacattccagactctgtgtgaagtggcggaagagagatctgcttctgtcgtccacaagcgcagagcgattgcacgccctgcgcttcatgtagacactctcggcgaaggactgcgacatgcgcaatcaggggggtggaggagtgcgtgctcacacttcctggctggcggaccaaggatcataatgggtcgtcccatatcatgcctgcatactctcttttgctccgacattatcaagtacgaagccaaattgcaggcgggcatgccaactcgatgaggtgtcggccgtgaatgtttggagtagcctcgggacgtcggcattgccagctgctgcatcccgaccgcctccggccgcaggcttcacgcggtcccaaggtcccgctggctacacctcgaataaatatggtcctcgcggcacatacccaaagctgacaagacacctaatactttggcagctcacgttacttggcggcggtcaacagaattattcataaacaattctcatgatgcagcgctcggcgaccgcctttgccgtactggcaggaatgttcgttatgttctctccagcccacctcgcacaggtacacgaggagtaagggtagagaaaatgactgtatactttagctgctgggtctctcgtagtgttattataactcacaagagtgtcggtgttccacatcgccgcaggccacctgcgacccaagcatcaaattcgttggtttgcccactgcggagtgagttcagtttcataggcatacataaacaggcaatggaatcttacgtccctttacggcaatgtttgtcatgaagacgtgtctgctcgtggtcgtggtcccagcaatcgaacccatgcgtccatgcccacccacaggttgcacaacaagactctattgatcagcgcatccagtccagatgcctactgccggtaagcgtttgcgagactccaagggtaacacgaggcatgttgcacacggtatcgatagtttgcctatgtggtgccctccctgtgggcaatcacaccgaggctctgtaccctagcaatcaagccatggtttctgcgtgtcccttgcatcgcagggcgaggggctttgcagcagctggagcctctgcaaatctcaccgtgacgccgacccaacccttcgaatggtattcgatctccaccatcaacccagaaacgctggagttctgcgtgccctcgaagtccgccttctgccaggctcttgccgcagttgaatgcctgcctgaaggcgtggatcagtgcacggcggacgctgatgggaacattggcagcgggaatgtggggagcaacaacctggggaacgacaacatcggtgactacaacaaaggtgcgccaaaacagctattcatatacagaggcagggtgctgtcgacacacaacattgtgatcatgtacccataccacccctgccaggaaacggcaaccatggcactggaaatactggaagctacaactggggactggacatcgtctgcaacaacatgcgtgccggtcaggagcgaatgtgcagtgtgtttgcgctgaggacgaatgatactattgtcctcgacgctgcttcagccgcccccctgccatgatttgctcctcagtcgccgtacatcgatgtgatatggatggtcgtcggcaaagacagacgagcttgctgcactgtggccccgggtacacgtatcatggctgttgtgggagttccccagaccggatactgctgccccctttccacctgttcccgctctgcaccaaccgtaccaaaccccggccccacgttgcattcgggtctcgactgttggattcccagtttgggtcaaatgccgccgtccagcgttgtgggggccttgcaagccccatcaacatgtccatctacgccaaatcctcactcttcacatctatccactgttgggctcttgttgtgggggcggg

SEQ ID NO: 17596 - DNA, 255 bp, Chlorella protothecoides
ggattcgcgggccgcgccttgaccggtgcctgccaagctgcctccatcgctaccttcctctccaggaacaaggttgccccctcgccctctaggtgccacgtgtgtctagaatctaccagcgcttcgacagaacaagtatgaccggagtccctgtgatatctaatgcctggtgtgaattgtttcctctttcaaaatcttagctctcagcaattggtccaggtttatgtgtgagagccaggaggtggctgctgaggg

SEQ ID NO: 17597 - DNA, 504 bp, Chlorella protothecoides
aaggtaaactatattgatcatccaaagcaacattatcatactctgttttattagaattattaattaaatcatataattcttcgtgaggctcaggaccaatatctgaatcattaagtttataaagaggttgatcaaattttaaaactaatttagtacgttttattttttctaacccatcaatataattgtattttccagtattttggttgttactgaggatcttgattatatcttcctcattctcctcatcttcttcgtcttcttccgcttcctcatcttctccgtcttcttcctcttcttcattttctgcaacagttacctcattgtcacggttcgcaaaatctaaagtttggctttcaacactattttcatcctcattaattaaatttagttcgtcattattttgattttcctcttcatttgtttcgtcattttcttccgcttcctcatcttcataaacagcctcttcacaaattaattgaagatcatcttcttttaagaaat

SEQ ID NO: 17598 - DNA, 135 bp, Chlorella protothecoides
taactagctaaaaactagttaatacaaaaatactatgatttaaaatatgccacggtcacaacgaaacgataattttattgataaatcttttactgtaattgctgatatattattaaaaatattacctacttctaa

SEQ ID NO: 17599 - DNA, 209 bp, Chlorella protothecoides
taaaagaattcttttaatattaatcttcataaaatagattttttatttaaataacaccaacattatttaccaggaacgcgtggaggttctctaaagaaaatcgaaaaaaatataatacctagagtaccgactaataaaaacgtataaactaatgcttccatattaactgcttatttatatatttaattttttaatataaataaacgttt

SEQ ID NO: 17600 - DNA, 112 bp, Chlorella protothecoides
gtttacttttgcacatttaatttttgctttatttttctttattggacatatttggcacggcgctcgaactattttccgagatgtttttgcaggtattgatgctgacttagac

SEQ ID NO: 17601 - DNA, 410 bp, Chlorella protothecoides
cggggacgctctaaaaggccttcttgcaaatagaaaagaaacaattgttaccaattttcaagaagcagatcggcgtgctttacaagctaaagaacgtgtgaaccaagctcaaatacaatttgaagaagcaaaacaaaaagcttccaaaattagaaatcaagcttcaattactatagaaaacgaaaaagaaaaatttaatcgcgaaattacagaagatttaaatagattgaaggtttttcaacaagaaagctataaattagaacaacaaaaagttcaaaatcaaatagctgaaaaattaattgaattatcattaaatcaagttaaaaagaaaataaaattacggttaaattcgtctaatcatagtattttaaataactttcaaattgtactttttactaattataaaaaaa

SEQ ID NO: 17602 - DNA, 209 bp, Chlorella protothecoides
gcaggttgtggtggatatgttgttggtgaaactgttaaattattaaaagaacttaacgcattttacgaatatgatattattctttttgatgttttaggtgatgtggtgtgtggaggatttgctgctccattaaattacgcagattattgtttaattgttactgataatggatttgatgctttatttgcagcaaatagaattgtagcctc

SEQ ID NO: 17603 - DNA, 216 bp, Chlorella protothecoides
ttcaaattaactaattgattttatcattataaaaacatataataaataaatatattaaaagctaaaataaaaaatttaaaaattagctctattattcaaaaactcaggagatcagttttatttatgtctacaataactattgagattttagaaaaactaaaaacaattactttattagaagcttcgcaattagtatcacaaattgaagatgctttt

SEQ ID NO: 17604 - DNA, 322 bp, Chlorella protothecoides
gcgagcaccccccttggatcgagaagaagggaaaacaatcccgtctccaactcatggaataagtaaaataacgttgggagtagtggtatttcaccggcgtccgaggactcccacttattctacacctcccaagtcatttcacaaagtcggactagagtcaaactcaacagggtcttctttccccgctgtttcttccaagcccgttcccttggctgtggtttcgctagatagtagatagggacagtgggaatctcattgatccattcatgcgcgtcactaattagatgacgaggcatttggctaccttaagagagtcatagtt

SEQ ID NO: 17605 - DNA, 210 bp, Chlorella protothecoides
acgccggcgccggcggatgcggccctacaccggcctcccccgctcgacgaacagccagctcagaactggtacggacaaggggaatccgactgtttaattaaaacaaagcattgtgatggtcctcacggatgttgacacaatgtgatttctgcccagtgctctgaatgtcaaagtgaagaaattcaaccaagcgcgggtaaacggcgggag

SEQ ID NO: 17606 - DNA, 70 bp, Chlorella protothecoides
tgatgagttgattgccaacaaactgcaatcaatctgttcggtttcctggcagggcctattactgggatcc

SEQ ID NO: 17607 - DNA, 195 bp, Chlorella protothecoides
gcgcagacggagcggggcgagcccgctcacgcccacgcggtcctggcaagatttgtatgccgaaacgtctacacatcgtgtatcgatacaagcccatcatcagcccgcccatcgactgcggaagcaagcgtgggagggtgaacatcacgtgttccatcggagagtcggtcgagactccatccgatgcaacgcagc

SEQ ID NO: 17608 - DNA, 61 bp, Chlorella protothecoides
cggtcgagactccatccgatgcaacgcaacactgatcggacccaggggcgacggatccagg

SEQ ID NO: 17609 - DNA, 134 bp, Chlorella protothecoides
gttttatattaaaaatttataataaatacatattagcttaataaattaacatttgaacttactgtaataattacccgttttgagcgtggtgaagaatttgaacgttttaattttcgtggtggtcggtgtgtatt

SEQ ID NO: 17610 - DNA, 161 bp, Chlorella protothecoides
tgtgatagcttgttattgtattagatgatatacaaatagattttattataaacggcctattttagcatttatacgattaatattatttagtataaaaataaacaaatgcaattcttattatttaaggagaatttttaaaattatgatgttagatttattgc

SEQ ID NO: 17611 - DNA, 327 bp, Chlorella protothecoides
aaaaaaataataataatttattattaaatcatactgaaacaacagcagctttcaaactaaatgataatagtggacttttttactcgttatatacagatacaaatttacaacgatattatcaagacattatatgccacgatctttgtctaaaacaaaattataaaaatataatggaatgttcatctttagatcaaattgtatgtaatactagttctaaacactatgtaggagaaaaagagtctatcttacctgcctgttctgctcttgaaatgattacaggtcaaaaaccaaaatacacttgtgcaaaaaaatcaatatctagtttta

SEQ ID NO: 17612 - DNA, 377 bp, Chlorella protothecoides
ttttttattctacataatcgacattatattaatgatctaataaattattataaatataatctattttgtgtactgaaacaaatattatttataaaagtaattatttaacactaaaaaaccaagtcattcttgtttgctcatcatccgtgtacggtattggcttaatatttatatatctaaatttatgcgtaatcgaagtagatacttggtaactattaagagttgttactaaattatcaagtgattcttttagagattcaaggtaattataaatattaacactagtggttaactgcccatcagaagctatatttactagtttttgtaaattatgatcaataccttctttaacacaatattttacccaattaacattt

SEQ ID NO: 17613 - DNA, 162 bp, Chlorella protothecoides
acaaccttaatgtcaagtctgaaaataaaaaaactaaaactattgctggtaattgtcatttgcatttatatttagctttttataacgattttctttgtccagaagctaataaaatatacacacatcttgtaaaacatttaggcaaaactgttgttgatatgc

SEQ ID NO: 17614 - DNA, 248 bp, Chlorella protothecoides
aaaaaaatgttaaaataattctaagtaaatcataaatgttttacacaagtaaaaaactttattggaggaaataatcttatggatccacttgttgctgctgctagcgttgttgctgctggtcttgctgttggtcttgctgctgttggtcctggtattggacaaggaactgctgctggttatgcagtagaaggtattgctcgccaaccagaagcagaaggtaaaattagaggtgctttacttttaagttt

SEQ ID NO: 17615 - DNA, 183 bp, Chlorella protothecoides
cattggtttcaattatatttgtattaaaactaaaatgatccgctaaaataaaaagcgagttagcattcataataaatttttttatttaattttgttatgatacaaaagggtttgcaaataaaagagctaaagcaacaaccagaccataaattgttaacgattccataaaagcaaaacttaaaa

SEQ ID NO: 17616 - DNA, 180 bp, Chlorella protothecoides
ttttttgcttggaccgacgcttgcgccttccactgtgattttcttaaattttttcttgttttagattgtcgttttttaggaactgccattatattctcctaatataatttttttaaggtattctgcaaaattttatatttattatatatctttttttacagaaatttcaaataattatta

SEQ ID NO: 17617 - DNA, 173 bp, Chlorella protothecoides
atccaacccgtttggaccacgtaaaggctctaaccatgaaccacggaaatcccaaaaacgcatagtttcaccaccaaaaataatttctccagttggtgatctcattaaatatttaccaagaccagtaggtccttgtgcagacgcaacattagcgcctaaacgttgatctcgta

SEQ ID NO: 17618 - DNA, 234 bp, Chlorella protothecoides
cgttttcgtcagcatttattaggaaaacgtgtcgattattctggtcgttctgttattgttgttggcccggaattaaaaatttatgagtgcggtttaccattagaaatggcaattgaattatttcaaccttatattatccaaaatttaaaaagcaacaatattacaattacaacaacttcagctaaaacttttattgacgaacatcgcccaaaaatttggaatatattaaaaaaa

SEQ ID NO: 17619 - DNA, 193 bp, Chlorella protothecoides
gtgctaatgtcgacaatggtatatgaactgccatttgatctccatcaaaatccgcattaaatgcaggacaaacaagtggatgtaataaaatagctttcccattaattaatttcgggaaaaaagcttgaatccctaaacgatgtaatgtaggagctctatttaaaagtatagggtgtcctttcattattttttt

SEQ ID NO: 17620 - DNA, 212 bp, Chlorella protothecoides
tagattttataatttcaccatattttggttgattattaactaaatattgtcttaaacctattaaaaagtctgatacacgatcaactgggatatcatctaaataaccattagtaccagcaaaaatacttgatacttggtcttctagatttaatggagaagattgtgtttgttttaataattcccgtaaacgttgtcctcgtgctaactgattt

SEQ ID NO: 17621 - DNA, 213 bp, Chlorella protothecoides
actctcaccattcttgcagatatcccaccatctggtgggtgtcatgtgcagcgcacaccgtggacctcttcctgaaagatttgggcaagatgaaatgggtgacggagattctggatccatgccaccagatctgcaagttcatgaccaaccatgcaacagctgtgcaccttttaagagagcattctgaccggggacttcttgtacctggtgagt

SEQ ID NO: 17622 - DNA, 154 bp, Chlorella protothecoides
ccttgtccaattggataaataatgaatacagcagtagctgcagcaacaggtgctgaataagcaactgcgatccacggacgcatacctaaacggaaagataattcccattcacgacccatgtatgaacaaattcctaagaaaaagtgacatacga

SEQ ID NO: 17623 - DNA, 80 bp, Chlorella protothecoides
ttattatcgcttttatcgctgctccgccagtagatattgatggtattcgcgaaccagtatcaggttcattactatatgga

SEQ ID NO: 17624 - DNA, 4898 bp, Chlorella protothecoides
gccggcgacgcggcagcccggtctgcgccgagggccggcgccgcctgcgcttgcgcctgcgcggcgggcgcgggcggcgtgggcgagcgcaggggggttgggggcagggagggccgggcacgcgcgcgggcacgcgctccgcccattgcgggcggggcctgtgcgcacagcacgctgagcaggacctccagggcgctgccgggggagtggggatcactggtcggcgcgggggcgggggaggtgggcgtgtcccgcaggctgtccgactcggtgctggaagccgtggccacagactcctccatctgtgggatgggagggggtgggaggcagggatttacttgagactctcgcaatcgtgactcgaggggcactaagattggggcaagggcccaggtggtccaaggggcaggcagcttcgaaggggcatctggggccagggggcccccgcttccgagtgccacatgcacaggccggggaggagggtggcggggagcacaataggaccgaacagccaccccccccaaaaccattcactgactccttacctgcagggcagcgtctgagagccgggccagggaatgcaggtcgcgagggtccggttcgtcccgggggcccctccgcctgctggctctcacgggcgccttctcccgagcctgtgacgcgtgcaagggggcgagaaagtgtgctgagcgaatggtcatggcagtggcggagtgggggggaagccgtgaggtggtttcccgggaaaccgacgcggaccaccgcccgggcgggcagacaagcctaccgtcagcaggggccgtcttctctctgcatgaggagttgaaggtgaaacatgaggagccacagagcctgccaacgcaatgcgagaggattcgcaccggctccaaagtcccgaccgcagcctggagggcaccgcgtcacaccactcaccatgcttccgcgtaggctgttcccgagcattgagtgagccagacatgttctcacgtgcattagaaggcgtggtgcgccagcgtcccctcatagagagaaactgtcagggttataccgggcgtcccgagtatgaagccggcaagtatggggggtcgaaccgaacgtaatcagggtcagggggcggatcacatactatgacggtacatgagtcaaatggtatatttgcattggcagggccaggacagaaccggctttttgcgaccttccggagcagatatctggctcggagcggggcgggtgaatgccccggtttcatggactgtccgatcgtgtgagcgcccatgtggcgacccggggcgacccctcgtgcggaaaaacagtgtgacgcttttcccgtacccaagcgagtcttgtgtgaatagtttggcagcatatacaagtgcatgggtgatttgcatactgactttcgcatgtggacccaagctcaggcaaagattcctcgggtgctacggtctggctgccacaaactaacgccgtcataaccgcgcacagagcgacgaccaaaagacggacattgtgatattagaagcctctggttgtttccatcgcgatttggtcgccgtgaaacatggtaagacacctcgtacgccgtgcgtgtccccctctctcggacgggcaaattacagaaagtccagagggtggggttatactcccttacatcaggactctcactcttcaaaagacttattacagcattatatcaagcttcacaacccctgaatctcacccgggggattaacacgcagatgtggctcaggagcaggaatccacgatggccagaattccgaaccgcccgtaatgtccgaagataacgattcagatttcatgacactgtactggaatcgcaacactccatactttgatatgccagcaagtcttcctgatagggtgcactggtcttcaagcaccagcacgctgccttcattaaggacctacaaaaacaagagcggaatgcggcggagatgacgtggccgtttgcttctgggcgggaaagcgatcgagctgggcccatgtttgtactgagggtcaaacgatgcaccacacttggcgcagattctgatggtcgagatccagtgacagcattcgtctttcagatgatcaattgcaagcgtcgggaggacatctgatgcatggattgaaggagcgtgtgcctgtggtcaggctgccatgcgaatcatgccgccaaccgcgaggatgccggcccggcgaggcaacactattacatgcaaccttcaggatggtcaatcgccgcaagtctccgtgcgtcacgccaagatagccgacatccctgcagcagcgcgcctgtttgcacaggcatgtggctggtgtgaaaggcgtgcatgcctgttgcccttcgcctgcaacaggcacgcagtcaggcagccgtgcactaccgtcaataaacatctgaccacgctggatcccctcaatcctcgacgatgtatcattgcgatcatgtttgagccctggaagggtcgcccagctacccaccctctcatgccaagcaggtgtttgaggacgatgacagtcggacccctttcctgcctcagcgccgcgtcggtcctggcgagtgggaggcccacctccggaatgccttctccgagaagctggtggctgccaggacggaacgccagctgacctctcgattcggggccagccatgccgccctccaagagcatgcagttgcccgaggtcgaccgtgccccacatcgacgccggccctcagcgcgcgtcagcgccagcgcctgcgacgtgcgcgccactactcctgcctcatggccgaagagcgggctggtggggatctggtgggtgccgtcaccctgcacctggcctggccggatgcggtgctacccgccccccttccccccctgcgccagctccgggcctgcatctgcaacctggccgtagcgccccggtcaaggtgggcacggagtgtctgacagtgggggctgcggcatgcgatggcatcacatgatgcatgcaggtgagggcatgccaccggccgaggatccactcacagtcatcgccctgagggaggggggaatgttcctccgcgcgatgagccacatgatgcagcagggcctgctcttctcaaaaaccaccccggctccaatgctcctcccaggaggcgaggcgtggcgaggctgctcctccagcgctgcgaggaggctgcgaggtggtggggtcaggactcggtctggctgcaggccgacccgtggaacgaggcggcgctggacctgtaccacacttccgggtacgccactgtcgaggacgtgccctggcatcgccccttccgggtggtcatgaggaaggaactgcctgggaggcgggccgctggacctggcgagcccgacctcctgcctggcaatggagcgggggtgttcatctggaaggcgggtgcggccagggccagggcccctggcaatctggagtctgaaacctaggcgcgacgtaacagccaactaggtatgcacaccatcgtgatggcatgagtcagtcttgtttccttgtggaactctcggacacatcgccactgtagagcatggctggcttctagcagagtctgtttgccagctttacacctgtgccaggatctctatacactccaccccagggtgtcatgcactgcaggcactttgccgcttgtatgcatgcgatcacaatttgccccgtacaatcactccagatcgatcagcgctgcctgtgtattgttttaggaccatggtaggtcctgtactcctcctcccttttgagggtcttcagccttgtacaaaggtgtggtcaacacccatcccacgcatgtggccctcctgcccaggacatagcagcactcccgtacttcactgttacacctcaccagaccgtatcacacacaggcacagggcagtgtcagccacgaaggatcacacaagaaaaatgccccagcagcctaccagccgcggggttgccaggccaggtcccccacgatgtcgtcgatctccttcttcacgtcgtccgtgattttgtcgatgaagttcagggccttcaggttgtcctcgagctgcgacgcgccaagaggcggcagagtgagttctcagctatgaggtggatgcgcagcgtgttgcaagcatccagcacacttgggacagccatgtgcaccacactgcaccaatcctcctgtgatcaacaccccccgccccctttcccctttctccccccaacccccctcacctgcgaccgcttggaggagccggtgatgacggtcgagacacgggggttggctgcgcaccacgccagcgccagttgcgcgggcgtggcccccatccgctcggcgatgggcttcagcttgtccacggcgtcgatctgggcgcgcttgccctccatgatgcccttcctcagccaggcgaacttctccaccgacaggcggctgccctcgggcacgttcccgcctgagtacttgccggtgaggatgccggaggccagcgggctccacaccgtcagccccagcccgtgcttctcgtacaccggcgcgaagtcgcgctccaccttgtggcgctggaagatgttgtactccggctgctccaccgcgggtcccaccaggcccagccggtccgccacctcccaggcctccagcagctgggccccagtccactccgaggtgccccagtagaaggcccagccccggtccagcacgtggttgaaggcgcggaccacctcctccatgggcaccgaggggtcgggacggtgggccaacagcaggtccacgtactccagctgcaggcgcgccagcgaggcctgcacgccctccacgatgtgcttgcgggacaggcccttggcgttgatggtcatgtcgggaagctgggacccaaagtacacctaggtggttcatttgattattttatttttggggagggaagggggggggg

SEQ ID NO: 17625 - DNA, 62 bp, Chlorella protothecoides
cctgccataggtggaagtgtctatgaaatgggtgttatatgcaaagtattctcgctcagtgc

SEQ ID NO: 17626 - DNA, 61 bp, Chlorella protothecoides
tgttatatgcaaagtattctcgctcagtgccatggcacgggatgctgccatggcatgtgga

SEQ ID NO: 17627 - DNA, 302 bp, Chlorella protothecoides
cattcgcgattccatgagactccaagggttctgcacaacttatgcacctctattagatcattgtgttctacgaagcctggactgcattacatattcacaaccaacatgagaagagcggaatagatggccggatgtttggtggctttgatatattgtgaggagcattgcgaaccctagagctgtccggtcaaataaccccctcacaataagtgtaatgtcatgggataatcaaaagactaagggagggcttttatagaaggcgtgaggtcatgctatccccctctgaagacgcggccgcgata

SEQ ID NO: 17628 - DNA, 102 bp, Chlorella protothecoides
ttggtccagggtggccacgccaaaatgcatgttgccctaaaagtttggttgcgcggtgcatccgcctggttccaaagtgtttcatgtttctttactttccaa

SEQ ID NO: 17629 - DNA, 150 bp, Chlorella protothecoides
gtattgctgcacaaacacccacgttgcatctgtctacatgcatatatttaaaacacataaactttacatctgctgcttgtaccactctgggtgttggtgattctcgggacttgcccaactttcctcgtatcggatctcaaactggccacg

SEQ ID NO: 17630 - DNA, 67 bp, Chlorella protothecoides
ttttttagcaatgcactatacaccacacgttgacttggcatttatgagcgtagaacatattatgaga

SEQ ID NO: 17631 - DNA, 403 bp, Chlorella protothecoides
gctgcaggatttgaaaaaggacttgatcgtgataatgagcctgtattatcaatgcggccattagattaactttattaatgctcctccccacaatgggggggcattattttataaaaaactaaatttttttacatatctttatttttttattagctgataataatatgataaatactacataccaggagaaatggccgagtggtcgaaggtaacgcattgctaacgcgtcgtatgataaaacataccgagggttcgaatccctctttctccgattttaatagctacaattttttaagcttggcgggaattgaacccgcgacaacgtgcttcggaaacacgtactcttgatccactgagttacaagctttaatatttgtttaaaaatatttattatttataacta

SEQ ID NO: 17632 - DNA, 243 bp, Chlorella protothecoides
tttgattctttatttataataacggccgcattttcatcaaaccggatacttgttccgttttttcgacgtacattttttcttgtccgtacaataacagcacgaacaacatctgattttttaattaacatatttggggccgcatcttttactacagctataataatatccccaataccagcagcttgttgtttagcaccacttaatactcgaatgcacattatttcacgagcccctgtattatct

SEQ ID NO: 17633 - DNA, 62 bp, Chlorella protothecoides
aggatgacgtaattcatatccagctgcgcggtggttgcagcgccgttgccgaccggaagatc

SEQ ID NO: 17634 - DNA, 476 bp, Chlorella protothecoides
ttttgatgcttgaagtctggtaaaccagaaattaattaataaatatgatgcaagacctacaccttcccaaccaaaaaacatttgtaaaaaattatcagctgttaccaacattaacatgaaaaaagtaaaaatagatagatatgccatgaaacgtggtaaatgaggatctgcttccatataagaaatagaatataaatgaactagagtacttatacttgtaattacacaaagcattattactgtaagactatcaaaataaaaaccccaaccggcatcaaacatctctgaaaaaaaccaaggcatccattcaatactacaggttactcctgataatgctacctcataaaaagctatgcaactaataacaaaagataaaaatacactactagttgttaatagagctgctcctcgaaatcctaaaaatcgaccaaacaaccctgctgaaatacttgcaagtaagggtaataaaagtacca

SEQ ID NO: 17635 - DNA, 212 bp, Chlorella protothecoides
tccataaacttagaatatttattctatattatgtgtaatgcatcataatttaacctctaccagtcatttgaagccaattttgtgcttcaatgtagttagtcggcgctattctaatagcttcacgccagtagtccgcagctttatcaaatagcaatttagatatttctatttgacctatctctatagcttgttcaccccgataatgaaaaatt

SEQ ID NO: 17636 - DNA, 147 bp, Chlorella protothecoides
tcttgagcatcatctgataacattaatgtttcccattttatagtttgtataggataactaaaaataggtaacgtgtgctctaaaacattaggatgaaggtgtggcttaaatcgaacaacaatatattgtatagctgaaaacgtaaaa

SEQ ID NO: 17637 - DNA, 218 bp, Chlorella protothecoides
aaaattataaagtattattattattgaaaaattataccaaacacgttggagtattgtgtctttattatttcacaccaggttggtacatattaggttttattcgaacaataaaagctaaaaatcttaggattttaacaacaataaagtgggaattatatgtctataatcatagacttacaatgaacagaaaactcagatcaattgaagtggatcagggg

SEQ ID NO: 17638 - DNA, 289 bp, Chlorella protothecoides
tgcttggtgcgagccattgttcttgatgtgctttgatgttgaaggattctgtaggctgggagattttgtgggagtgcggtcctgtcgcgtggatttatgctggagacagggcctcacgaaacacttcccgccaccgccattgttacggagcacaaaccgatcctgcggtccaaaacggcaatactggcccatcggcacagtgtgcaatttgcgtcctcgatactccatatagcaggccccgaccttcgagctcagcataattctcaccatctccacacagtctcccacc

SEQ ID NO: 17639 - DNA, 78 bp, Chlorella protothecoides
tttccgcccttgccgcgtccagacatggttgcaggaggttgatttgttggtgggagactgtgtggagatggtgagaat

SEQ ID NO: 17640 - DNA, 130 bp, Chlorella protothecoides
aaaaatactagaattaaaaataatacagagtgtacaggatttcgggcttgaataactagtgcacctgatactaatgttaaactggaaaatatataaaataaaaaatccatagatttatattttgattttt

SEQ ID NO: 17641 - DNA, 555 bp, Chlorella protothecoides
gttcaagtatacaaatttattttttacttgttctattttttcaaataccagtaatatttatagctttattttatttatcttattttgactgttttagtctttgtagatatagaaaaattgtatttttttgtatcatttgtatttcatcattgctatctcccccagaaatattgagtcaattttgttgcttattagtaaccagttttctttttgaattttctttatggattggctttgtattgcgtttttttaaataataaatttacttggttttaatttcatacaaccaagtaatttcatacaacgcagtaacttcgttgtacgaagtaaaaacaaagaattttaaaatataataaagtgatgttaggtattgtcgaatctatagaccttgagatattgattcaatatatcatttattttaaacaagaatttatgtacgtatatatctatgaattaacatttttgtacatatataatacataatcaaaacataataaacaagttattttctttttttatttaaataactttcatttattttacaaagcaaaaatc

SEQ ID NO: 17642 - DNA, 61 bp, Chlorella protothecoides
tcacagtgagttttggaaagggagtgagggtgaaggacatgctgaggtgcatcttgatggg

SEQ ID NO: 17643 - DNA, 1273 bp, Chlorella protothecoides
caaaaaacataaaaatataaattatataaaagcatttataaaaatatgtatttagaacaatcttttcataaacagatatccttttcgagttttttatttgaaaatgactttctagctctgtttccggagatatttttagtatctactggtatttttttattagtttatggagtaattactagtacatcaaaatcattaaattatccattattatcgtataatatcagctggtatgcgataatggccttgttatatacttctttattgatttataatagtccaataaataatgctgtgttactctataacacactcgttatcgatgatttcactcaatttgtaaaaattacatgtttattatcaagtgcatgctgtatatcaatgtcattacaatatatccaaacacaaggagacaatgcatttgaaactttaatattaatactatttgctgtatcaagtatgttatttttaacgtcatcagcagattttatatcactatatttagcaatagaacttcaaagtttaagtttttatgtgttagctgcgttaaaaagaaattcagaatttgcaactgaagcaggactaaaatattttttacttggggctttttcttcaggtttattaatttttggttgttctttaatatatggatatactggtgtactttcattctctgaatgtgctaaaatttttgcagcaggtgttgtgccatttgatggtattcaagctgtaacaacagaatcggcacttgtttcattaggaatggtatttatacttgcaggatttttatttaaaatagctgcagcacctttccatatgtggtctccagatgtatatcaaggagcccctacgcctattacagcattttttgtaattacacctaaaatcgcattatttgcagtgtttcttcgtgtatttttacaaagtttttatgacttgtttccaatttggcaaacacttgttatttttgctagtttagcttctatgcttgtaggtgcattagctgcgctttcacaaagtcaaatcaaacgattaatggcttttagtagtattaaccatgtgggatatttacttgcaggatttgcttgcgctagtattgaaggaatacaagcattatctatatatttaattgtatatatttttatgaatattgcggtatttagtattttactatgtaacatgcgtcatacacataataatgggctacctagaattaaatatattactgatttagcttttttagctaaaactaaccctctcttagcatttactt

SEQ ID NO: 17644 - DNA, 85 bp, Chlorella protothecoides
aaatctaattcctcatttaattcatcaacctgcaaatctgtttcaagggatttaatagatttagttttatctaaattagctactt

SEQ ID NO: 17645 - DNA, 273 bp, Chlorella protothecoides
ttttgttgaaaaaggtaactctttcgtttgttttccttcagggtcgtaataatccggtaaaaatggaaaaacaaaccatcgtttattataaggttttttacgtatagcgtatgtatactctttgttaaggacttcaaattcagctcgatgaattggaacatttgtcaaatcgtcatttaatgctttgtcaaaagcttgtagcccatgccatttcattaaattatatggagaatacataagattttttggtacaatagggttatcaggtgagtg

SEQ ID NO: 17646 - DNA, 79 bp, Chlorella protothecoides
cccgctgaacttaagcatatcaataagcggaggaagagaaactaaccaggattcccctagtaacggcgagcgaaccggg

SEQ ID NO: 17647 - DNA, 155 bp, Chlorella protothecoides
aaaaaacgtactgtaatgcctgatcctctttataaaagtagtcttttagaacttttagtacgacaggttatgcgaaacggtaaaaaattattagcatatagaattatgtatgaaagcatgaataaaattgctgaaattacaaaaaaagatccact

SEQ ID NO: 17648 - DNA, 264 bp, Chlorella protothecoides
cctgtgggcgagagaaatggaacgcatgcacttgaacctcccagcaacctcacaagcaccaggtccacaccttccaagtggtccacattcatccagggaagtggtttcattgtgcaccgtttcctcttccacagagtgagggctagccagaggggcaccttgcactctctgtttggtaggaacggtccgaactcgccctacacaggggtatggtatacagtttaacttttgaaagggccgctggagagggtcactgcgtcgttc

SEQ ID NO: 17649 - DNA, 226 bp, Chlorella protothecoides
aataaaaacaaacggttacaactttttaaacattatagttatatgttaggaagtgatgctaatattccatgggattatttagtaaaagtaacatatggttttagtgcggcagatatttcaacaataatgaatgaatctggcttaaaagcaatagctcaagctagccatcatacattagaaactattgaacacggtattgatcgacttactactacttcggttgcaa

SEQ ID NO: 17650 - DNA, 300 bp, Chlorella protothecoides
aaaaaagatattcccctgctttaccagcatatgttccaatgattctatgttctagttctccacgacaaacatactttaaccattctaattgtacagtacgttgtatttgattataacgcacgctatagtgacgataccaaagatgaaccactatcaccggtgggtggtattttaaaagagttccaacaagagctttagctgcttgataataagcactccgggcagtcgaaaataaaaattcttttctagctttagggtttttaatatcttttgcaacgccccttgcaaccgaagtagtag

SEQ ID NO: 17651 - DNA, 3352 bp, Chlorella protothecoides
tccatctcgtaagtcgacacccccgcctccgattaagaagccgccgcccccctctcgcaagtcgacacccaggtctccaaccaagtagccacccacaggccgcaggattaccctccacccactgcaaagaaagttgccatctctcaccatcgaaatatcccctccacctcctgcaatgaggtcaaagtctcctccagtaaagagcccccgtcaactatgttgaaaagatccccgcaacgcccatgatagatcaatctgcatttcattgcatggtgaccgtcccctcctacatggtgctctccgacaaaatattgaatctcattggtggagaggtcccggagcaatcaatggacatcccatcagctccaatgatcagacgcagtcttccacctggatgggatccactcccttttcccagggacagatggagcatcattgcaatgcatcacaaaattcgcgatacatacagagctgtaaccttcatgaaccattgtttctttacctcgttgtatttgcgtcacaagattgaaaggaagagcaggccgatggagaatctaaggatgcacatctggattttcgtgtttcttgcaatgcaccatgtgtcggtccagaggctgagcccgacgcaggaagtgtttctgtctggatcccagaaacccctaacttggtgtgtaaccaacaaaatgctgaggatgcaatagtctccctagatatcttcctcccagatatcaagcgacccgcaccatctccaatgagtccagcattcgaggtttaccagccttaatcttgggcgtctgctgccaagcacatccgccaacctggatttcctcatccttctatcagtctcctgtgcgtctatctgagcagacagctcaggaccctctaaataaagagataaatacaggcttcgtggccaggcgcaagtttcgccctggggcctttcagtccagatggaggtgatttgaatgtatctgtgtaatgatcaggtccggagtgagcaggcgcgaggtatcatccacctgaccgaggccagactcgggtattaagttcctgtccggatgccgctgtcgacttgctgtggagacgaggatatgaatagggacattaatcaagaacgcatgcagaatcaggtggtggagtgcgcttcagcacgagcttcgacgggttttaaatagcaatgggaagcatggcccaaagcacaaaaggagtcctacctcatgatccgcgcaatacatccggatagcacaggtgtcaacgtccggtgcgcggtcggcgggttctgtttacggacacggagacgcgagctgtgatcctagcgttcttcaggtgactgttcgccgtttctctgactataggagatttaagtgtgttctcctatatcctgtcttccgataataacgcagctcgcgcatagcgcttttaaatccagagccatgcgggcgctcctgcatttacctgccgtctttctggcgctcgtcctcttcctgcaaagctccattatcgtacaggtaagctttgctccgtgcatgggagcaacaatggcgcttttgactcattccgcatcggatctatctctctaacatgctaattgcctcccaccaacacccaggcggactgcgaccccaggatcgggttcttcagccttcccaccgtgctgtgagcaggccagtgtgctgcatatcatccgaattatatcctggatggttatatcccttgtcacaggctacacacactgaccatgatggtgagggtcctgattgtgtaggtacaatggcacgctgttcctcgcctccggaagaacccccacggaatactgcaagtgagtccgcgagagtgctcttgcatggtgcctttcacgccgtgggatccctggatgcgaccagacgcccggaatgacccaccgcatccgtacacgttgaccccgctccttactcaactctcacacctcaggctcaggggctacgactcccatgcctttctcataacggaggttgtatctcgcagttatccctttcccaatgccgagatcagtaccttgaacatcgacagctgggatgtgtgcgtcccatgtgatcgttatgattgcagctgcacctacatcaggataatcgagtgcctgccggaaggagtggagaggtgtgagtcctggtacactcccttctgggcgaccatcggcaccgggaacaacggcttcaacaattacggaaactacaacctgggcgatgacaaccagggtgcgctggggtcgccttgcatgttgcaccgcaccccgaccagcagtgtgtgagcgagcactcttcccaccggcgtgcagggaatggcaacattggcaactccaacgtcgggaacaacaacactggggagtccatcatatgcaacaacaagcgtggcgattcgccgtgcaccatggcggacctccatacatcggagacagcagtggtggtgcccaggcccccaatgcctccaccaccctcacccctacccttcccctcaccccctcccggggagggcggctgtgatcccggcatcggcttctttgcgctccccacagtcgagtgagtggggcagaagaggggggttgcagcagtttctgcgccccatcactgcgtcgcggacattccctaccctcatcctctgcgctgtaccctcgacccacaggtttgctagcctcgtgtacctgctggacccaaagtctgccggcacattctgccggtgaggccaaatcagagatggtgtgttacatgagattcctccatcttcattctagtcgtcctttttgatcctgggcagggcagcaatttgctggccatggggttgatcagccggaccccaccctcatatgccgactcccacctgcacccaggctgaaggggtatggaggtggagctcatgttccttacgcctataaaatgtacgagcattggccctttgacgactacagagtatttacgatggatattgaagcccttgagcagtgtatccctcaaggagcccattcatgccaaattgttggcatggtccagtgcatgcccacgggtgtgccgcagtgccaagcaaacaaggacggcaatgttggcaccggaaacgtcgggagaaataattatggtaattacaatttcggcaacagtaacataggtaagctggacgggcgggcagctgcgcctgctgctgtagactccatttgcagccactaacagccttggtgcaatcactgatccacaggcaaccacaatatcggatcagacaaccgaggaagctggcttgtgggtgacaatttactctgcaactatgcaaaaaaggatgactgtcctcaatccttcctgagaacggatgagactctgaatatcagccc

SEQ ID NO: 17652 - DNA, 174 bp, Chlorella protothecoides
gtttaaaacttctacaattagtggagaatttattcgattaaaaaaatcgttaaatcaaacttattggagtagtttaagtaaagatgatattgttacattaaatttaccgagtaaggcgactgaattaactttaagggttggtcaaattttacgatggggtcaaccaatttatca

SEQ ID NO: 17653 - DNA, 225 bp, Chlorella protothecoides
gtaatttttcccctgagagtgtctctcttgcttcaaaaagttgttcaatttttggaataccttgtacaatatcttgtgtctctaatcggcgtgattttaacgttacaagaagtttgttctttaaaatcaaatcattatcggatatatgaataattccacgttttgaagctaaaatgggtaaacctcgacggattgataactgtccttgatttatttttataattt

SEQ ID NO: 17654 - DNA, 84 bp, Chlorella protothecoides
aacctacaaaagctactaataaccaaaaatattgtgataaaaacgaaactaaatctaattgtggcataatgatataaaattttt

SEQ ID NO: 17655 - DNA, 710 bp, Chlorella protothecoides
atttcttttaataaagtttgttcaaatttttcaatatctgaaatatttaatttatctaaataccctttagttgcagcgtataaaacaacaacttgtttttcaataggcattggtgaatattgaccttgttttaaaacttcagttaatcgtgctccacggtttaataaatattgagtagaagcatctaaatcactaccaaattgtgcgaaagcagcaacttcacgatattgagcaagttctaatttcatagtaccagctacttgtttcatagcttttacttgagctgcagaacctacacgactaacagataaacctacgttgatagcaggacgtatacctttataaaataactcagtttctaagaagatttgaccatcagtaatagaaataacgttagtaggaatataagcagaaacgtctccagcttgtgtttcaataactggaagtgctgttaatgagccaccacctacagaactagacattttagctgctctttcaagtaatcttgaatgtaaatagaaaacatctccagggaatgcttcacggccaggaggtctacgtaataataatgacatttgacggtaagctacagattgtttacttaagtcatcataaattattaatgcgtgcattccattatcacggaagtattcacccatagcacaacctgaatatggtgctaaatattgtaatggtgcagggtcacttgc

SEQ ID NO: 17656 - DNA, 234 bp, Chlorella protothecoides
tggtcgtggacaacgtgaattaattattggtgatagacaaactggtaaaacagctattgcattagatgctatcattaatcaaaaattcgtaaacgtatcaaaagacgaatcagctaaattatactgtgtatatgttgcaattgggcaaaaaagatcaactgtagcacaaattgtaaaaacattagaagatgcaggagcattagaatatactgtaattgtagcggctactgcaag

SEQ ID NO: 17657 - DNA, 1056 bp, Chlorella protothecoides
cgatgttagtgaaccgtgtaggtgattttggtcttgcattaggtgtaatggctattttttcagtatttaagacggtagatttttatacggtgtttgcacttgctgctcatcaatcagaagcggtgttgatattttgtaatatagaatttcatgcattaacagtgatatgtatattattgtttgtaggggctgtaggtaaatcagcacaattaggtttacatacttggttaccagatgctatggaaggtcctacaccggtatctgcattaattcatgcagctacaatggtaacagcaggtgtttttatgatagcacgttgttcaccattatttgaatatgctcctaaagctcttgttgtagtagctattgtaggagctatgacatgtttctttgcagcaacaactggagtagtacaaaatgaccttaaaagagttattgcttattcaactgctagtcaattaggatatatgatttttgcgtgtggtatttctcaatatactgtaggtgtatttcatttaatgaatcatgctttttttaaagcattattattcttaagtgctgggagtgttattcattctctttcagatcaacaagatatgagaaaaatgggaggaatggcaaaacttttaccttttacttatgctatgatgtctattggaagcttttcacttgtgggatttccattccttactggattctatagtaaagatgttattttagaagtagctttcgctcgatatacttgggatgctaattttgcctatttatttggaagtatttgtgtagctcttacatcttattattcatttcgtttgttatttcttacttttatagctccaacgaatgcttataaatctactgtaaaagctgctcatgatgcgccatttttattagccttgccattgtttctattatctataggaagtatttttgtagggtattgtgctaaagatatgatgattggactagctactcctttttgggctaatgctatttttgtcttaccacaaaataatgttttattggaatctgaatttataccacaatctcaaaaat

SEQ ID NO: 17658 - DNA, 79 bp, Chlorella protothecoides
tctcatggtaaaactgtttataattttgactttttattatcatcatcaacaagtgctccaagtattgctggtcaaaatt

SEQ ID NO: 17659 - DNA, 204 bp, Chlorella protothecoides
caagtaccaccacgtccaggaccatcacaagggaaagcataaccaaaatcttttttatctggcattaattttgaaccacgcgcgtctagagcacctttgatcccaattaatgtagttgtatgtagtcctaaagcaattgcatgatgcactaagaaatcaccagggcctatgtttaaaaataatgaattactttcattattaatt

SEQ ID NO: 17660 - DNA, 281 bp, Chlorella protothecoides
aaaaaataccagtagctatttgaactactaaacaaattcctgcaatactaccaaaactccaaaaataattaaggttacttggtgatggataatctacaatatgatcatttaatattgataatattggttgttttataattgatagtcttttcatgaaatttttttatttttttataaacaaagtacaacgatgtttataatcctggtattaataaatgaaatttattaacaatcaagcttaatatagagtgttgtcttataaaggactttgttctttactt

SEQ ID NO: 17661 - DNA, 111 bp, Chlorella protothecoides
gacaagccaatactctaaccaactgagctacgtcctcataaatgagatttacctcatttaaactaaattaaaacgaatgaaaataaatgaataaatatcatttattccgtt

SEQ ID NO: 17662 - DNA, 88 bp, Chlorella protothecoides
aaaccatgatcaaattcttgtaataccggttgtaatgatcttattacaaaagggaaagatacaaaaatcatagctaaaagtacaccaa

SEQ ID NO: 17663 - DNA, 75 bp, Chlorella protothecoides
gcgtggaggtaagaaggggaatattgtgggggaagtaaacgtggacggtatggaccgtggttctggacatgggaa

SEQ ID NO: 17664 - DNA, 1510 bp, Chlorella protothecoides
gtctcctcctcccccctcccccgctcccccttctcctcctcctccctcccctccttccccttctcctcctccctcccctccttcgccaccgtctccacctcctcctgacaatccaacccccaagcttattctctttaagcaactcaataagacgcttaagttcaccgtgaaatcaacgcgagccttcgtcaaagttgttgttcatatgagcaacactgtgaagtatacgtggaccatgaccgctcaaacgtacttcaccactagcacagaagaaaccttcacaagtatgatagagcgcacatggtatatgaccgtagagtatccagacggcactgtctcaagcccatccaacctggccacagtcatggggtgatgcgtgtggggattacagatgtaccaattcagacgcagttttgtacccttcatgacacagctcttactgtactgggttgttgaggtggggtgtccgctcagccccctggtcatgtaacatgatgcaacagagctggagtaggaaaagaattaagtgatcactcaaagcctcaagggcaagccacgctccacaataggttcaggatgcaaagagagcttgtgcgaaggtaaccgaggcgaccctcgccaatcatgcccttaccttgatgtagccggttgatagagtggtgccagtgacagggatatggtcagaaagcaattgcggaagcatatagggtggtgtagattagtagacccatacaccggcttaggtcagggtaaccccccaacagccgtcagggtgctcttttgactgaatggaattatctcaggcgatattttacggggacgcatgcctctacagagcatatttgaagcttgcttgcacatagctcatagtagtgcaaaagcagtgtctgttgccttgggcagggcacttgtgagcttggctgaggtctaggttttatctcctgcagatccaggctgcacacagaggtagtgctgttctgaaaaagcaagtcgtctgcaatggaatcatctgagagtcttacttaaaatacatgagcatgtgcagcacggccaggtcgatgcttttctgtaggtcagatgcaccactgaatgctaggtcgcagggaccactgggaggcccctcccacgagtgtcattcaatattgcccatgaattggttgcttcatgacatgctttgagtcccgttggaatactagtggttctgtctgtatctcggctgatcggcgcagtgaccaatgtgggaaagagatggagtcgggaaagaggcgacaaccaacccctccacaaccaacatcatgaaccagcaagagtcgattcagactttggcctgtggacagcatgatgtttgtctggatgcttccattctcatacactgctgtcctcagaaaaggcataatctccatgggaagtgcagagcagcctcccatcagagtctgaaagcacacccggggcatgtcatcgatcagcctacgggaccgaggagagccttcaggggaatcatgggatgact

SEQ ID NO: 17665 - DNA, 531 bp, Chlorella protothecoides
ttaatattaatattaattgcagtaccttcattcgcattattatatagccttgatgaagtagtagaccctgcagtaactataaaagctattggtcatcaatggtattggagttatgagtattcagactatagtgtagctgatgatcaaagcattgcttttgatagttacatgattcctgatgatgatttagaattagggcaatatagattactagaagtagataatcgtgtagttgttccagttgaaactcatattcgagttattattacagcagctgatgttttacatagttgggcagtgccttcactaggggtaaaatgtgatgcagtacctggtagattaaaccaaatacctattttcattaaacgtgagggcgtattttatggacaatgtagcgaactttgcggtgcaaaccacgcatttatgcctatcgttgttgaagctgtgtctctagaaaattacatttcttgggtatctaataaattagaagaattgtaattatttaatataaatgatacttatataaatcaa

SEQ ID NO: 17666 - DNA, 100 bp, Chlorella protothecoides
tattcataaagaatatacgttattttactttgtgatttttaaaatacactcttatagattaaattgagacaccaaatatgtatgtttggtatttcaatta

SEQ ID NO: 17667 - DNA, 10707 bp, Chlorella protothecoides
cccccccccccccccccctaaaacacacacacacacacatacatccacacccacacacacctcgtcgatgaccagcagctcggcctgcgccagcttggcggcgtgctgcggctggatgtactgcaccgtctggcggtgggtcttatacacgttgacgcgcacgatggccttgccaaaggcggggttggtgctctcgaccagatcgtagtccaggtgctccttgtagtccaggtcgtcaaggcccttgaagatgaactcgaacagggtgcgcaggttctcggggctgggggcggtgacgaagatgttgctgtaccccagcgccagcgcgccggcgatggccaggcccagggacgcggactgggagcggtggatgggtgggcaggtgggtgtggggtggactgagggtatgctgagggcgctacagggaccatgtcatgctgttcgtctctccctcattgggacactagtatccagcaacaatgcaaggccatgctgcaggttcagccgcaggccggccaaggcaacgcagctccacaccggctggaattccctgcccccaacaagacccatagcagggacccacgcagagtccagaccctccgcggcgcgcctcggcaacacaccttcccgcgccctcgggcggccgtcagcgccaccgtggaacgcagcgtcttctcgctggcggcgtccaggaaggtcgcgacggcccgcgcctggtccagcgtgcggcaccggcccaccagcgccccggccggctgggtgtcggccaggctctccaccagatcccggagctccgaggttcccgccgcctcggcgcccaccgacgcggacaaggggtggatgttttgcacctgagggggcgatgtgtgaggggaccagggtgtccggaggcatgatcttgccagcaggcagctctgctgtcgaggatgatcaagcacggctgcacctgccacgcaacgcggtgcctggtccaggcccccacttggtcagctgcaccccatcataacacagcatgcaccctggcttccccattaatatgatctgcagcaaacctgggtggaggtgggcaggatgttgagctcatcgtccatgaggatgcaattggggcaggatgccaggctcagcaccaggcgctcattaaagcggcctgcagaagggagggataggggttgagaatatcgagcaagacgggcgggacccctcagagacctcaaactatgttgtatagcaggggtcgtagggtgatgcccatgtggcagcggccatgcgcagcgttaccagccaggcttcgggtcccactgggggcattgggttcagatgccaagactccacccctttcagaccatgcctccccattaccaccccccacacgccccctcacccacccacccttcacttcctggtggctctcggtcctcagccgggagtggacgtccatggtcagggagtacagctggctcagcgactccagcgtggacagcaggagcacgatgcagcccccgccctccaccgtctccaccgtccgcgcgagcaggttggggatcagggcctcaaagtcctgaaggaccagcatgccgtatgtgtttcccagcaccttgtgcgtctcagagtagtagcaataccggatgttggtggaggcctgagtggggagggggggtcagtggggagcggccatgagggggggaagcgggggtttactgttccaggcaggcctgggaggagccttgggggcagtggctgcatgggtcacctccagccatccctagcgcatctcacatcccactacaagccttcttactgaccacaaagagggagaaagggtcttccttctcggggtcaagcagaccacgctgggacatcttctggatctggcgcatgcgcttcttgcggtggctgcatggtgaggaaggggggccgctctgcgcaaggcacccagccgaccaggcaaaacgacgggcggcagacggcagcagatgccgcctggccagacgcatttgcgggcacattgcccttggccctttctccgaatccgcttgggccttgtctagcatggttcgcacctggacaagtacaggtccttcttgtagcaccacaggaccgacggccgggccttgaccacggtcttggacagcatgtagtgcaagttgacgacctgggcatccagcacagggtcatcggaggttgagtatagtcccgcatcgacgagggaaaagctgtccctcatcctcatgccgcatggccttgccgctgcacgccctcacgccttcctcactcgcctggtccctccccttgtcgcccacgatgatgtacagcgacctctggcgcgtcttcacgcagttctccaccagtgtgcggatgcgggaatccactttcttcctcatggtgcacgacgaccttgagcgggtggtgccggagatgctacaggggtgagggcggggccatgcgcttcctcggagccgagtgtcacgagggtattgcacacttattcacgattagattgcatcccaataagatcggtacttcttcaagcaaaagggtgggtcacttgcaatgcatgcattattccgcattgttttgcgcctgcgcgcaacccgagctgtgagtggcaaaaaccgagagttcaacatcctcgactctgccattccgttgggaacagtctcaagaaatcaatggagaccattattaccatactcaaacgactctttacttggttcatatcgatcaccaatgccaagctcacagatcatcctgtggtcatttgccaacccaggaaagagagttcagactgaagcatgtactacaaggacatgctcacaatctggcaacagagcctcattacttgcatggagaactttattgcttgcaaggacccagatttgtttggaacccaattttttagcaaacaccatctcagcacatcccaagccaacgaaggccattggaacttggatgtgaagactacgggcaaatggcaagctcacattcattggatgctacatggagatggattatacggcttggcttcgacaggccccaagtgcccagcattgagtgggaaggcgaggagcagctgagcgagagtagattaagattttctccccgcataagaaccccaccctatggccgtggacggggatccgaatatgcactccgcctataaatggtcaagactccccctcacatcgtcctgctgagatcgcaggccaggaacgagccgacacaagctgccttggtcggcaaggaaacggtcctagctgcctggccctcgacgactggagtcccaacctgctcgacatctaggcaccctgaccttatattcatagaaatcgtagcttaagtactacgttttccgcctcgtgtttaccactcggacctgcgcggaccctatcctggtcgagtggcttgcagtccggccctcgcttactctggggaccaccctctgccagagggcgcacccacccatgcagtcgaccataccccttcagagtggcactctgcacccgcgacaccccctgccctacccccgggcctgccaggtgacgttcatgcatggagatgccatgcagccaggatcatgcatgaattgggccgaggccagtggccctgccctgcttgagtcgctgcgatctctgaggcttacgtcgcccttaaacccgcagggatgtgctgctcagctgccccctctagactggtcccggctccaaaggcggaggatcccgggagttgcctccaggctggtggtccgctgtgctcgcaccgactacaccgccaaggccggggatgtggaggtgctgaaaaagcccctgaagtctgagctcaagccctccgaactcgtcacggtcttcggcttcccccgggactttgacacgcagtgagtgcctttgaacgcgggctgggagacgtgcgacctgaggcctactgctctgtgtatttctatgatcacgacgaccttgaaggtcagggaagcgccttgcgttgcaggtccatccaccaatattacttccctcctcctccccgcctcgtgcccagttatgccatgggggacatgctgggggcggggtcctttggcgtggtgcggcaggcgacggaaaaccagactggcaaccagtacgcggtgaagagcatcatgaagatccccaagaatggccgcccgacgccaaggtacctgatcaagctgcagacggaggtggatgccatgcgtcagctgggtgccagcctggacgctgtgcacctcaaggtagggggggaacagggctgtaagggcgtgctaggagtggtgtgactgcccttgtggggctggaccactggtatctttgctaagatccggctcctggcctcttgaggctatggatttgctgctcagtggatatctgcttgttttttgggcactctgcattgacggctggtgtatggggtaggggctgcctgcctgcctgcgccccaccagaggtttgcaagataagatatgcactgcggcgccccgtctccgttcctctcacaagccgcaccgcacaaatgacaccttctccaaacaggatgtatttgaggatgagctcagcatccacctggtgatggagctgtgtgagggagggtccgtgcttgatgggctgcagcagggggactacagcgagcgccaggtgagggttgggcagggcttagagtgcgtgtgggagcattcctgcatgatgcctttgctccccaggtgcacagggaaggctccatgtcttgttttgctgtctggcaagacgccatatctccaaaatcctcaggtccagcacatcatgaggagcgtgatgagattcctggcccagagccactccaagggcatcatctaccgtgacgtcaagccagacaatgtgggtgctttttagggggggtggaggcgtatcagaacgtgaggtggttttgagcatgggcatgggcggaacctagggatattcatttgggaaggaatggtcggcgagcgacccttgagcagcgccttgctttcggtaccctcaccatccacccacgcccatgtctgttccatggccccgcagttcctggccaaagacaaggtgtggtgaggcgtttgcgaggctgcaaaccctgctagagcctcggcagggtgtgcctggtatccgacgcaggggatgccactcttgaaccgtttccacattggagtcctgtaggatgtgccatcaggaacctttcatcaaaacaaaacgccacaagtgcaatcctgcgcccagcgctgcatgaacacctcaccttcatctccattccaccccagaactgggcaaaggagatccactccgagaccttcctctcgcgcttcggccgcgccgtgggtctggactcgcgggaggaaatcgcgcccagcgactcccccatcaaagcgacagatttcggcctggccatgcgtcaccgagccggggagccgccgctgaagtcgaggtcgggaacgccggcttacatggcgcctgaggtaatccagcagtgctatggcctgcccgccgacatttggagtgcgggcaccatgatgtaccagctcctgacaggcaaggcttggtggggagggtgttgtttctgtacgcgtccctgtgtgcatacaagaggtaccgagatcagggagtagacgatccaccacccgtgcaaccccccttacccctccctgcaccgttcacacaggcaagtttccgttctgggactcggtcaaggactgcacgctgcaggacgtgtggaaggccatcctgtcgcagcaggtcaacttcaccaggccagagctgcagcaggtggggtggagtgttgtgtgtgccttgccccttgaaaaggactgcggcttgtcagctcgcgcatactcgtggccctccagcctgccatcatccccaaaaccacaccgtctttcctcattccacacaggtgtccacctcagcacgcggcctgctcatggccatgttggagcgtgacccccgcaagcgcatcaccgctgccaaagccctggaacatccctggctgaaggtttgtgtggtgcgattggctgcgaggtgacccccttcaatgccgctggacacagcgatacttgccaacttcagcgcctccacatacttgtgacaagcctggttgcttgcctctgtgtgcgcagctcgatgcacacctgtccagactcccgacctgaacccagcagatgcctgcgtgatggtgctggtgatgccgaccggacccccgttgccccctcccgtcctgatcccttcccaatgccaccccacccacccacccactcacacgcaggaggacttgggctccgacaccccccgcctgcgcgcctcggtggtgcagcgcctgcagcgcttcgcgacgcacggccagctgaagcagctggtgctgcgcacgctgaccgaggcggcgggcgtggacggcgagtcggcgccgccgcccatcgagggcgcccaggagtggctgcgctccgtgcgcgtgctgttcgacgagctggacgttgactcctccggcaccgtctccatccaggagctgagcgcggggctggaggcgctgggttttgatgtgtcgccgggggagatggaggtgctcatggcccgcatcgacacggaccgcgacggcgggctgcagctctcggagttcgtggccagcctggtggactggggcgtcgtccagcgccaccacgcctggcaggactgggtgcgtgccgtgttcgaccgcctcgataaggacggcaacggcttcatcaccctggatgagatcgcggaggagctcggtgactacaagggcaaggaaggtgggtgggtgatagtgtgggttgaatttgggcatcgtctgttctttgtacctgggaagggtggcctgaagggggattgctgtggtggggtcaacacaatgctggagcctctcgtttgtggagaggaaatgcagtgtcagggctggctgtgtgtcattgccaatcaggagcaagcatcagtctcaacgcccgtccatggacctccatcaggagcatcacactccaccacgttgcctgactcccacccaatccccgttttgtatcgtccgctttgcagacagcctgattgccgccaggcgcatgctccgggaagctgatgcaaatggcgacgggcaggtgcgtgagtggtttttgggtgggagaaaattgtgttagcacagcttctggtcaagacctggcacgataatactttgcaaatcccacccctgcctcttcaggtctcttggtctgagtttgtggagctcctggaggcgacagacgacgacttgaatcaggtgggcggaaggcatgagagagggtggtgctgcaccgcttctctgttctcccttgctctgcgtccgtgactggatgatcaagaaggtgtgctcctacacacatccctgcagtacgactcgaggctgaagcgatatgcccatgacgtcgtggacgaagacctgtcgaccctggactcgctccatggtagcggcagcagcgatgactatgtataattagacgcccaggtctggtagggaaacagtggcatgtggccatggcccacaagcctgcagcagggctcttgttcctgagtggcacaccagccgttcctgttcagtcctaggacgcccgctgccctgcagtcgtattcagggaatgcaatgctcacgttttatcccttgcgatacaaggtcctggccatcttcacagttttgtgcttggcagagagttgcacttgtcgacaattgcctaagccgggctcatgccctgccttgtatggtacatgaaatctttaagcagaatcaagggtatgtctgaacactctgcagaagcagtcacatgagttggaaaactgtcgcatagacactccagcaatcggcatggatgctggacaagtcgaccttggctcatatcttattgcactgcctcttttggttggattcttgggcagggagcctacgatatgagatttaagtgggtgtgacatacttccgccttcaataggtaacccattgaaggtagttcaacagcttccagacaacagtcacaacgcaattgacagtatgccaccacccgactcactccacttgggctgagcttattcatgtgaagacatggctgttggtgcacagggtccagatgctctggaaggggaaccttaccaaaagtcatggtgcatgataggtctgtgtgaaaggggacagtgacactgagagggatggattggtgtgacaaacattgagccatttattccatcccacacactgcgcttgccttcaaagttgggttccagtgtcaggggtaagcccacagtttctaggaaaaatgtctgtgtaggcatctgcgatgtgagagggacgagcagcagcattccaatgagctgaagtagatggccaggtgcaattgacccaagtatcgtctggagtggacatcctgcgtcagttttctgggaacaaccttgcaagagctgccttctttccccccgcaaacaccgagtccccaagctgctcaccttgcacagagagacacacattccaacacagccactgccttcaaggaagcgacacttttcaatctgaacggcactcttccactcgtgggtcttccctttgcttgagactttcacctgggagaaacaaataatggcatgatattgccgccaggtgcccaccacagctttgaggcagcgcatgttgattttggcgacggccatgcaagctctgccaacaaagccacacccaagcagacagcgtacctgttgccgctgtgtgtggccaacaaggccgccaaagcaggtggacgcaacgagagccatggattcagccaccaactgtgcgcgaggaggaggaggagcatcagggatctgttgtagcgatgacatgcaaacagaaacctggttggcgcaagctgacccaaacatacggttttgctcagcaccgcagcaccccggcatgcaagctgtcccccaccattgcagcaccttgttcaggggaagatgccgacggaggagtactcccatcccaggctggaccagacctccaaggaccttggccacaaacctgcgctgctcctccacagacctcccacgagtgatgctttcggctcggtctaggaatccctggaatgtgttgtttctctctctatcgcctggaggattgagggctggaaagtgagagggggaccgtcacgatgcacccctgctctggatagttcatgcattggtctggtgtgcacaaccacaagccatcgctttcagatgatctggcccagcctatcggcgtctcacctcccaattcctcgtccatccgatgatttatgatccctaggattaccctgtccatccaggtgtccttgtattcactcggagggtggttgggcccagtgcgaagctgggtctttacaagagggctatcgacagagggcgtcgcggcgcttggcttcgcatggaccgccatgcactttcgagggacccgctgggtcacgaaagccgtgttatattggggcccggaggctggtcgaccaccatgtcgacagcttctcggttgcacactagaccggcaggccgggctgcatgggcctgcctgaatgggccccgcaactcccatgcacgtcatcgggactgtaccatcattaccagtgtggggtgacctcccaacggggtctcatgccttgtgcacctgcagttggttacgtcgactgtcctcatgcagctgctgcccatgctttcctggcgatgtggaggtgcgatatgagccacattgtcccagcatcaccagcagctcaaccaaccgctacccagcctccaggggaagcggagggcagatgtctgaccttctcccgtttagcgcctccttgaatgtcagctgtgaccagtcccttgtggtgcagacatgtctagccccattcaccaagcttgcatcaccccagctcccaacactcccccccgtacttcccaacctggataattctatacatgacagagctataagaaaagcgatatagtgtaggggatgagaggcaccagacactagcacagtggtctgcacagggtcaggttggaggaccgctggcctagcacattgccggggcactttgggggacacacttctggatggaacggtgccggagagggggcaaaagacacatggggagaggcaagggggcgatgtccctgctggtctcaagaggatgcatacaatgtcagtggattccttttttgtgagcttctggctcaaggggatggcaaagtggatgtcgcgaagcacaggggctgggcagcgggaggcacgatggggtcccgaccctcgtcggcggcaggacacggagagaaggactctgggaggagggagcagtggcgaggctgttgcgtgtgtgcgtgggggagagaggcatgcttccctgtcacactcctccgtcccctcgtcagcctgctgacctccagcgcctgcgccggccggccccagcgcatcagtgcgcgccccccctgctcatgcggccggcggccaggacgctggacagggggagggtgcccgcctggggcgccatgacgccgcccaggccggccgcgggccccagcagctggcccaggtccggcatggcctgggggcctccctgcgccggccgaggaccattcgcggccagctggaagggcgtgggcgcgggcaggggcacgccgccgtgctggccgtcgtgcatgctgccgctgccggcgcggggcgagccggcggggggggggtagtgga

SEQ ID NO: 17668 - DNA, 221 bp, Chlorella protothecoides
aactaactattaaagtaaataagtaaataactaacatattaatctattacttattacaattattagtaagtaagtttagtaagtaactttagtaaataactaagtattaaactaaataagtaataaactaactaataaagtaataaataaactaataaataaactaataaactaactagtaaagtaactaataaactaactattaaactaactattaaact

SEQ ID NO: 17669 - DNA, 551 bp, Chlorella protothecoides
tttttagtacaagatatatactaaaatatgcgctcacaagccaaataaagctacttttttgtatcgcctgatagaatatatatgcaatgggcttttatattagaattttacatatagaggactaaaactaatatattcaatacaaatctattacagtatatataattgcattctaataagccaaataaacatactttttacgggtgatattataatatatatatacttttatttacatgctttattttaacaaccagctattatatttacactatttctcagatcgactaaaagttattatttgttattttaaaatatagaatataaaagataataaataaaattagtattagtcaatctgagaaatagtcattctagttactttattacttactttacgtacttagtcaatctgagtgatacttatttagttagttagttagtcaatctgagtaatagtcaatctaagtgattgttactttacgtatttagtcaattagagagatagtcaattagagtaatagtttaatagttagtttaatagttagttt

SEQ ID NO: 17670 - DNA, 62 bp, Chlorella protothecoides
actcatgtatcaatggcgcattgaaacatggtagtcatctgtaaagtgatccctcccacgtc

SEQ ID NO: 17671 - DNA, 64 bp, Chlorella protothecoides
attcctccactgacagtggatcatcacagactgtacgcaaaccgactgaggagactggcgcatc

SEQ ID NO: 17672 - DNA, 74 bp, Chlorella protothecoides
gtgtatgcagggctacagactggagaagtgatggtccaagggatgaggagaagtctgaggtgtgaaattgatgg

SEQ ID NO: 17673 - DNA, 188 bp, Chlorella protothecoides
attcaaattataaagaaattcctaaaattttaggtgggttaggaattattattatttcaacttcaaaaggattaatgacagataaagaagctcgaaactctcaccttggtggtgaattagtttgttctatatggtaaattaaataaatttagttttatttaaattatcctaattttttagcttttttt

SEQ ID NO: 17674 - DNA, 271 bp, Chlorella protothecoides
tttttttttcccgaccgaaagcgatgagtaatacgcccacgttttaaatcatatgggcttaattccacaataacccgatctcctaataatattcgaatatatctttgtcgaattttgcccgaaatgtgtgctaatattaaaaccccattatcttttaatttaaccctaaaaagaccattagataaacattgggttatcacaccttccatctctaaagcatcaagacgtgaacttttatttaaatacactttaacctccgattatttttttt

SEQ ID NO: 17675 - DNA, 153 bp, Chlorella protothecoides
caagcttcatagggtctttctgtccaggtgcaggtagtccgcatcttcacagacatgtctatttcaccgagtctctctccgagacagcgcccagatcgttacgcctttcgtgcgggtcgggacttatccgacaaggaatttcgctaccttagg

SEQ ID NO: 17676 - DNA, 573 bp, Chlorella protothecoides
caaaagcaaatcgtggtattttatacgtcgatgaagttaatcttttagatgatcatttagtagatgttttattagattctgcagcttctggttggaataccgtggaacgagaaggtatttcaattagtcacccagctcgttttattctcgttggctctggaaatccagaagaaggtgaatgtagaccacaacttttagatagatttgggatgcatgctcaaataggaactgttaaagaaccccatttacgtgtgcaaattgtagaacaacgagctgattttgatgcatcacctttaaaatttagaaatatttataagcaatcacaagaacaactagcaaatcaaataattaaagctagagagttgctaccggaagttcaaattgattatgatttccgtatcaaaatttcgcaaatttgtggagaattggatgtagatggtttacgcggagatttagtaacaaatcgagcaagtaaagctttagctgctttttatggtcatactaacgtgaatgaaaaggatatttttaaagtaattccgctatctttacgtcatcgattaagaaaagacccgt

SEQ ID NO: 17677 - DNA, 141 bp, Chlorella protothecoides
cccacctttcccccacactttcatcgctccccacccgccagggagggcctcatcgccatcaactacgcggcgcgggcccggggcatcacccggcacatgagggtgcatgaagcacgggccagggtcccagagctggtgctg

SEQ ID NO: 17678 - DNA, 88 bp, Chlorella protothecoides
tacatgcatgcacttgggtatgtgcatgggctgggagctgtagaggagacgatgtagtgcaagggaccttgctcaccctcacaccaaa

SEQ ID NO: 17679 - DNA, 144 bp, Chlorella protothecoides
ttttttgtatatcgataatgcttgtagtttttataacggaataaatgatatttattcgtttaataagtaaaagcgtatcatttctacttttattatcgaaataaaaatactttttacttcgtactacttggtacgacaataaat

SEQ ID NO: 17680 - DNA, 62 bp, Chlorella protothecoides
agggtaacaacaatacctactggcattttttgtcgaagtttaaaagctgcaattggtttttt

SEQ ID NO: 17681 - DNA, 686 bp, Chlorella protothecoides
aatactattttacttgaaataaatataatttattttaatttcatacaacgaagtaaaataaattatatttagaattgtatagtatcgttttaaaattaatatatggatgtaaccaagtcgaaaccaagtcataaccaagtcgaaacaaaattgaaacaaagtcgaaaagaatcgaatttattttaattatgcaccaccccagtaatatacacatacaaataagaataaccatacaacgtcaaccatgtgccaataccaagcggcagcttcaaatccaaaatgatgagattttgagaaatgatgtaatattaaacggaataaacatacagctaaaaacagagtacctattataacatgaaatccatgaaaaccagtagctaaatagaaagtagatccataaattccatcagaaattgtgaaaggagcttcaagatattctaatgcttggaatcctgtaaagataacagctaaaactacagtaactgctaaggctataataccttgtttacgatttccagctaaaatagcatggtgtgcccaagtaactgaagcacctgaagttaaaagtataatagtatttaaaaaaggaatttcccaaggatttaaaacttggattcctttaggaggccaaattgcaccaatttctacagttggggctaagcttgaatgaaagaaagcccaaaaaa

SEQ ID NO: 17682 - DNA, 116 bp, Chlorella protothecoides
tatatatatatgcaattaaataataatttttttattggggatatggcggaatcggtagacgcaacggacttaaaggtactatttatatttatatataaattgagcctattagagga

SEQ ID NO: 17683 - DNA, 342 bp, Chlorella protothecoides
atttattttacttggttttaacttcgtacacttggtacaactaatgtaatctattctgaatttatttaatagtttttagtgcgtaatttgcgaacaaatttttgtattttttgcaacctttcgaaatcacctttatatttttgataagagcggacccatatttgaaattctacgctttttaaactttttattgcatatctataactattgtcgggagcagtgaaataatcaataatttgttcaatagatgaagaagctccagtagttaagttataataaatttttttattaatcgctattttagccttaataccaaacattttacgaaatgcttctaacaaa

SEQ ID NO: 17684 - DNA, 279 bp, Chlorella protothecoides
ctattttataatcaattatatatctatttccataattatgtggatttataaaacaaaataaatataaatttcatttgattcggtgttattcattaaatccaaccacttgcgtttatttattatttaccatgcaaaagagattataatagaagtttatatactttttatatatgtcgtccaatttcatatcatattcataaattttattttattaatatgatctttataaatccgattggttgtatgaaattaaaataactgatattcataaagaatata

SEQ ID NO: 17685 - DNA, 61 bp, Chlorella protothecoides
ccccgaagcgtggcatatagaatggcagggtggtatctggtctttcccccccgacctgctg

SEQ ID NO: 17686 - DNA, 107 bp, Chlorella protothecoides
aagtgtaaagaattattaagagtatcataaatacctttatgaccagcacctaaatttcctgacggaggagtgtgactttctagaatttctttgatactatgcccaat

SEQ ID NO: 17687 - DNA, 68 bp, Chlorella protothecoides
ttctagaatttctttgatactatgcccaataccaaaaattgttctatattggtgtccggctaatatga

SEQ ID NO: 17688 - DNA, 71 bp, Chlorella protothecoides
ccggattcaaaatcgtgcgcctccgagatgcgtgcgtcgtctcgatccatatgttcagctctaccgcttgg

SEQ ID NO: 17689 - DNA, 80 bp, Chlorella protothecoides
gagggtcgtgggcggtgcatgccgatgttgagtgagtgaaaggcagcagcacgggcctccagccgtgcttgtgactctat

SEQ ID NO: 17690 - DNA, 207 bp, Chlorella protothecoides
ttttttgtggagccattatagataaaacagcgtataatcatttggacttaaaaaaaggaattgagtgtgtatataatacatcaagtcaagaagtttatagtcgattattagaaactttaagtcctgattcgcaactaaacgaattatctgatgttctagagagaaaaatcgaaaatgtttggtctgctttaatacaaaacaaaaaaa

SEQ ID NO: 17691 - DNA, 284 bp, Chlorella protothecoides
aaaaaataatataatatagcttgataataatcacgtctcccgcataaagtagtacatatgatgtagaatgctttcacaaatcgagttcggaaagggttcgggtggttcacattcccagatatcaagctttttttctttgataataaaaattaggcgaataacgggatttgaacccatgtttccagagtcacagtctagcactttaaccgactaagttatactcgccaagagaaacaataaatttatactgaactaataactgatattcataaagaatatacgct

SEQ ID NO: 17692 - DNA, 257 bp, Chlorella protothecoides
atatatatatataaaattccttatatttatttaagatacaattttttattctattaatgtccttttcgtctaggggttaggattccaccttttcacggtggcgacacgagttcgaatctcgtaagggataactttttataccttatataaaagattatagaaaaccctatagaaaaaagaacctcaatataaattacatttattttatcttagagtattattaaaagttaatttaacgatctctctttaaataaatt

SEQ ID NO: 17693 - DNA, 181 bp, Chlorella protothecoides
tgcgttaaatcaattagtacgtactcctggtatttataagttaattgaaaataaacgtacaactaaaggaataaaagcaatcccttacatacgcatagttcctgataaaggtagttggctaaacattagttttgattctaaaaatcgattatggattacaacaaaaatttttagaaaaaaa

SEQ ID NO: 17694 - DNA, 61 bp, Chlorella protothecoides
tcaaacttacctatatttgctgcaatggtattttgatgaaatgttcgatctggccctaccc

SEQ ID NO: 17695 - DNA, 289 bp, Chlorella protothecoides
tttgatgaaatgttcgatctggccctacccagtaaggattaaatttccattcttcggggtttggaacataaattgaactccatttttgaatttcaccgtttaaatatttttgataaagtttcaaatgccaccatttttcaggaaaccttgtttgtggggctttaccgtgtaataacttcgctgctgttggggttttttcatacgtttgagcaaattcgtataaatattgttctctaacgtcgttatgttccattgagttaaaatttcgttttaatggcaatggttctcg

SEQ ID NO: 17696 - DNA, 326 bp, Chlorella protothecoides
aaagtcgaaaactcaaagaaagaggttttgtaaaatcttctaaaatattaattggtaataaaaatgccgctggagatatataacgtttaaaatacgagaatccttttttactaatacctgcataaaaatacgcaagtgatgttaaaagagctaaagcaactgtagtattaatatcatttgtaggagccgctaattccccatttgggagttctaaaatacgccagggtaataaagcacctgaccagttagatacaaaaacaaataaaaatattgttcctaaaaaaggaacccattttatataatctttttctccaatttgggttttt

SEQ ID NO: 17697 - DNA, 297 bp, Chlorella protothecoides
aaaacataaaaatttttatgttttataaagtaaatgtatagtaaatataagaaagctataattaaaactctttttaataaaagccacttgaatttatatttttatagaggaaatagtatttatgacaaacgttttgtttgatttagcggaagtttctgttggtcaacattggtattggaacttaggaccctattttgttcatggtcaagtactaataacatcatgggttgtattaagtcttattattggaatagcattaatagctaatcaaaatttaaaaactatcccagaaaattt

SEQ ID NO: 17698 - DNA, 114 bp, Chlorella protothecoides
ttttttttaatgcatccatggcagagtggtcgatcgcaccgcactcataatgcggttctttttaaggcgccgttggttcaaacccaactggatgcaaatatttaattgcctttg

SEQ ID NO: 17699 - DNA, 176 bp, Chlorella protothecoides
aaaaaaacacattttacatccacatacatattcttatggctattttattcatatatgtatagaacagtttaaataaattcaactcattttcattaaaaaagtatatactatttcgcctccacctctactcttaatacctaaaataaattcgatttatttgatatcttgataaaaaa

SEQ ID NO: 17700 - DNA, 301 bp, Chlorella protothecoides
cttctgataatcaaaatcttatatcagaagcaaatcgattacaaattccaattattggttgtactgatactagtagtgatgcaactggaattacttatcctattccttgtaataatactagtgtggaatttactctatatttatataaaaaattatatagagtcttaaaaaatttaaaataaataataaactttatttattttaggtgtatatctataatataacaatgagatgttatagaataccgcggaaatagctcagtggtagagtgttgccttgccaaggcaaatgccgagggttc

SEQ ID NO: 17701 - DNA, 61 bp, Chlorella protothecoides
agtggctgcttgaatcggtgagggagtggcatgaatcgattctcgtgtttgggttctgcga

SEQ ID NO: 17702 - DNA, 433 bp, Chlorella protothecoides
ttaaaaaatgtggtgataaatgacaaaattctgtagcaaatataatactttgcaatcgtttatttgaccaattcatacaagcccccaatggcgagggcttgtatgaagcatataaaggatgtactaccgattgttttaattttatatgtccaaatctataacggcgtactctagataaagtacgctccacgccgcaaatattacaaattttaacttgtggaattttaacttttttatcacaagcacaagtgtagtcttttatagggccaaatattttctgacaaaacaaccctcccatttcgggttttaatgttttgtaattaactgtttcccaactactaacctctccaacaatagtaccatcaagtaatgaacgttcaccccattcttgaatttctcgtggcgaggttaatccaatttttacttttttaat

SEQ ID NO: 17703 - DNA, 99 bp, Chlorella protothecoides
cttatttacatcaattgtaggtaacgtttttggatttaaagcacttcgtgcattacgtctagaagatcttcgtattccaccagcatatgttaaaacgtt

SEQ ID NO: 17704 - DNA, 80 bp, Chlorella protothecoides
ggagcggaattccgttgtcgggaaggctagtcatgtggcagattctgccaccagggttatcgaaaatggaaaatggaaat

SEQ ID NO: 17705 - DNA, 146 bp, Chlorella protothecoides
attgtatctgttcaatctttattaattttatttcttgttccacctttagtaaacataagtttgaaatttttgctaattagacctattgtagaacattattggaatcgtcccggtaatgagatttttttgaattctgatcaaaaaaa

SEQ ID NO: 17706 - DNA, 273 bp, Chlorella protothecoides
aggcaccgcacggcgccactgtgagtgcaaagggagggtgcttgggtcgttgcgatatactgggcaaccgatgtgcctgtagcatgacttgcatgggtgccgcttggagcggcgcatgcatgatgcatggcaggggagcaggcgtcgcctgcgccacagaccattcctctggattgcaggcagcaattgatcttgctcctgacacaagggcaagcacccacgattaacaatgtgtgatgtcgcccccgtgagcaccctgcgcacttgtgcccg

SEQ ID NO: 17707 - DNA, 757 bp, Chlorella protothecoides
taaaaacacaaaacgaatataaaattagaaattaacaattagtttgttactaaattttttacgtttacgggtttttacacctaatgctggcttaccccataaacttactggacgagcccgaccaataggtgcttttccttcaccaccaccatgtgggtgatctactggattcatagctgaacctcggacgtgggggcgtcgacttaaccaacgacttctgcctgcttttcctaatgttatattagaattatcgatatttccaacacgaccaatagtagcccagcatttttcagaaattaatcgagactcgcctgatggtaaacgaagtgtaacccagcggccttcttttgctacgatttgtgctacagaaccagctgatcttacaaattgaccaccagctccgggttggagttcaacgttatgaacagaagtccctaatggaatattagataatggtaaagtattaccaatagttatagaggcattaggtgaagaaagtaatttttctccgatttttaatccaagaggggatataatgtagcgtttttcgccatcgttataagaaactaatgcaatgcgtgcagtacggtttggatcatattcaatattttttactgtagcagaaaccccaattttatttcttgtaaaatcgatttttctatataatcttttatgaccaccaccacgatgcctacttgtaataatacctttgttatttcgaccttgagaccgagaccaacccttagttaattttttt

SEQ ID NO: 17708 - DNA, 61 bp, Chlorella protothecoides
catgatcaccttgacgtccgacagcgcgtcgaagccgtccagctggttcagcagctccagc

SEQ ID NO: 17709 - DNA, 61 bp, Chlorella protothecoides
ggcgccacgaggggcacaatatgcttaagctactgccgcaaacttcgtcatgaccgtgtga

SEQ ID NO: 17710 - DNA, 465 bp, Chlorella protothecoides
tttcctgttcgtgtcgttatattttcattagataagcgaatacccttacctttatatatactaggtggtcgagtgttacgtatagaatgagctacttgtgaaacttgatttaggtccacaccaaataaacatatttctgaaggactttgtaaaaacacacgtaccccactaggaactttataatgtatatcatggctatgtcctaatttcaacacaattgtatctttaattggagagccttgatctgtttcttctttcgaaggttgtacggagtcttgataaacttgatttattttatttcgtacaccaactacactttcagaagaaattaaagatgcacgataaccaactccaacaatatcaagatagatacaaaaacctctagaaacaccaataaatttattttcaatgagttgtttatataatccattatatgatggatgaaaagaacgtacaattacttgt

SEQ ID NO: 17711 - DNA, 182 bp, Chlorella protothecoides
ggattattatttgcagcttcaatttggcattgggtttattgggatttagaacttttccgtgacccacgtacaggaaaccctgctttagatttaccaaaaatttttggtattcatcttttcttatcaggtttagcttgttttggttttggtgcttttcacgtaactggtttatttggtcctgg

SEQ ID NO: 17712 - DNA, 347 bp, Chlorella protothecoides
tggaaaaaccctaaatcccattggtaacgcgttggtccatataattctactggagtagaagaagaaccataccacattgttccagaaacaacaaaagctgcccaaaaaactgctgcgatactactagaaagtactgtttctatgtttcccattcgtaagccattatataggcgttgtggaggtcgaacacaaagatgaaacaaacctgctaatataccaagaataccagctgcaatatggtgcgccggaactccaccaggattaaaaggatcaaatcctgtagcatcccaagatggtgatacgggctgaacacttccactaataccataaggatctgatacccaaat

SEQ ID NO: 17713 - DNA, 117 bp, Chlorella protothecoides
gaaaaaccaggtaattcacctaaacggcgtataacacgcaatcgtggacctctataacgcgacatattcaatttttattatttaaatttgtttaacaaaatgctttttaattaaaaa

SEQ ID NO: 17714 - DNA, 201 bp, Chlorella protothecoides
caaaatcaaataacaattttagtaaatggagcagaatctgcagatactttacaatcagaaaaagtagaagcttcgtttgaagaagccaaaaatcaattagaaaatgcagaaagcgaaaaacaaagagtagatgctctttttcaatttaagcgcgcaagagctcgatatcaagtaattaaacagttagttaattaatttttt

SEQ ID NO: 17715 - DNA, 61 bp, Chlorella protothecoides
ggccggaccaagatgttcaccgcggtggacaaacatgccaacgtgacatcctgctcctcca

SEQ ID NO: 17716 - DNA, 63 bp, Chlorella protothecoides
agcgatatccatccaccgggtccgtctgcatactatgacctcacgtgcaaacctcacaccctg

SEQ ID NO: 17717 - DNA, 229 bp, Chlorella protothecoides
aacgcaaacattggtgagaatccaatgccccgaaaacctaaggattccttcactaggttcgtccatgaagggtgagtcaggacctaaggcgaggccgaacggcgtagtcgatggcaaacaggttaatattcctgtactgttttgtatttgataccaggggacagaagaggtaacagttagccgttattggatttcggtggaaacttgcaaagctgggaaaagaaaaaaa

SEQ ID NO: 17718 - DNA, 204 bp, Chlorella protothecoides
attttgccgagttccttagagagagttatctcgcgccccttggtatactctacctacctacctgtgtcggtttatggtacaggtgttttgcatttatagataatacaggcttttcttgagaatatgataagaaattaattcatattttataaataaaatacaaacgtatcactcgttagctttaaaaaggaagaaggttttttt

SEQ ID NO: 17719 - DNA, 61 bp, Chlorella protothecoides
acaaaaaaatgttctcgtttggggttataaaccttaatacacgttgtttattttactatcg

SEQ ID NO: 17720 - DNA, 172 bp, Chlorella protothecoides
ttcaccagaccatacaaaagctctacgtgcccaagcccaaggtttcgttaaaatgtgccaaataccaccaaaaatacatagagtaccaatccaaatgtggccacctataatatcttcaaggttatcaacactaacaatccaaccatcaccaccaaaaggtgattttaaaata

SEQ ID NO: 17721 - DNA, 221 bp, Chlorella protothecoides
ttttttggatacgtttggaaagataaaaacaaaatgactactattttaggtattcatttagttattctaggtatcggagcttggcttttagtattaaaagctctttattttggtggtatttacgatacatgggctccaggtggtggtgatgttcgtttagtaactaacccaactgtaaacccgggtgttatttttggttatattttaaaatcaccttttgg

SEQ ID NO: 17722 - DNA, 244 bp, Chlorella protothecoides
aaattcaggagcagaacggtgaattggtagttgatctgaagtattagccggacctaaattatcaacagtttccccaagtacattaaaaatccgacctaaagttcccttaccaaccggtacatttaaagcatcaccagtatctaaaacctccatacctcgttttaagccatctgtagcgttcatagaaatagcgcgaacacaatgatcacctaataactgctgaacttcgcaaacgacaaaaata

SEQ ID NO: 17723 - DNA, 194 bp, Chlorella protothecoides
aagtatttttaaatttacaaaatttaaaaaattacaaacactacaaaaatcaactaaatctttaaaattatggctgtttctacagaaactaaaaatgttggtcgtattactcaaataataggccctgttttagatattacttttacggcaaataaaatgcctaaaatttataatgctttatctattactagtaa

SEQ ID NO: 17724 - DNA, 538 bp, Chlorella protothecoides
gatatttcagcttgggatgctttctatcttgctattttctggatgttaaatactataggttgggttactttttattggcattggaaacatcttggcatttggcaaggtaatgttagtcaatttaatgaatcgtctacttatttaatgggttggcttcgagattatttatggcttaattcttcacaacttattaatggttataatccttttgggatgaatagtctttctgtttgggcgtggatgtttttatttggtcatttagtgtatgcaacaggatttatgttcttaatttcttggcgtggttattggcaagaattaattgagactttagcttgggctcacgaaagaacacctttagctaatctaattcgttggcgcgacaaaccagtagcactttctattgttcaagcacgtttagtgggtttagcacatttttctgttggctatattcttacttatgctgctttcttaattgcttcgacttctggtaaattcggttaaatttttttaattactcttttattaataaaataaaaga

SEQ ID NO: 17725 - DNA, 113 bp, Chlorella protothecoides
cttgaactttgggcaaaaagggacttgaacccctgacctcacgtttatcagacgtgtactctaaccaactgagctatttgcccttatcatgataatatactaaaattataatt

SEQ ID NO: 17726 - DNA, 101 bp, Chlorella protothecoides
aaaaaaagtgctattagaggtcttcaaaaatcaaatttagttattaaacaaattcaagaagttacaccaattgcacataatggatgtcgtcctccaaaaaa

SEQ ID NO: 17727 - DNA, 61 bp, Chlorella protothecoides
gctggccgagaacttcctgccccagctcatagccatccccaagagcgtgctgcagaccatg

SEQ ID NO: 17728 - DNA, 168 bp, Chlorella protothecoides
ccctattgatggaaaaggtccgttaaaagatgtaactcgtgttcgtgcagaattaaaagctcctggtattattgttcgtgagtcagtaaaccaacctatgcaaacaggtttaaaagcagttgatagtcttgtaccaattggtcgtggacaacgtgaattaattattgg

SEQ ID NO: 17729 - DNA, 61 bp, Chlorella protothecoides
atgcgtggaacacgtgactcatgtgtggcgacctgccacgcgcgccctctgacccctgccg

SEQ ID NO: 17730 - DNA, 157 bp, Chlorella protothecoides
acttcgtacaacgaagtaaggtaatgatatatttttgtaaatgtttaggtagctcaggggtagagcggaggactgaaaatccttgtgtcggtggttcaaatccacctctagacaattgatagagttggacaaaagatttaataaattaaaataaaaa

SEQ ID NO: 17731 - DNA, 270 bp, Chlorella protothecoides
atatatatataatgaaattattaactttttactttgttttaagctacaaaatccttgtggacttgtcccacgaataagattcaagagtgctgtttctaattgatcagttgctgtgtgccctaaaataaatttatcaccattttcaaaaattaggcttctattataagcttcctgacgccaatttcgtgcactagtttcagtaaaaaatacactttcactcaggttaatacatattggagttttaaaaatataagctaatttataaatttg

SEQ ID NO: 17732 - DNA, 82 bp, Chlorella protothecoides
ttcagggggacaagattcaatatttttgtttttttggttattacatcttaaaaataaatggaattttaatttaagtatttta

SEQ ID NO: 17733 - DNA, 326 bp, Chlorella protothecoides
ttcttttctgagaaaagaagtttacaacccataggccttcatccttcacgcggcattgctccgtcaggctttcgcccattgcggaaaattcctcactgctgcctcccgtaggagtctgggccgtgtctcagtcccagtgtggctgatcatcctctcagaacagctactgatcattgccttggtatgcctttaccacaccaactagctaatcaggcgcaagcccatctcttggcaattttcatttttcacttctcagcaatataaggtattagctatcgtttccaatagttgtccctttccaaaaggtaggttcttacgtgttactc

SEQ ID NO: 17734 - DNA, 83 bp, Chlorella protothecoides
taatttatgcaaattattaaataatttgcacaaattttgttaaaattaaatatatatttattaaaaatatttttaataaatat

SEQ ID NO: 17735 - DNA, 78 bp, Chlorella protothecoides
gcttgcatcctccccgcatccccgccgcctcgacaccttcaaaccccccccctcacctccagcttctgcagggcaaag

SEQ ID NO: 17736 - DNA, 18855 bp, Chlorella protothecoides
ctgcgcgtccgcgccgtccccgcggcggggacggggacggggtggggccccggcccggcccggccgcgggcggatgcgccggctgaagtgccagtgcagccggcgcccgcacaaccggcgcccgcgcagcaggcgcctgtgcagctagcgcccgtgcagccggctggagcagcccagcatgcggcgctgcgggagcagctggctgcggtggctgagctgcgcgagcggggactccaatcgccggcgcctgcgccgccgtcacagggcgagcgcccaggccccgtcgccgcggatccccaggctccacgatagcaggaaacatgggagtgaagtgcagcgtgtgcgagctcggcaccccagtgcactgtgctggacgatgtacagtgaagtttggcgccaacctgttacggagtagggcaaggagctcgcgcgcgcacgtcccatcgcgcaaggaatatcatcggtagcagctctgagaatgggtggatctcagcgagtaacggaaatataattttcaaacaaaatggaagtccacctcacgacgatctagtgcaagacgccccggggggggggtgaggggcatgaggaacacactccccagtcggggagggcaaagcctggcagggaacgctaatcgacaccctgcaattacatttgctgcgttgatggctactgttatcctctgtcgaaggtgcgagagactcgttttcatccatggctcgtccatgcggcccgaatctggccactgaaccaccaacctcctcggcctgcaggctgtggtccgacaccttcgaaatcaggcatctggtgagtgttacgactccagtttgtgtgcggaatgtcacatgtcgtgtgccagggccaacctccatcggaagctgattgccgaagctcggcacacacattccccttcaccgatgcagagagagagactgagtgaggcacacggcgggcactcacttcttcagcctcatgccgaatcacaagatgtacaaccccgggagacgcagcagatattgcactggagtgtacgggcagactcaggggatgcacccccattgacgggacccaggctggagaatgtgcatctggccccaaaccagccccagttccatgttcagctgaatgaagtggaggagggcagagttcacggctgggcatgtttgcgtaacagcccctctgcatctattcaggtgggatgcaatccccggagagagccagggattgagggtgcccaggatgtgcgccctggctctgttgagatgaccatgcacgcaggaacaggctgcaccacagtccatgtgtcatggtgtgcaaaactaaagcaggagaccccccgtcatgcaggtggcggcgtatgtcaacggcatcctggctgctcaagagggggcaggccaagcagcgcccgtccatgccgctgtgcttgggctgtgtgggctgagtcccgggaccaagcacttctccaacggcttttccatagcgctcccacacctgcccaccggcgtgcacgaggtatgcaggtcacccaggcatcctgctctgcataggggcccatgcgcggcagcctgcccctccccatcccatgccgatctctcacctccctcccaccacagctgcgtgtgctggcgtcgctagacaactccacttggcaggaggccaacgccagccccatgctgtttgaggagagcacggcgcacccggatgccaaggccgcgctggccaggaaggatgccatcatcctgcagcgaaatgcgcagctggcggcgctctgggcggagcgcgccgagatgggcccttggcgggacaggccgcgcggcaagggccccgaaggggtggcgtcggcggtggagaatgcgggcaatgctaccaacctagtcgtcatcgcggtcaacacggtcggtgtggcttgctgctgttggcgggcgggagtaggggtgtcaagtggggatggggtaggaaagcattgcgaaaggaggacatcaggattgtctgagcctcattctagcccatgtgggtgcaagcggggccctgctcgggcctgtacgagtgtggaggcgagcctgagggcccctgcgcaatgcatggcagcctgtgcccacacccttcaagaagctcccaccctggcccctctggatgccactatcctcacctggcgtccctggtcatatgatgagtgccaggcacacagcacgccccacccctctcccccaccatctctcaggggctgggatcgcgggatcgtcgggacatcctgcgccgcacctggttccccaagggtactgagctggccgcctgggaggccaggggcgtggtggtccgcttcgtggtgggcacctccgtccaggccaacgacccgctggccgaggcgatgcgcaccgaggcccgcgagtttggcgacgtggtggagatgcccgaagtcatcgacacctacggcggtgagcagcgcggggctgggcgaggggctttcggcgctgggcctgctgggtggtgggtagaaggagcagagtccctccgtccccgcgcgacggggctcatctgcacctcccctgggcatgcttggtcccacgtgcatgtacaagggtgactgtctgacacccaacacccctcctccctcctgcccccagacctctcgctgaagacgcagcacctgttcaccacgatgctgtcgctttgggacgccgatttttatttcaaggtcgacgatgacgtggcgctgaacctggaggccttatctgactacttgacggcccgcaggatgaagaagaacctctacctggtgagggctgggagtcctggcgagggtgggagcctgggttggaggtttgtgtgaaggttaggcgaaattttttgttcgagtgctgtctggggtagccggatgtggaaggatgagctgcttgggcagtgccgcagacggcagccgactgcacacttgcccctgtctcccaccacctcttgcgcccgggcccctgtgctgcggcagggatgcatgaagtctggtcaggtgctgacagacagcaagtggaagtggtatgagccggaacactggcggtttggagacgccctgggaccccagggcatcaactacatgcggcacgccacaggtaggtttgcggccggctgctggcctgcaaggctgggcaaacccggcgtttggtgtgctcggtagtactccatcgaccacttgcatctagggtgcttgagcagctctggatttctgccctgcccaaatctcagctgcccatatttgggatcctagacctcgacacctctcaacctctcaacccagggtgaaaaactacatcactccctccctcacccccccttgcgcaggtcaagcatatgggctgtcccggcccgtggcgcagtacatagccaggaacgcgcacatcctgcaccgctatgcgaacgaggacgtgtcggtgggggcctggatgctgggcctggaggtggagctggtgcacgacctgctgctgtgctgcagcagcgccgcacagtgccgggagcagaccacgccagagaagcggtgtctggtgttctccgaggtcacctgcgcggggatctgccaggccgagaccaggctggagcctatctggaagagctgcttggagaagccgtatgaggccgtcaccctggctacctttgaccagaccgagaccagcactgcctgaggttggtccgagcactggggccattcatgtcattgaggctgcaagctgtacataccgcaaagaagccagtggggagcggatcctgtggccagtgctgctgggtcggcctcacacacaggaaacagttctggggtattgcacccaaagagcctccgggagaggggccagcagttgggacgaggcatgctttgccatttggtcatctacagagttcgtccgccaaaggggtaaggccgtgcatcctggcatccaagaccttgatgcacacacgtgtgaactcgccccttcaagattccccatcaactgctgagactggtcactctgaagctagaaaacatcgtcgagggggtggaagcagcagccaagctcagggtcagcacaccccgctgggccaggctcttagaataattggtagcaagactgagggaacaaagacgagccatagaagtcgaggtgagttgtggtttcatgaagagtatatgctgcttcttagatcggtgcagccatggtggcaaccatggaaaaccttcctactcattcaagtgagcagcttggccttcggcaagtgctgttagtactgagcgtgacaggtctccaaacagcttacgaaggagcgcatcttcctccgggagtaactcttgcgggaagtgcaggccagtgcacggcaagggaagctcgccagctcggatcgggagatgacccttgcaacccatcgacactagaactccgggtgcgagagtaagaatggcttcatcggctgttatgcgtttttttatgcattgtgaccctcttcaatccattatagaaccagggctgctgatgttggatgaccagcgcctggtcggagtcatgtcgctgtctgttgagagtccggtaaaattattagttgcggcgggaagtctgggacagtgccacacagttccgctcttggcgcagccacatgatggcctcgaaaaccctcaatgacctccaagccgatactttgccatcaaagctacacgttccggtcgtcagccgcagtacgttgtcgaagtgtgccctcgggctccgggcaccggaggcaccctcgaggaatcccccgcacttccctcctgaaccctcgagggatgctcgaggcgtgcccattgtataattaatgtatgctcactggctccagcgagctgtctagggtcttgctcgagggattgaggcgtccgacgacagagccatgagcgaacaggattcacccgtttttccgcccaacttcttcgagagctgcccatggagcatccaaaccgatttccaatctctgaaggaggttgggaagggcaagtaagtgagggggtatatcccttgagagactggagctcagggcatcgacgctttcgtgcccaaccgaccctgtaacccatgtgctccatgcagggacacagtgatctacagcgcagtgtgtctgcccctgggaaacaagattgtggccgtcaagatctacgacaaatcccgcctggcctctacgaaagttcgagccatcaagcgagaagtggccatgatgctatactttatgcggcacaggtgacatgggtgctggcatgcgaaagcaagcgacagcctctgaccacggcgctgcacgagtgcgactgcatggaggaggacggtgatgcatgcatgtagcactgatgtgcaggttctttcctcgatatgagacgcaggtaccccaacgtcgtggaattatatggagcctttgaggacgagtcacgctacttcatcgtcatggagtactgctcaggtgcgcctgcggcatcgacatcagatcgacgccctttcagatgcccgggacccaccgtgtaaggaattctctctgcactgcactgcgctgcagggggggacctccttgagaagctgctgcgggagaaaaaggccatcagcgagaggcgtgtggcgaccatggtggccatcccctgcctcgtcaccctcaggtgcttgcatgccgcaagcatcattcacaggtactgtgaggacagacgccagatcgggactgcgtgaggggagtcaatgcaagctgaacgaagggtgcaagacataatagccaagccaagtcctgcttattcacaccagggacataaagcttgagaacatatttttggacaatagcggccgtgtcaagcttggggattttgggtgagtgtattgagaagcttcgggtccggacggtgggctcatttcaggacagattcagccactggttgaagtggctggtacatctgctggatcagtttgttaccttaagatttaagccggagcatcaggtgattcatctaccaatgcaggttgacgatgtgcacccgacaggaggcagccatatccccagttggcaccgtagagtacatggctccggaggtgcgcaagctggctgctgtggacatgtgctgtgtcaacgacgtcccttcccaagagttacaatccacagcaatgcctgacgcgtccctcgacccctctgccctgacgtcaggtgatcgctctgccgcccgtggatgccgtggtgagcggccaagtccgggcgagtgagatcccaccaaacacagagaaggtcgacatctgggcactgggcgtcacattctttgagctcgtcactggtgagtgggcgggctgcaggttggcaggcatgtctgaagtgccgcattgttgcctccactccaaggctcacacgctgtccagcagcaggcttcattcttagcccaagtgtgccaggtgctcaagatccccactcgagcaggtcgtctgccttttgaaggcaaggacaagctggagatcaagaccaacatcactgaatacagaatgtcaggttttggtccgcatgtctccgcccaggtgaagaatgctggcattgctgcagatctttctgcgcacaccaactgcatagagactgggcaagggatgtctgtcaagggtgggacaggcctgaatggcagcaagttgcctttgcgcgcttccccgccatcctccatccgtttctcatcagagcctgcattcgtgcggcctccctcccacagtgccaagatctgatccggagcatgctggcctatgacccggcggatcgaccctccgctgaggagctcctccagcactccttcctagccctgtacagaaataaggtcaagctcagcacagcagctacgcagtccccatccttctctctccaagccttcactccaggtgctggcagtgtcgtcgcgtcatgccagtgcagcgctaccgctggttgcatgacgggaggtcagaagtgcgcgatgtgcctcaggcgtcaagagatcagttgtatatccaccatgcctgtccccactcctacacaggggtggccatgtctcccaccagcaatggcgcaccagccgactcggtgtccgaggtgcgcgattcgtccttcgttgggttgtacctttgtgagcccatctccctggcagaaggctcgcagcgtccctcctgcccggcactgctgttccgcatgcctgctgtgatcacccaagccatctcacacgaccgagcagggtgcggccccagccttcgaaagcagcctcgggggaagcagctcgccggggcccagtgtgcgcttgggccggctgaagtcctggagtcgcgccagcagcaccgtgagcagcaaggcaggccgttgggaggaaaggggggcatgacaaggtgcatgggcaggggtgtgtgcccggtcatccaggatggagttcacttgagttgcggcttgcatgtttcactcagcccagggcgggtgtttgccccttccggcccacagggcagcgctgctcatcagggtgtggcaggcccccagaacatcgtcgcgggccccacacggcgtgtactttcctggacgatggccaaaccgccgcccgaggagcaggttcaaggcatcccggacgccaagtctagcatggttcaggtgggtcggtggaggggcctcacctctggctcacctgagagcttctgagctcaactcaggatgcgaacatccacccgtctcaccaggggccgtggtttccggatggggatgaggaacaggagtgttcgaccccacgccttgctgccactcttgcaggaggttaggcaagccgtcaaacgaattttcagtaggaaaagtacattgggtcgaggcgcggaggttggcattggccatctgtgatcatgaagagcagcacaagaagagaaaagtgaggaaccgcgcaatccgccatcgctgaggctaccccttcacactgtcattgtctggcgtccctgacccccagcttgggcgacggagccctcaaacctgcagagcattatgtacccgttgacattccctgcgatgaattccttctgtcgttggtgttttacctcgctgactctcccattccccttgctccaaattggttgcatcatcctgcactacctgcaaaaccagatgtagataccgatcatgcccaggagggagggtcaagtgccttcttgcatgttctcacatcagtaggatggcccaaaagggcaaatttagccgatcgctccactatgggcgcgatactcgagctccaggtgggtggcaaggaccttcaccgcctgatcctcggggaccatggctcgaatgctgcgctggatgccgatcaagaagttcagccaccgggaaagagcctggccgggcaggtcgcccctgatgagatcgggccagaggagaaggtcgcaggtggcgagcaggagctcgagggtgtgcatgccatactcgttggggccctgtggaatggcatctccgcttgtggcttgtccgaccagctgccgtggggatgcaaacctgttggcaaggggagcgcgggagcatggcaagtgaacctccagggtggctccctgcaagaccatcccttacaccgtggtagggatccgacccacacaggtggctgcatggcatgacatttcccctggacctccaccattgcccaccagccgcccctgcatccccccacgcatgccctcaccagggttgcaggcagaccacagagcttgcagtggaggttgctgtcacaggcgccgctgcagcatgtccagggacgagggatcccagcagggccccccccacgtgcagccgcagcctctgcccccgcggcgtgaatggcagcagcctcagcatgtccagacacgcctgaggactaggggcatgatggaccagccttccggccaggccgcgcagtgatgctcccgcatgttcagcccactccgcctcgctgaaggcctcgaggaagaggggcagcgcggcgttgattgcgccgcccaatgccggtgccgccgcatccacgaggagggcacaacaggcctgtatccagggaaccaggtccccggctggcacagcgccgcagtcctgccgctgtcccatagagcgttgttgagctacatggccggccaggcgcagcagcagcttcactgtgtagacctgcagctccgagggcgaatcctctccactatcgtcagactggcgggctgtgggaccatctgagcttgcccccatcttgcgatcgaaatggtagcctgtggcctcgagcgtgaccatcagctcttgcaaggacggcagctggaaggctggtggcctggatgctgatggatctggagcatcggacagagggcagcacgtacggtaggctgagtctgcatgaattccattcgatgtgtcgcccgtgagcatggcgcaggcagcgcccctcacggcagcgctgggggcgctgaggacttgcctcatcagagcctctgcatcggcctgactcgtgatcaggctgcgcaggtatcaattggaaagggggggatgaaaaactgagcgtcagggtgggaagggaggggagggttcagcatgacagcagccagagcccagatcaaccagccacagtccaatccttacccctgactaccaggccccactccgcccatcatcgttgcccagctcgcagccgaggccagaagtgcaggcctatcttcccccagcccatccaggtggagctgaaggccgagaagcgacgtggcatgctgcactgcggcggcgtagctcggggggaccgcctccctgccgggcccgggtcccccaaagggggggacggcaaagagtacttgcctgacagtcgccggagcagcctgaccgaggccggctccgcggcgcagggatacttccagttgggggagtgggttggcagtgccctctgaggagggcaccccggcctccaacagggccgaattctcctcctgcttgacgacccagcgacgatgggtagcagctgcttttacggcctcctccatggccgcactcctgcgcatgagcgcctccagcttggccccatgcctggcaaggtggatgggacaaaccttatgccaggcagttcacacagggcacacactattgtgtaatggaatgggtgtgagagtgtgcaggtcatcagtggcttgaaagattctactcactctggcaagggagccctcgcggccatcagcatcgccggttagggaagtgcagatgtttgtagagcggtggtcggacagcacctctgcctacagccaatcaaacgctccatcagccttcggaggatgcgggccctggtgagcgaggcgattgtactgtacatgtgcaaggagatgattcagctcatccccccggactttcttggcacccagttgtcactaagtgcagagtcggggccacggtgggttcaagctggggaaatcacacaggtccgtcggggcatgcggtgcatgctctgaaaagcaaacgcgattcaaaaccctcccgctcagtcaattgtccgtttgctgctgacccagtccgatctgctcaatccagtcccaacgcagtttcctgcaccattacgtcgacgtcgctggcatgaagcgaggcgtcattcccggggcgcagtgctgcccccatcggtccaaggacggcgagcgcgcacccaagcgagaaaaaatgtgggtgcgctgcatccgacatggacatcatgcaatggtgcactcgtgagacttcaaaccgctgatcgatcagaccctttccctcggctcgcagacccaccacggactacggcttgaccagccacctgccccatcccaaggactcgaagaccaccatcgatgaaggcccctcccacagcgcccccagccccaagcgcgtggtgcccatcccggagatgcctctcagcccctttgcgcgcgcccctctccgtcctgctcagactgatgacttcatgagcccaccttccaccaagcagggcgtgagtcaacacaacatgcgcaccccaccctccctcctgcccacacctcccatcaagaccgcaccttgtcccctgggacccactcccagcttcagcagctggatgttggatgcctcaagcgccacctcggccccaaacccctcctctctgagagacgtcatcgcttgcttgccaggccaggcgtgccgcaatcccccacgcccccaggcaagtccttccgccctagatcgcttgctggccgacccggctctggacgatctcgactacggtcaaagagttgcagcctgggataagggcgagcaggccgtggtgccgtcaagaacggggcgagggcacaagcctacaagccctcgatctcacacagcagtgtccatgcgccttgctttctaggaagtttggcccaagtctttgccagcttgtagtataacccacgcatgatgttgggttttggatggtagcttattccttcgagctccattgctcttgtgcctgctctttccatgtagtttacccagcgcgctgtatctctttcgccctccaagctctgtcgcagtgtgcgatggagctcttctgcaatccctgtccccatgctgcagcattcctgtatcatggtacagacccttggccgtttaagcacgccttttcaggacgaatcgcacgacaagggtcacggccaggacgctcccagccaaagctcccagcttgatgagccgccggcgtaaagggcggtcggggggaagctccatcagcgcctcgatgtcgatagccgattcccagttctcgctaggaaggggggggtggagccggcatgttgttgaaacagatcaagcagttcaaaaattacccagaaaccatgttggcagaggcttgcacccacaaaacacatgaacgcgggcttgcagagttttcacgtccgtccctcatcaaatgctgaccataagaatccgagatttgcgtcgaggctgccctcctaactcccacaccggcaccagcctctcacaaaatacccaggccagcatgccccctcacgctgcacctcaccggatgccttgcaaatgtcctgctcctaccaccgccaccacagatgacgcatgtgccgcgagctttcgcatcatgtacaccatgtagaggttgcgctcggtcaggagcggcccaatcattcctgggtactccttcccaaactccaggattgcctctgtcaggacgtcggcctcctgcagggtatgtggtagtggcatgccagctgaatggcacgtgccatacatccgagcagaccacggcctgtcgcggccgagggccagagccccgtcagggcactgaacgctgccgcccccactcctggcgccgcccccactcctggcgccttcccttgcacctctccttttcaccttcatggactctatctctttggtgagagcctcggcatccagcatgctgaatccagtccacgtcaggttcttgaccagcgacagcttctcccagatggaaaggcccccccacacgcgcgcaagggtcacagaaacaagtcgatcgcctagcaccacctggtgagatgtgtgaggggattggggagaggatgcagtccaaaaagttaggcctgggcacagttttatgggcgtgtgagttcgaactctggcctccggctggatgtctaccttggccccaacttgctgtgctgatcgcagcgccaccctaaactcctccccaggcttgatctcaaggttggttgccactttagccagcaaccaggagtacagggcctggaagggcgtgctctttcctgaccgtatcgcagcaacggctgccccgaaatttggttcctgtgggtttgggaggatagtactcgcatctccaccaagtgtcctcgctgccttgcatggcagcggtggtgtacctagagatgatcatccacccaggctctgaactgcatgtcttaaagctccccctagccctacctcaaacttgtccaaggagaggatggagatgcgctcgttgcaaagctccaaaagcacgaaatctgggcgcacccttgcaatcaggtctgctgcatcgcggcaggattgcatgctcacgtgagctgttcccagtacataaaatttggtctccacgttgcttgcgttctggggatctctgtatttcaggatctctaatggacgcggcagttcctcggccttgatgatgtcccggccattctcaggctcgcttgccattgagactgctgtgtgcgacagtcgtaggcctccacctcctagcttgaaattgtggttgctgcgggccgaaaggatgatattattgtcgttgtaccaatgattaaaaagcgacacccaaggatcctcgacgcgttgtgccaaggtccctttgcgacaaacccctccctcctccgggagagatccgatgctggcatagctcctggcagggcagggcgcgcggatccgaaatattgccccgacgagtaaagctgtcgtacctgctgaatattcggggaggttgccaatatgttgatgactgttttattgctttgagagcatgctgctctacgacgcctgaactggaagagggcttcccggcccctctgtgctttcctggacatggcagatgacgatgatgaatatgtaccgcttctggaggaggaagattcggagaatgagacgtctgggagagaagccatggacgttgaagactatgcaacagcagtgcagcgggacgaagaagattatctcagagggctcacaacaggtgtgcaatgttgctgcatgagggagtgagtctactggtactgaagcccaggggcacgctgacattcccactcttccaaattcataggagaagatgatgatgatgaagcggtgtcgacgttgtttgaggatgccctcggccctgaggcactacttgctgggctggaagaggctgctggacaggctggccggcaggcgtatgaactcttgtcacgagctgggcgacggaatgctgcgacccggaggctccgacaggcatgctgagcaaggggtggcttcaagtatgggagttttgccaatgtcatgtttatccagtgtccatcgggtctggtcttgcatagcattgattaccaatgtaattaagcatccccagcaccctgacattctgtcgatgattgcccatatttaggatccagagcctgcctcgtcctcatctgcggacgaggaagtggatggatccggtccttccgggagtcgtgcaaaagccacggctctatttggggctggtgtcgaggacatatggtgggtgagggtggtgcggccctggcctcagccatgtgtcagatacaagcttgtcctagtacggagaaccacgatactgtccaatgcggaacaccgaatacaatgcgagaatcctcggcgctcctgccacagggccgctgaccagtatccagcaggacaaaaaaaggaaacgcgcgtgaggaagaaaggtcggggacagggcaggtgagaatacaggaggtcttgaggttccacagcagagcgtttctcatcccgttgaaagaagatgcaccgctgcacatctgacggtagccattgtctctttggcgcttgtgcagatcgcgcaggcggcggaacaagatctcagaggaggttgcggctttgatggcggaagcaaacatgctatatgtcaacaatgagtgagtcccaggtccatccatttgtttttttgttggcagccttgatttgccaggattcagcagtagaggtgggagtggcatcagacgctgcgctctccttcacggcacagagcataatattgcaacgcaccccccatacttgttcaccaggcgcccagttgaggccatcgccaagctgatggaggtcatacgccaggagccaaacctgccagatccctaccatctgcttggaatgctgcacgagtctgtcggcaatcacaagaagggtctcgacttttacatgatcgcagcgcaccttacccccaaggtctgtggattgcgggctggcatgtatgcagacatgctgagacaacacgatccgcaaaggtttcaacgcaggggccacacgaccacattgcatcatcctctcgacaggatcttgagctttggcgccgtttggccacgctgtcaagtgatcaaggactcttgcggcaggctgtgtactgcttgtcccaggtgaggacgtctggaggacctgggaggtgtatgcgcacaggacgagccggtgcatgtaggccattgtgctcaaagcagccatggtgtaagacacgcctgatctgagggtcgccccgcgatgcaagtcaatttcttatccgtacaggttcttcggagagacagggggaatctgagcgcccgattcgacagggctctgctatttgcagaccttggagaagtccgaagggtaggcgaaggtgctgctaacacaagccaacctgcagcacaacccttacggcctgcttgtggacttttgctgcaatccggacgtgatctcccacccattcccatctctgtcctacccttttgcacaggcgctggaggggctaggccaggtgtcgagcatgcagcctgaccacgcggaggttcccaaagccctggcacgtctctactacaagactggcaagcatgaccttgccgtgcaggtgatggcgaggtgccagttgtgctgctcgagcctgattctgagcacatatgtctgttctctttgattgaggttgccttgagggatggcgagggccaagcccttgtttgtagacaaggtcctgccgcagagtgcgaggagtggccttccactttgatctttggacagctggctaacttcccccaccttccaagctgtgatctttgcatccctcatccccctggcaggctttgaatagcttcatcacaagtcatcccgccgctgtggatgctacgcacatcaacatcttggccgaactgttcactgaggttgggcgatgggccgaggctgtgagcctgctctctcgagtccagacagagctctttggagggcagcctctccccgccgaccttcaggtagctttccttgtgctttttatctgtcccttggaggcggagtctcagagcagtaactcgtagcaaattgcatgtgcagggagggattgaggtagtgcaaggtgtatggcgggcggagatggatgcgcggcaatgtccactgaggacggggtgcactgccatttgagcagatgttcccactgtgatgtgcctggcacaggtgaagcggggcctggcgctgctcgcacagcgtgacctccctgccgcgctttccaacctcgaaagcctgcttgccgagccagtggagggcttcgcggacctgtacctggaggtaggcgagcgtctggccgcggcgggccaccccccgctggcgctgcgcttcctggccccgctgatggaggtgggtggcggctccaatccagtggttgccacgctgctggcagactgccacgaggcgctgggcgaccggcgcagcgcgctgggcgtggtccaggcgctcgtggagggcctggacgccggccacccggcgcatgcggcggcgacgctgcgggccgccgcgctgcatcgccagcttggcgacgacgcggcggccaccgccctgctggaaagcgtggagcaggtgctggccgtgcagcaggagggtgctggcgctgaggagggggcgggggcggagctgatcctgcgcagggccgccctgctgcactccgctgggcgcagggtgaggcatgcgttgacgggttggggcgggggagccgtgtgggtggcgggctgggactccccaaaacgtgctcaggcccctgtgtcggcatgcttggtgtgagggcagcaggggggcggcaatcatctggtgcctgcttcctcgctgaagggcgctgtcccggtattgcaattgttgtaccggagcctgcacatgtttggcattcactcggctactgaagtgcagcctttgcatccccatggcacatgtcgcccctgcatatcccgccacaggaggcattcctggacctcgccctacccacgctgggcgccacgctgcgggccctggaggcagaggcagagcgcagcgcgcccgacgtggcgctccgtcggcgtctgcgctggctgggcaggcgggggagggaggtgggacgagcacgagggcccgtcacgatgctcgactctgagggcggcatgttcagggggctggatgggcgcctggaccgtaggaaggagcacgtgcgcgagctggatgcgcgtgtggaggagctggtgaccacagccgtgcagagagactcggatggtgtgtgtgtggttgagttgggtggtcacgctgttttggcatggatggttgagccctgcctgtggatccactcgtccctctggagcctgggtgggattggattgcacgcatgtcccccatcgtgaacaagaacgtgtccctcggaggcagacatgaggactgcactgaccctgggtcgtccttctgcaactgcattacccatcctgccggctccacgcgaggctcaccttcacctcccatgccacccaaatgtgcagaggaggaggaggagggtgccgccgcagggtttgtcatgcgggaactcctgcgcgaggaaggcccatttgccctcctggtccaggcggggcaggccctgcatgcggaggggaggtgggaggaggctcgggaactggcgtctgccgcgctggatgtctgtggcaagcgctgggcgcatcgttggaagagggacgcagtcaggctgctggctgcgagaggggcgatcgcagcgcacgatctccccgccgcgctgcacaacctgcggctggcatgcgcacggtggccgctggcgagtcagccctggaactcctttgcactgtgaggctctgcagggcgtgatgctgcgtcaggacatgccttgcagcctgcacagggcttgacatgtgatgctcctgccatgcctgaaccttctggtcctcgctctggttactgcattcctgcagacccccccttcgctgccgcattcccaccctcgcagctgcatggcaaggtcaggaaagtcccgtactgctttgcggttcctgatccctcagcgccatcgcaatcccacctcgctacctttggcgctgctgactgggcactgccacatggcgctgggggcatggagcgaggccctctctgagtacctgcatgcctacaggcgcgtagtggggtgagccggatggctcctggccagccattgatcagcattacacgggctgtgcaagggtcgcgtcaaatgatgatcacacagtctgcacactgcaggatgaagcctagcgaaccgctggtcctgctgtgcatcgctgcgggactcatcaatcaggcgtgtgctcgaggggtgagcgacaaagaggccctggtcctgcaggcgttcgcgttcctggaagagtacgcggccacacgcctgaacactcaggtagcagtgtgtccaatgggaatcgcctaggattatagttcacctatcagtcctgcatgccaatctgagaatgttctgtcttgagagcagcttgtcggggttgcagagattcaagcctccaactatttgctccccctgttgccttcaatcaggagagcctgtacaacttggggcgtgcggcccagcagctgggcatcccacatgtggctgtcacgtactactgccgtgctctggccgagggggtgccacggatgggaagggatgacatgagccgggagattgccttcaacctgatgctcatctacagggcctccggcgctgcaccccttgcagcagacctggcaagaaaatacttgactgtgtaatgcccgggtaccgcgccaactgctctaagtataataacgggagtaaatcacatcgaacgaaagcacagaaacgcggaccagagcgtgtcggcagtggcaacacaaaaggggaaaatccaaaaagatgggggcaaccgagaatcgaactcgggacca

SEQ ID NO: 17737 - DNA, 123 bp, Chlorella protothecoides
aaaaaatagactataaacttttccacttaaatttatataaacgcggcaaccaaagcacatgtactcttcaacgaccaattgttgcagaaactgattgggtagaaaaatcaactgttttggcag

SEQ ID NO: 17738 - DNA, 117 bp, Chlorella protothecoides
aataatattcacattttttaataatgtgaaaacatagaattatattacttacgacataaataatataagttatgttgtatcaagtaaaataaatccaatttattgtcgtaccaagta

SEQ ID NO: 17739 - DNA, 92 bp, Chlorella protothecoides
catgatagtactttcacacttacaggttttttaattccaacaataattgatacactacaagcaaaagactatcattatgaagatgtttggcc

SEQ ID NO: 17740 - DNA, 9048 bp, Chlorella protothecoides
caccccaccccccacccccaccctggccccactttcccgcagtcgcgcccggcgcatcggcctccgcgcgggttcccctggtccagaacccagcgtcggccacgcccgccctgaccccggcgctgcaggtggccatcaaggtgtcccagctgggcgtgctctacctggccgatgccgtgccgctggccgcgctactgcgcgaggacgggcgcaccagccccgaggcctttgtcggcgcgtggcaggcgctgccggacgccgcggagcaggcgcggacgctgcccctggtcatccacgccgtgcccgccgcgcaggccagcctggaggccgccaggctcttcgtcatggcgcacaagtcggtgcccggcgcggaggtactgtacgtgacgggcgcggcggggctgccctccggccagcgcgcgcagctgctgctggagctgcggttcgtccccgggcagcgcggcgtcgccacggtgttcaaggcccaggagacgagcctggccccggccgcctttgacgccgtggccgcggcgttgagctgaggggcgggtggggtggagggcatgcgccgggagcgcgcggaggtggctctcccgagcccaatcaggatgcaccatgctgacgcgtgactgggcccccgcccctggcacatttcccctgatagccaagtgtcgagcagggtaatggttgggcagatgagctagggaagggggtatgcagattcagtacataaggaccgagcaggagcgtccggtccgtcaggcgtcggcggcaaagtcgtgccgccgcgcatgcccaaactcggtcatgggcttgccgctgccgaccacgcccacacgcgcccccagaccatcggggaccttgaatatgctctccttcttgtgccccgtcatgaatcctggcttcttcttggagcctatgggaaattgcagggcaggggtaggaggtgggggttcccattgccgttgatgcagacacttgaatgcttctcccaaccagttgttcccatggcatctgccgccatcctccctgataaaagatgatcttgcaggccagtcctgacgcagaaacctatcatcctgataccaccataacccatcacagctcccaaccccggtctcacccttcccggacacaaagttcttccatgagttggccttctccttggtttgaacgtccatcctggcaaagcgttgctttgacttgtacgatttttggagcttcttcttcttcgccttgaccttctcgtcgtctggaagatgagattttgaggggcgacaggggtcgaaggaggtgcgggactatgggcatcctcctgctcagactctgtgcgcctgcccccccccacggcttcccaccacccccgctcccagtccagtccatacaggactcaccctctggttttatctggagccaagcgggcatctcctccagcgccacctcctcgttcaccttccgcttcttgggcgccaccacgccggtgtagccgccgttggcctcggcgccgcgcaggcgcacctcctcccgctccacctcctcggcctggtcgtagccctcgtactggacgatgaacttgccggagacgctgaccgccgacaccacgccgttgtaccactgcccatcctcccggtagatggcctggacgggggcaccgatggcccaggcggcgggggcctgccccgcaaacgccgctcggtgccgggccgacctgatctgcgcggccacggtgggggggaggatggagggcaggcgcaggtccggggcggtggtgatggcggccgcggggtggatgaggggggccgcggctgtgggggcctggggctgggccgggggttgtgatgggctgggtcccccctccgcgatgagctccttggtgagctggatgacctgtgaggggatgagggcgaggaggatggatcccacaccaagtccctgatgtagaacacacctacatcgccccgcagagcccctttgtgcatccagtatgaaggtcgtcctgggcacacctcggtcaggctttcgtatatgcccttgtactcgtcgttgtgggggtcatccaggagcaggcctccaacctgcggtttgtgcaaagttcaatcagacccatgtagacggctgcaggttcatcgactcgcctgtctacgctgcgggcgtgccacaccattttccaacctgctcaagttgctcctcatactcgcgaaggtttgcccgcagctcctccgggctggtaccctcctccgccatctttcagccaacgacagttcagcttcttaattgccaggggatcgcagcaggacaaggatgctggctgctcacattacttcgttccggtcttgcctcgcgcccaggcgaaagccggtgtagattccaatggaaaggaaggcgaccacgacgaccaccgcgttactatcgcgtgtgaacatcgaagtgggcaatcaactcgtccatctgattaagtacaacgtggacacacagcgattacgtgctctctctgcacggtgtctcgacccaagcgcgtgggtctgcatctcactgggatcctcggacgccatacggagccccgactcgctctgcaggtatgtggagtcgtgctggtgtcttaaagatcagcattgcatgtgatggggtctagtaagtgctccaaagctgcatttcccgttccggtcccgggggggcgggggggggttctccctcgacaagccgaatgcttccggaggggactctgctgccccaatccactatttaccaagctcgagggacagagctcttaacccatgtaacactctacgaaacaccaggtgtctaggaaagcttcaacatgcagcggtcgacgattgtctccctgctgttcggtctcaacattatagcatggattattctgctgggaggtgggtggtattttagaggcttgaggggtagtcttggggcacctcacgaactttaccatgcgatgcgagtaattgaggcgcttgctgagctcatgcgccaaattatttgcccaccgcaggtatctctgcctggcagtacaactgtaacaaggagaacccagattccatcgtagatatctgcctgacggcgtatgcgcagctcgcatggtaagtttctgcctgtggatggaggacccgtttaccctgcatggctcacaaccagtggccatgggctgttctgtcccggcaagctcctcaccacagccatgcctccaatcgcatagagcctgccgtgcactctgctcatcgtaccccccccctcccccccccttcaacccccgctgccctccctaccctccctcaggtgggcggtgttcttccagctcttcaccctgatcttcctggcggtggcctactacacccgccgcggcagcaacaagctgggcctgatggtgacgctggccatggtcaccaccctcttcttcgtggttacaaacaatgccttcaccgttgtcaagtcgtccagcggggcactgcggagctccacggaggcctttgccgcaggggccatcctgaccatgatagccaatctcctcatcatcttcgtgctgggggatgatatgagcagttcggtggctgcgccgccggagccctacctgaacaacaacccggcctcctcggtacagatgtccggggcgaagcccacttcctccgccatggtctgaggtcgtgtggatggaccacgcgaccagagccccacccacctgtcgctcccagtattgcctttgacgcatgatgcactgccgcccccccgcgccccccacgatgtgaccacgagaccgggtggattcccattcctcaagggtccagatcgcgacaaatctgcgacgcgctggtgcatcacaacagcttcttgcagtgccgttctgtgatatattgagaagaagacgttgctgtggatgtgggaggcagtcaatcggagcgtagcctgcaccagcactggaggcggtccataagtgatcccaagaccttgagtgcgatcgactttcctcgccttgtaatggggccccgcacggcaaaggcttggaggtatacacttcgactgccttcctggtccctggctgagctcccagatggcgactcgtctgtcttttatcaggtcgccgggggtagcacaaatctgggcagggcaggcataccagacccatgcgctaacattgctctatactgaggcctatttaagagacatatatccaccacgaaatgcagatggaggtcaccgtgatccctcccgacgggcccccacgtcgaaggagtgtgggcaggcggttctccaatttcaccactctgcaccagaaggtacatttttacattttcctgcagcctgatgcatttagaactcggagtgacttttcaagctggccttttcagccccaccactaccctggcagcttcaggaggagctggggccggccacgctgactgccttggacccgccacccaagaagacgcttgcctgggtcaatcagcgccccgacctcatagagcagcggcggtgggagctggagcagtggctctggcgtctgacggaggtcccctccatcgccaactcctcggccatgtatgccttctgcgagctggacaccaccgcccgtgccgtcaccaggtggggagggtgcgatggcgatggccccccgccagtgcgcaacacttgacaatgtgcagccctgcagcccagaaaaatatgcgtatggagttccttaaacccccattttccttggctgcaggacgccggtggctgggctggcgcccagatcccactccctggcctccccatctttgtcagggagtgcagggctaggtgaggtatctggactgcgtgaaggcagcggcaacatggctggcgctgagcttgacaggcaaggctctgcccaacaaggacagacaagagatggcgacctcgtttccgcaagcggcagccgcgacctgggggccaggctacagtccacaggaagcgcctcccccccagctctcgccaaagcgcggcaaggaaccgggccccgctcggaaggcagtgcccacgcgcggacacctgtccatgacaggggcgaggcccggcaccggctgcgcatgacgctgcacgtggaagaaagggcgaggctgtctgcgatggtggagacgctgcgacgtgccctcgtcactgctcacgccgatctgcacggtggggagtgggagcttgggaaattttctatgtgtgggtttgggacgggggggatgcgatggtgccaaggcgactgctgtgcgctattaagaagcctcaatgccccattctcgctggtcacttcgcgggttgagggccaggagcacggacacctatgagtcactgcctgcctgcatgagtcacccccccgcagcttgctccgacacagcttccaacctttccacgcctgcatcctcgtgcgccagacgcggcacgctgcatccaaacggaccaggcggcgatcgcaagcctggcagcccaggtggccgaacgtggagacggaggtgccgctgatgatgatgcagacgcggtgcgagccgagctggagaccgagcggcgccagcgccgtgcagcagaagacgccctgagggaggaaagggcgcgcctggccgcgagagcggcggaggatgcggcggcatgcagaacggcgctggaggccgagttgaagatgcagcggaccaccgccgatgccgcagccgaggcctctgcttcggcgctggaagagtgcgagggccggctccgggcgcagacccaggcggcggcggcagccgccgccaaggcgagggccgaccagaagctgctggcgcgggagatcaagtcgctgcgggcccgcgtctctgagctggagggtcggcgggctggaggaggggcggatgtcgcttgggcggccatggcggcgccgccagtaattccgcaggccgccgctcccgacgccagccctgaggcatcggaggcttcagactcggccgtggcggccgcgctgggcgcgctgcgagccgagctagggcgctgctccctggacgattgcgtctgcgcggaggacgtgtgtgccgtggaggcgcggctggcgaccttccgggaacggctggaggcggagcgggcgtcgcttgcggggcgcgcaggccgccggcccctcagctcgcgccagctggcggacgtgtccctatcgctgacgcacgacgccgcggcggcgctgacccggtcggcggcgctgctgcgcggggcgctggggatggccagcgccatgcaggggctggaggagagggtgaccacgcccgccctcagccccaccaagcagcctgggtccggcgaggggtacgcaaacgggcaggcaagcctcatctgagccggtgaatgcacatttctggtgaaccctgatgttgaacttcttggcgggagacttacacagctgggagcgggggagggtggtgagcggaagcagggcagggtggaggggttgcaaaagcagaggaggccaaatcaaacagcactgtcacagcacgcactccgtcagcgcttggcgtacgtgattttcagagcatgctgcggcgtcacatggaacccgttgagcccagaaagcgcgactccagactgcagaggggatgggcttggattgatccgcgtgagtagtccctcgcagcaccctcgggggcaaccagcaaacatgttgcactgtgcccacacccttgcatcttcccaggggttgacatgtgaggataccaagaatcaatactttcgcaccgacagaaccttcatccagagcaagggatctataacccacctgtgcatcgttgctgaagtctatgaaagcaatgcctggccgagcctcgaccatccgaatctccacaaaacctattgtggaccaagggagaggggttagtcgggtggtggtaaacagtaggccgtcttccaacagggcaccttcacagatgcatgtcatgctgcctcagcgactgctcccactgagattgtcaagtggcagaagagtcgagactgcttctttgcctggtcgtaccgagtacggcccccgagtcggccctcccagcctcatcatggaagggcccattccaggcacacaccattgtactggctgaagagcatggagagcatgtcggctgtggtggcctcgggcaggttctccacgaagagggtctggttcggctcaccaacgtccacgctgcgctgcgccggggtcgcagagggggcgtgagaaccccgcccgtttgcgagggcaggcgcggtctcggcgtcctttgctgcctctgcaggcttcttgtccttcttcgccttcttgctgccggcttctagcctggtgatgacctcagacttggacttggcaaaggatagccgctgttgtgagggcagtgagtgttgcataggtcggtgcaggagcccttggccacaaacgccagatgccaacatgaggaagggggcagccatcccaacacaatacattagatggcaggaagggcaggacagctgctttctagcagggccaggatccagtacgggaaggaagcggcaatttcccgaagcaccagccacaagcacgtcagacctcggctcctgccaccctcatccaccaccccaaaggctccaccccacgcaccagaggtttgtcgaagaaaggaaagtcttgcatggctcggagagcatctgtggcagcgccgacgtcggcaaagaccacccaagccttgcccctcaaggccgcccccttcatcaccacaacgtctagcactttcccaaactggccgaagagcgcatacagcagcttcttggcctctacgcagtgtagcagagtgagattttattcacgaattgacatgggcaatgcgcttctcgggaagattttgatcgccaggagcagcttttcctgtgtgctcaccatccttgttcagcttctcgtacaggttgctgatgtacaccgtctggttgggtgggatgtccatgcctggatccccaatgcgacttgaatcagcagcccttgttcttggctgctacagacggccgagaaagcgaatcgagctggccagctgtgcacgatgggcctttgccggggccctgcgagtgacagagggttcagcaggccctaggacatcgatgtgagctcagacgttgtgtggaaggaggtcagtgctgtctctagcgactctggacctcgtgaatgagctatcgcagtggctcgatcactccccagtgccacatcacggaaatcgacctggcagtagaccctggaggcagggcggctcttttaccgcagggtagagctgggcggtagggtgcctgactccctccttttcggcgatagccatctgcgtttcccctctgcacccgtcgtcgtgagcagccatggcgacgcagatcagcaagaagaggaaggcgagcggaggagcgaggggcatgctctgggcggggaccccttacttgccacagagccctcggagggcgtcgagggagccgggcctatactctccttcccccgaattccatgcagtttgtggcggatggcgtcttctacgcggagctgaacgagctgctggtccgcgagctggcagaggatgggtactccggcgtggaggtgcgcgtcacccccctgcgcactgagatcatcatccgtgccacccgcacccagggcgtgcttggtgagtggctgggagggtgtcacggaggggcaggggtggggcgagtgcggaatctcgaaatttttgtccggcgggctgccgcccagctcatgctggggaccagccgacatgggaggttgggagactctcatatttctgaacccgcgcgctcctagaagtggatgttcatcatgttgatggataattgcagtgactggcttttgggccgtccctttgaccccactggggatcttgctccctctcgaatctgccggcacccgtgacatgcccttgacctgcctgtctttaatactctttctcccctgaggctatggcaaactaccttgccccaggctcaaagttgcctctttggccatagctcgtgcggcaggaggtgctcccagctcgttaagttgtcccccccctcacttctcagtccccccccccccccccccccgcc

SEQ ID NO: 17741 - DNA, 242 bp, Chlorella protothecoides
aaaaaaaccacatccagaagcttgtaaaaacaacagatccaagtaaaatgccagttatatataaaaaattattggcaatacttaaccctaaatgattcgaagtaaacccttgtaaaattgttgggtttgctgaaaaagtcacattacttaaaaattgaaaaatagcgccttgctcacaccatgccattaaaaaactatatataaaaaattttttatattttgggtgatgccaagtttttaat

SEQ ID NO: 17742 - DNA, 135 bp, Chlorella protothecoides
aaaactctataatgctattatacaacgtgaaaaattaccagttagaaacactagttttcgtgtaccaaaaggagtagaaggccttatagttgatgttgaaatattacctccaaaacaagatgacattttattttt

SEQ ID NO: 17743 - DNA, 181 bp, Chlorella protothecoides
catcaataggagttccatctggtaaataaggcatatcttgaacaggtaatatttttgaaataacacctttattaccatgacgaccagcaattttatccccaacttgaattcttcgtcgctgtaaaagagataattttacacataaaatagaattttttggcgctaaaaataaaatgtcatc

SEQ ID NO: 17744 - DNA, 841 bp, Chlorella protothecoides
atttatataaataaaaacttgagtatttattaggagagtagaattcctggagtagaggtaaaatttgttgatctcaggaggaatacctaaagcgaaagcagctctctggtaaagcactaacattgaggcacgaaagcgtgggtagcgaagaggattagatacccttgtagtccacgccgtcaactatgatctttttttattttcccttgaaaggggggaagtggagtagctaacgcgttaaaagatccgcctgaggagtacggtcgcaagattaaaactcaaaggaatagacggggacccgcacaagtggtggaacatcgcggtttaatgcgaaacaacgcgcaaaaccttaccagcccttgatataacacttatataataaaatattatagttttagagtttgtgttacaggtgttgcatggctgtcgtcggttcgtgccgtaaggcgttggattaatttctttaacgaacgaaacccctgttatcaattgctaagaatttacaaattattttgtatttcagaactttgatactactgccagtcataaactggaggaaggaagggattacgtcaagtcctcatgacccttatgggctgggctacacgtgtgttacaatggcgaatacaaaaagatgcaatgatgagagtcggagcaaatctataaaattcgtcttagtacagattgttttctgcaattcgaaaacatcaagaaggaatcactagtaatcgtggatcagcacgccacggtgaatcagtactcgggtcttgtactccccgcccgtcacactctggaaatcgagtggattgtaagtctatgtctccctatttttttatgggat

SEQ ID NO: 17745 - DNA, 64 bp, Chlorella protothecoides
cgcacgccgcagcacgcccgtcaggaggagagaaggggtgtcagtgcccacggagtgagccact

SEQ ID NO: 17746 - DNA, 61 bp, Chlorella protothecoides
gctgcagggcaaggcggatgagtacacaggtcccgccatagcagccaagcacctgtccctg

SEQ ID NO: 17747 - DNA, 61 bp, Chlorella protothecoides
tagataatgaaccaaataaagctaagttaatagctaattgagcatgccaagaagttgttaa

SEQ ID NO: 17748 - DNA, 162 bp, Chlorella protothecoides
agtatgcggctggatatcccgccctgacatcacaggacacgcgatgtcttcatcggcactgtagctcaatggatagagcatccgcctacggagcggaaggtcgtaggttcgacccctatctgtgtcaaacattttttatgttttggctcgatgtcccttaca

SEQ ID NO: 17749 - DNA, 230 bp, Chlorella protothecoides
gcggagctcacctgaagacagctggatcaaatcgtggccgtttgtgaggacgccgtccaaactgctggtttgcatgtaagacaaccggtacaacggtacaggcaccaatgggctgatactctgggagtcctaatctcttgtggaaggagacctgcacatggggatccagaagatcctcgcctgtcgcaaccagaagcattccagcaacaccttgatctccagattacctt

SEQ ID NO: 17750 - DNA, 309 bp, Chlorella protothecoides
cccctcccccccctcatatctgcgtccttgtcgtgaccaagaatatatacccacgaggaaagtgcagactgtcctgcttggctgtacattacactgcaggcctacagagcggtcgcaaatactagtttctcccttccccgagctttccacaacctggcctggagtgaccctggagcatggtctcaccataagattgcaagcctccctggcctccttgacattccggaactcctgaaacagcaggacggacgacgcggtgcagcctatgtacccccaacgaaggtaatctggagatcaaggtgttgctgg

SEQ ID NO: 17751 - DNA, 274 bp, Chlorella protothecoides
agctgcagctaattcagggctccatttacaagcagcgcgaataacatcgccaccttcacgagcaaggtcacgaccttcgttacgagcttgtacacatgcttcaagtgctacacggtttgcagcagcaccaggtgcattaccccaagggtgtcctaaagtaccaccaccaaattgtaaacaagcatcatcaccaaaaatttctacaagagctggcatgtgccatacgtgaataccaccagaagctactggcattacacctggtaatgatacccag

SEQ ID NO: 17752 - DNA, 96 bp, Chlorella protothecoides
tagaaggtgaacgtgaagttactttaggtttcgttgatttaatgcgtgatgattacatcgaaaaagatcgtagtcgtggtgtttactttactcaag

SEQ ID NO: 17753 - DNA, 61 bp, Chlorella protothecoides
atcgtagtcgtggtgtttactttactcaagactgggtatcattaccaggtgtaatgccagt

SEQ ID NO: 17754 - DNA, 208 bp, Chlorella protothecoides
aaaaaattactccacctacacgtgaccaaatgaaacaatctatggaatctttaattcatcactttaagttctatacatcaggatttgttgttccagcaggtgaaacatatactgctgttgaagcgcctaaaggtgaatttggtgtatatcttgtaagtaatggtacttcaagaccttatagatgtaaaattagagcgcccggctttgc

SEQ ID NO: 17755 - DNA, 159 bp, Chlorella protothecoides
ttataaccccaaacgagaacatttttttgttttgattggatctaccgtgtgaaataaattagatttattcagttatttcatactagattatcgatcaacttctccaaatacaatgtcttgtgttccaataattgtaacaacatcggctaacatatgatt

SEQ ID NO: 17756 - DNA, 133 bp, Chlorella protothecoides
ccaagccgttataattttgaaagaaaagaaataacaacttttttgctcttgttttcgactattgtttgcatcgaaacatacttgatatatttttatatatttccacaaatttgtgagttattttcaagttttc

SEQ ID NO: 17757 - DNA, 120 bp, Chlorella protothecoides
cacaaatttgtgagttattttcaagttttcaaatctatatcaactatacagataacaatcaaggtaaaataaatgatatttatctccaaaattcggaaaaaacggatttattgttttatt

SEQ ID NO: 17758 - DNA, 418 bp, Chlorella protothecoides
caactaactgaagctatatgttgagatggtacgacacaactaatatttgggggaaattttatatcacctgcagtcgctatttttggtccctgtatttttaaaaaagcttccatttctttttgaccagataccaaacaatggatattttcgctagtatgggtaaaaacaatttctttaagattttcaataatgtcaaatagagtctcgtgaactcctggaataatatcaaattcgtggcgagttcctaaaaaagttatatctgttaaaactaaacctggaacacctgctattaaattccgtcgaatggcatttgaaaaacttaatgcatggtcttttaaaaaaagacctaaatgaaaccgagcgtacatttgcccagaatctaatgtttttgattctacaaacgaaataaatttttttt

SEQ ID NO: 17759 - DNA, 61 bp, Chlorella protothecoides
catcgacctccgggtgtcctcaatctgcggaatggtaagcggtgagtggaatgccatgcaa

SEQ ID NO: 17760 - DNA, 675 bp, Chlorella protothecoides
gcatcatattcatgcttttactattcacgtaacggttttaattttgttaaaaggtgtactatatgctcgtagttctcgattaatccctgataaatcaaatttagggtttagatttccttgtgacggtccgggtcgtggaggaacatgtcaagtttctgcttgggatcacgtgtttttaggtttattttggatgtataattctttatcaattgctatttttcattttagttggaaaatgcaatcagatgtttggggtactgtaacagcaaacggcgtttctcatattactggtggtaattttgctcaaagtgcgaacactattaatgggtggttacgtgactttttatgggctcagtcatcacaagttattcaatcatacgggtcagcactttctgcttatggacttattttcttaggagcacattttgtttgggcttttagtttaatgtttttatttagtggacgtggttactggcaagaattgatcgaatctattctttgggcacataataaattaaaagtggctccagctattcaacctcgtgctttaagtattacacaaggtcgggctgtgggtgtagctcattatttattaggtggtattgcaaccacatggtcattcttcttagcaagaattttagctgtgggttaataaactttaacaatttagaggtt

SEQ ID NO: 17761 - DNA, 77 bp, Chlorella protothecoides
aaagattgcactaatacatatattttaacaaataaaaaaacgactcatttaacaatttagaggttacaaaaacctct

SEQ ID NO: 17762 - DNA, 126 bp, Chlorella protothecoides
tttatagatgattataaagtttttaatgtacaacgtttcccaagccctataaaacaaactaatttttttattcaaaaagtaagtacaaagcaagaatttgaatatcttatcttagaaattataaca

SEQ ID NO: 17763 - DNA, 227 bp, Chlorella protothecoides
ttatatttagtcgaggtttctattagttgatatacttgaaatatattatgtaataatgctttattattttgaaaataaagttcagctggtttcccatttataaaaagattttcagttgcactaggacttaactttacacaagcggaagctgtttttctcccacctgaatgtattaattcatgtttaattgatgacattattaaaaaattctccttaaattttttgta

SEQ ID NO: 17764 - DNA, 274 bp, Chlorella protothecoides
ataaaattcaattattttattttcttgacactttttagtagtattaaatattataaaatcaatgattaataatgtaagtggggtagagcagtctggtagctcgtaaggctcataaccttaaggtcataggttcaaatcctattcccactccttaaactaaatttttcattaaacaattccaaaccagcccccatcgtctagaggcctaggacatttccctttcacggaggaaacggggattcgaattcccctgggggtagacaactaaaaaaaa

SEQ ID NO: 17765 - DNA, 320 bp, Chlorella protothecoides
ttctctttttctaaacctttttgtggttgttcgttatttttggtttcttcctctttttctttaagtagtggttcttctacttgcaataataattgtttttcttttttagttactatttcttttatttttatcatagtgatttacctccataaataacttattgattttatttttaaaattttaagaaatttacatataatatactattaaaataaaataattgttattaaaaacatactattttcattgtttttagattacaaatcatttaagttcttattaatgataataaaaagaggtgcaatgttttacgttttttt

SEQ ID NO: 17766 - DNA, 37720 bp, Chlorella protothecoides
  modified_base (2993)..(3002): a, c, t, g, unknown or other
  modified_base (3471)..(3480): a, c, t, g, unknown or other
  modified_base (4457)..(4466): a, c, t, g, unknown or other
  modified_base (6049)..(6058): a, c, t, g, unknown or other
  modified_base (7878)..(7887): a, c, t, g, unknown or other
  modified_base (8076)..(8085): a, c, t, g, unknown or other
  modified_base (8425)..(8434): a, c, t, g, unknown or other
  modified_base (8802)..(8811): a, c, t, g, unknown or other
  modified_base (9049)..(9058): a, c, t, g, unknown or other
  modified_base (10707)..(10716): a, c, t, g, unknown or other
  modified_base (12491)..(12500): a, c, t, g, unknown or other
  modified_base (13007)..(13016): a, c, t, g, unknown or other
  modified_base (13659)..(13668): a, c, t, g, unknown or other
  modified_base (15910)..(15919): a, c, t, g, unknown or other
  modified_base (16574)..(16583): a, c, t, g, unknown or other
  modified_base (17147)..(17156): a, c, t, g, unknown or other
  modified_base (18161)..(18170): a, c, t, g, unknown or other
  modified_base (18999)..(19008): a, c, t, g, unknown or other
  modified_base (19509)..(19518): a, c, t, g, unknown or other
  modified_base (21467)..(21476): a, c, t, g, unknown or other
  modified_base (22121)..(22130): a, c, t, g, unknown or other
  modified_base (22258)..(22267): a, c, t, g, unknown or other
  modified_base (22512)..(22521): a, c, t, g, unknown or other
  modified_base (22840)..(22849): a, c, t, g, unknown or other
  modified_base (23728)..(23737): a, c, t, g, unknown or other
  modified_base (24915)..(24924): a, c, t, g, unknown or other
  modified_base (26580)..(26589): a, c, t, g, unknown or other
  modified_base (27541)..(27550): a, c, t, g, unknown or other
  modified_base (29430)..(29439): a, c, t, g, unknown or other
  modified_base (29947)..(29956): a, c, t, g, unknown or other
  modified_base (32332)..(32341): a, c, t, g, unknown or other
  modified_base (33663)..(33759): a, c, t, g, unknown or other
  modified_base (33846)..(33855): a, c, t, g, unknown or other
  modified_base (35279)..(35288): a, c, t, g, unknown or other
  modified_base (35347)..(35356): a, c, t, g, unknown or other
  modified_base (36846)..(36855): a, c, t, g, unknown or other
  modified_base (37051)..(37060): a, c, t, g, unknown or other
  modified_base (37306)..(37315): a, c, t, g, unknown or other
gtaggtttgcatgcaggagttaccattcacaatgcaatgtgcaactctctagtcttctagtggccgctgtgataatttagtttagatgtctgaccttcgaatgtattttattccaagagctcaattcaatcgcagagatctgtgcaaaatgggggactgagcagcattactggtttcaccaatgcgtaaaattaaaaacccttgaaacgcaaagccaaagtgagtatttgaaatagaggtgatcaatatagggaaagcgccttggcggcctcagagtccgccatatacatccatctctccaaactaccgtctgattgccgataggattgagatttggtgatggtgggtcacagacctgagtgagttgataagagtgcagcctcttgatcaagaccaggccatctaatccggggagccgcgctctcagccaacggcttgacttggctcaagccggaaattgcccattgcgggggggagcctgcccgacactttgtagagagtcctgttgctgtcatttgccgaaggaggtacattcacgcatcgccttgcgcacctggttaaatccatcagcactctgtatcccgacagatacatacaaatctaaattttatagctttcctttcattaggtgtgtaaagagctgggaagccttgcatttcctctgtttgtgacccgtaggtatgaacaggctgcttatcgctttgtatttgtcagtattggttctgagtctttgctgtagatgtgggtacaaaataatcatacaatggtgtatcttgagcgcctgcctgagtatgtccacggctgtgcgcggattacttgtaagcattgggattgggagcacataaatatagacctaaaatacttactcgccacagcctattagagcgtgatcaaaccagatatccgaatacacgatgtgtgtacgatttgtatacagggttccgaatccttggtacatggcactatccgaagctataacagtgcaaggtttgtgtcccactggcacaggtcagactttgagattcactttactagcaaatatgggttaatcgtaaggcttgaggtgttctgggttctcattggccatacatcccagttccattctacttttgattacttactgtggagtccagtgcatgtagagggcgatgaagacctcggactgtacccggtctacatctttctctcaaaacaccgggtgtgcgtaatgccatggccatttcgacgattggagcagcatgtacaacaggtcaggatgtgtaaaatctgaactgagatgttggtgagtagccccagttcaaggcacgaccttgtgtttatcctccaggttactcatgccccagattatcgctcttaggcagagaagaagaggccgggcgcatggtttaggacaagatgactcgtagtgataaagcgatcattgcaccgagtcaggcagaatagttctcgatgcaggtataagcccaaggcaaaatcaattgtgaccaggtgaccgccgctgcgtctgccactaaatcacgctgtctccgggcagcatgctttagcttttctggagcattcctctcagtgaatgccacccttcaagctgacaagtgggtctcctgggaatgtacacatgacaatggcgctgtggtgaagtaacgaggtgtaggccgaatggtgagggcaatctctcgttggtccttcaagctatagcgactgccctatatgctcaagctcttcgttccgacggcgccttcatatctgaatctcggacaagaaggctcccgacttgatgtgaccatcacaaatcattgtgcatccaacaagtgtcacataactcagaattgagtgaacctctgtggtgctgttaaccaacccttctgctgtgtgataagatgattgccgatctcccttcaacccaggcacagatgatccagaaaaggaaccagtgtcaccgacgaacgtcactctctgtttggtatttgccaacccttgagtgttggattgccatggaccagcatgcatcttggtcgtatgaaatttacagtatacggatgctcagtgtgacaatcattctacgccaatgatgagcattgtcaaattcaagtattcctcatttataaaatgtacagaaagtctttgtcgctcgcaggcgcgattccagtataggctctctccatatcctgccggtaagtgtgttcaccaggctttcggtaacagattagagccttgcagctgaatagagaatgatacatttctgatgagttgttgctgagagtgagatgacggcccccgttcttgaacactctaaacaatctcgactacgagcctcagccagaaggtgtgtcattcctcgtatctattttcgtatttgagcgcttggaggttgtggttctatccgagcatctcccttgtgtatttacttcgtcttccaagaaagcttctcacgcaataaaggagctgggaaaaaacgatgagaccattttgctgctcggagacagattctttagccgaaagaaaagagtggttgcgatggacaccgtccttctgtactgtcttgtatggtcaaattgacatcccggcatccgatgataaatattcaaattgcaagccattggtcgaaggaagaaccactcgacatgttatccctggcgccattgtgggtgaggtatctcttttagatggggcaacctcagcatcgagaccttgtacatatgtggaggctcatggcattccttctaagcattccttcgagctctcgttcgcactcccaaccaccaagctgcactcatttcgaagctcgtgcagataggtgcgccccagggttcaaaggaaagctgtggagtggctctcttgacaatctcctgacaggccccttgttgagatgttgtggtcatcactacaggcaggatcctgatgaagaaagtctgctctgcaattacttgctatgcaccttgggaatagcatgcaagcatgctttccgctgtttcagtaatgttatcaacaaagtnnnnnnnnnngctcccaatcaccaagttgcactcatgtcgaagctcgtgcagctaggtgcgccccagggttcaaaggaaagctgtggagtggctctcttgacaatctcctgacaggccccttgttgagatgttgtggtcatcactacaggcaggatcctgatgaagaaaatctgctctgcagttacttgctatgcaccttggtaatagcatgcaagcatgcttcccgctgtttcagtaatgttatcaacaaagtccgaataacagtatggccccttgatggtcacttgtccaacatttgctcccgcgccttgcgcgcgcgcagatgaaaacctcttcaggtgtcggaatcgatagcagatctctcgttacctgtgccaccttttattgacacacaaacgacagaccgcattccggggggtcctacgattagatttattgctggattgaaccacctggttgcgagctggacctccgtttnnnnnnnnnnatacacaaacgacagaccgcattccgggtggtcctacgattagatttattgctggattgtaccacctggttgcgagctggacctccgtttgactccacgctatccagcgtcgtatctgaacgattagactcgcaacacggacagcgcgatgctgctcccggggtagagccttgttttcagtgtaatgtgataacaagaatcttcgatgaggacggggcagcatatcgcttgcctgtggttgctgttgctcgtgagcaattgcggatgcgcgctggtcaagtatccgcagggttccgaggtcagacagcgatacgggaaggcgccgatgttccgcacatcagcaggaaatcgctcaatatcaactctttcttctgcaatctttgccagggccttcacaatcagaacctggtcgaggtgtcgtacagtccagccggcagtggagtctacctcggctcaccctctctgctcgtgctccacgaaagtggccgcatactgtgcagccatgataccttcccggacggcgagactacgtatgtcctcgaatccaaggatggaggggccacatggcaaaatctgagctccgtggctgcgcagtattggagcaacctcttcatggtccaaggtcggtgcgggaagatggggatgtcttccctcctctgatgcatgtggctttgttttcaggtggttcacgcatgtctactactcctcgcgcagataccatctacttgatgggcaccactcacagcacgtttggagcaggcatagccctctctgagtcgagcgatggtggctcctcctggcggcacgctgtcctctttgagcctcccagtggttgctcatactccacaggttgtgcagtggggttcaggcagtgaaaagcgcgactcatctcaatgttgtgcctgtcagaatgttcacctccgtgtatttgaaaatcactcctgatattgtctcctcgcaggagctgtgcctgtccnnnnnnnnnnaactcatctcaatgttgtgcctgtcaaaatgtttacctccgtgtatttgaaaatcactcctgacattgtctcctcgcaggagctgtgcctgtcctggaccatggtgggctcctgtatcgaggctttgagatgtggtgtgggagctggctggtgtggccccaggcctatcaggcctttgtggtgtatgccaacaggtcgtccaccctcttggatcctgcgtcgtggacacggactgaggctgtcgctttcacaaggtgactcgttcgtctgtgagcatgagccaaacccttgcggatgcatactctgtgccaataaagtctaccgacgcttgcctatggttccttcccaaacagggatatgattccggcatggatgccctcccctgtcgtcagtggaggattcctggaggggaatacggttcttcgacccgatggacgtgtcagcctcctgatgcgctgccgtgtgtacaacgggcagagcgagatgtattctgtccaggaggcttgcctctttgacctgacggcatctacgagcgacatggacattcgtgaggctcggttgtccctcagatggcagggacacgtgttcatgccaggtggtgggaacaagttcacagtcaggtgaggtgtaagtggttgggaggggactactcaggtcctaatgctcactctaccgcgatcccaaattttcaacattgatggaatgtgcctcagtgtcgacaaccactccctgcaggtatgatgtgcattcacgaatgtacttgagtctcaccaaccccagcatcgataggtatggcgtcaacccagacgcaaggaacgtccttgtgctggtcttctcccaaaatttagtggattggaggattgccaccacggtgctcgtgcccaatgatggcctggactgggaggccagcctctggttcactgggtaccaatatgtcgattggcaaacagacggtccagacatcgtgatggcagtccgcactgcctaccagggtgcgcacaatttccacgactccaacaggcgcgtggcatggggtcggagaacaatgggttcctgtgccgcacacttggggacaggagaccccccaccactaaatcccctgcccacctccatcgcgacagaatcgcattcaagcgcctccagaactacatgcgctacctccctgtagcccaaacagaagtattctgaaatgcgtcgtagaggggagtgatgaagtctttcatgtaagttctctgctaggcaacttggtttgaacccctcgtggtctccagaggtatgtagaatttcctcgcaatcttggatgtaagcatcagctcgaaaaggtaccaccaactcccaccagtcaaatgtgagaagtgtgacgtgagggagagcttgcaccagatgtgtgttatggaggggatgcccatcggtgcaacggccacatcaccatggtaccccccgtttgcccgattttgtgcacgacctatttcgagtgtccgcaggaagaacgctgcggactccgcaagtggtgtcgagtactatcgacaaaaaccatctgaagggccaactgtccgcaattcctcctggagcgggcattgagnnnnnnnnnnctttgccggattttgcgcacgaactatttcgagtgtccgcagggagaacgctgcggactccgcaagcggtgtcgagtactatcgataaaaaccatctgaagggccaactatccgcaattcctcctggagcgggcattgaggctggaggtggggagggtcgtaacacccccgagcagcgatggcgtcgacgagagccttcagggcccggcctgtcgacataagccgggccctgccgattgtacgggatctcaccctccttgactccaccgagggcctcccagcgagagaagtggtgcacaatcatgccgcactggatgccgacaacgaaaaggtgggaccaggcctgtaggtgctcaggtgtcagaatgatgtgtgagagcaccacactccatactccgtctcttgaaccacacctagcacccccttacaccttgcagcccaaaatgataagccaggcagatggcaagggtggcaaggagattcccattcccggtgtgaagaccatcccttcctacgagagggattacctgcccacatggaaggaccagaacacttacatccgagaccgaggttggtttctgatgacaatgggagtggcgttgggatatgggatacactatgcccatggcaagcgaggagcggtcgcacatccaacactgtggggcgtttgtccttgcagggacggcggaacaagagtttgagctcgtggagtatgacctggactcggaagacgagcgctggctgcaggacctgaacaacggtcaggtgatcaatatggtgggtgcttcgggggtgctgcacctgtccaacacaactctgcctcctctgtttccagcttcatgctcgtcatctccaggaacgattgcccaaggcgagactcgagatgatgctttggaagctagagatacacaatgcagctgctacagatagggccctggcctttgcgggtaatagtttggggaatgaatggtttaggatgtcctgattggaagtcattgtaggtttgagtgtaccacaccactcctagagcgtacccccacccccgcttgctaggtgccactgcggctgagagaatgagcgtggcggcttgctccaccaccgaccacatgccacgcgaggaggcgctgcagatgctggaggaatcctgcacgggtgaggaatgtttggtgctggcatctaagatggcaggcaggtctcatgtcggcccagaccctacactcacatgtctccgccaccttgtgaatcagggcgcgatgtgcttcgggccacggtgtacgactactggctggagaagcgacgaaggctgggcaggcccatgctccgccgcctgcaggcactgacacctcccaatgacaacaacccctacaatgtgttcaggtgtgaggcctgctctggccttgcctgtgaacccgagtggtgtagagggttgctctggatcactggcgactcgcctagcctgcatggtctcctgctcctacgcacccctccccaccctcacttgcagaccgagggaaagggtgcaccgtccccagacgcggcgcagaagggagaacaacgaggactccctggacaagttgcggatggtccgtgagaatgtactaaaggcccttgacctgtttgagatgctggtcaagagggaacggaagaagcgagatctcctggtgcgctgaatgcggagcgaggggcgatgtggaggctgggagcgccttgctgcctgcagtatgggaaacgtgccggtactcggcagctgtgagtctcatcagccccatgccaccctctcaccccctcgcgcacagtttgttgcgacggacctgcagcannnnnnnnnnccggcagcagtgtgtctcatgagccccatgccaccctctcaccccctcacgcacagtttgttgcgacggacctgcagcagatccagctgaagctgcggcacgagccccgaggccgctcagagcaggtactgttgtatgggcatacaatgccctggttatcctcctgcagagtactcccgcacgcttcannnnnnnnnncacgggcatacgatgccttgtttttcctcctgcagagtactcccgcacgcttcaccgcgccgcctcagtactttttctcacctccttgctgcagatcgaggagcagtatcttgctgcatccaagtccaagtctgtgaagagacctcttggctttgagctgccagaggctgctcctgtcaccaacaacaagcttctggagaagctgaagaagacaaagcggaggtgggaagagggtttttttagtgagagtgcgacactcccagacttgatgccctgggagcagggaggagacctcgtgggtgcaagctaaccctcaccaccttccttgatgtctacctcnnnnnnnnnnttgggagcggggaggagacctcatgggtgcaagctgaccctcaccaccttccttgatgtctacctccggcaggaggaaaccaggagaggatgcccagctcaatgcagtcgcccagctcccatcgccaccgccctctccgcccccagccgcactcttcctcacagacttgaatgttgcagagctctctgccaagttgggaggcaccgcattcagcatcccaagcagcgacgctgcaaggtaagtgatctcggttgtccaaccctttatgatcttgtgttttgcggcacagaccagccacccacaccaatctgcacatcccttgctgggcagagcgtgcacccctcgcatcggacgtggcggtaggctgnnnnnnnnnngagccacccacactaatctgcacatcccttgttgggcagagcatgtacccctcgcatcggacgtggcggtaggctgattatggaccgctgtcagcccttcctcgcggagtgggaagcgcctgcggaggatgaggtagggggcgagagacatgcaagagctggaattgaagggattccccccttcttgactccagcacagaagtcgaataatgacccaccgtgccgacgctacaggagnnnnnnnnnngttgaagggattccccccttcttgactcgagcacagaagacgagtaatgacccaccgtgccgacgctacaggagtccaagcagctgcccctgtatgagcagccgaatccgtacactgagtggctggagaagaggaacctcgcacaggcggccctgcagaagttacaggcgggcgaaaagctgcgaatccctcagagccttgcagatggcatcgacggggtcaacggtcacgcggagacggccaaagttaaggaggagcctgacggtgccgtgcccgatgagaacggttccctgggtgcagggggcgccgctcgacgagcagggagtcgtccttcacggagtggcagcagacagaatcttgccagtcaatgaatggcttgcatcgactatttgctcgtcccctttactgatgtgtccgccttggtgagtagttggagcatactgctttagaatgaaaggtgcttctcagccgggggaacacagactttcagggcttgcagacgggttgtttgtggaggtctttcaatcatgttggtgttgttcacttcgtcaccgctatgcaccttgaaaattgtaggccagactgtcttttccaaccacagcaatcgctcaaagcggttcctgatggccaaactttttgaagaagggaggaaacttcctcatgcatagggaaaataattctgaacaaggggtgccaacattgcatttgtgcgcgtcgaagagtgcaccctgatgcaggatccaaggtctcgaggtgtgtgacgtactactaggggttgctgcaaaacaacaaggcaccatttccagcagccaggatgcttcaccgacactcgtagcttccttgcttgccgcgggcatctaggcatactccagcccatggaagcatgtaggtaccatgtgcagcagctcctcaggctccgccacctccagaccctcagcgggagggtcctgcataggcgcccccccggcctcatggcaggccagctcctcgggggtcacaaatcgccccttaatcctgggtctgacctcggcgtacacgcgtcgcgtttcgtacctgatggtcttggcaaagctgcgcctagcccgctttgcgcggtaccgagccagtttgtcggcacgggtctcagtcccgttgccatagtcccggtgcaagaccactccctgagctgctgcgagggtggcggcccgggtccgtatggtcatggtccgaggtggctgacgatcagctgtctcgcatcctgacgatgattgtgtgagagggggagagcggatgtcggtggagcaacgtccacttgcacacacttgagacatccaaaaggagccgcttcaccacgagactgcatccagctcacccgaatgttcgatgtggggactggtcctcttcttgacaatgtcttccgtgctccgctcccccttgccatatgtatttgttgggtggcgcccatcacttccctcgcagattggaacaggctgcattgaggagcagggcagcagtcaagacataaactttggaggccttgaccagaccaagcatgctgacaatggacaccaccgcacatagcaaatttcagcctctcgctcacatggagatcctggcctttcgacttctgtagcgaattcttctcaggctcggcaattggcaaagggtannnnnnnnnntgctcacatggatatcctggcctttcgacttctgtagcgagtccttctcaggctcggcaattggcaaagggtatacagatgcatcgtcgcctgttgtgatgattcggtgggcggggtgcaggcccaggggactgacaggctccatcggtggcccgacctccatccgtcgtggaaccacacctgttcatgaaatgggatgagcggttcaaacaacattgccagtgctgctgcaagatcagatgcaaaacctttgcaagtcactatcctgccgagtagcaccatgtcagactcaccatcattctcctgcacaaggaggctgctcataggctggccaggaaaggccctgcctgcactcatgtgctgccccgtcccatcaatagaagaatacccgacatcaacatcatagggatttgggaagatggactcctgcagacgattcagaggagactggctggacgctgctagctgggaatttgctcaaagtacgtggcactgctcattgctgctgatgttccgaccgcatccctctaagtcccccaaccacccacgcatgcacaaacaggaggatacctcaccatcaatgcactgctgagggagctggaagtctgagcaacaacaacgtcttgacctccaggctgtgcatcccactgccggaatgcgtcgcgatggggcatgtaaacctggaagcaagccaccagggaaagaattgtgaggttgtgtgagcgtttagaagcattaaattgcacatgtggtcttccagaagctatgcacccatcaggcaaaaacagagcaccttggaaccggtgtggactcaccctcgactgttcatctccgaggaggaaacgctcatgatggtgtgccaggacattgaaagaattgtgcacggcagtgtcacaaatactgcacaggaaggcatcatcattcctgcagtacaccgtggccgtgcggacgccacacagcttgcatgatagctctgaggccatctacgatatggaattcccaagtctcgtggggtgcggcgcgtgagcgtctcccgtttcctgaacgagcgatgctgtcgatgcccgtcgtaccggtgcctgccttgtctgggaggaatgacgcaaggcgacatgtcaccacaggaggcgagtgaagtacacaagtatgcattagatctctcatctgcgcgactcaccgtgctttcgaccgactaccagctgatggactgtgccctcgccccaggcgtgcccgctcttcgccagaggtcgcaagtatccccggcaggctccccactcggtcccggccagcgtctaatgttgatcccggcacgtaggacagcttttaccagcttaccgaggttgcgcgtgcttcttcaagtatgtactaggggacatggaatcgacaaggaatccgtgctttcccgccatcaacacagtacgacagacagggagggcggatgtgagagttcccagcaccttgagatgagttaaaaaacgcaggactgatacactggggtgtcagattcaggtggcgctcaagtacatttctcacatcacgtcaccctacaggcctgtttccgacccgcggcccttgctgcatcacgggtgcccggcggcacctgcgcagcgatcaagccgtcctcatcgaagacgtactcgccatgccagggactgttggcgaagttggcgtcgtactggcccgtgctccggaactctctgaggtcggccgcagacccggtcgaggcaggtgcatcaggcgcgccggcaggctccctgccacgggcctctgccagnnnnnnnnnnatactggcccgtgctccggaactctctgagatcggccgcagacccggtcgaggctggggcatcaggggcgctggcaggctccctgccacgggcctctgccagcgtggcagcggcaccgtccccaccgtgcacagtcagcgtggcctgactctgcaagctctggatggaggacacccgagagtccagggcgctgtgaatggaggacgcgcgcgaggcggctgcaccggcctgcacgattccatggaacagctccgtgactccttgccctgcgcggcgaagggcgcttcggccaagccttagactcttgccaggcttggacaatcacatgccaaaagcacggcagcaaataggattgaaaggaacacggcctataagagaatacagcagccacacccctcacaacgtctctccatcctccctttccgctccatgcagctcagaaacatacaggagcctcaaagaccagcgacaccgcacaccacacctgttttcgcagacacaacatannnnnnnnnntcagcagccacacccctcacaaagtctctgcatcctccctttccgctccatgcagctcaagaacgtactggagcctcaaagaccagagacaccgcccaccacacctgttttcgcagacacaacatagagggatgcccccgtcatcttgcagtaggcatccacctccacaaagtcgagggcagctggagacaccccggccaccaccctggggtcgggtgtctgtccgtcggagtgagggtcgccgcgcgtctcgggcaccacgccgtccacctcatcttcaaagcgcaccgtaggggcctgtgaggtagcttcctggaagccactgcgcatgcgctcgctgtccccccccgcgtgggtggagactcgaggcacattgccttgagcgtccgcaccctttccctcgctgggctttgcagcctcgggagaagggcggggcggcgcgaaatctgtgactagatctgccttactgcaagccacaaagatcaggatgcctggctgctcctgtttcgcggcgtgcacctgcaggcatggggtggcacatcggagtgtcatgcaacaggccagttctttgttcggcaagtgtgcagaatccactggtaatcatgacccgttacaggtgtacagtcgggcatactgatgcatnnnnnnnnnntggagtgccatgcaacaggccagttctttgttctgcaagtgtgcagagtccactggtaatcatgacccgtcacaggtgtacagtcgggcatactgatgcattgtctaccacgtcatcccaaccaactcacccagagtttgagcttctcccagctgggcctgctggtcaagtcgcacactgcgactgcaacgtccgcaccctggatgaatcgcttgctgacattctgaaatgcaggcgatccggatgtgtcccaggccccaatcgacactgaatggccgttaggcagctggtatcgccgtgcggcgaaggcagcaccataagtcggtcgcagggtagacctccactccttggccacgtatgtctgcagcagacagctcttccctggacgcacattgtgagcagagcagatatttgcatcatatgatgctcgcttaccagctctaccgaccggaacggagtaccgaatgccacactcacccgaggactgtgctcccagcagcaccaccttcaggtcgaagttcgccatgcctaccgaggttgactcctcgataaaacaatcatctcatcagcgttctagatatcctcctcaatatccataaccctcgggttcgagagcccagtatagttgccattggccggcagagcgggacggatgggagccgagactcctgctgatctcatcatcaggcgcgagctactccagctgcagcgcccgtgacatgcatgcacagatccgtagcgcacccttgcaagagccattgatggtgggttcatgcaaatctctacacacacggtgctgagaggacatcggcggctcgacaggccggcgaagtgatcgccctggttgccctgtacctaggaccgcgcttcgatgtcccttccagaagatcatcgatacaattatgtggtcacagcacagaaaccaagcagcgttcgtcactccgtggttgggtgttttactgcaccgggggctgtgaacctgatcgtctcgtgagtggtggggcgacagcgagctcctgggacatcaaagatggccggctctactgtgcgatgccttaaagagtatcacgcattcccccttgcgcaggaagtgcacgagactggagatcagtgtgatcacagcagatggactgcaggtgcgtctggtgctggaggttgagcactccatggctcgagggatgggcgtgcatgccgcgcgaggaactcaagactgtgcatgtctatgccaagcgcaactatcccgcccctcacaatgcagggcgtcatggatgtccccatctacgggcgcatctcagcgctgcgcctctttgctgtggcgggtgaggagactgagcgcctcttcctcctcacagagaagaatcgctttgccgtcctgaagtgcgaccccgccacaggtgcgctgattgccgcagcgactcacgatcctccgtgagaggctgtcgtgccaggccgtggtcgtgccatgacggctgcatggaggaccgggggcgctggccaggtcggcctgctggctgctgctcgattccatggcactctcaatcctgcctccaaacccgcgtgtgccttcctgcaggcgagctgcagacctgcgccaatggcgacgcctcggaccgcatcggtcgcccggtccagtcgggacagatgtgcatcgtcagccccaagcgggacgccattgtcctgcacctgtatgatggtcacctcaaggtagctgataaaggcatcctctgggctgcaaaagggggagactgggatgcctctgccaaggggccctccgggtggcaccagactgtgttgtgctggtccctcccacagcttccactttacccaatgccacccacccccttcccaacttccttctgcctttgcagatcatcccggtgagccccagcggggtcctttccgaggcttacaatgtcaggatcgacgagctgaacctggtcgaccttgtgttcctggacgcagaggactttgagggtctgcccaccatcgcggtgttgtatgacgatggaggaggccaccgccatgccaagacgtactccctctccctccccagcagggtgggtgggaggggcatggggcacgaccttgtgttgtcaagggtgtaactggatgcagaggcccagctttgcaccaaacgaggttgttatggccttgtcagtcaaggtcctgtggccctcgtcagacttttgctccctgtgctggggccagggtccacctttcgtcacgatcgtagatctgccannnnnnnnnngttggtccctgtgctgggcccaggggccacctttcgtcacgatcgtagatctgccacccctcgctgtgcaggcctgacgctcacagggcacatgccgagcgctcttaccctgtccccttccgttcgaacatcttgcaggaactgctgcagttccgctgggcgcaggagaacctggatgccgtggcgaacctgctcatccccatccccggcaccgacggcgtcgtggtggtcggccagagcaccgtctgcttcctggcgcacaacgcggtggtgtcagcctccatttcctccaccatcgtcaaggcgaggctcgcttggggatgatgttttggctgccacttgccgtgcccctcacccacgcacagatggcatgtatgagaatgtcacctcctttccccctccccttgacgtgtcccaggcttatggtgccgtcgaccgagaagggaccaggttcctgctgggcgacttcaggggcgagctgctgctcctggtcctggagcaaaatgggccgtccaagaggtgcgtgctgtcgtggctagggcccttgctgtgccgcgccggtgacgtgttcagccagcatgtggcactcgctggatcgttctgagtggtgtaaggacagggctgccctgctgctgtccactgagcttgttaagtnnnnnnnnnnggaatgggccgtccaagaggtgcgtgccgtcgtggctggggcccttgctgtgccgcgccggtgacgtgttgagccagcatgtggcactcgctgaatcgttctgagtggtgttaggacagggctaccctgctgctgtccactgagcttgttagactgttggtggaagctcccggcccagggtcatggctggggcagcactgcgcctgcacagtgccccctacagccacttcctttcaccgtcgagcatgcgttgaccgtggccctgcccccgctcgcaccggcagcgtcactggactccacattgagcggctcggccgcacctcccagcccagcaccatctcctacctggatgccggcgtcgtgtacatcggcagcgcatgcggcgactcccagctcatccggtgggtggcgacgtgtgtgtggcatgatggactgcacactttgtggtgtggaggggagcgaggccttgcgtgaagcgcggccgtcgagacggtgggcccaggggcgggcggaggtctgtccgtcttcccctctcacctatttcccctgcagctgcctgaagcnnnnnnnnnntggccgtcgagacgggggccccaggggcgggcggaggtctgttagtcttcccctatcacctatttcccctgcagctgcctgaagcctgctccccaaagtcccacaagtccctaaattccccgagcctgcccccccttcccaaaccaggttgcatgcccacccgccagaccccagccagccggacagcttcctggaggttctggacaccaccaccaacctgggtcccatcgttgacttctgcgtggtggaccttgaccgccagggccaggggcaggtggtcacctgttccggcggcgcgggggatgggtcgctgcgcattgtgcgcagtggcatcggggtgctgccccaggccaccgtggagctgccgtccctcaagggcgtctggaacctgcgcaggtgggggtgctggtggcggcgtggggtgtgagagagggtccgggggggcgatggagtgatgggggctgacattacgtgatgggtggggagggtggagggtcgggcatgtgggttgggcctgtgagacgctcctaggaaggatacgattacaagcagcagggtccacaaagggccactgggtggtccagggcaacggctttcccactgcccacctgtcatttcactgctggtggcactccacatggggacttgcagcgacccacacgatgatcatcatgaccctttcccatccccccaggagctttgaggatgagcacgatgcgttcctggtgctgggatttgtggaaagcacgagcgtgctgggaatgaatgcggctgaggagattgaggaggttggggtgccgggctttgacgaccgggcacaggcgaggcaggagagaaacgggcttctttggtcatgagggagtggcgtggctgaaagcgttggggagctgggcttgagaccggacgctgcgctcaaacgcttgttgccagctcagatgtgccggtgacgggaaagaggagggaggacaatgcagcctttcaccaggcaccgcgggggtgcagcannnnnnnnnnagcggtcaaacgcttgttgcaagctcagatgtgccggtgacaggaatgaggagggaggacaatgcaacctttcaccaggcaccgcgggggtgcagcatgctgtatgctccaaagcaagctggtcccccttcttcacatgccgtagacgctgtggtccagcaacctgctcggcagcctggtggtccaggtgacgcccgctgctgtgaacgtggcagacacccagacgctgcagcgtgtcagtcagtggtccccgcctgagggcagccacatcatcatggccgctgctaatgcaacccaggtgcgggaccagcgggccttggcatgcatggggcgcgggccccatgcagcgctggcactgtgaggtagaatgcctccttgtcgctgcgagggctgtgttgggccctggtgctgagccagacaagcgtgaaagtgacaacatgaatcaacgcccacttcctctcatcccttgaaacccagatggctgtggtgacgggggttggcagagtggtgttgctggagctcaagggctctgccttggaggaggcaggccagctggcactagactctgagattgcctgcatcgacctctctcccctcagtacgttgcatggttgttcacgatgtgcctggcccacctcgacaccctgccgtgcccacatgcctggcgcggtggcatttgtgtgacagcgcagccgtctgcgtgtaccctcctcttgggctgcacagtgctgatcgtgcatgcatatctctgtccacgatgtgcgattcatgttgctccagcccaaattgcccgcttcatcgccgtcccctcttgcccccgcagaagccnnnnnnnnnngcctggttgttcacgatgtgcctggctcacctcgacaccctgccgtgcccacatgcatggcatggtggcatttgtgtggcagcgcagccgtgtgcgtggactctcctcttgggctgcacagtgctgattgtgcatgcatatctctgtccaggatgtgcgtttcatgttgctccagcccagattgcccacttcctcgccgtcccctcttgcccccgcagaagccggggccacggcgtcggactggctggtcctcgggacgtggagcatgcatgtgctcctgtactcgctcccggggctgcagctcgcgacggacgaggccttgggaggggaggtcattccaaggaggtactttgcagccggtgccgcctgcctgtgtctgacttgtggtcatgcagtcttgctggaatggtacgcttgcccatgtcataatgaacctatgggcgccagtgcaagacaaggctctgaccctttgtctccccctccctacagcatcctgctgtnnnnnnnnnntatgaacccatgggcgccagtgcaagacaaggctccgaccctctgtctccccctccctacagcatcctgctgtctcagtttgaggactctgcatatgtgttctgcggcctgggcgacggccacctggtcaactaccggtgcgatggaggtgctagggtgcccgggatgagaagctcagctcctttgacgctgttctcacctgactcgagtcattttggggtcgcaagggactcagaccacgctgttctgaggcaggccatcaaggcacctgctttctgtcgctcgacagccctgcctgcccacatgactcttcccccaggctgcacggcgaccagctcggccagagaaagaagctggcactgggaaccaagcccatgaagctgcgcgctctgaggtaggcatcgcgatgcgtgagaattttaggacattcttggtcttcactttctcactgtcatgctgcttcgagcacaatggcctcaacccatgctttgtgttgcccatgtaggtcacgaggcgtgcactacgttttctgtgcatccgaccgcccgaccatcatctatgccaacaatcagaagctcgtctactccaatctcaacgagagcgaggtgtgggaatgtccactggcgcaaggacttgagcaattcaagggacttggcgtgcaagcgcatcagccacggcattgtgcggctgaccacgtccagagcttgctcctgtaggctgatggccctgttgcacatgagaatcccttctcacctattgcaggtgaacttcatggtgtcattccataccgaagccatcccacactcgcttgctctggccaaggacaacgatctcaccattggcatcatcgatgagatccaggttggttgactgcggaagtggagtgttgccagcaggccagcaagggctcctggcgcatgcatgtggcttgggatgcacgacctgtccgtcccaggagcttgcagtcccacactgcgcccctcccggtccctgcgcagaagctgcacatccagacggtgcccctggaggagcagccccggcgcatcgcgcaccaaccggcgacgcgcacgtatggtgtgatcaccacccaagccaccatgggcatgggtgagtggctgtctttttgaggacgcgggattacagtatgcggtcccatggaggcagttggactgtagaggggggcatggacgaagagcagagcggacctgcagaccatgctttgaggaggaacactttgacacatttgcatgccctcctctcatgagtcgattcccgcccttgcagtcgacgccaagagcgattcgctgcgcctgattgatgaccagacatttgagaccctggaccggtaccagatgcctgagtccgacatggcatgcagcctgctctccacaaccctgggcgagacaggtgcaggcccctactacattgtgggcaccgccacgaccaaccttgcagagcgggaaccgaccgaggtatgtgttggggacggtgtgtgtgcactgcgtggggcaactgagggaatggcccatcgcatgttcgcttgcagctgccctgcaatagcactgcatccccttgctggtgcacacatgcaatgcagggacggatcatggtctttgaagcagtcgaagggaagctgcacctggtgtacacccatgaaacgagaggtgctgtgtacgtcctccaccccttcctccacaacgacgagacgatgctcgtcgcaggaattaacagcagggtgcagatgtacaggtgggtcggtgctgtggctgtgaactgtttctggttatgggtgcgtgctggggttcacgaggccctatttctgtgttgcatatggcaagtcggaatctaatcttgcttctctatatgctctcagtgatgacattgctcagctcccccccaccacctcactcccacatttcagatgggaggtttcggccatgagcaccgcnnnnnnnnnntatctgatcttgcctctctatatgctgtcagtggtgacattgctcagctccccctccccacctcactcccacattccagatgggaggtttcggccatgagcaccgccagcctcatgccccattgcagctatgatggcaatgtgctgatcctgttcctggactccaggaaggatcttgtcatcctcggtgaggattgggatggaacacacaaacgagcagcctgagaagtgcttggcccactctgcaaggatcaaagatccacccctcacatcccccactccatccttctcaatacccaggtgacctgatgaagtcgatgcaggtgctgcagtacagtagcgaggaggggaagctgttgctgcgtgcccgagacttcaggcccatgtggatgacggcagtgaaggccatggatgatgacacgtacattggtgagtcatgtaatgggcgagtcgaggcggctgcttggtcagaatctcttcttcttggtacatccacgtggagacgtggaaatttagaccacagaggaatcttaaaacaggctaccttgtgtgggactgcatcggtgagcttggaaaccgaatgtatatcgttctggagctcaggcgtaatctccacacctctttgtgaaggcggcgagaactcctnnnnnnnnnntacacaaacgagcagcctgagaagtgcttggtccactctgcaaggatcacagatccaccccccacatcccccactccgtccttctcaatacccaggcgacctgatgaagtcgatgcaggtgctgcagnnnnnnnnnncacgattttcctgtgttgcttctgatcacctctctcctgcccttcttcttcacttgtcatgcacaggttattggccagtaccatgttggcgaattcatcaatcgcttccagaaaggatcactggtgatgaaactacccgattcaggtgtgcaaacgcttcaataccatttaattgagggagtgcggactgctcgcgtcacggtccagtcactcccagtcttccgtggcaacatgagccaagctcnnnnnnnnnnccttggtcagaatctcttcatcatggtacatccacgtggaaacgtggaaatttagaccacagaggaatctccaaagaaggccaccttgtgtggcactgcatcggtgagcttgaaaaccgaatgtatgtcgttctggagctcaggcattatctcctcacctctttgtgaaggcggcgagaactcctgcaacatattcgttgtgcacaagggtgacgacgctgcacctgatgaggagcgaacgaggctagaggtgggagtggtgtacgtcgctgcgacgctcctgggtgtgcaagctgctgctggaatccaaccttgtctnnnnnnnnnntgaggtaggagtggtgtacgttgctgcaacgttcctgggtgggcaagctgctgctggaatccaaccttgtctggacccgcaggcaagcggatacctttttcctgtgttgctgctgatcacctctctgctgcccttcttcttcacttgtcacgcgcaggttattggccagtaccacgttggcgaattcatcaatcgcttccagaagggatcactggtgatgaaattacccgattcaggtgtgcaaacgcctcaataccattgattgagggagtgcgcactgctcgcgtcacggtccagtcactctcagtcttccgtggcaacatgagccaagctcaaggtaatctccttgacccgcctttttcaatatccgtatcacctcttccaagtacagaactctcgcaagccccgctcatgctatttgggacaatcaatggagtcattggcctcattgcatcgctctcacaagaccaattccagttcttggagcggcttcaggtgcgatggcattgcgaggttgacaaggtattcctgcaatggtgttgggggccaggatatccagggtgttcttggcaccaccagcccaccaatgctcgcatgcaggccgcaatgctcaaggtcgtgaaaggagtcggagggttggaccatggagcatggcgctcattcgtcaacacgcacacccagcccacacccgcctgtggttttgtcgacggcgatttggtcgagcagttcctggatctaaggtaggagtattgaccaactgtatcaggaattgtaagttggggactgtgatgccaagggcagctcttgccctgaatttccctataccgttttacccatgcagtactcggttgtctttctcgcacagaggacactcttggnnnnnnnnnntgagcagttcctggatctaaggtaggagtaatgactaattttatcaggaattgtaagtgggggactgtgatgcccaagggcagctcttgccctgaattatcctgtaccgttctacccatgcagtactccattgtctttctcgcacagaggacactcttggatcatcatcccctccctctatttgcagtcgcggggatcaggagatcgtatgcagtcatcttggaggatctgcatcgctcgagcaggtccagcaccttgtcgaggacctgtccagattgcactgacttggtgatttccactctgtccagtgccaaacttggtgacgtgctgtaaattcaagataattatcagtcgaatctctgcacaagtgcttcaaggtgcccaagggtgtacttctgtgagtctgaggaggttgcatagacagggtggaaaggcatgccacagctgtaggtcagctctccaagcatcacacctggacaccggtcaccccctcaagcatgctcaaggctcagcctccaatgactgcaggagggcggtcaggttctgttcattctcctgcatgagggctccggtgccagagtagaagcgcagggccagccggatggactggatggggcgccgcaaccctgggtcgctgaggatctcctcggcgtgctggcgcagggagctgtcatccatcaccacaaaaccgagcaggatggaggcgtacatcacaatcaagtccttggcacctacaaggaggggagagaggagaaagtggtgctctggtgagtgccttcaggatgcagagagctgatagcttttgagcctgccacagtttgcttcttttgtcccaatgcagacacatgagtctaatcttgcggagtatttgtgaggggcacatgcatacagacaccaaagttatcagggcatgctcagcttgccttcccaaaaatgggtcaacgcagtaatgcgactgacctggtgcagaggaggtgaactcgggcgcaggcgcgcagctgatctcgacaggagcagctggctcgcttgccgtggacctgtgggcgtgtgtgcatgtgtgtgtcttaagaaccaaacagggcaccctcaaatccgacatgttgtgcctaggtacagtgcatgcgactctacaccctcccacccgtgcagtcgcttcaggagctccagaacacattgannnnnnnnnnctgtgtgcgttaagaacccaacagggcaacctcagatccgacgtgttgtggctaggtacagtgcatgcgactccacaccctcccacccgtggagtcgcttcaggagctccagaacacattgaagcacgccggagtgggcatgtgcagcatgtatgtcctcgctgctcgcgcaggcccggagttgggcacgaaaatcagggccatgctcggcaatatttaccaacagtcccaggcagccgcagagctcgtccagccacgtctcgagatcccaattgcccttggcaagccctggtgagaagtgcattggacatcgtttcgctgtttgaatcttgcagatggcatttgcatgagatactctccctgcctctgaacttcaacccggtctctgccaacaaaccaccagaacggcatgctcaccttcatccaggccaccatcctgaaccacaagggtgatcaggtcgaggactgtgccgactgccccacaaccgagcagttgctcacacccagcctggctgttttgcgacaggttcaccaacacagagatggcacacctcatgcagtcctgaagtgagcccgagcaagggaaactttgtcatgctctcagacttccaatggaccagcatgggaccaggcatctgtttctctaaaaaagctgccctccaggtgtttattcatccactgagcagaggcagaccagcctgcctcaccttcttcagtcccaggcgcaatccttgggacgccaaagttgccaccatctgcaccagccaggcaagcagggtgcagcggctggtgacctgcatggcgcaggcctcccccgcgttttccgggcaggcaaatgttgcagcctcaaagaggaccaggctccttggttgggagggtttcgggatcagtggtcaggtggggggggaggcgcggctgcatccgggtgcatgcacgcacaggaactctgattttccatccctagctcgttcgaccaccccctcctggacccccacaccccagcacctcacctgtggagtgtccagaggcagcgcaccgtgtcttcgctgggcgaggtgtccgtcagcgcccccacgcagagcagcatggtctgcgcaacgatgccaaacccgccctggcacctgagcccctccttccacgccagcgctgcagcagcatcattctggtcctccacacgttctgaggtgattaggtgggccgcaagggacgtggaataggtaattcaaatgcactttgtgtgtcctatgccgtcacacagttcaaggacagagccctgcgtgagctttgtcggcccccagcgccgctgcccaccgtcgcacctgtcagggcctgcaggagcagggccggcgcatctcggcgcagggtgctcggtaggcggcttgcggaggagtgtggcgcggaggccaggcgctccagggtcgcgagggcgcctggctcaccgctcggtcccagatcctgtgagtcatgggttgggggtacattgcagggcgtgtgacactctgtggcactgtacaagctgcaaggggtcctgctcgggcggggccacccaggcactaaacaccagaaacggttccaagggccctgcccttggacctgcacattccccctgcccaccacaagtatgggcccaaacaccaagccggcgctcccaccaannnnnnnnnngaggcattaaaacaccagaaacggttccaagggtcctgcccttggacctgcgcatgccccctgcccaccacaagtatgtgcccaaacaccaagccggcgctcccaccaaaaatggcctacaaatagcaaagtcagacacaccgcggactcctgcaggattctcgtgaaaagggcaaaagtcccaggcccaggcgggctcactgcagcgcagtagtgtgcccagaacagcgcagcgcaaatcttcagggtcggggatgcggtgaactgccaggtgcctggagcgtgggggagggtgttggaggacagagtgaacaaggatgccaggcactgaccacaggcccgccggcgatagcaagggcagcatcaggtcacgatttcccaggtgagcctgcacaaaaggaacgccggtgccacaaacctgctgtctcaaggatcaggggcagcagcccatgctgcttcatcactgccagtgttgcgggacgtgcagacagctccagcaaggacagcagggaggcgctctggacgcttgcgtcacggatgcgcagcccgtccaaggagtagagggcgtcgtccagccaacggacttgctcacccagctcttgagcctgagggggaggcaaggggtatggatggggagggtactctccagtgatgagccgcaggatggtagaggaggtcttggtacacagcagcgcaagatcgtgaactcatgacgagctcacctccatgactgtgccagcagctgcagctttggcattgcccagtggcgttgtgagagctgaggggccagtgttgcgctgtccctttcctgcgcccagcaccagcatggcggcctgccgtgcaagggttgagggaagggtgtgtcacagagctttgccgtacacatacttctgagcctctgcatgcattccatttgcgtttgacttgtatgcctgcattctcagcctgtccnnnnnnnnnnccttctgagcgtctgcgtgcattccatttgcattcgacttgtatgcctgcattctcagcctgtccccacttccgaacacctgcttggtacttcgcttcccaggcacagtccgggtcggccgtgggggatgtatagccttgttgggggcatattggagtcctttgggactccgtgaacgaaatacaaccgtttcctgggagattttgcgctgaagaagtcgttcaggagatgcatgacgatcttcttcctgcggtggagaccatgctgttcttccgggtggcagcggccgtgtcaacctggccggagacagagacaccgctcccgccgcatgcgcgcagtctccaaagaaatacgggtcggagctgtcttcgatgcattcagcgctcatcattgtgctcagtgcccgggcttatgtactccggcttatgtcatgcatgtgcacggttgcgacgggagcgtcggggagtgcctcagaacagctccacaccagggtgcatggacgcgttctgctaccaaatcaacaagtccaagctgcatgtatggcatcaacacatgcgtcgacaaggatcgctcggctcctcagcacgacaggcccagctccggtgttttgaaacgccatgatgtgcctgctgtgaaatatcggtgggtttcggcaggcaaatccctctcccattgccccttcaccatgacttcattcactaccttggccaacaaaacgtggttgcgtcagctcaaattaccctgccgtgctcatgctctattgtgccgaactaccccacaccccaaaaggcaactttattacaagccatcaagtacatccctgttctaaagggtatggttgcgttcgggttgtcagcacatgcatattgacccaaatactgaatacatgagtctgtcatgcggggtatcggctgccgcagtgcccacagcagtaggtgtgctgggatgtgccggttttgcagaggggcacaaagcaaaaatgaaacttggatgatgtggcgaagagctgcgctttaccgccacaccgcggacaatgcatggactgtccaagccgcttggtcttggtgtgattgccgcatgtgaagatgatgggcagaaacatggagggcgtggactatccccggtaggctgaagcgacgagatgcctcccttgtcgagtctcaagttgacgttaatgtctgaggtattggtgattgaagtaccgacggtcctcgaatgtacaaggaaagcaccctgagcgtttgctttatgctcatgttgctgacgcgctggttagctatgctacctgccgggaagctgggtcgtcaatacggttgccttcgattcttggaggcttcaatgcgagccggacatttaagcatcatcccgagagcaagaacacgggtattgaggcgatgcagtgccattaatagtacgtatcggggtatcgacgtcggcaatattattatatacaaggaactggaaaggcagctgttaattgtaaggctgcaccaaagctggctcaggcacttctcaatgcttgaatggaaagatgtacataatcatgctttctgactttgggaagctatccagacatgactcgttgccgttgccgtcctcattggaggtgtacacctccctgcaagcaataaagagcagttcagttaagtgggcaattaattgaggttcaggtatgacaagaaccagtgctgtgaagacagggcggtaggggcatgccgtcataaatccatagcatttccgtctgtttcagttctccctgcctcggaccctgacatgctagtgagtgcgcccatcccttacaaaatcattgccaagttgtgccagacctgtgcactatccaagcttccatgtagtatgcatcatgcccttagatggggagnnnnnnnnnnttttacaaaatcattgccaagttgtgccagagctgtgcactatccaagcttccacgtagtatgcatcatgcccttagatggggagcgggcatcgtcctgtgccctggaagccatggctgtaagagaaagtagccgaaaccatcactgtaagggaggcatcaacagggatcatcttctgatcggggatgcgctaattttctcaatatgagtgtacttggtgcatatggcggcgctgttttgtaaaacaagtggtccactgtcaactcagatgcccaatcaacacaggtcacccttgcagaattcaatgccacctctcaccgattgggtaataatcatcttgctgaataggagaccttcaaaactgctgaaaaagaattgctgtgatgggctgggtgcatcgtccttgccacccacccacccctcatgcgaggtctgttgatgcgagggacacttttaggctgatccattgaggagtcgagtacgagttggaggtatctatggcactcannnnnnnnnnagggagaccttcaaaactgctgaaaaagaatttctgtaatgggctgggtgcatcgtccttgcaacccacccctcatgcgaggtctgttgatgggagggacacttttaagctgatccattgaggagtcaagtacgagttggaggtatctatggcactcaaggtatgtgttggtgctcgtgtgacactttccttggcgtggcgagtcgaacgaggtgaccgcgcgctcgcccacttcctcaccatgtcagatcaaatctagcatcgcaggtgccgcacagagccatcgactgcatgcacaagcatttcacaacggtatgcaataaaaagaactcggatccagacggggtgatgcacacatgtgaacccagtgggccctggaacagcatcgcatgacagaggttgcgtccctgactgaggccaatggagaacctcccactcctggaaacctcgatggggagttcctccatgaaaacctctgccgccaccacatacccttcaataaagacaagctcaaggttgccattggcctcggcatagccttcatcaacgaccttggtagggttgggacgtcctctcttggtccaccaatttccatgctgtccagcctgcctcccttctccactcccctcaatgggctggcacaccaaaatcaaccctacactgccagcaggcttgtttgatgggggcgagcgggagacctacgaggcctgcatcgaagccggcaaacctccctcctgcctggcctgcatccaggctgctactcgccaggaggccatccctccgctgctggaggcggcccactgcctggtggagttgctcatcctggtgcgaaaggacctgaacaagctgtatgacctgcacatgcgcgtgagcgcgtgctcggtcctgctgggcgtcaccgtctttgccgtggccaccatcgttgaggagtccaattcctgcggcactgccagctgctttgtgctggagggcacggcactggcctgctacgtgctggccctgaactgtggcatgcgcctggccttcatctacggcatcaggaagatccagaccgcggtggagggcgacatcctgcgctccggctgggagcgggagctgcatactcgcacacgcctggacctgaagccggggctgaggcggtcgctgctcaggttctcccacaacgaggcgcagctgttctggagggagctcaagggctggttccggaaagagtttttggcccctgccaaaccaaagacgtagccaccgggaggtggaggtaccttgcgccaccaggggatgagcgagccgctgtgtgagccagggagaaggtggtgcccgactcatgaatggcccagacccaggcacaccggtactcacagcatgtaggctgcgtagctttctcctgccatcctctgggcactccggatgcatgacacaatgatgcatggctttgtcaggtgccacccggcgcagctcaatccgagcaccctttgaagtatactcgccctctcgtgcaatcacatttccccctttctaccagcctcaaacctccaaataacatggcccgcatgttcagtaagcgtgcgctccccggacaatgagctgatttgggggttgttgcaccacgagtatgtttgatgcgccccgatgacagacatggagtgtagaccctgccgtcaacctcaccagcctgagcctccacagccgccagcctgctcatgtgctcgaggtgcgggctgatacaccagcgcatccgttgaccaagacagcatctgagagccagtaggcatggcaaagcaacaagggcaccaatgtgcatcaggtgatgctgccagtcggctgccccatcctggggcttcctcttccgagaagagcccacccaaccaattttcaactgaatacacctcattcatgctcactatgctggctggacaagataggtggctttgcaggagtctctgatgcatgatagatttctgaacagatatgggagccgcacgatgaacagagcatgcaccttcaccaagggcagggctgcatacaccaataggcagaataatccagacttcaggctcgccgcgtccgtccactcctggggccggctcgaggggctacctgctgattagaacaaagcggcaaactggaatgtttgacgatctggaggaggggtatgagcaagagggatgcagctggtacaggcaggcgagcacacctcttctattgcttgctgcctggtgggaccattccacgcttgctttgcgtaggtgtacgtcgtcttcaaagtgaatattgacctggtgagggttgcgtggatgggctggcggcatgacacgagcctgcctttgtggcattgccaatgcatgcccacaccagacacgcaccagaacactaggnnnnnnnnnnatggatgggctggcggcatgacttgagcctgccctttgtggcgttgcccatgcattcccacaccagacacgcaccagaacactaggaggaggctgagggcttgctgcaggtttgggttctccacggcccccgaaagcttcgtaatgaagtagccacccccagagaagatgcagaggcccatgagggcgacgcccttgccggtattgaggaagctgtgggccgtgggggatgagggtgggcttgtaaggctacactcctggccatgcacacccaagttacacggtgatacgagtgggatggagcattttaaaggtgtacacatatcacctcatgatctgggagtcgtggccgtggtcgggttcccagctgtcctagggccggaagggtcgtgaatgcgtcacgagccgcgtaacgtcgatggataaaacagcaacgaggactatttcgctaaatgggtgattaattcttgtattcgcatgtcgcatggtgtgcatcgggggacttgcacgcgagaaatggacctccatagcagtcacatggggacacagatgggaccctggttgcagggcaaaaagagaagtgcaactcacgctgctcctcgcacgtttgatcggtgccagagcacatgtaccacctcaggcgccattgtcggcagcgtcatgcagcgatcgtccgcagcagctgccggggcgcagggcagggctgcggcggccgagacgaggggcagggccatggctgcggccgtgggcgctcaggcgcccgggccggcgtacccctcctccacacaccacaaaaagtggccgcagtgggccttggtgtactcccccagccgtgcatgcaccacctctgggtcctccaggtcgcaggcggggagcagggcctccggcgggtgcgccgacagccccacccccggcgcggcggccagcgagcgcatgtgctcctgcacacgccgccccagccggtccaggtcggcgcgcttgttgaagttgacgttgtacttgggccggtcccagcccagccggaagtcgggcccaaagtactcgaggtaggggttctccggcagcgcgtcctccacgctctgccccgtcagcaccgccgtctccagcgtccaggcccgcgccaccgtggtcttgatgtacccgcccccgcccagcaccagcatgggcacgccgtaggccttgacgtgggccaccgctgctgcgtgcccctgcagtgacaggttccatggccccagccggtcgcccttcaccgagtcggcacctgtgtgttgggggggagaaggtccttcatcgttcgtacgttggcatgtgtgcgactgtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgcggcgaggcatcctcccctccgatgcgcccacatgaccgccagcttcccccctctccgccccgccccccctccctaacctcatnnnnnnnnnncgcgtgcccctgcagcgacaggttccatggccccagccgatcgcccttcaccgagtcggcacctgtgtgtgtgggggggagaaggtccttcattgttcgtacgttggcatgtgtgcgactgtccgccccgtacatcgcatacgcgcacgcatgcgcgtgttcctggcggcattcatcggccgcagccagcatgtgccccaacccgatgtgcgatgcacgcggcgaggcatccccccctccgaagcgcccacatgaccgccagcttcccccccctccgccccgccccccctccctaacctcatccggccacagccaccgaccccagggacgcaccgcactgcagcacgatggcacccggctggaagctgcgcatgacggcgtccagggtgggcctgaagagtcccaagtactgctcatcgtcgatgccctcgtccagcggcacgttcagcgagtagccccggcccagcagctcccccttgtcctccagcgcgcccgtgccggggaagaagccctcccgcttcaggtggaagctcacggtcatcaccctgcatggggcaagggggggagggggcagctccagaggggtcccccgcagcacctggatggggcatgcaccgcacgacctacgaccccgccagcccctccctcccacaaggagcccccttcgcacacccactggcccccttgccctgcctgtcggtggtgtaaaaggcctcctccacgccgtcgccgtggtggatatcgatgtccacatacagcacgcgggcgtgggccttcagcagctccaggatgcccagcacgcagtcgttcacgtagcagaagcctgacgcctcgcccttcttggcgtggtgcaggccgcccgcccagttgatggcaatgtcggcgtccccgttcaccagtttcctcgcagcgtctgagggggagaggagcgcgaggaggcgtgtgatcctgattcagcaggcgtggcggaccacgctgggccctgcaccagcaccagcgttgcatctgggggtggtagagtcaggtggcatgcccaccagagtgtacagacgcgatgcaattgtggcaagctgtgcctacgcccatgtgaagcccagggtagaagggcagcagcacttgctcgatcattcccatgagatgctgctctcaaaatcgtgtcagacccccgcccagaggccggtgctcgccctcattcacctatggaggccccagcatagagcctgcagaagtcaaagaggccatggaagatggggcaatccagctcgatcccatacttgaggaacgcacgagggtcggagcgcgcctcctcgggggtcgtggtctgcagcattccgacatagtcgttgttgtgaaaggcagtcagctcgtcgtgctgggctcgacgtgggcgctgcagagggggggggggggggggtggggggggnnnnnnnnnncggggggcattcacttgggttaagtctcgacacatctagagccgctctttgccatcccnnnnnnnnnngggcatccacttgggtcaagtcttgacacatctagagccgctctttgccatccctcagaagggtccaaggcactgtaaactcacgtagacatccatatgctcgtgaagaccgtatccaaggatgagatgatgcgtcatggcaatgcgctgaggcttcatggggtggtcagccccatagtagtagcctgtgtaatcgcctgcagaggagtgggggctctcatggtgacacttacgtgttatttagcacaagaatacatcgttgcacaccagcgtcctactccacttccgactcactgtcgtagaagtatgcaattttttccttcccgttcaccatggtggctagttcgccgggcgcgagccccagcgaacgtttacttacgtcattgtcattcagaaagtgcagttatggaggtagaacctacccaaacgcgacaggatggcgcaggaagtcaagcaagctgctctcagagctctcgtccctccaaggcactattctacattgggtaacactcgaggtagaaactgcggaaatcctgtaaacggtagaatgatggaaaaacgcaaggagcgtcacccgggactctcaacaactggccgtcttggccggtaaagagcagattatcatgattttggaggaccactgaacctctacgaacgcccagaggcccctcgactggtcgtaaatgagcggcgccgtttgcctgggctcgcggggtcctggtcacccccagcccgggcacgcgttcgtatactcccctccttcggctgataattaactttaaacctcatttttgaggtagggaggggctagatcggcagacgcgcgtctatggcgtcgcagagacctgacccagaccgaggatatcgccgtcaggtgagggtcgtagcttgacattggagaggccaggcaccaatttagggagctttattttcacttcctctccgaattttgccttctggtgtcctgcctggtgttcggcgtcgatcggtggcctgcttggtctcgaaccgggcttcacccccacacccctaacaaaccaggagcggagcacatctcctcatggcagccgattcaggactggaaaggtagggtgctaggtatttgcattcatcctgtgcttgcttgccattcagcgcctccgacacaggcggtccatgctgcgcacccttgcccacttgcagagattcgctgcctttgggccggagggcgagttcctgcgagagcggcgctctccacctggctctggaaccccagggtacgacaagagggctcgctgggagtcctcccgtgccctttcggaccggcatgccaagttcgatgcctgggagggccccgactcgcgcggctttcgcagtccgcccacctacgacagcagcctgtacgagcgaggtgaggtgcaggtgttgtgttacggagtgactgcgggaggcagggttgccagatgctcaggaccgctggtgccttggatcacgggtattgatcggagcannnnnnnnnnttgcaggaggcagggttgccagttgctcaggactgctgatgccttggatcacgggtattgatcggagcagtgtcctccagactggtgcgagtcagttggtgctgcatgcaggcagggacgcctaggcatgatcggtgcccgcaactgtgagtttgacccatgcatgattgttgcacaggcatcttgctgtggtctnnnnnnnnnntgcctgggcatgatcggtgcccgccactgtgagtttgacccatgcacgattgttgcacaggcatcttgctgtggtcttcagcaagaacgttgtgtgaccccaattccaccccacccattccttcagggccatctttctcgtcagagtggcctcaaggccccccaggcgcaagaccctcaagcgcccccggcctccaccgcggcccgaccagtccgcgcagcgctgatcgcgccccgttggaccccnnnnnnnnnntaattccaccccacccattccttcagggccgtctttctcttcagagtggcctcaaggcccctcaggcgcaagaccctccagcgcccccagcctccaccgcggcccgaccagtccacgcagcgctgatcgcgccccgttggaccccggcggcaccggcgccccgttccgcggcgggtggcaagcccgccgccggacgtcgcgctcccgctcccgtgagcgcccccaggccttcccccgcgacgccgaccgcacactgacccatcctgacccgccccgccaagccagctgggacggccaccgcagcaacgccggcgccgttgcgcgaggagggccggatgctacctggcggggcccggagggtccggaggacacgggcgcgggcagcggggccggggccggcgccgg

SEQ ID NO: 17767 - DNA, 158 bp, Chlorella protothecoides
aacaacagtagggtaaaactaacctgtctcacgacggtctaaacccagctcacgttccctattagtgggtgaacaatccaacacttggtgaattctgcttcacaatgataggaagagccgacatcgaaggatcaaaaagcaacgtcgctatgaacgct

SEQ ID NO: 17768 - DNA, 176 bp, Chlorella protothecoides
agtgctatctaatgcattataaatattagtttgttccagaccaaattttaacaaattgtttgtaccaagtaacgaattaatttcattggttttataaacttggtttattttacttaagctttgaatttgagttgatgagtcaagtttattatataatttttgatcagtctcaaaat

SEQ ID NO: 17769 - DNA, 149 bp, Chlorella protothecoides
ataattcgttaaatagtgaaaatatttttaaatattctctacaaaagaaaggatctaataaaattaaaggtttgactaaaaccaatgaaatgaaaactattggtgtgacgcatgtgacgcaaaatatgtctttatcttttatgccagca

SEQ ID NO: 17770 - DNA, 96 bp, Chlorella protothecoides
aattttgtaactgggcgtaagtcaggtggtagtactggtaagcaactaagtaccatccaggctggttgcatattatataaataaatttttcgaaaa

SEQ ID NO: 17771 - DNA, 201 bp, Chlorella protothecoides
ttcataattgcccttgtatctaaaataagatcttgaccagattctaaattctaccgatttcatagatttcatatttgtttttgatctatttttaccagaaaaaaacgttataatattttcattagcgcgtgaattggtattatctaatatgtaataattgtgtttgactctataacgtatttgggcagatattccaaaaaa

SEQ ID NO: 17772 - DNA, 327 bp, Chlorella protothecoides
aaaaaattctcttgtttttcaaacgttagcgactcgaattgataaagattttgtatcacctatatggctacaaaattgtactattcctcgaaaagaatttttgaaacttataaatcttcacaatttaacaaaagatgtaaaatatatttacaatcttgtagctttgtgtgatttaaaacttatcatatccaaaccttggttaatagggtttatagaagcagaagggagtttttatttgataaataaagataatgataggatagtccatggttttggtattacccaaaaactagaccctatccttttatgtggaattagatctttttt

SEQ ID NO: 17773 - DNA, 121 bp, Chlorella protothecoides
tttttgtttgcgttgttgttgctaaatcttgaacgttgttttcagaacttaaattagacactccatttcgtttagtagatttattacttaaaatctctgttgctaaactttggaatccaaa

SEQ ID NO: 17774 - DNA, 193 bp, Chlorella protothecoides
ctaattgtggcataatgatataaaatttttaaaatagaagggtgaataaataaaatttattacgaataaatgaaatttattttaaaccgccaagttgccttctttatgttttgaataataaaaaagacaaaaaataataatattaatttttaaatctttttatatagtctatattatttttatataaaaataa

SEQ ID NO: 17775 - DNA, 1004 bp, Chlorella protothecoides
caagcatcattgtaatcaagtactagattatttttctaaatattcaactcaaaatccatataaacaagctaaaattaaaagttttaaacgctttttaatttataaagaaaaaggatatcatttagacccccttaaaaaagaaaaattagtacattttataaaagtatttgaaataaaagattaagatagagtccatttgtgctattataaacaaagcaccctgaagtatatattttaattatacctggttttggtatcattagtcacgtaatatctactttttctaaaaaacctattttcggttatttaggaatggtttatgctatgtgtagtattggtattttaggttttattgtttgggctcatcatatgtatgttgtaggtttagatattgacactcgtgcctactttactgcagctacaatgattattgctgtacctactggtattaaaattttcagttgggttgcaacaatgtggggtggtagtattgaattacgtacacctatgttattcgctattggtttcttattcttattcactgttgggggagtaacgggagttgttttagcaaactctggcttagatgtggcgtttcatgacacttattacgtggtagcacatttccattacgtgttgtcgatgggtgcagtatttgctctattttcaggtttttattactggattggtaaaatttctggactacaatatcctgaaactttaggacaaatccatttttggatgatgttcttaggagttaatattacattttttccaatgcatttcttaggattagctggaatgcctcgtcgtattcctgattatcctgatgcttatgctggatggaacgcagtagcgagttacggaagctatttatcaattgctgctgttttattcttcttttatgttgtatataaaacacttacaagtgatgaagtatgcccacgtaacccttgggaaactacacctggtgtatctccaacattagaatggatgttaccttc

SEQ ID NO: 17776 - DNA, 61 bp, Chlorella protothecoides
gcagcgggcagtgtggtagggggccggtgtcatggcggtgagactctgccgtgcactactc

SEQ ID NO: 17777 - DNA, 79 bp, Chlorella protothecoides
aagtgaccccttgcaccatgatttggtgataaaacacaagaccttggcaagcagccgattctttgtctgtacagcaggt

SEQ ID NO: 17778 - DNA, 96 bp, Chlorella protothecoides
taaaaaaactgattttttatcaggattgcatgaaaatgtaattgttggtcaattgattcctgctggggcagttttattttcaaaattaccaaaaaa

SEQ ID NO: 17779 - DNA, 556 bp, Chlorella protothecoides
gctccagaaactctctcataaaattccattagtttttcgcgttcttcaaatccccaaagaaatggagttaatgcacctacatccatagcatggcaagtaacagctaataaatgatttaaaatacgtgtaatttcactaaacaatactcgtatatattgagcacgtaaaggtacagtcattttattttcatcagtattagacgaactaggcccagtgttgaagtttaaaagtttttccactgctaatgaataagcatgttcttgacacatcatagaaacataatctagacgatcaaagtaaggtaatgcttgtaaataatttttatattctattaatttctcagtccctctatgtaataacccaatatgtggatcagaacgttgaactacttccccattcatttccagtacgagtcttaatacaccatgagcagctggatgttgaggtccaaaattaatagtaaaatttttatattttggggctgtaattactttttcaatagccataattttatttttttattataaatagtttccatacttatttatggcttgtt

SEQ ID NO: 17780 - DNA, 875 bp, Chlorella protothecoides
cttcttatttagagggttgcaactttttaactgttgctgtttctacacccgctaatagtatggggcattctttattatttttatggggtcccgaagctcaaggtgattttactcgttggtgccaacttggaggtctttggacatttgttgcactacacggtgctttttctttaattggatttatgcttcgtcaattcgaaatcgcacgttcagttaaaattcgcccatataacgcaattgcattttctgcacctattgcagtttttgttgctgtatttttaatttacccattaggtcaatctagttggttttttgcaccgagttttggtgttgcagctattttccgttttattttattcttccaaggtttccacaactggactttgaatccttttcatatgatgggtgttgctggtgttctaggagctgcgcttctttgtgcaattcatggcgcaacagtagaaaatactctatttgaagatggcgacggtgcaaacacatttcgtgcgtttaatccaactcaagcagaagaaacttattcttttgtaacagcaaatcgcttttggtcacaaatattcggtgtagcgttttctaataaacgttggttacatttctttatgttatttgtaccagtaactggtttatggactagtgcttttggtgtagtaggcttagcattaaatttacgtgcatacgatttcgtttcacaagaaattcgtgctgctgaagacccagaatttgaaactttttatacaaaaaatattcttttgaatgaaggtattcgtgcttggatggctgctcaagatcagcctcatgaaaaattagtattcccagaggaggttttaccacgtggaaacgctctttaatagtagttt

SEQ ID NO: 17781 - DNA, 68 bp, Chlorella protothecoides
agtttgcagccaagttgatgccctgcagggtgttgtgatggactgattggcccctggtcagtcacctt

SEQ ID NO: 17782 - DNA, 344 bp, Chlorella protothecoides
tttttttcgtaataattgattgattgtaggcataaaatattgctctatttttcgtttgttgggtaaaataactaaaatttattatcaaattattttttcatgccttttcttagaatatcaatatctaaatgaaaaggtaagtatattctttgtggcgaatataaaaaaataatactatttgtaattttagaaatttctaaatggatcggtttgttgatttttgctaaatccgtttcaatcttagacgtatttgcatacaaaatggtatcaatttgtttttttctattttttgttgttttagtattaaaattattaatagtttttaaaattaataattttttttt

SEQ ID NO: 17783 - DNA, 230 bp, Chlorella protothecoides
tttttttagtagctagtcttatattactagttgctatgattggagctattgttttaacaatgcaaaaaggtattcgtattaaaagacaacaagtttttttacaaaatacaagagattttgctaaaactatcagaaaagtagcctaaaataacctttagaaaaacgttatttcagtatataaatatagatataaaagtataaacataaaacaaatataattatatttgttt

SEQ ID NO: 17784 - DNA, 15684 bp, Chlorella protothecoides
cccccccccccccccccccccccacccacctggccggagtcctcgtcggtgcggaccttgtacccgctcaggcgcagccaggcctcctcgcccgcccccgcgccgtccctcccatacaccatgggcaggcacagcgggcaggccgcgaccagctgcgcgatgaggagctccgcaaaggcgggctgccctgccgccacggccaccgcgacctcggccagggggaaggcgaagccgggcaggcgtgtgacctgcacctcgcactgcacgcagatcttggcggccagcgccagctgcgcgtaggcagaggccgggccggggccctgctccgccatcagcgcgcccaggcgcagggacaggcgcgacacctgctcgcgcgaggctgacacctgctgcacgccaagggttagagccttgtccacggcccggcgcgccgccttggtccccgggtcggccttgtacggcgccgccagggcctgaagcgggtgtcagaatgggcaggagggcgcgtcaggcgggaggccacttggttagaccatgatgccggtgcgccagcgtgcgcaccttgcgcagtacgtcgaccacggtcctctcccttgcactagggcggcacactgcttcaaggccaacccacacatacactctcaacaggactccaccctttccaaggcacacgtcccaccttggcctcggccagcagcgcctccaggtgccgcttccactccagggcgccaggcgtggcgtgcaccgcagactcggggagggcgggcggggccgcggggcgcagcgcggcggcacttgcgctcgcgccaccctggttgaccgacccacgctgggcgtgctcgccctccttcgctgcagcctgccgctgccgctcctgggcggcgcgcgcctcctcctcccgggcggccgccgccgcggcggccagcctggcagcttcggaggcgcgctgggcagcggcagcggcgtccttctcggcccgtattcgccgctcctcctcggctgcggcctgccgggctcgggcggccgcctccgcggccgcggcgagctgctctgccgccgtctccgcagcggcagcgtgccccacacgcagggaagaaagcaggcgcgcccggctggaggcccgctcgcggcgtcgggccgcctcgccctccgcctcgcgagcggcgtcggccgcggcgtggcgggccagctcctgggcgacagaggcttcctgcacctccaatcgtcccagcgctgcatccagccgtcccagctgggtggctgccctgagctgtggagacagggcagcgcatggccagcgatcacgagctcggctgtcctggcctgacgacatgcatcctgggacaccctgcgtgcataatcaccgcgccaggcccacctgcagccgctctgtaagctccagggccagatgcgcagtgcccaagtccgaacggggtagaaaggggggatgctgccttggtgcacaggtctccacgtacctgctggcgaggaaagggtgccggctttgagcgcatgctcggtgaggactgcaggggagcggggcttgcgtcccagacatgcaagagagctcagaagaacagggttctctgcgaggcgtcatgcaacctccgccacctgcggcgcaccttgtccctatgggctggtcgacctcctccccatccccgccgctcgtctcctcatcagaccaaccgtttggcgcttgcagctgaaaggatggggagtgggcacctccatcactgtccgtgtcgctgaggggggctcgcagacgaagactgggcttggggttgtctccagaggagtgcaggctccttctatcggcaaatctatggatgcccgatgaaggtggggtggaccaggagcgctcgggtgtcgtccgccacctcactccaggactgggtgtgctcatcgacacccacaatggaggtgaagggtcccagctgagctccaagagccccccggttgctattgtaaacttggggacataggttcactccccagctcggggcattgcactgttcggataatctacacagcagagattgggcagacatactatcagcgctccccgcggatagataatcgagcgcctgcaccgagatcggcgcgccctgagctttcgcctgggcgccctcggcaactttgaaatggaggtccaggctaccaatcgtgaagggcataggtgcatgtctcatccagcgattgatctcctttgatgtaccctgatggtgataggacacgagaccttctgattaggagtcgcaatcacgcggatcatcgcggatcctggttctgaaaggctgtcaggcgaaacctgggtgcaatggtgtcccaggaaggcctcgagctcctctcggaaactgtgggcaataagctgcaggtagacatgacgcatgggcaagccctgtatctgcaggcatgccaatggcgtcttcgcaccagccagccgagcatcaacccgcctgtcactccaacccctgccatgcaaaggctgtcacctacaagtggctggcacgagaggctcatattccatacgacacatccaaagccatcctctttgacttcatgaccaagcacgcctcggtgggaaggagattgtggatggggcactcagttgcatgtctcgacagtggccaccatgagtgaaataatgcacctcgcacggtcccctcctcgcacagactgtccatgcgacctttctcctgagtgggtggaggcgctccggagagggtgcaaggcatgtcgtgtctgtcatccccgccgagaggctggagcgtgcaaaagcggaactgcagccgatcaccgcactgcacgtgtatgcagtggcgcctgcctcgcaaaaggtaacattgggctactccgatgctgggcgctgtctgttggtccacttgcgcaccgctgggtgtgccatggtgaacgctgaccacaccttccacctgctcgcaggacattgccgtcctggcaaatctggactactcccagtccgcagcgctgcttgcgagtggagggacatatgcccaggaggcacagtcgctcagttgcattcaaggcgggccccagaggaaggcccctcagaagcctgactctgtcgcccagaggacggtgctgcagccagccagtcggggcggggcggggtcggtggcaacatctgcacccctcccgactgccaaggagcctctgccaaaggtggagccaccggtgcaggcaatgccaaaacctaggggggagaagggcacagactctggcgaggctcctcctgtcagtgtcaagccggccaatcctccacccgtgaaagaggaatctgtgcaggctctgaaaccaccaaaatcacgtccaggtgggttcaagttccatgcaggggatgtttgaacgcaatggccatcaagcatcatatttcaggcggtaaagcacatcccatgcacctacagggaggcaagttttagacgatgatgcatccagcgacgaagaggagcattttgccaagccggctgcgagtcaggtgtgcttactggtgaatccaactgtggcgtggtttttggaggggtcccaacacctgtaagctggcagccatgccatgaaactacaccccttggcatgcgggaactcttacaagtctttcctgatccaaagcagttcagagtctgaatcattgcccaccgctgcagctagctcaagagccagagcctgagaagcctgccaagaagaaaggtgcccgcgctagcaagggtgagtggtgcctgggaatcagggtagccatagagctcactctgaagatgctcttgcctatgcatgagagacactgagctgctctccccacaatgtcgcttttgggatggaccgagctgaaccgccgggcttcaccactgcacaggtgcgcccaagaaggcttccaagacccacccgcaccctccagaagcaagcagtgatggtgtcggcgccgctgaagtggcagctccagagggcggggctgcacaggccaaaccagcctctcagactgtggtaggctgttttgcactggaggtggttgcaggggtttgaatgccctctgccttggccaaacactgctccatcaatccctgaagcaatgctaaaattcagcccaagaccctcacgacaggctccgtcgcaggcaaagggcaccaagcgtgtcatgaagacctactacaacgatgctggggaggaggttacaggtgggccacaggccagcctttccccttttgttatcgggctgtgtggtgcggcggggagactacaggataattcaggcccttgttcgttcggaattcctcccaatcacattgcacagaaatggtcaaagaggaggcagactgcaaccctgtctctccggagctggcacagagaccgccacccgtagggcccccagctggcccggttccctccccacagcgtgcccaggtggcaccagtacccagtgccaagaaggcaaagtccgctgcaggccagcggaacatcatgtcattcttcggctccaagtagggagctatgctatgctcatgccacagcgcctaccagtaatttacaggcctgctcaccctcatgacccttgcccaccatcatgcagtgcatgttgcaagtctgaggtctgcagggtgtatgtagaaggagtcttcaaaccagtcatggacttaagcataggggctggggcaacggtgcgacctccacgctcaaatgctgaggaaaattgtatgcaggggccagcaactggcagccatcagtatactgcccattcatcattgatgggaggatgtcggaggcatctccaagctgccagtcttcttaatcagtgtcatgtgtggctccttgccgagggaagtggtgtcactttgcagcagcgactggagaccttgccctcgccagagccagtggagagctttgcagacaagtgcaccgcttccctggcctcactcgtcccagttgtcttctccaccagacagccaggctcacacaggggctttccccgcaagaagcaagtgatatgctcggatatcaaggagggcctgtgaatattgtgcaggagccggggctgccaagtccgagggattcctaatctgaggtcaggttgtcaataatttcctgtggcatcctgccaggccctcatccatgcccattaaccacggcacctatcttgctgcatccagtggctgcatccctcgaccatcagagtggtgacatctgcgcagaaccggccataatcctgcagagaggtgacgcacagtcctgtgaagatcttcttgtaccaaaagagtttcaatgagctgtgcatcttcatgcactttacagaagagggtacccagcgttgcacctggaacatggaaggaaggaaggcggcgtcttgttgcccatacaggaccaggagaggcacagatatagtcgactccaggggcctgcaaaggtagcagggagtgcgctttcctgttgtttcagactgctcactgtgcctgcacagggtatgctgcaaagatggcggtcaaacctcctcggaaagccaaacacttggcaccatgggaccccatacgttttgagtatctggtcaggccggcgtgactgattgtcgaagctggcaacgtaatagttcagggcagctctgagtgcacctggtctacccaacaatgccttggtgcggtccacatcctgtgatgaacatgaaaggacttcttgctgattggagtccttcagttgaagcttgacgtgcccactctgacccacctgctctgcagggcacagacaaccgttacagggtggcaatcgcaatggacacagaagccttcactcatctatccagatgaatcggctccccacctggtctgtgatggtgccgtccactatcacccccctgggtgcttttcggagcatagagtccacttccttgaagtctgaatgggacatgtagacagccgcaaggcgtggagcttggaacaagatgaagtaccatgacctgggagggttgcagagcgttgcattgtgcaggagattgtgctaaagggctgggagttggacgaaatctgggtcgaatgaacagaaacccagtctctgccccttgcaaacagagaaaatcttcattcaaacaatcttatccacacactgcctgcctcagggactgctggggggtgaagcaggccggatccaggtacgctcgggggtgtggcgaggcaaggacgaccatgcgctgcaccgcctccgggtgggcagccgcaacatgccaagccaccatgccaccccagtcgtgggcgaccagggtgcatcgtgtgtgccccagcgccgccaggcactccagcacgtccctcaccagccgtgacatggtgaatcgccgggggtgctgcgcagcatgagcaaggggtgatcaggatactgacctgctggggagggcacgctgtgcgcctggaaaacatgcagacgatgcagaggcaggggggcgagcgacatgaaggctggcacctcgacatgccagccctgatgcgcacccccatggccaaacctttgggcggtctgagaagccaaagcccctcatgtccatggcagcaacctcgtactcctctgagaacgtctggcatgatggtgcgggagggatggccatatcactttctgggtgggtaaccgatactggaggatatatccactgtcaaggcttccggctatggaacgtagtgccaaagataccccatatgccctacctcgatttgatgccgccagctgtagcatgtctcagggaaaccatgcaggaacagcaggagcggcctccccctcccacatcctcgtgtcgcgacgtgcaacctgtggtttgcgattgtcttcgagcaggctggagactggacacatccaaagcatttccatcacatttcaaatgcacaagctgctcctggcctccattgacagagcaaccaaaaggatgtggatgggatctcacatcacatcatcagatgttgagaagtgtgtgtggtcgcagcctggcatgtcatcctggtcaggtaccggccgacttttgtggaagaagaacttgtggggcctgtacattgcaagcagaaggaatgtgtcgcacaatcctatttgaagccagtcattgtgaccttgagaagacatgttttcaacgctctttcacggcacctcgataaagcctggaaagcgaggctggtggacacgaccagccagacaggacacatcatggcttgggcagccgcccaccgcacatgacccgcaactctcatgaggacgcgtggaagataacccaaaggatgcgagtcacacacacatgtaatgggtggagactactcatctttcccaaatcattcacgatgtgttctcgttcccttcgatcgcgatgtgaccccaaccgtcacacatggccactctcccggtgggcggcgagctgccggccccgtggcggcactgatgacatacatttagagtcgccagctcgtggtagggcaatttagccttgcattcggtacatgaagagatggctgcatttacggctatcagaagccgtaggccatgcacgcttatttattgctcccgaaagggagtttcggcgcgcgcagcccgtctcctgaaaatgttgcaccccctccctgaacgtgccctcaagcccgagcgtactttggatgtaccactttgatctacgattttagtgcgaattcgatcgaccaggcacattgccgttgttccctttgcatcatgtccaaccaggacaagttcgacgtgctactcgagggcctcgaagcccatcagactgacacatcactcctcaaaacaggagattctgtcgagttacagcacagagatggtgcattgcattgctcaagctccgccggcattatcgggagagtacccgaaggcaacagcggccctctcctcgaaggcgactggcggggatctgtgcgaagcttgaaaaggaacgcggagacaaagtccttgacacaagtgctggtcaggttcttgcggggcgcaggagcccatgcacctccgccaggtgtcgcggtttggtgtcctgatcgggggaggactaggtcccttggaatagtgtagtccccgcttcatacagcaagaaatgcagcaatctcaccgtacatgcagctgctccaggacacaaggtggaagaggcagatgatgtagagttcctcagtgcagcgcagtacgagttgttaggtgagagcagatatgatgtgatcgtgtctgtatgctcgcgtgtcgattcctctacatgctgcgcagagggtgagccttcaagttcctcaccaccccgttgtcctccagcaaatcagcctgagatgcagcaactcttgagtaatcccgaactgcaatctgtggtgaggagcgtggacagtgcagcagatcgagagaaggtgggactcttgtgtggggtatgaaagtgctgtgtcagcccccagcagcacatatgccacagccattgaacgcccactcttccaggctctggtcaaggctttggagtcaccaaacttcaaggagttcacagacaaggtgcgtgtttgcaacatgttgcatgtactctcatacggaccttgataacacagtgctcaccaccagacctcccctgcagatactgaacattgtctcccctcccgagactttgtgacaaccaggagtcctggcgtccagcaggctccaggggcaagcgtctggctttggggggctttcatctctgggctcatcaacatgtcctcgacaagaagccacagaggctctggaacgagacacagacgttgtaaattaacagaacatcacaacgtatgttgctgctggcaccatcaatgagggcacacccttgccgcaacaggatctcccagggacaaggtggccgtgagtctccgccccatctgtgacggaaaacgaaacaatgtctgattctcctcatttgttatctaccaggcaggcacagcattgcggctgtatgctgcctcattgtaagcgtcgtacgccgtaggcacctggaggtgggggagccagatggctgaggaagaatggcactttgctcattggcacattacctcatgccacatcctgcaaggcagggtgcttgcttgccctcatccctgcccaaactgctaggtgcccaaggtccaatgcttagcataaagtaccctaccagccttccatccatattcaaagatatccctccaaccctcctccaccagagacatcgcacccaccagaccagacccacctgggtggcagggatgcggtgtgtgggggcggccggcgcgtcgtccagcgtgtacagtgagtccttggagtgtcccaggcccacagaggcgcccgctgagtggttgcggcccaccttggcgcgaatgccaccctgtaggggggagtgggtgcgaaggacaattgatatcgtgcccaatggccaggattatcgagcaccatatccgtttacaggaagcccctaactatcaaagacatgtccactcgaggtccactccatgcccatgcccccttctcccgcacctgctgtccgttctggagtcggggcacgttctcgcgctcgtcccggcgtgcggcgatgacctctggcatgccggccggaggcagagactggagcggcgtgctggccccggaattggcctccaccggcaaggggtagccgcgtgatcccggcacgcgggccttctgctcgcccagcgcggtgttggcgctgcggagcgcctctgactggatgcgcaggactgcacgggcggagcatgggctgcagtgaaaggccagaggatccactgtgcatagcacgacatggcccctgtgtcacagcaactacaccctccccccctcaactccatacctccagacaggtagctcttcaaccaaacgctgtctgtaatgacgttttccagctggtggaacacgagggactcgtgctccttgtaagactggcggcaggctgcaacatggtggaggaagcagtaggttaggtacagggtgaagggtgtaccatgcacagcagccatgcaatcacagcagttcgcaggtgcacacctccttgcacacttgcacccagctgtcttcactcttctcgcacctgacagcttggattccttgtgctgcaggatcttgatggtgttctccatctcatactctcccttggcccgagtttgagggagccgtgctcgttggacatcaacctgtcaagcgagaggcagactctcatcattttgtgtggtctgaggaagtgtgtactgcagatagcagacacacaggctgctgatctcccaaagcaggtaaatcaggagatgtacaaggtcccaagtatataggagctcaaggtccatcatggtctgaggcaatgtactcacaaccagcagcgtcacaacccaccttcttgccgagcttggccacggtgcggcgacgggaatccacctccaggcgcaggctctccaacctcttcattcgctgctggatgagcacaaaggcattcatccatcgctccatgggggctagcacctcggactccacaagcttcccagcagacttgacgacgcgcgacatctcctctgcattgtaatcggcccccccgatggggacgattggtccatttggggcccccaccacaccagacgcggtgctggccgtcatggggatgaccttgccacccccaacctcttcgtagacgcggggtagcggtgcagacatcaccgccttcaccgtgctcagcagatctgaagggggattggagggtgcgttggaagcggttttgacatgtcctcgcttcatcttggaacacgagacgacatgttcgttatgggaaacgtgtttcccggtataaagctaaccttccgttgaggcctgcatcttgcggatatccttctcacaccgacgcaggtgcccagcaaactccatggcctcgttcatcatcatctcattgcgagagtttggagtggcctggaaatccttgtcctccacgatgttccatttttggcgagcctatgggatcgcacgggggctcgagggtgaggtcgggcccaggtctggtggtgttaacacggagccgggcgacagctctaccccgcgccaggagcgatccgccctgcatcacctcacacctgctccgagatccgcctccaggtcgctcccatgccttcgagtgcgatttatgcacctgcaagtgcgtcagacgtcagtcagcagacagcggttgttgaggtcgcctcggctctggcgagctcgatgcggatcattccggcccttacaccacgcgcctcaccttgacaaaggccttgatggttcttgatgcactccgggccgcgctgttgcaacttcaaggctggcctgataccaccagccgggttcacaattcgagttgggggctgatggttctgtgaccccgatcaaccccattgagggagcatgcacagcatttgcacggcacacaaatctggcgcaaatggacagaggaaggagctcatcgccttgtgacagagtatctaacacagcagtcttcttctgatgcatgcgtggtagaaacacgccacgatcatgtccataaggggctgatacaggacaggcagagcggacgggaggtccgcaggcagggtcgatcagagccctgtcactcttttcttcgagaatattactgtaaaatgacaacataagtatgacgagctataccgatgaagttgcgcggatcaaggtgagcgccgaggatgctttggaggtcgtgccaaattgcggaactgtgcagggccttcccataccaagatctctacccccctgccgccacgacagaacggcgtgctggaggcgctcggcactagaaccagcgtagacgatgtggggagggtggcagtgtccctcctcctcgcccagccatctgaggagggtgcatcgctgaagccgctgtcgccgacgcagcacaccctgttcggcaacggtctacaggtcgtcgtatcatcgcttcttgatgccgcgttggaggagggcacgcctgccatggagtacaagctcagcagcgctgcaaaagtgccgtcgctgcgcctcttgctggatgcctcgctgtccctggcgctgcagggtgtcacccatggaggcatccctgcagccctgctggagcaggtgtttgacagcctgacggttgcagagtgcgaggtcccctttgcttacctcgaggagcgactgtcagacttcaagcagccagctgtgcgtgcccgtgctgccctcaccctgcagagggcctgcaaccttctcatccacagactcagcaaggtgggtattgcgagagcgtacggcgtggccctgtaaagtgggacgagacggtttgttaaggcgctctgtcggcgtattttctggcatgcaagcacatgcagcactaactgaaatgggcccccccggctgggagacaaccctgctctgccttgctcgcacctctcacatgttcgtccaccttgcgctccccttggacagagtcaaaactcgctctttgcgggtcggctgctcatctttcttgccaaactccttcccctcatggaacggtctggcgtcaacctccaggtttgaaagggggtccatcagagagcttgttgtgatgggccccttgctcttggccctcaggacagcggagtgcagaaatacatcatccaatggtcacctctccatctcactcaatggaacagggtgctttccatacggagaactctacaccagtggaggacgttgcggaggtggggacgtgcacagtggggcatcagcgtgtcgcgggaatcctggcctcccaaacaagcactgcgttcggaagtgcagttgttcgtcgcctcgaagggccctttgttctgctcctgattacccatagccatgctgacagacaccttcaccctttatgatcagggtgcccttgacagcctcggcaagaccgtggacgcagaattctacggcacgttctggtcgctgcaggctgccttctcgaaccctcctcaggcagggattgagtggagtgagacagcacgtgccgtcaagatcgttctggagcgtctgaagaaggacccggtgaccctaactgaggccgcatcaggtactgtgggtgatttgccttttccgcagccctgggggccttggcctgcgggtttcatgtgcagcagtggacggctgattaatcgatttgcaacccgccatgccagattatcatgcgaaaatccatacttatcagcaaagcgcagagctgaaggaatcgtccattcatatcactcacccagctgatctcccctggacccatcctggtgtgcaggcagcagcatcagtgcaaaatacctgagcggcagtcggttgctgtccctacaactacgggacgcaaccttccggcggcacttcctcgtccagtgtctcatcctgttccaatttcttgaggctccccatgccgccaaacaggcctggccagtcctcaagggccgtcagattgaagagctcaaggtgtgggggtgcccagtgttgttgtggtgatgtcaaggatggggtcccacctctgacacccacgaacatgttgtgtcgctctcttttggtgaggaacattgcatgcaatgactgcatggcatggagcacctggcgtcactctagtgtgagcaaggggctggctcgagcctatcaagactgatcctgagatccgagtgcattccccaccccaacacaggccctccaggagagcgtgtacgagtcactggcttctgtgccagagcgaggccccgagttcgcagccactatccgccagctgctcctggacgagtcctcctgggcggcttggaagcaggtgtgtttggcaggcttcgttgggcgggaaagatcgcagcggggttggcgcagcgcatcgtggcatgccagcgtggcattgcaggccctgacaccattccgccatgctgcctcaggcaagctgtcccaaggaagcgtttgaacggcctgctgccgcgccgcctgcggctgccaagaccacggacccgctggggccccccttcaagcggcgtaagccgagccgggacgctgtgttcggagtgaccttgggcacagaggagctggacaggctgtggaatctgaccgaggacaacttgagcggtgattcacgccctggcttggggatgggcaccagtgtggggcggagccgcgccggcatggggtgcgtgcatgtgtgtggtctctcagcctgcatgcatgttggtggtctctcagcctgcgtgcctccgcccctgtcctcgcaggtctggctgcggaggaccgaggtggcttcaagacggtcagccagctcatggagccggtgctggaggagatgacggaccccgaggcccccagcctggtgtgtgaatgggggaggggagacaggccctgggccggggccacggagcttggctggcatgtgcaccggttgccgatgtgggtggagggaccgtgacagggcccaagacggggacatctgtccgtggtgactcccggccatgacgcccgcctcatccaccccctgcccctgccttcccgcagtccaagagcaccatgtacagctggaggacgctgcgcatggtggcacgcgtcaacctcagggtgcgagctgggaggtgtgggtcgtgcgtgcacggtctggggttgctcggggtggcagggctggctgccccgctgccccctgcagcatgtgcacccgcagcacgatgatcgagctccagcacgcccctcgctcctcaggcgtttgtggcgtccgtccaggccaagggcgacctccaggttgcggcccggatcatgtacccaaaccgatgcccagaaccggcaggggcgggcactgcttccagcggggaggcgcaggagggcggcaagcaggaggacgtggagatggcggaggcttccgccgctcccgtcgccagccccagcgcgggcgggggcctggctgcgagcgacgccggcgatggcgaggagggcaggtcggacgccgacgcggggctgctgggtgctgttgcggagggcgaggccggcccagagacagcgagcgaggacggccagatcggggggggcagaggaccgaggggggacgaggcggactcgcctcgcaccggaccgaatggcgacgagagggcgggcagtgggtctcccgcccccggaagccaggcggctagcggcgaggatccctctggtccggcgggcgacgcggagatggagccttgacctgcacctgcaggagaccttggcgtgtgcctgccgctgtgggtgcatgacatgtccatgacgatgccccagccggcggcctggcgctcagcactgccgggggcgagcattcaagttcgttgggagcacgcacgagactcgggggtcaccgctgcacgacgagaggtgcggcgggcatggcgcgcctgcttctaagcaggatgcgtcgcgaaagagccctgccaagaccatggccgcgataatccctcaccccgccctgctggccgacttgcgggccgaggcgttgagcaggcgcttgcgcaggcggagcttggtgggggtgacctcgatcagctcgtccccggcgacgtacccaatgacgtcctccagggtcatgaggcgtgggggggtgaggtgcaccttctcgtcggcgccggcgctgcgcatgttgctcagcttcttctcgcgcaccgggttgacgcccatgtcgccgtccctggacgatcgcgggggcgaggggggggggatggcggaggggggaaggcaggggaaaggggatgg

SEQ ID NO: 17785 - DNA, 499 bp, Chlorella protothecoides
tctaaacattttttaaaaggagcctttttatgtctcatactgtaaagatttacgatacatgcattggttgtactcaatgtgttcgtgcgtgcccaactgatgttttggagatggtaccttgggatgggtgtaaagctagtcaaatcgcgtcagcaccgcgaactgaagattgcgtaggttgtaaacgttgtgaatctgcatgcccgactgactttttaagtgttcgtgtatatttaggtcctgaaactactcgtagtatgggattagcttattaataataatatttatgttggagttgaaaaaacccaacataaatattattattaataaagagaggctgattggattgatacttaaacttataaaaagtaatttattttttgtgaaaacgaagagtttgatcctggctcaggataaacgctggcggcatgcttaacacatgcaagttgtacgaaggtattttttctctcgggaaaagatatactgagtggcggacggg

SEQ ID NO: 17786 - DNA, 260 bp, Chlorella protothecoides
aaaaaaataaagtgttccgtttttttactctatgtatataaaactcttgtctatatgatcgacaagaactttatatattaatcatacaccttttcttttaagagagaacaaataatacatattatatgtatctccgaataaaataaaccaaatttatttccgttattttaatgcgcaaattgatctactacatggacgataatgttggtggtagggaaaatgataatattatcgagcctttaactaatgagactgttttt

SEQ ID NO: 17787 - DNA, 82 bp, Chlorella protothecoides
gatggtgctaaaagattgtttcttgcccagatcaaattaagtgcttctgtacgtgctaatgtcgacaatggtatatgaactg

SEQ ID NO: 17788 - DNA, 61 bp, Chlorella protothecoides
ataataatatattattatgtttatacaatacgaatagttcatagatttttttgttgttatg

SEQ ID NO: 17789 - DNA, 61 bp, Chlorella protothecoides
cgagcaaggcattgggtacatgtgacggggtatttctttgtactcagaccagtccccgggt

SEQ ID NO: 17790 - DNA, 414 bp, Chlorella protothecoides
tatatatatactatgtatagactactcattttcttatagaaaaaagtaaaaatgttttatattaatggtcaattcgcctgggtagatatacccatcagagactacatgtgatacaactttaataaacaaagtttattgtgagtttatttttagtaaatataataagattttgggtataataaactaaatctctattttttaacataatatcttataatcaattaatttattttaccatggaaaatgataaatttttaaagcaaaatgataaattttttaagcaatggttagtgggccttactgatggtgatggctgcttttatataggccataattcaaaaggttattggaatttcgcatttaaaataagcttgtctatttataatttacaagttttacattatattaaaaaaa

SEQ ID NO: 17791 - DNA, 207 bp, Chlorella protothecoides
ttttttcgctttttgttaaagaatcattatctattacgcttatagcatttttaaagcgagtataagaataaaattttgaagttaagagcgggtaagtttcaaatatcggtataatcgtttctcttaacatttttatatcacgaatacgaaaagtccccatttttttggaagtttctattgttatagaaccaccacctaaattttttt

SEQ ID NO: 17792 - DNA, 178 bp, Chlorella protothecoides
tttttttactgtagaaagaccttcattgctagaattatcttcagaattgtcttctttaaaaaaatgattttgataatactcatttgattgtagactaaaattctcttcaaataaatcctcatactcatcattcaaataatcatcctcaaaatctaattcctcatttaattcatcaacc

SEQ ID NO: 17793 - DNA, 136 bp, Chlorella protothecoides
aaaaaatatagcaccggtataaaaaaagtgagttctgttcgagaatttgctagtatagctgatttagaaaaatttgaaaatagatttaaatttactgaagatgttgaagtagctaatttagataaaactaaatcta

SEQ ID NO: 17794 - DNA, 67 bp, Chlorella protothecoides
tagaagttttaaacccaacagctaactttatatttggtagtacccactcattagaaaacgtttgaaa

SEQ ID NO: 17795 - DNA, 65 bp, Chlorella protothecoides
aaaaactttaaaggattttatagtggctttgtttctgatttttataaaacaaattcaaaatcaaa

SEQ ID NO: 17796 - DNA, 323 bp, Chlorella protothecoides
ctaaaagttttgatggtcatggaaactataatttaggtttagaagaacaacttatgtttcctgaaattgattatgataaaattaatcaaattcgaggtatggatatatcaatagtaactacatccacaacagatgggcaggctatgagtttgttacaagcatttggcatgccttttaaagataaatctaaaaaataaaaatcatctaagttgatcgctaaataattatctttaaaccctttttaaatatttattaaaaaaattcaaaaatatgataactgatacaattagtgatatgttgacccgaattcgaaacgcaaattt

SEQ ID NO: 17797 - DNA, 173 bp, Chlorella protothecoides
agagtatctgcatggtaagtagaaagtcatcggttcaaatccggtaagaggcttaaatattatttaattgatattgaaccataaagttcatagaagcattttagactttgatgaatttaataaacataataatattaatacaattaatacaataataataatatattattatg

SEQ ID NO: 17798 - DNA, 172 bp, Chlorella protothecoides
ttttaaaaaagttcctaaagttaataagtataaacgtgttaaatttttaattccgaaaactcctaaatctgatataattgatgtgtaatacatattttaatttataccaaaagtattattatttttttgagctttttattttctaagtacttgatttttttgttgttatgga

SEQ ID NO: 17799 - DNA, 2336 bp, Chlorella protothecoides
aggaatccgtgccgcgttggcggcggtgacaacggtgtactgcgcgtacgtgccgtctctcgaccagggcgcccaaccatcagccagaccgtacactctgtcgccgacctttaaatctgtcaccgtgccctctgggatggccgcaacagtccccgcaaagtcaccaccagacacctgagtggaagaagaggataaatgggagtgatgtgagggcaaaagattctgaacatctgctagttggcccattgtgtcagggtaggtatcctagctggtctgttggcacctttttaatcacattattccggcagactccaatatgccgagaccccccaagcccgcaacgtatcgccgctgcggggtctccacacatcccaagtcataatcaaggaacgatgtggctatgagggtatgagcacagtgcagccataggcacctgcggcgtcttgatgatgaatttcgggatgtccttgcctccacggacgtaggtgtcaacggggttgacgcccgccgctttcaccgccacgaggatttggcctttgctgggaacaggtacaggccagtctctaacatcttcgagcacggatgggtctccaactctgcggaagacgatggctcgctgcaccttctgatcagtcattctggggtaaatctgagatctccgaaatgtcgatccctggttttgatgtgactccttgaatcctgatgcgaggcagatgtgatataatgggcgatgtcagtgcccgtgcgagcaaaatcgcgggcgggttgcctggagccgtgctcggtaagggttcagtcccagcaaagcaaatcggggtctttagattccccgaaatttccctccagcaaatttacccccaagcccaaatccccgacacctgcatgacccagaatgcatgcaacggtcagatatatgtagtccctatggtttgagcaatgatacctgtatggtatcgtttatgtgcagtctcatgagtgtctacactacactcatcgatctcgtgcctcccagggatgggcgcgtagatatgtttccgatactgtggggcactgagagattcagtcatgatatacagatggtcgtgggaaggaagaatctagtcgtgatgcaatccgtgaatgctgtgcaccaatcctcgtgactgggaccatgccaatcatcacttgagcaccactgattgagccgtggatgtacaggttgggtgggagagcccttgcgggcttgcatatgcaagtgcctcttgtgcactctgtatgtgaccctcccttcagttgtcctcctccaccaggagcacaaccttgcccttggcgtgccccttggtcatgtagtcgtgggctgctgcagcctcgccaagagggagcgtgcggtcgatgacgaccctcaccttcccctccgccaccaagccgacgagctgggtcaggtcctgcccatgcgccttgacaaagaaaggcgtgatggaagggcccaggcggacagccgcggtcagcttcctacaggtgatgccgggaggccaggagggctgggtcaaggggtgcaatcttccgacggcagaggcatgctgcctgaagagacccggtcatgaggtgtgcatgccaggttgcatggtctaccagatcaccatggagcgccttgaggtttctcctcccctcaccaccacacacacacgcacagccgcctctggacccctgcacaagcatcccacgcactgtcgcaggtagctgtaaccctggacgaggcggcctgcccggccgtagtcacgcaggtacccgttgttcatgatgtccaccagagcgccctggcgcttcagcaccctgcgcagctcccactgctctttccctgcaggtggtgggagccgttggtcgaggcgttcaggggcgcgtgggcgacggtgcctgggacctgctcaagagcaggagcggccttttgtggcacagctcacctccacggctgtcgatcacagcatcaaaggggttgttcttgtacagctccaccaggttcttcttgtggtagtcgtacacctcatccgctcccagttcctgtgagaaaggtgatgagaaggagggctgtattgcagtgaggattttcccaacttgcaaacaacctggggacccctggcacacgctccactccccatgcaccttccccccaaccccaccttgaggaagtcggcattggcaggcgaggcggaggtggtgacatgcaggccccgaagcttagcgagctggacggcaaaggtgcccacccctccggcaccggacgagatgaagacgcgcttgccgctcccggcctccagccccgcgacgtccagcgcctgccaggcagtcagccccgcgat

SEQ ID NO: 17800 - DNA, 77 bp, Chlorella protothecoides
aggttcttatatacacttaccaaaagaaaattttgtttttgatcataaaaatttaaattttcaaacgttttctaatg

SEQ ID NO: 17801 - DNA, 427 bp, Chlorella protothecoides
tggatttcaccaagagtaacttcattttgaatgaaagcttgaggaaaaagatacataccttgtacattatttcttataatgaagctctgaaggcgatcatcttcatcggtactaacatcttcaaaatcataccagtaataaaatctatcaagtattacttgatggggttcttttggctcctctgaattaacttttctttttttcttagtaacctgtttttcttcaacaataggttgaatttccgctacctctcgagcagtttctatatactttttagctttaataggatcatactcaatacctaactcttcgtattgtttttttaagtagtccgtaaatgttattggttcattatgtgcaggtgcagaataagccacagaagatgatgtagtggatgattcagaagttggtgcaaatatattattta

SEQ ID NO: 17802 - DNA, 133 bp, Chlorella protothecoides
ggtgactccgcccccatagccttcaagactacacacctctcgcaggaaggagtaccgagccttgtactctgcttgccagacgatgatgcagggtaagatcaaacccagcacagtgtgcagcgtgtagagcgcc

SEQ ID NO: 17803 - DNA, 61 bp, Chlorella protothecoides
ggaccatcttaccattgcccaggggtgcacacctgggcgcttgttgcaggggtccagttcc

SEQ ID NO: 17804 - DNA, 61 bp, Chlorella protothecoides
ggatacccaggtttccacatcgccgcgcacacctccaccggtctgtaaagacggcctggga

SEQ ID NO: 17805 - DNA, 193 bp, Chlorella protothecoides
aaactttgtttattatttttattatccagtataatagaatttgatacacattttccacagaatgatactaggagtgctaatgaatcgtttaatctatgttgtgcacagtcaaagtgaatttgagtcttttcatcaaaaagaaaaaaatttggtttttggattttatcattttcagtagaaaattgagttttgt

SEQ ID NO: 17806 - DNA, 285 bp, Chlorella protothecoides
gtaatagctattacgttaatcaacgttggctaggtggaatgctaacaaattggaaaacgattcaacaatctctacaacaattacaatcttttagaaaagctgaagaatcaggtgaatgggatttattaaagaaaaaagaaattgcaaaaaagaaacgccaaaaattacgtttagaaaaaaatttagctgggctagaaaatatgaaaaaattgcctgatgttgtaataatcatagggcaatctgaagaattaaatgctgttaaagaatgtcgacaattaggtatta

SEQ ID NO: 17807 - DNA, 102 bp, Chlorella protothecoides
aatcatcattagctggaatataccaatctgctaaataagggtcacagttactatcaagaagggtcactgtagtaatacctaattgtcgacattctttaacag

SEQ ID NO: 17808 - DNA, 282 bp, Chlorella protothecoides
ttttttttttgtgtacaggttttttacgagtaaccgcaaattcgccaaatttatgaccaatcatttctggggaaattttacatggaataaaaattctaccattatgaattgatacagttttaccaacaaattgaggtaaaatagtagaacgacgtgaccatattttaatcatattgtcttttattagtcgtatttcagaaaaaggaggttttgataaagatcttgacatatagtggttttatattttatagaaattgttgtcgcgaataaatctcatttttt

SEQ ID NO: 17809 - DNA, 66 bp, Chlorella protothecoides
tgtcggccaactcctcggcggacggtagaacggtgtcagcgctcgcgctggcctgaacagcaggcg

SEQ ID NO: 17810 - DNA, 320 bp, Chlorella protothecoides
atcagactttgggcgctaaggtccaaagtcgaaagggaaacagcccagatcgaacgctaaggttccaaagcgtatatttagtggtaaaggaggttattgagcccagacaaccagcaagtaggcttagaagcagccatcttataatgaaagcgtagtagctcactggtctatatagttatacatttttagtaatgtataggctcaatagcgccgaaaatgtaacggagctcaagtataccaccgaagcggcggctatatatagtagatcaaaactactatttatagggtagcagaacgttctgtaagtaggtttataataa

SEQ ID NO: 17811 - DNA, 235 bp, Chlorella protothecoides
gtaatatagtatacatcaagaaattttaaattcttgtacccattatgttatagcaatcgctagaaacacttaggggccgattaactctacattaaattctagtttgtagaaaacactggattttcggcgatcatgaatcacacatgattttacgttactcatgtcaacattctcacttctgatatataaataaatgcttacgtatttattataaacctacttacagaacgttctg

SEQ ID NO: 17812 - DNA, 61 bp, Chlorella protothecoides
cttgcttgacatgagcggtccaagggagttgcccccgaccctaccccagctcgctcaacgc

SEQ ID NO: 17813 - DNA, 167 bp, Chlorella protothecoides
ctctggcgagtttgtttatcagagtgagcctgagagggcagtcagcgcgggtcctaccatcgccgagcttctggcttgtgacggcagggaggaagctggtgcagtcgtgtcgttcccaggcggtcctgtaccccatacatcacatccggaaagaagaggtgggagga

SEQ ID NO: 17814 - DNA, 16059 bp, Chlorella protothecoides
gggggggggggggggtggttggggatggaagcctgcttccccgcacccatgcatcatgtccacacccatgaccaggcaggggcgcgggggctaccggggtgcatggtagtcaaggctactggcatggatgccccagcctgtataccaaacctccctgaagcccgcaccgagatgatcccggcacggaagccctgctccacccccgtcctttcctccacagtgagccccgcgtggtgaaaggccacccctggagaaaaggttcgtggatggggttaggggtggcgcacagtcatcattgcagataggccagccacctcatctgaacgcgtgtgtctaatgcactgcaaaattcagaacgccatgccccctcgacgcgtccaacaagccagggtgcggatctttcatcacaaaaacgtcccatagcacccaccatgcaggatgcagtcactcagaccaggtgtcggctccccgcccaattccccccgcatgtccgccagcagctcctgccgcgccagcgtcaggcggaggtcctcgggccttctggagcccagccgatcggtcagcagtgcagcacaggcctcgcatgccctcctggagacacagaagaccagcactgactggccctcggcctggggcagggagcagggggagggggtggctggagcggggattgacatggaaactctcaggcagaagatgaggccgggacagccttggagggccggggatcacagacggacttgtgtcacagcactctggccgtgccccaagcagtagattctccgaggggatctcaacaatcctgaaggctgaaaacattaatgtgcaactcctacccagccaaattctctcacttccgcgacgagcgcagcaattccatcgggatcagacctcctgtcaaaacaacggtccagcgtcctcaacctgacaagaggactgtccacatccacattgccatggacctgcacccagaagttgacagagaaagctgagcaatcccctccgatttttcagggtaccaatgcaacggtgaggagtatgaggtgtgccatcttccctcccccatccagatcaccttcatgtagactgtcccctgaaacacgacatgctcggtgaggggcactggtctgaaatttgtcaggaacatacgagcctgtagccactcggacaaggtttgcaagccccccactgtggatcgtagggagggatgtggaacgggtaacgttgtgaggtgtgatgctgtagcggttcctgttaggagtcctcacgctgacgtcggacttgcggcaaagttacacttgctggccttgctgagatatgttggatctccgaggccaccccccaaacccatccaaacgcaaagctgatgccagccgctcccattccccttccctgtccccacacccgcactcgactgggtcggcacatgcatgagcactcactggtggcggacatggcgatgatctggggccgatggcgggaggccagcaccttggagagcgcagcctccagacctgggccgcgattggggtccgccaccatgtgcgcctcatccaccacaatgcaccccacctcccctgagatgggacatggttatgggatgcaagaatgggcgtataagacaggatgtttgcgcaaggaataagcccgggatcccctcccagagagaccctctgaagcatctcatggcccagacaatggcgctggcttgcagctgccgactccgtccgacatacccagcctgcactccagggtcagtcggtcgagcaccacgtgggctttctccatggagcaaatggccaccctttcgcccctgtggtcagcaacggcacggcgatgaggccgacgaggactgcagcgtcaaacttggtgcagaatccccaggatctgggtaggtgggagctgcagctcgagtccgacagcacaaacccgccacgaaccccctctgcaataggcccatatcaaacttcacacacccgacacccaggggcgtgtgctcgtccaggccccccgtgtatcccttgacagaacagccaagggcccccaggatgaaactcagatggtctgccttctcttgcacgatggagaggtagggcaggatgaccaggccccttgctggcatgccgttctggggaaacgaatgaggcgtggggtcaggggctggctggatgtgacacatgggaggtgctctgcctgttcagctccagacaacgatccacagtgcctgcacggcatccagagctgggctcatgttccccagggtgtcacatcgcacgtaaacgtcgagaagatctcaccaaacgcagctggccaagggctttgatgagcagcaggtccgcgaccagggacttcccgcccgaggtgggcgcgctgtacaccaggttgtccccatgccatccctcctccaatgcggcagactgccaagggtacatcatgtgcatgcccttgagtgcaaacgcctggagtttggggcagggcagggagggggtgcatggtgtgatgtacatgagacaccaccagacgtctgtgatttctggagaggatgggcaagacatgcatctactcaccgcgatgatggcagtcggtaatccccattcctggagtcccagtctccgtctcttcggccaagtcatggacgggcatcgagcgtggtcaggagggccacaggcgtgtggatctcttccagcttccaatggagacgatgcgcatgtctcgaatactcaatctcacgctgccttcgcccaaaattggtagcaggacagtcatcaagccccgtccacgtccgtaagcatccaagagtgggtgacaccggcgagccgaggtatcatcagcctgcctttgacatcggcggctcaggcaaggaatcgcacaaaaaatgtatgaaatcaagtttccacataacggatggttcgatcaagattgcaatttaaccgatgccgatgctgcaggcttcgcctcgcgtgtttcgtatctgcttgctgtgcctgctgtgactaggcgagccttcgcacgaatcggtcgacatgtgtcttcatactggctacgctgccatgaattatcgagctgagatacctttagtactctgcagaagaaatacggcgcgtactttgatgtgtaatccgatcgcatgcaaggtctctgacttgggagcttaagtgagccaccactcctccggccaaacggacgaggcatccactctggccccctgtatggcctggaacccggatcagacctaccccatcacacttggagatagtattctggggttggaagcccccgagcactggactctgcgctacgacttcaagcctgcctctgcagccgaatccgggcaaggcaggctatcagtagaccacgcaacacaacgggtgagtaggcacgaatcttcaatttgtagctgatgaaaacatgatgcttgttattggacgggagtacagattgcagtacaatctgctgagctttgccatgatggatcctcatggtgacatttgccagtaagggctggggcaacattctcccacttctcaggcttcgttccaacggccaagctccgtcgaggggtgtccaagcctccaattccacggcaagtatgagccatccaaggatgggatggactgtgtggccatctatgatggccagggcttccgcctggagttggtgcaggcagccgtaaagaatctgaggtgaggagtgtgacgggaagtagaggacctgtccagggcatggggacacaggaagcgctgtgactcaacgcctggatggcgtcatgcttgtgtgctgctcgggccctgggagaggacctggcttgctggcaacccgtgttgactggctgcaagggaccggggtgccaagcccagtcttcacgctggggaaagtcgacccacctgggacgcgctgctgttggcatggttgcatcagctgcacaatcctcttcacaacccactcccatgcaggtaccagccgacggtcctgaggacccagaaccctgtcctggcctcggccgcgccggcatgtgccgccgccactcccaccgggtctgggctcccctccccgcccgaccagccgggggctggggccggatcctacgacaaggatgcagacgagctgctgcacagcctggaggaggagctgctgtcggagctgaccgggccgtcgctggccactgaggagtcgctggatggggcctccatcaacactgccctcgctggggtggggcctcgggcatgtgaccccgcatgcgcagcgctgcagccccaacctgctgcagctcctcgtgaccaggggctctcccggccagcacctgcagcttccagccccgatgccgggacgacggcctgcgagaccggtccggcacccgcctcgaactccaagcccgctggcccgaggttcaaacctgggcgcccaaggaagcgggcaaggcaggcctctgccacgccgccgccggacctggagggtctgaacgacctggatcgagagttctttggcagcctgtcccccgcatcaagcgacggctccttggacagtgggagcgacgaggacgatggcgatgctgggcctggcgaggcgctcaggcctgacggcaaagctgaggcggccatggactggaccgacgacggcgtggaggagctgtgaggcagctgcgtcgcgagtgcgcgcctttttgcctgcttgggagtcgtcctggcgggcactggcagggtcgcacagcactcttgccacggaatgcacgcaatgctctgaacccttggcaggctgtcactgtgtcacgatgcacagcgcaggggtccgcactcacccaggccatgtccagaacaacaagcaagtctgagagatagtacacagatcaccttttcaaaggcctctgagctgagtcacaacgagcagcctggtagagcacggcaacagcggatgcagggagactgcagatatctactgcactcccttttccccccgccgcgatcttcaggtcaggtcctcttcgccggcttcagcagcctggaggcgagggggcccgcctccacctggcagcgcggcctcgatctcagccaccggcccttcccccagcttcttagccagccgggccagctgtgaatgatgacggaggggtccagggacggaatgcgcagggatcatgttggaagggcagtgcaaaccgtgatccctcagccaggacaagccgactgcagccacagtgccaccagagacgccgcacacctggttgtcgaggtgcaggaaggcctggttgccgctgaccgcagccgccactgcggcggggaacgcggtgcggtaggcgtcgaacagggcctctgcggcaaaggcctcgttgctggtgcaaaaggcgctgacggccagggcgtcctggtacacggcccaggcctccttggggcgggcggcggagagccagaccaccaccgcccccaggtaggccttggcctggctgctgcttgcccctgcggcgtcgcaggaggccgcgaatcgcagcaggagggggcccgccacctcccagcgggcccctcgcacggcatgcgcgatggccagcctgaggtgcattgaggggcggtggagcagggtccgagagttgtaatgattgacgcctagccgagtcatgctggtgactcagacaatacactaccctgcccaacgcaggcccacgctgagaatccaggcaagccaataaaggttacgtgggtctatgcaagggtgcctgtgtgggcgtgcacgctctgcactgcaactggacaagcatcctgcaggacagtgactctggccctagtcccacctgtacgtgtctcctgatgtgccatccttcccagaatcttccagccactcaattgccttggcgtacagttttgtggcaacctggggtgaaaacgaaaggggtggctagggttgaagcgtgggatacatctgcgttgcgtttatggcctgagtggggcgttcaccttgctctagcgcggcaagaatcaccactccagatactccacgactccctggacatgaatccactccaactccacaagaggaccaagacatgcagccagccaggcgatgccacgtcacaggcaatgtgacactcatacctctggtgcaagcgtctcgagggccctggcacccttgactgctgcgtctgctgctgctggcaggcggccctccccacagtactgttcggcagcagccaggctgcaagactcgatacctgctgcatctgactgcgcccgagctatgtcggctgcgcaagcatgtgtgaggtggtgaatgatggatctcagtgaggaccgcggccgcaaggcctcttctcccccctccctccaactccctcgcacctgccttctcccaattcttggcggcatgccagccggaattctggcgctcttgacctttggcggccctctcgaatgccgtgcgagcctgggccagctccccatgttgctgtggtgcttgagggaatggcagcatgaggtgaccagggggcatcgtcgcacatgcaaaatagtcttccgcccctcgcgcatctcaccctgtatagaagaccagccctctcaaatagaggcgttgcagtggaccactgcgccttgaagcggagagccaacaccgaggggttgatcagtttcgtgccctccgagaaaagcctgtcagcctccgccaggcccccagatttggacattttcgggaaacggttggtgtgtattactttcgtcggcgttctgggagatgtaagcccttaagcctgagtgtgccgtgtcggagagtgcagcggtccaggttccgggcctcagttccgcttatttacaaggagagagagtcgctgtgctaacatggtatcgtaggggggtccctttagataggaattcgttacaaccacacagggtggaagggcgctgcgttgatcagacaaatgacctcaaacgcaccgtggcagatcagtcggaggggggtcgttagcattactcagtctctgatcgtatcctggggaacaagccaatgatgttcaggagcctgtcggccaatgcccaatgcattcgcccgagcatctcgcactgtagccacatcagttggtggaaatctgcaggctgcgcgattccatggccaggacgcccgccagcgccccagtgtacccggcgttgaagtccaccgcgacctcattggcccggaagttggggcgcgcatcctcgtacccatcgtcgcccctcaccggccctcccaccagcgcccccgtcaggacgtgcgggttggggtccgggctgttgtggtactgccagacgcgcccctgccccgcggctgccgctgggatggaggcggctcggtggtgcggccgcagcgggtacccgctcccaacccccaccacgaagctgcggccggtggaccacagcacatagtccagctgctggcggcaccaggccagggccttgctttcttcgctcggcgagtaggaggcgcgcagcgccatcatgaaggcggtgttgcaggcatagcgcaggttcccaaagtcagcaaatccggggacaatgagcccctttggcgacttcttcatgtcccagtggcctacaggaggagggtggggtcagaggggtggatgagagctaagcagattggcttagccacaaaggcaaccgtgcatgtcagcgtgactttctctcgtggcgccctgtgatgaaggtactgatccactgcattgtgtctccagaagccagtctccgtcatcccccctttctccccccccaccaacccaactcaccgcttctggggtcaaaccaggcggacagaaaattgttctggaaccaggcttcatattcgtcctttccaggcaccgcctttccctgcgccgccaggcccagcagcaggttgagggctgggacggagagcgagtcccagctcgtgacgacgtcgccgctgccgccggcggctcgccagtgggccagcgcatcatcagcgtaccgtccttgcccggtcgccctgaatagccaggccgccgcatacatgagcttgtccaggaagcggctggactggtagacgtgtgttgcgcccttgtgggccgcgttgtacttgcctgcatgggggcaaccgggcagccgctggtttcaatgggtgcagcaggatgccgcagtggctgtgcttgtgctgggtgactcgcatgacatgccgtcagcctgcacgcttccacgcccaagcgctgttcaacctccatcctcctggcacaaactccacccagtccgagccctcccctcctcccccgctcaccttgcacctccttggcccaggcgtacagctcctctgcatggcgcaggagctcagcagccatcttctcatcccgtcccttgaggagcaggtggctggcggcgagggccgcagccaccgagcccaggaggtcgctggcgggcgtggcgagtgtccaccggaaagtggggcgactaccgcgctgctcctccggccggccccagtaatcgtggtcgatgtcggggtccccgatctggcccacatactcgtgcttacccacgtggcagtccatgaggtactgcgctgcgagccggatgttctccaccgggttgttggcagggctggccgcggcaaaggcctcggggaagtccagagcagcccaggccaggaaggacactgcctggcccagggggaagttgagcttcaggtggtcgccggcgtcgtacctggcagggagagggcgggaagggcttgctattcatgtggtagtggccagccccggtgcacggcatagtacggttgtgttagaaggggggaagcaacagggaccagtgagcctccatcaccaaagccgctgcatcctgagcaccatcacccaacgccttggccttaaatctccagctcaccatccacccggcactgcgtcgtccaggtgtgcatccccgcgatacttgatcctgctccaggggggttttggcccgctgatctgtgcctcatagaacagccacgatgcgttgaacgcctgaataggtcgtgtgtaggaggagtggaatgctaaacttggtggaacagcatgagctgtgttagagcaaggcaacgagacccctcgccccaatcagcctcagttgggttttgcatggtatgctcgccccctacactcgcacctccgtgtatagaggaaaggcggcgggaggggtggtcgtggagggtgtcgaagacatgttggctgacatgtacagagcgcgtcaacctacggcgagcaaccacaatacgcactgttcctgatgctcgctcaagttcccggaatcggtccggatggtgggtgcagaggcgttgagctggtgcacgtatggcccaaactcgcgcaaaacaacgacacagatgcccctggcggtctaattggatggatttcacgtcacggagttatgtgaagctccaaatcacgacgcagtatataggggggatgccacatgaagcttcctgtgatttccgtttcggagcgtgttgggtgggatgccgctcaggtcgcgcatgcgcaccttgcgcgcagtggtgcttggtcttatcaggatctgagagaactctagaacgtaagcttaagccagctccacatgaaccccagatcctgggcagctgcttgcccatgcagtcgcgcgcccgggtccgctctggagagtcggtagggtttccagtggtaaccaactgccgaaactgactggccccccttagtgaatggtgccactgcaacagtcggtggtacagaggaagaacaatttaatgctattcacccattgtgctactgttcaaggtgtctgatgaacttgaggtgtagtagtaagccatagtctagggtgagattactgctcagagagtagtctgtcagacctgccgatcaatgcagcaggacggtgggaggctcctcgccgccttcctcgaccaggtcaaccacagccggctttggcttcttgcacatgaaggcactcatggacatctgtttgccagggcgtttggcaaccgacccttgacccggccccctgctcgcgcgatggagctccagcggcagcgtggtgccagcctccctgtctttctgcccgctgggtgctgcttccggggcgacggccattgcagggcctgggacaggcttgtcactcgtcccagacaacagcggccgtgggacttcgaccggcgctctgttcccgttgtccttcccgtacaggatgctgtaacggtcttggtcgtcagtgtccatggcctgcactctgagtgcatgtgctgcctccctgtggccacggcatggagggtgaagaaatttcaacaggggaaagcagcctgttccaggtcaggatcagatcgcatgcacagccaagagccgactgacgcagctgggagggacgcccttggagccctccctggaagcagtcacgcaatggatgcaccccatagcacccggccctgcactgcccggcagcatcctcgctgaggccactcacctaggcgccaagccgagctcgaggacgggagccgactggatctgacgcttccgctcgtcctcctcgatcagctgggacaggcggcccatggtgtcgaccaggaaggctgtcagggccctcgtggcatgtctccatatctgcagggacgcacagccagtcttctgatggagtgcagacgaaggcatgcaagggcctgcgaccctacccagcccagggacggatgcagggccgccacagggccactcgcaccaacaagatgcacatccggggtcaagagtattgtaggcccacctccccctggcctagcctgtggaatcttctcccactgcataccggcttggggaggaacagcgtaggggagtccttcctagcatggtcgagctcgcggacatggtccagttggtggccattgctatcaccgtccttttgcatgatcgcctgcatcctgcagggttaccgtcggtgggtgccttgaaagcagactcgccttccgcctcatcctctgtcaatcgacgccccctcccacacgcccaccccccctccctcggccatgcaaccagattccctccttgaaggcgccgccggccctggacctgccttgggtgcgaaaggacgctcttctccatggcctgtgccagtccccgggtgccacacacgggaaagccaacctcctggaccacctccagcatcgtctggaaatggctggcagtgaaccagtccgcaaccttcttatgcacgatcctgggcagggtggcgaggtaaagagtgggatggcgatggcatcgcagggtgatgcaggggcaagggccggcgctgggcccgccgccctccggcaagtgtgtccacacagccctgtctggccccaagggggcggtcactcacgtgcggtaggcgccctcggggaaggggatggggcggccgcgctgggcggcgagcaccttccactgcttcaggcagttggcaaaggcagcgccacgcagcgtccagcgcgattggtactccggctgtgataccacctgcggcatggggccagcgcgggcatgtgagggtgtgtctttccacctggccagtgcctgtctgggtgcaacacggagcaggggctcccgaccccatgcatcatcggcgctggagagccggggcagccggcgactgggcgcttgcaggccccacccctcccggcccggggccgcccctcaccttggcgaggcgggggggcatctgctcagcgatgcggcccatcacgtgctccgcccagaactcgggcacgcgcgcctcgaactcgctcctcgcccaggccgtggccgcctcgaccttctcgcttgtgaagtcgcgcagccatgcatcgacagcctcgtccccggcctccaggacctcctgcggacacagcgccgcgacgggggggcagtccatgttgaggtgccgctgcagggtgtcggacgggagctcgggcctgggaggggagggcgtgctcgccaccgtgtccgccagcagccggacaaaggaggccagggcgggcgccgcctcaggccccaggtccgcacagtgagtcgcgccgatgcgctgcatggcctcctccgcgcggtcctcgcccaggcacaggagcgcgtcctcgaacgccgtcaccgacgcggggctccactgccgggggccgcccttgggccagcgtttgcggggcttgcgggcttgggcctggcaggagcggagatgcagaggaggggggccgttcttcaatgactgcaagattatgggtctggccaaagtggaattaccagcacacgagctgagaatggttgaggcacgcaggatgatgttcccgacggagagtcaccgtgcctcgtctagcactgcatcaggcatttcaccccgtgccctcttgccccgtctcccaaccctcaaagcatgctgctttaactgctgctgtcccagtgccccttgccctgccagatccaggcaatgcgccggcagcaggccggtccccctgtccccaatctcaccgctgtggtcgtggcgtcaacgccctctgtgtcctcctcgccgccgctgctcgcacggtcgtcgccgctcgccgaccccggctccgcctcgtaggtggagtcgtcgccgtcctcctcctcctgcttgcggcgcctccccaccttgcgcgcctggcgtgaggggtagggggttaatttgagggtccaaaggtcctggcagacgcgggaccaggtcacgctcggcatcttctacatccaccgcgcacaccacacaccaaccgctcccagctctgcagcgacaagacttgccacagagcgcttgccccgcccaaagcaatccatccctgagttgccaagcttccagcccagcctaccttgtcgctgtaatccacgacgcgccggcggcggggggcgagagcctgcggcgcagccgccgcggcggccgcggcctcgtgcgccgcgacggcgctgggcatcaggttctgccagtagtcctcgcccgcgtccgcgcccgcctgccgccccgcgcccgtcgccgcgaaagaggtcaccgagaacgagttgccggcccggctcccgatctggcgcttctcggtgcggcccgccaggatctgaccgatgtcctccgacacgaattcgttgctctgcgcagatttgagagggatgggttggggtgggggaggcgttgaggtacggtgcgcagggctggctggaataaggggtcggccagagaaatgcagggcatctggaggctgcagagccggcgcatggcatggcaagggctggcagatgagaacaggcacgctccatgaatccccgtttcacctgctgagccgccgccgccatgtcctccagtccatgcgcgccgtttttcagcagctccgagatcttgcggctgtccaactccgggtcctgctggggccccgtcactccgaggatggcctcgtccagtcctgagccgaagggagcgaggggtggggtggtccttggtgggaccggtggggggagggatgggtatcgccaaagggcaaagagtggtggcatgtgcgtcacactacagtatcttgccgaccactctggatgcaggtgcagttagtaaccctctccctgcccccctcactgaaccccctccggctgcacctgctttgcgagaggaaatctcgaagaccttggcctcataggtgtccctggtgaccaggcggtagatggtcacctccttgtgctgacctgcagcagtgaatttgcagatgtagtcggtggttctgggacaaacggcatgagccagcaggcgcacatcgtagtgcattctttttgtaaagcctcctggacggtagagcaactccacaagtagtccgagttcagcagctgcttacactatttcttcatctcaagcaacagcaataaattgccaagcagtccatggagcactgctccaccctcaccgatccggtggcaccgcgccatggcctgcaggtcgttctgggggttccagtcggagtcgtagatgatgcaggtgtcggcagccgtgagggtgatgccctggccgccggcgcgggtggacagcaggaagacgaaaccgtccgagccctctgcacgacgagtgtgtggagtgctgagcgatggtgaggagaagatcttgcggtagggtcccttgtcacctgagcacattgggaagtaggccacccttgctcaaccaaagtcactcccagtaaccacaacacatggccaagaccaatcctcagcaccacccctcctgtggcgccagctgcccctcacccgaccccgcccctcgctgtccgtcttgcctgcgctgaagcggtctatggcggcctgccggtcacgagagggcgtggagccgtcgatgcgctcatgaggccagccctccccgtccaggtagtcctccagaacgtccagcatgatcttgaactgggagaagatgagcaccttgcggccctcgctccgcagcttgggcaggagcttggagaggagcagcatcttgccgctggcggcggtcatgcgcgctgcggtgtccagcttccgcccagcttccgtctcccgtcgcatgaggtcgtcctccagcccattgcacaggaacttagggggaagggttttttggggggggcgagtgtttgctttgtttggatcctgggaatgataacggtagcttcaaggaagcacaggggttgctggcagtcgcgaagcatgagagctctaactttcaaaccaacacccagccactcactggatggcagcagatcttgcggagctccatcgccaggttctttaggtttggcaggttccggggtgcagcgccttgaagcagctgcgtcaagtgattttgcgttagggatctcatggttgatacgatggcagccagcagctttgcgcggacggtatgcttgagcctcgctgctgtgacagcacccgcagcggtcctggagtgctgccatccgatccttagcacacacatgtccatctcccctccctcccccggccctctcatccgtgaaatgtactcaccacgccgatctgcttctcatacatggcgcggtagtaggcccgctgcgtcgtggtgagctccacccagatgatgacctcctccttctccggcagcgtctccacatcctccttcatccgccgcaagaggatgggtttcagtgccacctgcgtgatggtcgggcgtgatgagtgtgcgcatgcgggtgaggcgccacagtgtgacgatgcccatgcagcggtccagggtgagggcaagggctgatggtgcttgtgacgagccttggcgcgctccaaaacacactggagacttccgcccggggtggagtcatcatggcaccagttcttctggggtgtgcagcatctctcctcccgctagctcaccttgaggcgctggacctgtgcggcctccatgccggtcctctcgtccccgtaccggcccaggaactcggactccgtgccaaagagcaccgggtccacaagactgagcagacctgatatggagggcgacgggcgagcacaggtgatgggcggcagggaccccagggtcgtcagcagcctggcatcacacggctcgcttgattcagggcgcagcatgcaattcctgctcctcaccgtgcagctcgcgcatgttgttctgcactggcgtccctgcgccaggcgttggaaaatgggattgtgcgaccccgaggactggggcagagcggcacgcagtcaatccatgtggcacgtacatgggactgcaatgtcggcgtgatcggtgctgacatgcttgtccttgccatgtcctctcccaggaccagacatgcgtgtccccagactcgccattgacgccctcctcatgcgcctcccccctcacccgtgagcaggaggagccagtggcgcgggagggcctccagaaccgcccgcgtggctgagccactggacttcatcctgtgcgcctcgtccaccaccaccgtcgcccagtggacgtcctgtgtggggaaggtgcgactcgagtcaggtgtggggtcagagtcgagtctctgccccgtccgagggttttgcggcagttcaggacctcttaactttcatccagatgcttcaggtgaacactgcatccaccaggattttggcccacgccattttccaccctcccctccccccccattccctcccttcccccc

SEQ ID NO: 17815 - DNA, 284 bp, Chlorella protothecoides
ttgctgcaattcttaatccagatagtgtagctgaagaaaataatgatgaagctaacgtaacgactgatgatttgcaaaatactaataaaaataaaggtaatactgagaattcagaaattaatgaaataacggatagtaatagtgacgaattaggtgaagaagatgaggaagatgaggaaatgcaacaggaaaaagttatagatatattggggactttctatagtgacataattaaaccaaacccgtttaattcgaacactaataaggaagatcaagatcttgat

SEQ ID NO: 17816 - DNA, 68 bp, Chlorella protothecoides
tcaataatttgcaatagtataaaaacaaatctgaaatcgctgctatggtgaaatggtagacacataac

SEQ ID NO: 17817 - DNA, 150 bp, Chlorella protothecoides
tatatagattattcctatataagtgtcattatgttaacgaaaataaatagtcaaagcactaataattgaataaatttcaactggagttggttttatgctactctatttgattatgctatattttatgtgatatttgcttttatttaaata

SEQ ID NO: 17818 - DNA, 105 bp, Chlorella protothecoides
cagtccaagctctgaggcggcggggcggcgagcgatctggttctgacccccgaccatggaccctgtgtcgaccagccctctgcctgtgcttacttcgtgcccgcg

SEQ ID NO: 17819 - DNA, 231 bp, Chlorella protothecoides
cccaccgcgccaaaggaccggcccgggccccccgaagttcgactacgagctttttaactgcagcaacttaaatatacgctattggagctggaattaccgcggctgctggcaccagacttgccctccaattgatcctcgttaaggggtttagattgtactcattccaattaccagacctgtgaggcccggtattgttatttattgtcactacctccctgtgtcaggattggg

SEQ ID NO: 17820 - DNA, 151 bp, Chlorella protothecoides
ttttttttcgagcacctttaaatccagatgtacctgaagacgcccaagctaaaacattacctttaggatttgtaattgtaactatagtgttattaaaagtcgattgaatatgagcaactccccgtattactttttctttaaattttttttt

SEQ ID NO: 17821 - DNA, 71 bp, Chlorella protothecoides
ttgtacttctacacagccccagatctgattaagctcccacaattgattgctgaccaacgtacctacagctt

SEQ ID NO: 17822 - DNA, 80 bp, Chlorella protothecoides
aaaagcagaacctgtagttcctaatttttttagaaattgatcacgaccagaaatacctagatatttattctctgaattcc

SEQ ID NO: 17823 - DNA, 61 bp, Chlorella protothecoides
tttttaataattaattttattgtttttataatattaaaaattatagaaatatttacaacat

SEQ ID NO: 17824 - DNA, 68 bp, Chlorella protothecoides
gtatgaaattaaaataaataaatgttatttattttattcacaattctggtggagacatatagaccaag

SEQ ID NO: 17825 - DNA, 487 bp, Chlorella protothecoides
gtatacctagaaatgcttttatattatattttaaataaaagatgctatatttgatatatttacgttttactgtataattgaaactatttacctatcaatttatatgctcacaagctcaataaccatacttttaatccttggtattataattatatgctgcaattattacaatgcctcatttggaacaacagcattttatttataccaatctatttagttttacaattagtctttacaaagttgatttaggtttttacttgcgtaatcaatctaattacttattctaattaacaattaataaatctatacaattaatagttactataataatatagtaaaaagtatataacattattaattattcgaattacttattacaaagtttatacaataataggaaatataggttttactagttaaaaaagttatatgactaatcaatctatgttttattcttttctttgctctctaacttgctctacagctt

SEQ ID NO: 17826 - DNA, 16260 bp, Chlorella protothecoides
ggggggggcagatgggagctggcagcaggatcttcggagctcggcacgagggatctctgaactgctgacgccatgccaggcacatgcaaggcactgcacctatacacacaggcgcatggtcgtccaagcatatgacaacgcactgcattggcttgccaacacccctcctccacaccggccgctacgacaaagtccagactccaccttgaggagctcctggagcaggggcggggccaggggtccggcactgagcagacgccgcagcgtgtcgagcatgggtttccaggtggaatccagcagcgtccgcaggacgtcgtccgcagacggggccccaggctcggtcgtcgccgtgtcgtgcacagcagcgtccgaggctgcagcatttgggagtgtcgtggctgctgcatcgccagccgccgcgtcgccctcccccgagtcccacccggcaggcaggccccctgccaggccctccagggtcacggcaaacgcactcatcccctccagggccagcgccgccagggccgcacgctgccctgcagcagtagcagcgccggtgccggggtccggctccagcgaccctggccggcccagcagcgcgcgggccatggcggccggcagcggatcgtcctcggcgtcacgccccttctccacgctttccagcaccagcaggcaggcctcagccaggctgcgcacaggctcggagcgggacgcctgcggcgagggtggggcgattggttggttcagagatggaacagggatgtggagaaacatcgcgccgcaatcccagccatgtgcaccgcagggatgagtggtcgctgggccttgtcatgagtgctggcagctctggaagctccttctgctcatggggcctcaccatgcttccagcaccatcctgaaaccacctcctcaaaaccatccagcaagtcccaccttgtcgtggtcatacttggcccccagccaggccagcaaggggccatccccgaggagcagcaccacagcatggagcaccgccaccctctggaagttgggctggcccgcctgcaggcctgcacgtgattgggaagaaatggtggcattggtggagtatccgcttttgaggaagcggtggagacacatcttcatgggtttcgtaggtcccacaaacacacaggcgtcctcctccctcccttccccaccgcaaagcgcacctgagagtaggctctggaccaggggcccggcgccagcccccagctggcaatggaaggtgccgagcagggtgcgcacgcagcgcagcgcagcacgcagcgtggggaagtgcgccgtggcgaaggccgaggccgccacccctgcgtccagatggtcctgagagatggggaggaaggggtacgatggggtcagggctggaatccctgaggcaggagagtctgtgttcatcaaaaaaggtgcacctggcgtccagagcaaggcaaaacctcacagtccacccacatccccacacctggagctgcggcctgagcagatcgggcatggtctgcgccacgatgggctgcaggccgaggatgtccatgaagcaggtgggggaggtggcaagcacaaagtccaggagttccaggacctgggtccgcaggagagagggggtctgcagccacaccggctccccacctggtggggcatgggggttgatgcgatggtggcaaagggtgaggcagagtgtgacccagggcctcaaacaggctgtcgttcgggagcaacacgccttgccacgatctcatgtggagctgtggaacgcatgcaggtcaactgcatcccttttctccaatccacactcaatcgccacggccttgaagtatgtgtggcatggattcccgaggttctatccacctgttcccctccctcttcccctccctccccaaaccccccctctttctcccaccctttactcccacctgcagcgatggagcagaggtcggacatgacgcgcacgaccaccccctccacctcgccctcccggatgtaggacagcagtagcgccagcgcctggcgcaccgtggccgccgcggtggtggtcaccgtggacttgaagcccttggccgccaggaagccgaagcagacgcccagcagcgggcccagcgcggcggaggtgatggggtgcaggggcgactgcagcagggtcagcgccgtctgcaggcacttgagctgcacgcgctcgtcggagagccgggcggcggaggtcagcatgcccagcaccgcttcggccccctcggccgacgcggccgagttggccagcagcttctgcgcggtggccagggcctggccggctagccggggcgagcgggtgtctgccgcgagctggagggggcggaagagctcctgtgtattaatttttttttggggggggcgggatgttgaggggggcggtgcatgggaatgcggggtgcctggcagcgagggggatgcactgcactgcagctacatgggctccttcgaacatttgccaaggtgctcaagctaaagtggttgatgcatctgtggcatccctatgatccacaggccatggccagctgaacaatggcaagcctagctcacccctccttccctctctccaacccaacactggctggactcaccctgcactgggccagctgtgtgttggcatcagggacgtcagccagggacctgatgcgcagtagcgccttctccgccgcctccttgatctcggggtggtcggtggaggtgaagaggcccgcaaagccctccgtcttccgggcctccgtggacagttggcgatactccgcctccagagccgccacgaagctggtcgaggaggatggtgaattcatacctatgcatcaatgtaagctcccgggaacctttggcaggctgcaggcccgcaggggccggagtgccgagcgagtcggatcactttctccctgcccacacttggatccagcatgccatcttcgcggggggactgaatgccgagcacgtttcctatgtacccttatatcggagcaggcactcatctaatgctaggccaatcacaacggtgcacggcacgggtactcgtgcgcctaaaccggtgctcgcagcaggcggggcacggacaccaccgcgcgacatgcatgcagccactaactggtcgagaggatacatgcgtggcccagcgtccaactctatcttgcgatcaatataatgacggtgcgtgttgtgtccctgctccccagcgccaccgagatcgtgaccaaggtgatcttggcgcaggggccggggccgacagtacagctcgtggggaagaggtgggtaagggtacaggcagcggaatggggatcgagaagtattcgagatccatgcatgggatgaaaccctgcattgcgtcgagccagggaaaccggatcatggtctcggcgagtatgcactggcctcctcaccgccttgcagccacgagtgcgactacggccctacctccctggccggcctgccgatcctgacggctgccaggaccaagttcaccacatcagccgacgtggatgagcaggtgcgcacctccctggctgcaggagagagcctctactccgtggatagggacctcctccggagcctgaagcctgatgtcgttcttacccaggtacagggcggggagaggggcttctgcatgcgatttacgctgattttatatgatctaaaggcagacaccctgttcagtatctgcgctcgtgcctccgtgaagcatccctggcctcttgacatttctatccgccactaatgccccaccaccgatcctattcccctgcgctcgaccacacaaccccgcagagcctctgcaaggtgtgcagcgtcgacttccgcacggtgcaagccgccgtggcggagatgcagcccccgcccatcctggtggacctgtcgccccagaacctctgggaggtgctggacgacctcacccgggtgggcgccgcagttggcgaccccgccgccgccgcggcggccgtggccgagctccgcgagcgcatcgcggccgtccgctccaagttggcagagaggcgggtgcagcaggggacccagagccccagtgtgctcatggcggagtggactgaccccatctttgtgggagggcactggaccccccagctggtgcacatggctggggggtcccacgtcctcaaccctggaaagtgaggatgcaggggaggtccaggtggactggggactagccagcggtcctggtgtcaaggggtggtggggtcctggggagcgcggggatgcgcatgaagaagtggagggtgacgggtgtgagttgaggatgtggtggccgcgcagtttgccaatcatcctgggccatgtcaccagaaatgaagttgaaggcccaaggctgtactcagctcccctcccatccccctccactcctccacttccgcttgcagtgacgagggcggagcgggcaagagctatgcatgcccctttgccgatgtggcccaggcagacccagactggcttatcgtggcaccatgcgggctggacatccccaccaccaagcgtgagatggcacccctggtggcacagcctggctggtgagtcagcacctgtgctgaggcagcgaggatgggtgggtggagcgggaactggtgcacatctgcttgctgactcacatgtcgtggggcctgggtgatgaggagtgggcctcaggcacctgccagtgcgagaggcggtatgagtcacaggcttactgagcatgcccttctgcggccaatctactgtcaggacatcattgaaagcggtgaagaagggccaggtcgtcattgtcgatggcaatcaggtcggtgacatgcatgaggaggctgggacggctgcgagacgctggaaccctcgacgtgtcctggcccacatcggccttttctcctgcctcgctgccgtgcacgccctcgcccaaacaccctcctgccctcccttgtgcagatgttcaaccgctcggggccgcgcctggtggacgctctggagttcctgtactccctgctgtggaacgagccccaggccatgcccgcgggcttcccctatgagatgtggtcggacgcacgacaggcctgacccatgctctcttccctgcccatgccccaacctgacgccgctcagccaaggcgggttgcatgtacatacactctcaaatacaaaagggaacagggaaaaaggttgaagtgagtcaaaagttcacagcggggcccagcgggcctcgcgccagttttagcatgtggggcaagccggcagatgtagctggagttcaaggcccagtctggcacgccttggagatcaacaaggtgaggtggggctgcaggttcatgggcaggcatgcacctgctgaaccccgggtaacccctgtccatcaagaagaaaaatgcttgctggctgccggtcagcgctcaggggaggcaagccttggtgctcgtgcgcaggcgcacggcggcggaggcggaggcagtgctgtaggcgtttgcaatccgccgcgttctcgtcttgggcatctgagattggccttcgatcttcagggagtccttggggggccggctgacgcgagtcgtcggctgggcgccacgtgggtgcctgggcttgcgccagctggccagagatagccagagcagggtcacgttgaaggcgatgaggatgacctgggcgccacagcacagcgccatctcccaccaagcaaactggggagcctatgggatgcgaaggagcagttggaggctggtgggcggagaaaggcactggtgagcttctgaaactaggagggcagacccagcagagacttctacggtactaccctgccgtgtaaacaggggcatgccccatgacacagccgcccaaagcaagcggagtctgcacagtcgaccacatcatccaatgctgctgagctctcaacccacccagaggccacacaacattggcgcccgacctgcagctctcggtagaagagcactagcatgtatgggtagaggaagattcgcatggggaagaaggtgatccagtatgcgacggagaagggggtccggagactccgccactgcctcctggcgatgaggaagaaggtgttcaactcgcacagcccatcctgcggggcaaagaggatggacactggcctttacgccctgcttcacagccatggatcgtgagtgaaatcatacatcccaaacaagctgcatgtgactgtgcgccgcccaaggtcaatacagactacttgtgatggagctatgagccgggtacaccacagcagccctagtggaacgcaataaaaaccccaggcccatgcacaacgcccatcgctgctctgcgtccccggcactcacccaacatgtgtagcgaccaaactgggggtagcgcagggggaagaggaggagcaccagcgtcacgacatggtggacgaggatgatgctgggcagggacggcactgcctctgggattgcggccacccaaagcaggtcaaccgcgacgtagacgctgaagatagcagacacgatggtggtgtccacgtaccccagcaggcccgccaccgtcaggctgccaatgatgggcagcagcaccaggttcaccctgtcgtgcaggtgacatgcgggcttcatggccgctcgaacgcggccggtgggattcaaagtcgcctgaaggctctcagcaatcttttcgttccctgaggacctggagggacgcgagtctcggcgtcgcaggcaggggggaggaagtggagagcgtcacgccgtaaacgtgacgccgcccggctggagagctgtgtcgtggagaggtgcagatatgacgagacaaatgcttttatgtcttcgaattctaccctcaagtctgtgtaacagcacattacgcggcttaatattcggtgaagttcgaagatgcggaccgcttcgacacgtcagcacttcctcgtcgtggatctcgtttggctgcaggcgcagctgccgagctgcgggcgcggacagccacaaattgcatcacctccgccaggccagggtctgaaccctcccctcctcactccacccgacggagtacaggctgcctggcatgcacagcaccaaggtcaccaaacgcagcccccagtctggcttccgcgtcgtcgatcctgggaatgggggttgcatgacaggtggcgattgattccacacgccatccctttcagtgtccgcacacctcctcatgcgcacatgccagtgcctcacggctcaccaatccgggacccacctgcgtttcaggccgtgggtatgcgccgcttccgccgcacgcctggcctggtgtgcagagctggccctcggctcaggttcgtcatgcactgacgggatcaggggaggggcgcttgtttatgtttgtgaagggttggtggcacatatggggggggtgaactcgacgccccttcagcagaccacccctgcgatcatcagtgatctccatggggtagccccaaaagggctctgagctccaagccacaccccgtcgctcagaatcgcacctgatgggaaggtgggcatgaactcctgggccttggggagggggtgctcggagaagaaggggtggcgcagggctgcgcgcgcagagatgcgctgcgacgggtcgtaggtcagcaacttgttcagcagatcgatgccggagacggacagctcaggaaagcgctgcattgagggtgagttgagggtgatgggtcgaaggtggggcccaggcaggtcagccgcaaggtgcttccatcgtaaagtgaggggtttaagtggagggcaatgctttgcagcttggggagttatgcaaaggctttcagcattggtggccaaccaacttggtccttgcacccccgcagcatctttagctgagattcccacagctctggcgaccccatctttgccctctgccaacctgcttgagatggttgtgtggctggtccgggagctgcagcgtggtccagccaggcagtcggccaacgctgggccaaatgcgtgtgttgggcgaccccaagacgccgcccatcgccgcgagcatggcgagctctgtgggtggcatgacgggggtcgtgcggcttcagcatgtcattccagggcgggtgtgcagcattgctccagggcacaagcagtggcgtggtgatgcgttgggacacagcaggctgagcggcaccccgctgatcccccctcgctcaaatgtcgatgaggaggccggcaggcagggtggtcgaagcggctatctcgctgcatcgccgctgcagcccgcctgcgtgcccaccctcggagaggggttctctctcaccctccagtatcacctgtccgcgctggaaagagcggcgcattgcgcaagagctcggcgaagatgcaccccgctgcccagaggtcgactgcgccgtcgtactgcctggcgcccagcagtacctcgggcgacctgtgcggcaggagcgcacgagggggatcgagggcatggtggggccttgtggagagcggccccacaagctgcgccatgcccaatacgatagaggcccagggcgcgggagtatgatccagcacaaacacgcacgcctgagccgcggccctgtggaaccccgattcgatgcgcacgttgccgctcgcatgcctttcgccctcacccctccctccctcgccccagcacctgtaccacagggtggtgacgcccggggtcaggggctctggcctcggcgcccagcgcctgaccagcccaaagtcgcacaccttcagctggccatgctcgtccaggagcaggttgctgggcttcaggtcccggtgcatcgtccacctggcatgcaggtacgccagtgcgctcagcagctgcgtggtgcggcgggacgaggattgggggttgcatgggggggagttggtgagtacagtccctgggctagtaccagacggttgcctgcccatgtttctgagggcacaccccgtcaaacgggatcgttgaaagatcatacctgcaccattgctgttcataaaaaaccctcatcccaccgaaatcacacccacccagtccctccaatcacacattgcacaacctcttgcaatcccctctcccaggcgctacctggtggaggaggcacttgatctccgacagcaccaggggcacggccaggcggtccacgatgtgcgccaggtcgtgggggcagtactcgaagacgaggaacacggagtccagggaggcgcctgtgaccacgccaagcagggcgacgatgttggggtgggacgtctcctgcagggacctgagctcccgtacactggtgaccggcatgcctgccagaggttttgtcggagggtgggggagagatttgggaactgagtgcaagttatgtgcaaggggagagtcgggcagcccaccagtttgcgtgccgagtcaagaagggcaactgcatctcccctgcacaccgccaacccaccatcacgctctcgatccaggcgcaaccttttgagggccacgatcttgccagtgcggcgatcacgtgctttgtctgtgggattggataggattagtgggtcaagtgcgaagggtgagaggggcgaatggtgggctgccttcacctggggcaccaggggccaggggtatggctgccagacaagacggggaaccgccgtggggcgcacactggggcaaatgccaagccgagacggtcatccaccacctcctactacagcccgaggagctagcggcgcccaccctcaactcacatacaatgccaaaggtcccttccccaatgcgcttcaacttctcactgcaatgcagggatactgacagagtgatttcgggggggacatttcgagatcttccacatatcaactcatcttgcatgcaaaccagcccacgcactagtcatagacgtcctgaatgaccgggagggccgtgccaaccaccgcgccctccccctcggccatgacctctcggtggcgcagggcgtacttgctacatctaggggtccacaccagcgacaatcaggtcttcatgttcaattaaaagacatgcacattgacattacaccgccatgctatgcagtctgtcagcgaggtctcggagagcacttgggaaactgggatggtgtcgagggcgcgcgcgcggctcagcccgcatgcgaactcgaactcccactcgacagcgggcggggtctcacatacttggcccacgtccagaatcgaacggtgctgtggcccatcctgcgcagtcatcagccgatccaaggaggcgaaagaccatcccggccagtgtcatggccccggctgggacggggctcgtccccctgctcctggccggtctcgcctcgcgcctcgccctgctcatctgggccggctggcaggacacccacatggcggtcaagtacaccgacatcgattattttgtcatcacagatgctgcccaggcagtgctggcggggggatcgccctatgaccgggccacgttccggtacagccccctgttggcctggatggccctgccaaaccacctgctgcacccctccgccgccaaggtctgcttctgcgccgccgaccttggtgcagcctggtgaggagtttggtttcttggtgacattgtgtgagaagagaagtgcctcaggtggctgaaagtgatcaacgcagtgcagatcagcggccaggcacagcagcctaccaccaacacccactcccttcaacccctgaccaggttgatggcacgccttctggaacgcaggcgtgctcccattgcctgggtcaaggcaggcttggcggtgtggctgttcagccccttcaccgtcgtgatctcgacccggggctcgggcgaggcgctggtgacgtgcatgctgctgggtatgctgtgcctgctcgacgccggcagacccctgctcgctgggctctgctacggcctggcggtgcactggcggctctaccccataatctatgcgctgcccttgctgcgaaacctggccatgcggcggggggcgcgcctgctgagcatccccggcattgtgtttggggcggcggccgcggcagccttcttgacactgggcggtcttgggtatcacctctacgggcactccttcctccaggagacctacctctaccaccttggaagggtggacccgcgccacaacttctcgcccttcttcctgccgacgtacctggcgtcaggcggcggcgctggcatcagcatcggggggtgcggggcgctgacagttgaatgggaagcgggttcatctttcagggtgcttgagctgccaacagagtcactcagccgatattagccatggctccattgctatgtggatgcacggtattgtttggaagggtgtacataccgctcatgaccacttgcccccccccgccaacatcaatgagtgcaacccctgtcctcctcccttgctcagggtgtttggtgctgctcaggccctactcatcgcagtccttggctggctccacgcagcagacttgccctacgccatgctcctccagaccctggcattcgtgacttttaacaaggtggccagcatggcaatgatgtggtcattggactagagtgacgggccctaaggtccagcctggccgcatcagcccgctcagcaaactacacaaccccccacaggtttccacggcccaatactttgtctggtatgtctctctactccccctggtgttacctcgtcttgctgcagcccacgctcgggtgagtgctaccaatgggtgggatgtcacgtggcattgttatctgtcctgaagttgggtacccagctagtgcactggtatagatcccgcccacttcttctacccattccctcacatgcagggccaattgctctgggcagcaggcatgtgttccgccgccatcgcccattggcttgcctgggcatacgctctggagttcctgggatggtcggtctttctacctgtctgggcggcggggctgggtgtgttgcttgccaagtcttggctgctggcctgcctgatgcgtgtcccgcagggacaggcatcagatggcttcctgtacgggaaagcctgtaagaagaagatcacctgaagagacgcacctaacagctggtttgcttgcaggctgacttgcggctgatggtgggtgggggatggactgcacggctgcccccctttcctcccgtcgtctgcgtgtcctgtgaaacaggacgacgatttattcttcgcccatgtaacaatgtgatcatggaactctcatgatgcgaatggtgctggggtggcagtccaaatgcgcgcatttcaggggagactgggcaaactcgaccgcccatggtcggcatatacatgcaacatccggcctccatgcgggaaccgaatcgtccctcacagcatcacagatcacccagcgcgaccttctacgatgcctggaagatgcaggggttgttcgcgtatcggagagctatcttgatgcgaacaacacccgatgggcagtatcgggacagctgaatgtggcccctgagattgcaggggctgctgtgtcccgcttccaaatggcccacctgcaagaggtgagcctttgaagaatgtggatggaaacaaacacttgcaccgtgcgttgatgttcctagtgcatgctggctgttcaagctgagctcatttgtgggttttgaccacatggtagcccaaaacatgtgcaggaaggctcgaatgccccagcaaggacagtgcacctcctccccgctggtaccggcaggcaaatggcactggtgaatcatgaacgagccgtgtgcatcatggtgcagccgctggcgcagggcctgacccccctgtcacgtctggagcggcggctgggtgactctgtgcccaccgtcgtgtcggcatgcagcatcattgggactgcagcagccaccgccagcgttttcggtgccggtttcctcctggatggtggtcctctcagctcagatactcttgcctccctctccaccgctggctggggagccttcgcagttgccctcatccttcgtgagtgccagcgatgaagctgctgtggtgcgactggacagcctactagagatccccttacattgctgttggagttgtaggttctagcgggacagtctcacactgaccaacacatacggacaatcattgcaccagctgatctactgtatcccccggcccctcgtccttcagagagccatgagctggggcacagtcacatggctgcccggcaaggcgtgccactgggtgtacccgtctttctcccggccggcctgggccccctggcggcctttgggagcctgaggtccctgctcggccccgccccctcccgcagcgccgcagcagcaatcgccctggccgggcccctgacaggtgggtggcatggggtcgcgagtgctgtgacaccgctggcatggcctccatcggcatggggagccatgtcctggctgtccaaccgaaagaccatcctacctgagagtggagggtagcggcagccagtgagcgcccctggtcatcaggctgccaacatcctgtgcctctgcaacagcaccagcgctcaccacacagccccgttcccggggagtgcaggtctggctgccagctgctctgtgctcctggtgggcctgcacttcacgatgcagggctggggcgggctcaacatgaccctggacgcctttgacgaggcggggcccctgggcgccgttgtgcacgccgttctcgaccacggggacgttgcagcctcgaccctggactgccacccctggctggtcgccggggctggcggcgtgctcatcaatgccctggccctcgtaccagcaggtgggggccgatggcgaatgcacattggtttcggggtctcctgctgatccaacatgggcctgtgtgccctcctgccaggcttggcttgggaggggggttgtgcagagtggctgccagctgcgtgcttgtgaagcatggtccacgatgaagggcagcacctcacccagacggtggccttgggcagatctcaagctcttgaaaacaacatcccacccgctgcccctccccgcaggggacaccgacggcgggcgactggcgacccacatcctggggcgggaagctgccacgcggctgtccctgctctcgctggccctgctgggcgcgctgggctgggtcaaccagctggcggactggtggctgccggcactcctgatcctgcatggctcacctccggccttgtgcaccgacgaggtcacccccgtgtcgagggacctgaagctggccggcctcctctgcctgtgcctgccagccgccatgctggtccctcgcctcggggccagctgaagcggtgaatcgggtgaaagattacttggatttgggggccaatagagtaacaggaagggagatgtaagcaggccgaattaggtgcacctgtggggttgcatgtgcggatgagtatggtagggagaagcaaccagcgctccgggttaacagcgtcgcgacgaagtgctgaatcggagcggtcagaccgaggcctaccgaaacacgccagtggcaccatggctgtatgatgctccacgcaatactctcgcaaaccgttgttcatctcgccggtaccatcccgagcatccatccgacaccagggctgggcgtcgagccgtcccggtacagggtgtcggaaccggcatccgcacacaggcaactgccagccacttgcgtgacacacccccttgcgcagcggtctcttgcttatggatagccgccgagaaccgttgcaggccttggctggggtggtggcagggccctacggccctggcatggaccaggctcggaaactcggcctgagtgaggtggaggagctgtacgcctatgatggcgggcaagactcaggggtcgtggacaaggtgctcttcattcatcggggcatggaggtcgatcggggtgcatcgcatggttgcatgcattgttttgccgggctccatgctcagccatacatgatgaactccatgagaccaccaggcccctggttgtgagcatgcccctgcaccacttgagcaccaccctgctgccgccatccgcagttcagtcctcaccctctctttcctcaggtcctggcgctgctggaccgacacgcccccagagcggaccgtaggcagctgggcatcttcctggagctgctgcgctggaggctgggcaccctcctcctctgcgggcgggactgcatgcacggccggctgggcgctccccaggcctttgtggccctgtcccccgcccagcgcgaggccgcggtgctggcctgggtccgggccggcagcctctcccagatcaaggcgggtgttcctgggggagccagggtggcctcatcgagagcgggccggcctcgattcaggcaggagggcctgcattgttgcaagcagaactggaccctcctccacttggacacccaacccgcaggcctggaccggggtcaagaagctggtggccctgtgcctgatgtccaagctggaggcggatggcagcagccgggcaatgcgcgcgctggggttcccgatcagggacccgcgctcggacccggcccgcaccgagcgggctgggcgggccgaggcggggctggaggctgccatctgcgacgtggccagcttctccgcagcctctcccacagacgtcaccgcgctggccgcccgcctgcagtccctcggcctgcagcccgtcgacccggcccggtgcgccccgcccggcacgccggctgctctcctcgcgggcgctccgcacctggtcctcagcgctgacgtcgtggtggtggggtccggggccgggggcggcgtggcggcggcgcagctggccgccgccgggctgcgggtgctcgtggtggagaagggggcctgggtgccggtggacgccatgacacagcaggtgcagggtggggctgaatccacttggtggagtcgggggccaaggatgtgaggtggccgggcagcgttttgatatgcagtgaagggagggcggcgtgagggcgctgccgtccgggagctacatttcagaagctctgatccagaacccggcgtcgggtgccacctcctcaccaccccccatgcaaccgaatctcccatctttccacaggaggacgaggggtacagcgcgttgtacgaggccgggggtttcatgcaggacagccggggcgtgatgggggtgctggccggcgcgacccttggcggcggcaccagggtcaactggtgcgcctccttccgcacgccagagcacgtgcggcgggagtgggcggcggcgcacggcctgctgtgcttcacagacgcgacctacgagtcggcaatggacgccgtgtgcgagcgcctgggcgtgcggacgggtgggcaggatttcaggggtggaggggggg

SEQ ID NO: 17827 - DNA, 180 bp, Chlorella protothecoides
agaaaaacacaaccttatgaagtttatgatcgcatgaaatttaatatacctgtgggtactcgtggagattgttatgatagatacttgattcgtgttcaagaaatgcgtgaaagtttaagaatcattatgcaaactattaatgaaatgcctaaaggtgtaatacgtttagatgataaaaaa

SEQ ID NO: 17828 - DNA, 373 bp, Chlorella protothecoides
ttacatatttaaaaacttaaataaatagaaaatatattaggttataaagaatccataactatgtagccctttaccaaaaaaattcacacctaaataacaaacccaaataataataaaaccaaaactagcgacccaagctgattttatacctttaaatttaccaacaaaccgcatatgtaaatatatagcaaaaactaaccaagttataaaagcccatgtttcttttggatcccaactccaataatttccccatgtttcattagcccaaacagccccagaaagaatacctaatgttaaaaaacaaaaaccaattccgattaatctataactaaaattatccaaaaaaagtaattgagtttctttattttttttt

SEQ ID NO: 17829 - DNA, 328 bp, Chlorella protothecoides
acaaaaagagagtttgctgcgttatttgtttcgccgttagttttacttatcgtagcatttagttattttagtctgccttcatcactctatcaattacacccgttagtaccagctttacaatctaattggttatttatgcatgttagtgcaatgatagtaagttatggggcattattattaggttctcttttttcaataagctatatatttataaatttttcttttaaacctcaagaatataaaactccacctgcaaatctaatcaaccaagatgagccaaaacctatatatgcaatgtataatagtaattaccctttacaaaaaaaaa

SEQ ID NO: 17830 - DNA, 180 bp, Chlorella protothecoides
atagtctatattatttttatataaaaataaccaaagacttcaaaagaatgggaaaggcaggattcgaacctacgtagaaaacattcaacagatttacaatctgccgcttttaaccactcagccactctccctatatttgtctatatagattagttctccctatatctgtctatatagatt

SEQ ID NO: 17831 - DNA, 146 bp, Chlorella protothecoides
tttttcgctgatctcagaaattcttatatttaacatcataactacaaataagaataatactgctatagcccctacatacacaactaaaaataatagtgcaaaaaagtctaatcccaataatactaataaacctgcagcattaaaaa

SEQ ID NO: 17832 - DNA, 112 bp, Chlorella protothecoides
cacattccaggccctctggcggccaggcactgtgcagcctgtggcacaagtctgcatttctatatagtttggatcatacagcacccactggccgagaatgagctggttctag

SEQ ID NO: 17833 - DNA, 139 bp, Chlorella protothecoides
aagtaatgccttccgctaaagcatgaagtagtgccttccaaacctttcgatggggcatgaaagtatgaggtaaattataaattatcgagttaaaatacttggtacaacttaaaataacggaataaatttcatttattct

SEQ ID NO: 17834 - DNA, 180 bp, Chlorella protothecoides
taaaaaatctatagtttatagttatataaatttatacaaaatatttaagtaaatacttgttttttaattataaaaatgagtattattaaaattagggataaactaaaaaattatggtacttcaagtttcagttatgacaccggatggtattttttgggataataaagctgaagaggtaat

SEQ ID NO: 17835 - DNA, 152 bp, Chlorella protothecoides
atttgattttgttttactaatgcaaaaccacccataacagctaatggagtccattttttatcagtacgaattaatgttacaccgacatctaatgctgtaattagtggtgcgtgattagctaatactcccatttggccagtatttgtgggaag

SEQ ID NO: 17836 - DNA, 7838 bp, Chlorella protothecoides
ctggccgcgctgctgcccaccacggcttccggccacctgcgctgcccggccgccatcacgcgcatgcgcggtttcgtggctggcctgggcgcggtgcgcggcctgcgcccgcaggcgctgcctgtgcgcggagcggcgctggccgccgtggccgcgctgggcaatgtcccggccggcgcagcgcgcgagcacaccgccaagttctcccccgcctggttcgcggcggtgcacgtggccgtgcccttcgtggccatgctgcgcaaggcggtcctgctccccaactgggccctgctgctgaccatcgccgggtcggtggcggggcaggccgccggcgcgcgcctcgagcgcgcgcgcctggcaggcacgctggaccttggcggcgcactggccgcgctgggcgcgctggccgcgctgccggaggcccgcgaggggcgggacgaggagagcgtctggcccgcctttgcccacgtgtcgcaggcgccccgcgcgccgcccgccgtcgcggcctgaggccacgggggggttcgcccgcgtggcacctcgtcgcaccctgtgcactcgaagaatgtatcctcggagtggtgtaccccctgggacgcgagttggcatgaatgctcccctgtccttgtagaatttgtactggatgaaggaaggttgggtcaggtattgaggcattcggggggccagggggatgcggagcagaggggcgacgccagcaggcgatggtggtacaggaaagactggctgatgggaagatgtcatggcaaggaggtgcgggagcagcgacgcaggaccacaaccgcagccttggatgaagtccaacagcctcgtcagacaccccgctgggccacaaactgggacagcgcctccagccgctgcagctgcggcggcgccaggtcgccgcgccccgcctccagccgacccagcagcgcccgggcgcggcccagtagtcgctctgcgccggcgccgtcacccgccgccgcatgcgcgtccgccgtcttgaccatgcccgtgagcgcagagagcgcggcgggcgcccagccggggggcgtgctccccccgtccaccctgtcgttctcgctttccaggtcgcacagcaggcgctcgcgcaggtccagggcccgtgtgtagaagggcagcgcttcgcccacccggccctgcatgtggtacagctccgccaccttgttcagcgtcaccgacagcgtctgccacgcctccgccccgcccgcgtcccccagcagcgccgcgctggcaaggtaggcgtccagcgccgcctcggtccggccctgcgcgcgcgcgcagtcgcccaggcagccttgcacagtggccagcgcacacgcgtcggccgcgtcttcttcgctggcgctcgccctcctcgcctcggcggcggccctttcttgcacgtcgccagctgcgacccccatcccgacctcattcgcagcgctttcgccgtcgcaaaccacgccgttcccacccccagcctcgcgccgcgcggcgcggttggccatctgagcctgcagcacgccgcggcactgcgtcagccggtgctcgccggagggcaggttgccgcccgccagcgcgcgaaggcccagctgaaggaggaagttggcgcggccgcgcggctcatcggcgccggcgtcgccggccagaccctccagctcccagatggagtggctgtcgccatgcgcctcaatgtacgcctccacgtgccctgcgggaggtgttccaggcattgcccgcgatgaaggtaaggttctgcggcgcactgttgagcggcacaggctacttcaggcaaactggtatgggccttcctgctgcaacgatgggcaagccccctctcccagaccacccctcaggaaaccctaccctggacatccggggcggcagtcaggggctgggcgtcggcgccgcatatggggcagtcatggtaccgctcgatgcaggcgcggcagtactcatgacgacacgccgtgcgcacacagtcgtgcaggagagacctgggatgaaggggttggagcgacgagtggatgctgtcgaaggagattgcggtgagaagaacgccagtgctgtaagccgtgggcctatgccagcactcccgtcagaacactcaaagaccgcagaccgcatgggtttggaccaccaccatgtcttcatcccacgtcacatccgccctcgtcgtacttgcacaggacgcagtggaagctgcccagtttctgctgaacttccgaggagaagcccatgggacacttgggggcgtcgctgcccacaggcgtggagggctgtgcgccgccagaggccaggaaggggcatttcccaggtgccttgggcgcctcggcctgctccgggatctgggagtgaaaggggcacccagcggcttgcgcggcagccttgacgctgatctggggagggttgcccgcctccttgttaccattcccccgctcgctgggggtccgagaggggtcagggacgggagacgatgtctccttggcgccacccatgaagcgccggaaggggcagccagaggaggcgggggggggaatggtggtggcagggtctcgggaatctgcgcctgccacacgtcccgaagctgcaggatggtccaggtctgaagcgccaccagatgactggcctgggagcacggtcttctccttcagtgacatgccgctgaaggggcatttcttggtcgccatgcgaggtctggtgtcaccctggagctctctcggagtggggccagcgtcgtgtgtcgatggaccccgcctcggatgcacagtcccaatggcctttgcaagatatcaagtgatcctcagaggaatatgatgcgcaatatatgagcttttcgtcaaggaatcgacaggttctatcgcccataggttctgggcggggtcttacagcatgacgcagcacggtctcgggtcgctcttgcataaatgctgccccgagagacgattacccaattgcaggcgcaggactatatagctgtgaattctggatcggtcgaaagtgcgattgaggtttttgcgatgacggtgcagacctgagacgggtacttcgagcgtgcgagaggtttcggtggccagagctatggcccgcaaactccgagtcctggcgttccacagcttcaggacgagctcccgcatattccaggagcaggtagcgatgatgcactgtcggaatcgggtattaggtcctgctctgcgcaggctccaacccatggtcaccccaaccacaaacagatgcagcgcgtgggcttggacaaggagttggaagatttgatcgaggtgcgatgcccttatcgccaggtgtagcatgccagaatcattctcggctagtaccaacccactcatctgaactgtggcgcaggtcacctacatcaacgcaccgaatagggcatctggtccgatcccggaagacgtcgctcccttcttcaaggggccttactacgagtgagaacagagcatgggagatgggagaggaggtcgtcttctcttttgaggtttgctctgccaactggatttcccttccaggaaggagtgagagacgatgcaatgcacacccctcccgtcccccttcaggtggtggaatgtctcccaggacaagagtggcaagtgggttattgatgactgggagccagcaatgaaggaagcagcagcagcaatgcgagagcatggaccattcgatggtgaggcaatgcaggttttaaccgaggggcaagcagatcatctttgagaatagtcgaaggggcagcctggccaaagtttcctgtgaccacttctgcaccctctcgtcaaggttgctggcctgaagcaacgctctggtgcactcgcaggtgtgatggggttcagccaagggggcgcgatggcctccttggtggtggccctccagaggagtggggagaggttccaggagtttccccgtctgaagttcatcctggcgtttgcaggaatcaagtgagcatgggcatggcatgcatgagtgacctccattactggtttcgttcacaatccgagcgatgtgcgaaggggtccattgaactgaatgaaccgctcgtgcctgaatcatttgctgtggtagaaaccgtctgatgccgagttgggcatgcccaaaatgtgcttccctcctgcagacttcggatgaaggacctggagtacctctatggctcgctgcacgacgtggagtcctgccacattgtaggagatcgtgatccaataaagaatgtgagtcttacaagactctcggtgctgtgaaggtggacgcttgcatgaacctgttctcagagttgccgcatgtcgagaattactcatggcaaaagacttgaatgctccaattcccctgccaacctccaatcagatgacgaaccatctcatcgaatcgtttgacaacccaatcgtcatcaatcacactcgaggtcatgtcgtgccccagctggcgggtcacgacctgactacccttcgagacttcttgcaagcgcagctggcacatcccaagctctgaagacctttggctgccgccgcgttgcgcattttaatgcatgtgcatggctcattttgccatttgaatgaaccatttgtcctttacacctgtattccttgaacgtctgtcggcaagcggacagcccgtgtgtggacatgtcggtcgcaccgaaagccatcgagggtgaccagtcgatggttgcagatgtacgagtcaggtatgacattacggtcgacatcgaaggcgaggtagactgggtggatgacccagcaaatgcctgggaaggtgtcgtggacccgcaaccatgggttcggccacggtgggcagacgatgcgacctgcgtcatcagccctggctccaaggtgagcatggtacgggttttagcgttagagatatgtggagatttgggttgtgtcgagtcaccttcgtcccatcgagtggtgccctcctggtgcttggctgctgcaggcgcccccatctcggccgtcgcatccggggccctcaccagccgccttcaggctgagcaggaacaggtatgtgctcagaaaactgctaccattttcgaatggcatagagaattgcagcatgatcgaggactgagcatgtacacttcaccctcgtccagggctgcctctcgccgcatccagagggcgctcatgacccccatcatcgcaatgaataggcgataggatgttccagggctccactccgagtgttgctgtcaaagcttgggaatggcaatgtagagacactgctctcagcgcgggagcgcactgtgtgtacgcaacctaacggacttgtcatgcggcaaaccaagtcgccgtactctgccaaaggaggattgtcattcctatcgaaacccagcttgcgggtgtgccgacgcgtaccgtgaaatcatctgtaagttccatggatgagtcggacagaccaccagctgtcacaccgccagggtcgattcccgcgctgtgcctcggggatttcaatttcttccccgggcgtaccttcaacagctgttgaaggttgcctccgacctcatggcaacaatgcccttcaccactgcatcagtattcatgttgttgctgtgtggtctcgaataagagcatagcgatgtgttgagttacccctcgggggcagtcgttgttagagcatggatggcgcttggaccgagcaggaggtcccgaacccatcgtcttccggtgcaagtgcacaagctgcatccttggatgtgaaccgtggtaccgcttatgatgccccgagcaacggggtaagcctcttgcaggcttcgcgtcgtccgctcgcgaccgttgatacgctcccatgcttccgaccgggatgacgcgtgggcgtgtcccttccgccacccaccgagctgtcagaccccgcagagccgagttccggcccttaacgccccacccctccccaatccactcgcaggcatcctctgaacctgttttccccgtccccatatcgctgagccctcccctcaagagcgaggcacggtcctctaacccttccccaagagccagcatcgatgcgtcggctgaggcgcaggagctcaaacgccagatctgcttcgacttcacgaaagggatgtgcacccggggagcagcctgcaagtactcccactctgtcgaccacatcattgcagtgaactccgaggagaagggcatctgcttcgacttcctcaagggcctgtgcaaccgaggcctcatgtgccggttttcccatgacctcaccaacctgcaggcaccccaggtgaggcagcccgctgcacaacatcctggaaggaacagggttgcgctctgccctgatgcccgctgagacttggcccccaccggggtgccaaaatacatggtcggcatctagcgctgcaagttcactgttctagctcgtctggagaaggccgaggcctgtctcaaccgcggtgtcgccccaatgctgattgataagcgcatcccgttgtccagatcgatgcgatgcaccctctcatccatgtccaaacaggaatcggggaacggccggcgccgcttcgcccccatctgctacgacttcgtcaagaaccagtgcacgcggggggatgcctgccgctactcccacgactacgcctccatcctgtacgggcccaggggtgccggcaagcaactcaacgtgctttgcgtcgactacacccggtgcgcagggtgactggttgagagtaatgcgtgcgccgcgtcgggagcacccacgccgagcagatgcatgccgtgggcgggtcccctgggcaacccaaggggagattactaggtttggggttgtgggcttttaccacccggggcagtgcctttcgctggagcacctgcatcacagacactctgccccatgtctatccccaggggccgatgcctacgtggcgatgcttgccgatacctgcaccccgcccccgcggcgtatggcgggcctgcttcgctggaggccgtggtcggagctctgcagagccaggcgctccgggcgaacggcgagctggcgggctggccgctgcctggcgcagagctggacatgctgcagggtggaggggggcagcacagcggtgagtaatacatgcatgtgctggtggagcctgggtgctgtgcgggctggccactgccaggagttgtgggtgtggggtggaggagcccgaactctgaggcagactctccggtcgcgcgcacacctgtctgcgagaatcgcctcccgcgtccaactcatcacactgcaccatgcgtgtttgcagggcacgcggggatgggctggcagcagggccccggctggccccacgcggccgccgcggcggggtacccgatgcagcccgcggtgccggcgcccggctttgaccccgggtacgacctggtcatggcccagctccagggcctgagcctggccggccaggaggcggcgccgagcgggcggcacccacaggcggggctgtacgaggccgcggtcctgcagagcatgctgctgcagcagcggtttggggcggcggggcccgaggcgaggagcggcggcttccagggaacggcgcacgccgcgcctggcgcggcggcctttgctcaggggggcccgtgctaccctccggcggggggggcctacccgcacggccccgctccgtgctcgagcgccgcagctaccttcccccacgatgcagcgtccggcccctacggcgcagcgtccagcccctacggcgcaccgtccggcccccacggcgcagcgttcggcccccacggagcagcgtccgaaccccacggcgcagcgttctaccagcacgcagccgccggcgcggggcacgtggcagcgctggccgcgctgcgtgccgcagctggggcggcggggccgggccctggcgagcgccccgc

SEQ ID NO: 17837 - DNA, 61 bp, Chlorella protothecoides
tagatgtaaaattagagcgcccggctttgcacatttacaaggacttgattttatggctcgg

SEQ ID NO: 17838 - DNA, 109 bp, Chlorella protothecoides
aaaaatttataaaataaacaaagtttattatccagagataatgggtttcaatctatcgaggcaaataggcataattttataatttttttaaaaaattaaatttacttat

SEQ ID NO: 17839 - DNA, 134 bp, Chlorella protothecoides
ggctgcaccaagccgcctactggaagggcatccagcacccttgccccctggtggaccgtacctggattaggtgagccacatgccagaggcggcgccgatgtgctggcttattgggtcggcgacggctggggctg

SEQ ID NO: 17840 - DNA, 644 bp, Chlorella protothecoides
tttctatttttgaaacaggtataaaagtagttgatttattagcgccatatagaagaggtggtaaaattggattatttggaggagctggtgttggaaaaacagtattaattatggaattaattaataacatagcaaaagctcatggtggtgtttctgtttttggtggtgtaggtgagcgtacacgtgaaggtaatgatttatatatggaaatgaaagagtctggtgtaattaatgagtctaacatagctgattcaaaagtagcactagtatatggccaaatgaatgaaccgccgggtgcgcgtatgcgagtaggtttaacagctcttacaatggctgagtattttagagatgtaagtggacaagatgttttattgtttattgataatattttccgttttgtacaagcgggttctgaggtgtctgctttattaggtcgtatgccatctgctgttggatatcagcctacattagcgtcagaaatgggtactttacaagagcggatcacatcaacaaaagatggaagtattacttcaattcaagctgtatatgttccggcagatgatttaacggatccagctccagcaactacatttgctcatttagacgctactactgtactttcacgagggttagcttctaaagga

SEQ ID NO: 17841 - DNA, 311 bp, Chlorella protothecoides
aattaaattaaaaaagttatataaagaatattattcgttaagagatgagcttgcgtaagattaggtagttggtaaggtaaaggcttaccaagccaaagatctttagctggtttgagagaatgatcagccacattgggactgagacacggcccaaatactttagagtaacagcagtggggaatattggacaatgggcgcaagcctgatccagctatacggcatgagtgtagaagactgtattggttgtaaaactcttcggtgatatttttataatatccgtattatatttttttaaagtataatatatatat

SEQ ID NO: 17842 - DNA, 18825 bp, Chlorella protothecoides
  modified_base (541)..(550): a, c, t, g, unknown or other
  modified_base (1177)..(1186): a, c, t, g, unknown or other
  modified_base (2650)..(2659): a, c, t, g, unknown or other
  modified_base (3381)..(3390): a, c, t, g, unknown or other
  modified_base (3461)..(3470): a, c, t, g, unknown or other
  modified_base (3820)..(3829): a, c, t, g, unknown or other
  modified_base (4116)..(4125): a, c, t, g, unknown or other
  modified_base (4568)..(4646): a, c, t, g, unknown or other
  modified_base (4763)..(4772): a, c, t, g, unknown or other
  modified_base (4889)..(4898): a, c, t, g, unknown or other
  modified_base (5124)..(5169): a, c, t, g, unknown or other
  modified_base (6205)..(6214): a, c, t, g, unknown or other
  modified_base (6570)..(6579): a, c, t, g, unknown or other
  modified_base (7079)..(7088): a, c, t, g, unknown or other
  modified_base (7777)..(7806): a, c, t, g, unknown or other
  modified_base (8261)..(8270): a, c, t, g, unknown or other
  modified_base (8354)..(8363): a, c, t, g, unknown or other
  modified_base (8876)..(8885): a, c, t, g, unknown or other
  modified_base (9175)..(9184): a, c, t, g, unknown or other
  modified_base (9515)..(9524): a, c, t, g, unknown or other
  modified_base (10247)..(10256): a, c, t, g, unknown or other
  modified_base (10605)..(10614): a, c, t, g, unknown or other
  modified_base (11004)..(11013): a, c, t, g, unknown or other
  modified_base (11307)..(11368): a, c, t, g, unknown or other
  modified_base (11751)..(11760): a, c, t, g, unknown or other
  modified_base (12141)..(12150): a, c, t, g, unknown or other
  modified_base (13334)..(13343): a, c, t, g, unknown or other
  modified_base (13974)..(13983): a, c, t, g, unknown or other
  modified_base (14208)..(14217): a, c, t, g, unknown or other
  modified_base (15040)..(15049): a, c, t, g, unknown or other
  modified_base (15415)..(15424): a, c, t, g, unknown or other
  modified_base (15518)..(15527): a, c, t, g, unknown or other
  modified_base (15621)..(15630): a, c, t, g, unknown or other
  modified_base (15827)..(15871): a, c, t, g, unknown or other
  modified_base (17938)..(17947): a, c, t, g, unknown or other
aggcgaacctcgcaaatcacttccactcacgcaggtatgcgaatcatctccattggtcgcgattcctccatcgtttgtgacccactatgttggacagcctgcaaccctcctgtaatgtaatggtatcttaattactcatttctgtgaccaggtgtcgtcacccaccttggtgatcaagttgggatgaaaacgaggaacagatcgtccacgctgttcaacgtacagggttgccgcatggcgacatgcatgcgggggttgggtacattgtacaactaaaagcaccaattacccccacacacgatcaaggtccagccatgtgtttgggtgggctcctccattggactgctaaatacagccttaagttgagagcagtcagatttgcacagattttagaccaggagaatactgtatgagcagtgcttcacgtcatttgcactttgcaaataccaggatgctctgatcttgcaacgagtagattggaaatgctgtgtcttaggcttttttttgcgacaatgtgccttcagcaagaattcaaacaccnnnnnnnnnntatacagccttaagttgagagcaatcagatttgcacagatttaagaccaggagaatactgtatgagcagcgcttcacgtcatttgcactttgcaggaaccaggatgctctgatcttgcaacgagtagattggaaatgctctgtcttagggtgtctattgcgtcaatgtgccttcagcaagaattcaaacaccgatggttgttcaggcacatcacaatatcagccattctttccgccaacacctactccctgcaagtgagccagtcacctcccaggtgcccagcaacccttgcccaagactctaccccttcatctgctctggattgatccacacattctacattcagactgcgattggcaagcagcagggtctgcacagtttggtcactggcaccgcacagctcgcagagcagccttctaaggcatgagggcactcctcacttcagcttgtcaaataggcgtgcagcaacgcacttgtcgacgcacctccagtagtcaaagtactgtgtgaagtgacacgcatgagtaggcagaactggatgtcaagctcagagccttcagcgaaatctatgtcacctcaccccacacactgagcaatgcagcacgattcaccctcacctggcctgtnnnnnnnnnncacgcacttgtcgacgcacctccaatagtcaaagtactgtgtgaagtgacaggcatgagtaggcagagttggatgtcaagctcagagccttcaacgaattctatgtcacctcaccccacacactgagcagtgcagcacgattcaccctcacctggcctgtgcagtgcgcctccccagtggtgtcattcttgactcgctcgccgcaagcctgtcggaatgggtcaggtggctcaagtccgtgcgagagagaccgggccccgccaccaccgtcgttccccgcacccttctgcattcccacctcatcgaccccaggcttacctcatactctagcaagtacttggtgcatcgtggcttgcaccgttcctcctcctcaggcttcgggcacactacctcgtccgacatggtggccgagacccgagcgcgttcgacgccacttccttctagacaaaaggccacgttatgctggggctcaggggagtgatctctgcaacgagtccctcgatggattcacaggcatgtagtcacctggaggacccaagcggtaccgatgcccgggggtagtacccagcacggctcgctggtcccattcacagcccccatcaaacgcaagtaagccaacaaatgaacatagataggccggtcaggagtgaatcggtggtgggtttattgctgacgactccacaggcgtttgcttagatcggaaagggcgcaaagtctttggctccgggaggatcacttggaggtgatcttgcaaccatgagcgtccccgaggacgcccccatcagcatggaccaagatgctcccaagtccacgagcgcaccatccaagaagcctgacatcgaccctgtgaaagtagaggaaggcattgccaacgcccgtgctctggcagcccagggctctcgggaggaggccatcaacgccctgctgagcatcgagcagaagggccgcttggccgaggacgtggcaatcacccgcagcgcctgcacggccatcctggaggtgtgacctaggtgcagctggctgacaatggcagagagggtgaacaaaccacccctatcggtaggttgctggagccccgacgcccattccaccatccattgaaccccttgcagatagtgcatgctgcgcaggattggactgggctccaggacaccctgctcctgctttctaagaggaggagccagctgcgccaggttatcacggccatcgtgcggcaggtgatggggtatgtggacgacactccagacctgcagaccaagacggccctcataaagacgctgcaggacctcacagagggcaaggtgagtgattggatagggtgtgagcctgatggagtcagccgggcaggctggggcatgaggagagatcccttggcatgcagcaacttgtggagcgggtgctttgggtgggaggcgcccactgctccccgcggaggcctttccacccatgcacagattgcacggnnnnnnnnnntaacttgtggagtgggtgctctgggtgggacgcgcccactgctccccacagtggcctttccacccatgcacagattgcacggggccccctctccacagatacctcgcccatccctctcactccacacgaatgaaaaccccgtcagatgtacgtggagatcgagcgcgcccggctgacccgacgcctcgcccagatgaccgaggaggccgggaaggtttcagaggctgctgacatcctgcaagaagtggcagtggtgtgtacgcaggggattgacactgggcatttcgaagatgaggggggtctggatggatgggtgtgattgagtgcagtgcagcctgtgtctgagggactaacgagatatgtcggtagtgcagggtgtctggcaccatattgcgcgcccccatccgatttctgtgcgatctcggcgcaggaaacctttgggacaatggccaaaacggagaagattgcttacatcctggagcaagtccggctgtgcttggacaaggaggactttgccagggcccaggtggggaaagcgcttgcagggcaggctcaggcatgcctgggccaggggagggatgtgcggcctgctgcctagaagttcagtagttgggatctgccttggcagctggccacccgggatggacgtcctatgtccctctgccaagaagcgagggggtcgtgctcttaatgcaccgccacatcccctactcgttccccannnnnnnnnncaacaaggtatgtcggttgagcagggtgtttggcaccatatgcgcgcccccatccgatttctgtgcgatcnnnnnnnnnnagacgttctatgtccctctgccaagaagcgaggaagtcgtgctcgtattgcaccgccacatcccctactcgttccccagatcctctccaagaagatctcgccgcgcacattcgtgccacgggctgaggcgaagaagggggagggcacgggcgagataggcattgagggcacggccatcgaagctgcagagccggttagtgttatgtttatgccagccgctgcacgggttgcatactcatgttgtctgaggcttgggtgcctatgcgtcacgctctgttgtggcctgacagcaggtgcaccttcgaacaaccctcctgtgtgtgcccgcagggcactccctcgctggaggnnnnnnnnnncgcggtttgacagcaggtgcacctttgaacaagcctcctgcatgtgcccgcagggcactccctcgctggaggagctcaagaagcagtactacgcgctgatgatccggtaccatgcgcactctggcgactacctggagatatgccgtgcctacagagccgtgtatgaggatggcgacaccgaggtgggagggggatcggggagggcaggagcgatcagggatctcatggaggctaggaaggccaggcatggtcggcgttcatcccaggaagggaatcccttcactgannnnnnnnnncggcgactacctggagatatgccgtgcgtacagagccgtgtacgaggatggcaacagcgaggtgggagggggatcagggagggcaggagcgatcagggatctcatagaggctaggaaggccaggcgtggcgggcattcatcccaggaagggaatcccttcactgagacatctgtgtcaagctgcaggagccatgggtgcgatgcatgtcctgttccttgacaagcctccccccgccaccttaaaaccgcagacgcttgagaagatgtgctggtatgcagtgctggcccctgcagactccgaccagatcactctagctgctaacactgcggtgaggggaggaatgtgtgggactgcaaggatggggttcttggcctttaggtggtgtatcgtctgtctgctttacccctgtttgagttgttcttgagtgtcttgaaggtgaccnnnnnnnnnnnnnnnnnnnnnnnnnnnnnnnnnnnnnnnnnnnnnnnnnnnnnnnnnnnnnnnnnnnnnnnnnnnnnnncgttcctggcacacagcttgtggtgattacctttggaaaggatggaggaagggccaagggtgcccatgggcctggctcgtcccaacaacatggcctgactttgcaggagcacttgannnnnnnnnnggttcctggcacacagcttgtggtaattacctttggaaaagatcgaggaagggccaagggtggccatgggcctggctcgtcccaggaacatggcctgactttgcaggagcacttgannnnnnnnnnggcggtgaggggaggaatgtgtgggacagcaagcatggggttcttggccttcaggtggtgtatcgtctgtctgctttactcccgttcgagttgttcttgagtgtcttgaaggtgaccctgcgtgtctcatcatacctcctccaggccgagcctggcctgtcccgccttccaaagtacaaggacctcctgcaacgtttcaacaccaaggaggtggggatggtgaagnnnnnnnnnnnnnnnnnnnnnnnnnnnnnnnnnnnnnnnnnnnnnngatctggggccgtggaggcccatgctggctcctgcagccttgaagccgacatacagctcattgactgtaggctgtttgttaccagcatcacaccaccttcaccaagacaagtgccatctccaagttctgttcctgcttccaacgccacagatcctctggtggcagctgttcaccgctgacttcaaggcagagctcgaggccgcggacggcatcttcgggggatccaagggggccaagctccgcgaaggtgcggctgcgtctgcaggcttgcggctggtctggttggggccatgcgtctgtgggctggctgcccgcggtgggcatgtatgtaatggcctgagccctggctagctgtgcccaaatgagcacaaggtgcagtggtcttcccaccctgatcatctactggacactgggctgcagacttggtgtccaatgccgagtgccagccccgccctggcccacgctttacacccctatcccctgcagacctgaagctgagagtggtggagcacaacctggtggtgctttccacctactactccagcatcaccatgcagcggctaacgcagctcctggacctgaccacggacgaggtgcgcctgttgaaagtagtggggggggggatggggggcaaaatggcagtgctgtcgctggcatgggagtggctgcagagttgtgtgcggcgaggagagtcaggagtgctggttccccagcctcctttgccctttcctgtctgtgagctttcatggtagcagctacaagactcgaagacatcccctgtggccctgatgaatgttgcaggcggaggcgcggctgtcggagatggtggtggccaagaagctggaggcacgccttgataggcccgctggtaccatccggtgagtctacaggggggtgaggggtaggagcatgggtcgggagggagcaaaggagagggagccgagcagcattgcatgctgctgatcgctgcacatggtccagtcggctgacatacacagctttgcaaatggtgccctgcagcggcagaagacctgannnnnnnnnnagcatgctgctggtcgctgcacatggtccagtctgctgacatacacagctttgcaatggtgccctgcagcggcagaagacctgagctcacaccctttccctctgctcacccagattcgtcaagggcaacggttctccctccgccacactcagcgcatggacggctaacatcgcccgcctcctcgagacggtggagcggacgtgtcagcagatccagaaggagagcatggtacatcgggtgcccatcggggctcagtgaaccctctgtgcagctgtgtgagcgcggcacatacgaaatatcatgaggtcttgaaggcgaggacgaagaggagcagacttggtgctgggtctgagggnnnnnnnnnngcttgcagtcgtgaaggcgaggacgaggaggagcagacttggtgctgggtctgagggggcttgggcgatgctggggaccgcgatggcgccttgaggggaggcgatcgagtcgactgccgacctgcgccctccggagggagaagaaaagccttcccgcgcctagaaaacgtctcttcgacaattataactttcaagtatcagcagcacttgcatggcgactcgataaattgcggttcaatcttggtacatgtcgacatggcccccaaacccgccggcccacccaaggccaaaggaggcgggaaaaccatcgaggggggtggtgtagacgccaagtctcggatagaggcgatcgagagggagattcaggagcagcagaagctgagagtccatgctcagctcgagagggtgaggcacgcggcactagcttggcatcctcactgttacatcaagctcgcaaagctccagattggatcactcctggatcactcatctgctgaagnnnnnnnnnnccagctcgagagggtgaggcacgcggcactggcttggcatcctcactgttacattaagctcgcaaagctccaaatttgatcactcctggatcactcatctgctgaagagctctacggtgtgtgcaggactgggtgcaggaacgctgggaggcttccatcaagactgtggccgcccttgagaccgccttgcttgctaaagaggtcgaagccgaggcactacagacccaacatggcctagacctcaaggtactaacagacatctcggtgcttggctggcctgagcgattgattcttgccaacagcactcatgctctcccttcatgacctttttaaaaggtgtatcgtgctcgcgtgcgacagctcctggcagaggtaagggatggcgctattcagatccagggtgcagcagcagccgaggctgtggacagggaggctggagctgccaccagagaggcatcgctgctgcaacagatcctgaggtgggatggcactggcggggcgccttggacccgctggaaggtgcagagagtgccttgttcctggtcaagacacagagcatgggctgagcattgctggctttgcagaagttgacagacgttgctcttcatgaagcagggcatcatagcaaacatgaacaacatccccatccagaaaggtcgctggttcccaaccctctcgactcctctctnnnnnnnnnnnnnnnnnnnnnnnnnnnnnnagggggttcatcgtgaggaggccttgcaccaccagcaatcactggatgctgctgtggcatctggcacagagggtgcacgagctgcttggagaagcgctgaggagaggactgcctccctgtgccaggcgtttgcagaggagctggagcggatgtatggacaactagaggactgctatgctcaaggtctacttggacatgtactggagctaaaaatagcttggcgcagatttagttgcagcaggatgacgatgatcgactccgagtcggaagctgattgacctgccaacctccccctcgcaaatccctgcagacttggtagctacggtttcgtctgcgcaggcgtctgctgcctccctcatcgccagccatcataaggtaaaacggggccctcagtctctgcttgtttcccgctcttcgcatgccgaacgagccgaccgtgtgctttggctaacatnnnnnnnnnnaacagcgggtgcacgagctgcttggacaagcgctgaggagaggactgcctccttgtgccaggcgtttgcagaggagctggagcnnnnnnnnnncaggtagaacggggccctcagtctctacttgtttcccgctcttcgcatgccaaacgagccgaccgtgtgctttggctaacatcagccccagactggccccacataaagactaaagcctccctattaattccatgcaggagctgaaggcagccatcgaagcgtccaaggcaagagagcagcgcaggatgaacgagatgttgctgatcaaggtgcgccgctggttgtaatcaaatgtctgacgatttgttgttactggatgccgtggaggcacagcaggtttccctgagtgaagaagaggcatggtcccctttggtatcctcgcccctttgattctctggcacaggaggaggccagggccgctgctgtgcagtatagaactctgcagagagaccattttgccctacaacgggcaagcctcgcgggggtcgtgcgcggcacaatccgcgagcggtctcagtctcctcctgagtatcacactggcaaacctcaggtgggacatgcatgctgacattnnnnnnnnnngcaacgggcaagcctctcgggggtcgtgcgcggcacgatccgcgagcggtctcaatctcctcctgaatatcacactggcgaacctcaggtgggacatgcatgctgacattacctgctgaatgacgttgggcactgattcttcttccagacatgatctgctggtgctgaacggcacgatcttaacgtcataaagcctcgtcgttcattggaaaccctggcctgtggcttgaactcatgttccctgtgacccctcaggacctgtcggatgagctggtacgtaccagggcggnnnnnnnnnntacatgatctgctggtgctggacggcacgatcttaacgtcctaaagcctcgtccttcattggaaaacctggcctgtggtttgaagtcatgttccctgtgacccctcaggaagtgtcggatgagctggtacgtaccagggcggctctgcactctgctcaacgcaaccagcaacgactgtggtgggaggcccaacgcctacatgtccagctggaaaaggcatgccagggaggaagggggactttttgaccgcatcagcattccttgtgtaatctttgagatcagcccctggggatgagctacttgtgatcctcagcaagactcagaagcaccnnnnnnnnnngatttttgagatcagcccctagggatgaggtaattgtgatcctcagcaagactcagaagcaccgcgcaacccttgcagaaggccgaggatcacaagcagctgtgggaggagctaagacggttcgcgacctggcgacggcgaggagctcatgcgccacgccaagcacgtcagcctggcaccttcatgggtgatgtgcagtccgcaaggagctgcgctggcatgctgcaggctggagttacctcgaggagtctggtcctgggtcttaggccggtgagctcggactgttcttgagggctggagtaaggagggcagagaatcgggcagattggtctgttggacccaagtcatggactggagggtgccattagtcctaagcagggccgatcggcagacagtgcacctgctgggtggctcgcggtatgcatcatgccatgaggtactgccaatataacccatcccaccctgcacagaagcctggcagccatggggggagctcccacagcgcacatactgccagtggtttggccttgccccctgcggttgcggcccagcagacagggcctcataggggtgttagcggcggcgatcaaggagcctgcgaagggatgcagagtgggagctcatcgggcaggccgagcaacgtccagatgggaggatccggtagaggcccctgcaccacatcgactggctcatgcgagggcagatcacccatggccgaggctnnnnnnnnnntcgggaggatccggtagaggcccctgcatcatatcgactggctcgtgcgagggcagatcacccatggccgaggctgcacagcatgcccgcgagatgtctcggtccgactctgccactgaccctccagcaagcatcggccgtggcccccagtcggggcgccgtgatcctgtttcagtcgatgcgagtgcgctgggcgacgccacccgcaccagccccgcgcacacgcatacaacagatttgacgcagacaggcagccagcacaccttggcggcggcccactcactccatccagcgatccaggatgctgcctgtgtgaaaatgcgcctcggccagggagaggatcaggtgnnnnnnnnnnaactcactccatccagcgatcgaggatgctgcctgtttgaagatgcgcctcggccagggagaggatcaggtgacatgcagccagcaggcctctcctaccttgattgcaggcgccaggttgaccaccacattcccacttgaagtcgtgcatcggaccaattctctggagacagactcccaggatgcccccagtgcctgtcaaccacatgggactgggcctggcaagagtacgaccaggaccgcttccatgtcctgtatcccagctgagccaggagagcggccaagcacaggcgccactgccgcggttgatgcggtgatcaatccactgaaccctgaatctccagtgagcctgcatgtccatgacctggacactgcaagccagggtggtgtnnnnnnnnnnagccgcggttgatccggtgatcaatccactgaaccccgaatctccagtgaacctgcatgtccgtgacctggacactgcaagccagggtggtgttgcccccgccctaggcgaacaggctgcaaatggggaagcgaagacggcacgccctgcatcctcatcagtagggaggagtgctgaggagctggcgccaatttcccaactgcaaccggacaccctgaatagcccagttgcacagctgcatgtgcctcataccagacctccccccttgatcccgatggctgtggcctgcagagnnnnnnnnnnnnnnnnnnnnnnnnnnnnnnnnnnnnnnnnnnnnnnnnnnnnnnnnnnnnnntcatgcctgcacctcctccacctgagactctggagggaggtgacgtgcagcaaaggagggccgacgactcctgcctgcagcccaccctgaggccaggcacctccccaaccgacccctcccccgacgcccgagcatggacactacggctggacgacagtctgtccattgccctggccggagccgctgctggagccgaggcagcggttgcccgggcgcttgtggcgcggcagccgtgctgaggttcgttgtcatgtaggcatccctcctgaacccgaatgccgaaggaactgtgttggagaacaaactgactgatcttttcatgtattacaactcaaaataagtaactcacgccagggtttctacgggattgcccggaacaatannnnnnnnnnaaacaaattgactgatctttccatgtattacaactcaaaataagtaactcaagcaagggtttctacgggattgcccggaacaatacacggcgtgattgatacagagttgtatctggcaaggttctgattgacagggcagaagctagcagcctaaacgctgatgtccaccgtctgaacctgcaggatcatgcctgtgggcagggagacgtagtgggagagcaactgattgggctaaggattcatatccagctactcacacccaaaacacacagatgtgcatactcaagaaatgatgagcaatatgaagaacacagaatccccctcccccctccttgtgatggccaaggtgcttgttctcccagttgggccccccagtacccnnnnnnnnnnggcacacggatgtgcatactcaagaaatgatgtgcaatacgaagaacacagaacccccctccccccccctccttgtgatggccaaggtgcagcgatgcattgttctcccagttgggccccccagtacccttcctgctcaccatcctcgcaagctgtgcctgcctggctggtgaaccagtaggtcaccccgccgcccgccccagggtccgcccagatgtacatgccagtgggggaatgggttccctgctgcaggggcgccagctcctcgcagggtgcgacggcggccggcggctgtgtagacggcagcagggagcatgtcgaggaggcagatgaggtacccgagggaggaggacagatccccggtcccgggatctggtagacaccctggacactgtgccatctgaaagtcacagtccctccggtgcagatggggatgggtccatacgcagcgggctcagagttgaagccccagaagtcctggcattgaggggatttggcagggcattgaggtacccatgtggagagacccacgaggcatgggctctcgttggagtcctggtactgtcacccatgcgactgcatgtttggaagcgtcgtgcggcacagattctgcgacgcaataccagtttgagagagcagcgcaactcacccagttcttgtagcaattgccagctgcgcaggggtaggtgggtggagcagaattggatggtaaggtgaatggcagccagagtagcccaacaatcaacgatgttcccttgtctcacgtgagcacctctttaacctcacctgctctcccagcgatctgaggcacagtggcgagcaagagcaggagtgtcgctgcccataaagtagcgaggacgccgcgctgctgagccatgaacgagaatggtatccgcctgtcaatcagtcactgcgatttgttgcagcgcggtgatggggctccatggtccgaaagagtgtcaacgtgcgtctccgttcctttacttgctggccttagtgtcagaaaacgcgtcgttgggtttgctctctttgaattctaaagcctacgatggattcgatcgtcgatttcaggaaaaactcctttgtaatcgaaaatggtgtgtgacccttcgatcgcgccacggcacctccagaactaccctagagatcacacgtcggattctgcaggtactactctgttcaannnnnnnnnncgctctccttgaattctaagggctacgatggatttgatcgtcgatttcaggataaactcccgtgtaatcgaaaatggggtgtgacccttcgatcgggccatggcgcctcccagaaccaccctagagatatcaagtcggattctgcaggtactactctgttcaaaacacccgggtaggaccaacgacaaacgtgggaatctacccaaaacaacggcaatgaagaccaatcagaacttcagtcgtcgtccaagaaagccgccgcccctctcctgcgcctcttcacttcttccttcgcggccagcctggcggcctcggcctccgcttctcgcctatccgcctcccgagcgatgcgcagtgatcgctgctcctccgctgcaatgtcagagtacctggtgacctccatgctccggtcatccatccgatctacctctgcgaagcgacccggatcatatctggagaagggacagcaagggtgttgttctgagtgtatggaaatgcggtacctgtgtggcatgctgaggtgcggcgatgggcagtggggtccccgggcaagggaagggaaatgcctcggtgcacagcacaaccggccagcgcattgggacaaagcctgccaccgggttgcctcacccgnnnnnnnnnngatactccggtgcacagcacaactggcaagcgcatcggaacaaagcctgccaccgggttgcctcacccgctcagggcagagcgcagggcggatctccagtcaccctccgccccgcccatctcgccgtcgccctcgtcgtcgatgaagtcggaggcgtcggagtcttgagactccagggacggtctgcaaggggcaggcagagagggatcagacacaggctggcannnnnnnnnncctccagggacagtctgcaaagggtaggcagagagggatcagacacaggctggcacaaattcaccgacggacgaccaggaggctttgtggacggtcatgctgtctcaaccaggcaatgctggtcctccgctgcggccacatcaccaaccctgggagtcgcagaccacatgcactgacagagcgccaaggcggcctgcatgaacatgccagccaccagccactgcaccttcgcttcctctgcagagcagtgggcggctgcttcccgccgtaaaaagtgccgcggaggtccggcctgcctgacgagtccccgccaagtcggttgaggggctggcctgctctgctcgtgaccccagatggcagcgcaccccgccggtcgggcggcgacacggcaggggcggggccctttgtcccaggggcggggcgaacaatgtgcagcgtgcccctgcccgtggctgaggtgaccccgatgtgggccatggaggcacgctgcgatgcaggtgccggcctgaagctgtgtgatggcaaggacacaggtggcagcgaggccttggcagcatccactcgtgccctcagcgcggcgtcggccatctgtttcctgtccttgccaactgcgtgggtgtgaggaacgggcgaaggggtcaaggtcagcgcctgccctggcaatgcgggaggaacgcagactgcggcgctccttcttcagtcacccgcacccctcatacaagagcgataccaaaatgcctggcagcatcggattccatccacctgccgctacgttcactgccgtggttcgggccccctcgcccttcctcctgcccttggtcgnnnnnnnnnngacgggcggagggtgtaaagttagcacctgccatggcaatgtgggcggaccgcagaacgtggcgcctcttcttcaatcacttgcacccctcatacaagagcgataccaagatgcccggcagcatcgaattccacacctgccgccacgttcactgccgtggttcggcccccctcgcccttcctcctgcccttggtcgaggtgacggtggcatgggtgatcacccgcttggacggcggcggcgacaaactcgtcgctcggagtcctgtcccagggtcggccgcgggaccccttgcctgtactgaccgcgcccctgctgttgcacggatctggcctgcgcccagctttgagcctgggcccgctctttcnnnnnnnnnnatctggctccagtgcgccagcttgcactgtagcatgcccgggagcattgccaatctctcggccggcactgctctgggggcgtgggggaggggcnnnnnnnnnngtctggctccactgcgccagcttgcactggagcaggcccgggagcattgccaatctctcggcgggcactgctctgggggcgtgggggaggggcnnnnnnnnnnggggaccccttgcctgtcttgatcgcgcccctgctgttgcgcggggctggcctgtgcccagctttgagcctgggcccgctctttccgtgtggacgcctggctttgactgtgatgcagttggacggcctggagccttgggcgctaaacccagcccgctgaagtctagggaggctttgatggaggttttgggttggtgnnnnnnnnnnnnnnnnnnnnnnnnnnnnnnnnnnnnnnnnnnnnnagacacagcctgccagcctggggcccgagcggcttcgcgcgtggacaccgggcctccgaagaacgacgtacgactgcaattgggggactgggaggggacatttgaggctcgttgttgtaaaacgggactggcactgatctggcgcctgcctcctacccgccctgcctgccagaaacgcacgtcgcaagacgggagcgctctgactccctaaatctagccgtcgacattcaaagaaaaaattccaattcaggcctcatgctgtcctcccgattgtgatatcgcctgtcgtggtccatccctggctcgacataacgaggcaagtacgtgtcacatactggatggcacggcagctgagccaacaataatacaatcacgagtacatgtatctcggcggcgcatttggtgggagtgatcgtgtctgggacggcctttctcagactctcggaagttgtcggggggagctgtcgcccagcatgtatagcaggccgaaaggggatgagggctgcgttcggtgtatacgtactgcacattgcacacttttgcggatctagagtgatttgtaataaagaacatacaatgacaaggtttgggacgctggtcatctggcagcttacgggaccaaggcaggcctgagtcgtgccagatcgccctcatgccgccagccacgagggctacggggccccgcaatgtggtgcgtcggccactggatctgggtgtggtgtgcgagggtgcggtgatggccctgcacgctccctgcctggctttgggcggtacccagcgatgaacagctatcagatcagagctgcaccatgctgctgcacaggaagtcacggtactgctgctggacatcggcgcatccatgcatgcagacctggacagcgcagcgcatgccctgagcgcatacgtcgagactagggtgaggagcgctggggttgcgcagcgataccagcctcttgcatgcccgaccattcgagcctctgcgcccgatccaaactgcgcctgagggcgccttcccgcccatacagatgctgtccagacccaacagcgacctggccctggtctactttggcacctctggcacctccaacgagctgcacgacgaggcggcttctgcgggggaccccacccagtacctccacatcagcgttgtccacgcgctgcagcagccgggcctctccatgctgcgatccctgcgacagggtgagtcgcaggcggcgcggcacacgggacgctattcctgcccgtggatgaagcagcgatggtggctgctcccgagaagctgcatcttcccggcatcctgtcgttccctcgcgccgacctgctcccactccctcgacaccctgcaagccctccaaaacctccaaagcctccctcgtccccgccctcccagtcccacgtggagatggggagtctgactttgtggacgccctcacggtggccctggactccctctacaaggccgtggcactgcgggacgagctgcagggaccccgcgtcgccaagcgcatcgtgctcctgtcccagctggcgacgcaggtgcacggatctcatggtgctttggggtgggtgtggggaggcggccgtgcggcagtggatggcctcgtgcctgttgaggatctggaagcctgtcacctgctccagaccatgccatccaaccccccagcccgccctcccccaccatagatcaagccagatccggggaacgcgttcaaggacaccctggtccggaagctggctcagcaaggcgtgacgctggacctggtgtgtctccacccgtacctcgcagtccctgggactcgggcgcagctgcagtacatcctggacaacgtggggaggggtgggcctggcgggctgtctgggtgtgacgggggccattccagctcgagtgctggtttcttcatgtgggtcccaagccttgctccccaagctgagggaatatgggggggtggagctcatgatgaagggtgcgggcgctgggcttcgctgtcgcatggccacacgatgcacaccctcaaacctctgacctcgcctgcagtcaccgcacaccctgcgagaagtgcacgacgnnnnnnnnnntgcgggctgtctgggtgtgacgggggccgttccagctcgattgctggtttctacttgtgggtcccaagtcttgctccccaagctgaggggaaaggggggggaggagctcatgatgaagggtgcgggcgctgggcttcgctgtcgcagggccgcacgatgcacaccctcaatcctctgacctcgcctgcagacaccgcacaccctgcgagaagtgcacgacgctgcggagctggcaggcgcattcaagtcacgggaagtcacagccaccgcattttactccggacccttcaccatcagtgaagactttgagttcaaggcgaggagcagcacgcaggctcctgcgcaggcggggtgtggtgtcttggcaggacagagtccttgctgtctcaggggttgggctgatggggagggatgtatctgcttgccacaccccctccccttcattctgcaggtcaaggtggcaaagaaaaccaaccaggagaagctcccttccctgggcaaggagtcgccctttgacagcagtgaggcatttgggggggcatcgatgcgctccggcgcaatttgcacgccgccccttgggtgctggatgtgcttgaccacccctgccggacccactgcattgtgattgggaggtctctgactcgcctcgccccacgggcgaggcaagaccgggacccatctgtacgcacattgaaccgccgacccctctttccttgctctcgctgcgcagctgacccagcagcctcgcacggcttgactctggctcgggagtacagggtggcggaggaaggggatgccggggaggaagtggcgcaggaggagcgggtgaaggtgtaccgggtatgctgattcttggggggggaagggggggggggggg

SEQ ID NO: 17843 - DNA, 138 bp, Chlorella protothecoides
cctgctctaagaggtccagacttccaccaggggacggacgtgggcttggcctaagtatgttcggcatcacttcagaagtcagattcaagtgggcatggagctggggcagctggagcttgcgaggatgtgtgcatgtgc

SEQ ID NO: 17844 - DNA, 70 bp, Chlorella protothecoides
caatccattcaacacgattgcaaagacaatgactctaaatgccaacctgcagaggagtatgtgctcatgg

SEQ ID NO: 17845 - DNA, 8924 bp, Chlorella protothecoides
ctgggggggggcttgggggccgattgccctggcgaggccggaaccggggggctccatgcttgcgcgacatgcggtcatgcgggattgcgccagggcatccccaagacaccgccccggcgaggcccagattccgccatggcctggtgtacttacgtgacctccacaaacttgatggccacggtctcccgggtgtcccggctctcggccaggacaacgaatccaaagctgcccttattgatgtacttcagggtgcggtacctaggatgattgatcagaggatcgtctttgggatccatctcaagttcctagcgtgatagtcaggcgacgcccaatatgttggggtttgcttggtgtgcgcctgtcgtcggcagggcagggcttccaagggatagaccctcgtgaagagggttaggggaagttctccttctgaattatgttcaggagtaataggtgaagagtgtgagtcttgcccatcggttgcgcaggaccatggtgaggggtaaatggggcgcagatgggggaggtggggagcgaaatgtcacgggaaggtcctcccgccaagcacgaagttttgcagccgagaggacctggaccgtcgcatcgcttgaatcgcatgcatggcaagcgcaccagtatcgatatcaagaatgagtattgtcgtgggatccactctgctgagcactgctcctgatctcgaggcccagaacagttcataaacaccttttgcctgctcaggtggtggccaccggcgtggaatgccccctcgcagcttgaggaaacgccctgtgacgttggatgaggcacacgagtctggcgaggaggatgccgccccaaagctgagcgtggaggacacacgcctcctgcagaggcagcgccagcgccagacggtgggtgggggggagcctggcgttttccatgctcggggagtgcagttgtctcggcgccaactccatcgacgcttccatgctccaaggcacgcagggcgtggatgccgcggccctgttgcaggggcgcagggatgatgaggacagggagctggcgctggcgagcgctgcggcctcggccgcgccggaggaggggggcctgcacgccgccttcaagcgtgaacggcagcaggatgagggcgccgacaacccgcacatgtgagttgcggggtccaaacgtggtgacagggaatctcttgtgttgcgtgatgcccgggtcatggctcctcgggagagatgcttgtgcccctcaccagctctttacccacaccttccaggccctgcactcccaaccatcaccctcccgtgcgcccaggaagcaatatgtggaggcccagttggccgctcggctgggcaggccggcgccggggtcggagcagccggcggcaccgcgcggcatcgacgacgagctgtttgcgaccagccagtatcagcgaaaggacgacctggagctggggccctcctggatcacgggcatcacggaggtcccgctgtccatggatcagaggctgaagaacatcgaggacaccgagaccgccaagaaaaagatgctgacaaggagtggcatggtcaggtgtgtgcgtgtttgtgtgtggggttgtttgcgtcactcttcacgtgggagaacagagctgctcatcttgggaggggatcgtgggtgcagtctgggattccgtgtcttttcaccttgacacactccccaaacccgccccctgcatcaatccttgcagcatacacgatgccgacgatgatgatgatgaagaggagggtgcaggctcccgccaggccctacggcgtggccagtaccccgtcttctttggaaagcaggaccccgccatgctcaagcgggtggaggaggcgcagtgagtgatcgggcgaggggcgcgtctgagtggcgggttgacacttgcagcctttgcccgagtatgatctcttaagctgcagctgtcagtggcctctggtaacctcttcatgcttcccgtgctgacaggctgcccctccaatccatcacgccccatgcaggattgccaagaagcagaagaaggcttactacgccgacatccgcgctaagaagcggcaggaggaccggccctcgtggtaggcgctgtggtggcccctgcgtttcgcggccgccccgcgtcccatgttgacttcgggcgtcagttttgcccctgctattgactgcccatttactcctcccttccatggaccgcttgcctctgctgttaagcacctaccagttcagcagcgagctttgcagcatggagtaggaatgattcagggcagcataaatgggccgcatttaagaaaaccatggagtcacgatcattgccgcactgggcctcacagctccagcaccgtccccggcactaggtaggggctgtcccatgccgtggcctgccccgcctttccccccgccacgggcagcaggcggcaggtcaggggcttgccaaggcgggcggccatgccggcaatgtccaggaccagcgccgccgcggcggcgaccaggcgcgccgcctccccagccggcgtctcatccgacacgcccggcacaggcaccgtgtccaggccgcagccgcagacggcggagtagaagagcagggtctggacggagagcgccctgctggcagcggccagccccgtgtcctccgccaggggcagcatcaggccgcagtaccccgtggtgtcgatcccgctcagcgacttgaccgccgcggtcacgcgttccgccaccgccagcgtgcccggcccgccaaaggggcccagtcccacactctcaaaagcgcctgtgctcatgggcgtgtgtatgagagggagcgggggttctcatggaggtctgtgacgggagtccaggaagccaggcatggtgcagcgcggcgccggcgcggaatgcagcacgagcacgggagggcggctgcaggcgcgggccgggagccccgcgcgtggtgcccctcctccccagctcatgcatgcccacaagccccagcccccgtacgcacccgcgaggctgggcccctccagccccgggttgatgctggtgtcaatgcccaggtagggcacgtgcgtggccgttgccagcttcacggcgcaggcctgcacgcctcgcaggccggccgccatggcggcacgcagggccggggtcacgcccgccgggcccccctcccccgccgaggccagcgccgcggcgtactgcgccgagttctcggtggcgatggcgaagccggggcgcgtcgcgctggcggcggggaagaagggggtctggaaaccctcctcggcaaaggtcagggcgaagtgaaaggggcccacgtcgcccgtcgccctgcccagggagaagatggcgcgggcggcgctgcgcgcctcctccacgcccatgccctgcggcgaggggaggaggtggttgctgggcgggcctcgtggggcgcgcaggggatgcgcaggtctatctccaggcctccacaccatgggctacctgaacggcgccctgcttgccagcaacagcttcccacctcgtgacacccccaatacaaacgtgcagcgtcgtccaacgcatttttccacagtccccaccagctcaccggctgccagcggaaggtgcagcaggtgtaggcatcgccaccgggcgtcgcgagtagtttcgtggcgagcccctcctccagaagccgggcgttggagaaggcgccgtaggatacaaaggagatgccggtggcggccgcggcggcctgcaccacgcgggccttgcgcagagcttcctccacgctttctacccgggtcaggatgtcggtggcgactcgcagcgtctgcaccgtgatccctgcaagacaggaggatcgaatgtgcatctgaagggctggttgaccgcgatggcgtggcgccacgcaaccagagccctgagcagcaatcccatgcagagcacaatgtgtcccccatccaccagccacaccggtcgagcgcataccttcctgctcgagactccccctggcggtggccaggaaggctgcagcctcctgcatggccccctcccagcccgcagatccgacatctccttcgggaagaaagtaagtgacggatcgtatgatgcatgggtaggtggtgatgtcactggccatggctgcgtggaggccgggggcccgccctcacccaccgcggtgtcggacacccctacacgtatgtttccagcgtatgccaatggagaggggcggtcggcaagctccagcgatgtgggtccagaacaaacaatcattaaacactcgtatatatcggcaagtgggcttgcctcatctgtagttgtcccgggagggacgccgggcgcgcggtgtgacgtgagcgacaggtctggcgatgcaaacattccgacacagggcaagtacctaggcaccacgacgaatccaacatgaaaagagtgtgtcgcatcgtcatgaccatggtgaggtctacatcctgaggaatccatctacgtcctccgtcgcaacgctcagagcacagcgttcgaccacactgtgtatcccaccagtacacctctgcctcgccatcccgatactcaccaaatgatgatgcacctgaagtaacagcaagattaatggcatcccgtttgttcgaggatctgccggagcccagtgctgccagggagagagaggtgccaccctctaagcggccccgtaatgaaactgtggactctgaagtcagagaagaagtgggtgagggtggaagttccgcacctccatccaaggagacacaggcgactggcacagagcccagaggggagacagtaccccaagaggccgctgctggatcgggggctccccagtggaccacagacgatgacgaagtgcccccgccaccgccacctccaccacctcctccggtggacggcatagcccttgcactggagaagattgcatcgcacattccccaaccttcaaagctcgtcaaggcctctcgcttgctgcgccagctcctggaacaggtgaatgacggtgcacgcccgcgggccgtgggaggcagagcttgcaatcggctatcatctgctgcatagcagcacccatcggcagacccctgagcctggcgtgtcctccaagctggcagggtaccttggaccctgaagcgcatgggccacttgtctacagagcccttgtcggcagtctgtctggagcggctgcaggggacgagactccagtggcactggagctgagtaaggttttcaccttggccagcaagcgtggtcaggtgagacaccctggatactgttttctggcacaatcgcttgaaacagctggacgccagggttggacaatgtgggctcctcctgtcatccggcgtcgttaaatctactcattgcatgcaatgctgcatggctgctgggtgctggagtccagcgtccctgccgatcactctgtgtcgaatgatgacaaccctcccgtgctcctcgccgcccacctgcgcagctcttcacgcccagccagcgagaggtgctggaggtcctggctctgcgcggcgtcctgcggtcgcagctcctcaccacagatgactccttccagttcaacaaggtcgtggctcgcctgaaagaggcggtggcggccctcccagaggagcctgcgacactgcctgagtcagagggagcgtccgagccaggcattgctgctctcctggaggcagatgcaaagggcgcggttattgcagccgaggtcctggagggcgtgaggagaagccacctgctggactgcctggaagccggcagggtcgtgtacaggtgggctggcgggaaggaccaggtgggaaacttgcgatccagaattgacgactcgtcaacgacagcgcaccttcctgtgctctcccaccactttggagctcaatgtcttgggcacaccaacagtccaccgcaattccaggacacccatccacctccccccccttgcaatcctcacaggctaccgtgggcccggacctccgtggatctgctggtggaccactttcgacagcacgtgcggtgcttcctacccgccgagcaggaccgcgtcgcggccatgatcgtgtttgtgaaggagcagcgtgcggcgaggcggcaggtgggtgagggtctggccgggggccgcgggtgctgggaccatgcgccgcatggcggtccctccatgcatcggcttgacctccctgcatcgtagcagcctggaaatgggtgtgtgcctgggtggccggggcgcaccgggtgcctttgcggccacatgcgccggctgagatcagttgccatgcacagccagaacgtccccatgcaccacatgctcaatcacagggccccagcgcaaaggagagcaaccgcgacacgacgtcctttgaaagggcctcagctgcctggtcccaagccacagtatcccacaggggcaaggtcggtagcggaggcgaccacaagtcggagaattggctcggatgaggtgcctggcttgaaagagctgagcactcccagtgcagaatcaccacctggcgccccgggtggggcctcactggtgggtgaggcacagccctcgtcagcgtgcaacagccaaagcatgacaaatagagggggtggagaaggggggagagaagcagcaagcccttggactggctggcatgtgcaatgctcaagaatcaagtatggacaaggtaacagcaggtgaatattgatagggtgaagggaggaccaccaccttccgtcacatcagccgaccagcgaggacgctgcgcggatacttggcctgcagttctggccactacaaggatccaaggggggcagcagagtcacactgggggcgcagtgcaaggcctgggatatacattcagcattctcctgagtctggctgtgagaaacccatccctctcgttgggttgctcagtgaagtttgtcactccttgccacccggctcgttacccagacgccatcccgtgcctttgcaaggtcgctcacctggacaaagaagatcgatgccaatcgagcatggtacaagatcttcccggagagggacagccgatatacccgcgctatactctctacatacacgatcttggcggtggcgactccaagcatcctgaagaggtggacaccgagaaggcatggagtgtgcaagcgccaccatgtctgcacaccaaacggtgtgcaatacagcatccacctgcaagccccttctcacgatgtatcaccttgccagaagtgcagagaggcagatggggatgcaggtgcccggcccattcaccaacaccttgcatgcagggtgtgatgcagggcgagttggacgaccatggagtgcgggggacgcagcgccgcgcaaagctcgccttgatgcatgtacgcgagttgtttcaaacgcatccactgccaaacagtcgttctgtcctcaacaaaagacacgcaccaggtctggccttgctcggaacaccaaggccagcgcatacagcatggcatgggctgtgctgagtgcgctgctggtccaggactggcccacctccctgctgcgtggtatcacggcctgttggtaggcggggcccgagggatcacttcccttgccaggaatgccggcccaagccttttcgaaggcagtggccttgaccccgctcagggcatcggtggccgcggcgacatacacccgaggacggtacaccgaggcatcaaagttcttgaagagtctcagcatctccgcggtgtgcccgcccgatcccaggacgaccatggtggcgcatgtctgcctatgcctgcgcctggtcaggagtgcaagggcgaatcgaagggctgcaagggcgactccaacctgcaagaggatccataacatggcgaagtatacttcattgatttggcgcacaaactaccaacaaagccatcgccagcgtcgcagatcacatagtgcctgtgatcactttcgacctggcgcgcgcgctgctgtcgtgaacgctgacaggggtacagatcggctgtttcgcatcgcgcaattgccaggctttcgcctcgtgcgacactccttgatcgttgaatctggtagaaatgccggcccaaaggcactccctgcgcaccacgggagcctgaggatggacccgccgggtggccaggacattttcttcgagcgggagagggtgctggatctggtgtcctgggatgcagagagcaacctgctggccgtgcagctcgcctctgcaccatacccagcccccctgcgtgtctgcatcctcgaaccgcgctgcccccaggcaaggcagggctggtggtgtggtgggtgggcgtctcgggtactggtcgtgctacgctcttgcctgtcagcatggcggtgccagaccctggagcagcacagggccggtgctagtgttcctactgtaccgagttccagcccctgccgcaagccatgcgcgcaggaccatgccatcctggaggtgcccactgggcatgcgggcgaggcgctcacccacctcctctggctgccggggccggggcccaagtgagacgctgggttgggggctcatggatgttgtgacggggtgtgccgcctgccagcacccccaacgtggccccctcctcccgtcccctgcaaaggacgctgctcacgctttccagccggggcgccgcgcacagctggtcccaggtggaccccgacgccgagctggcggcggcggtgtgcctggatgtctggtacggcgcccccgccttccagctgccgcccggcggcggccgcgtgctggccttcagcgcccttgcccccccctccccctgggacatcggggaggggcccccccactccaccaggtgacgagccggctgctctgttgtctggaacgtgaccgtcggcacgtccctgctttatcttttgggggggtccccctggacgtcttccttgcgctcacatgtcagcacggtggtttttgggcagaccttttcctccccgcacaacacactgaccattaacccccacccccccggccccccacctccac

SEQ ID NO: 17846 - DNA, 157 bp, Chlorella protothecoides
atccataatcagttaatatgcgtcgtaaatcaggatggttgtgaaaaaatacaccaaacatatcccaaacttcacgttcccaccaagctgcgctagaatataccggagtagctgactctagagtagtatattcatcaacacaagttttaatgcgtat

SEQ ID NO: 17847 - DNA, 61 bp, Chlorella protothecoides
gactttttatgtataccctgaatatttaaaaccatttctttattttttacgcgatcatatg

SEQ ID NO: 17848 - DNA, 97 bp, Chlorella protothecoides
ttttggtacaatagggttatcaggtgagtgataattagttacccaagattttacaacattaggctcaaccaaaatagaatctttagtttcttcccca

SEQ ID NO: 17849 - DNA, 222 bp, Chlorella protothecoides
tatctatttaaactaccaattaatttttgtattaaattaacatttcttttgggtattacttttctagttagtgctccaagtaatgcctatcctatttttgctcaacaaaattacaacaaccctcgggaagcaaatgggcgaattgtgtgtgcgaattgtcatttagcccaaaagccaatcgaaattgaagtaccacaagctgttttaccaaatacagtattt

SEQ ID NO: 17850 - DNA, 194 bp, Chlorella protothecoides
tgaaaattattatacaacggattatcattgtatgcaaatgataaacattttttatacatttctgcagcatgaacattttcattatatatactaacaggtgtgaaatttgagcctaatagattagaattattttgagattttagagaaattttcataattttattgttttatgtactatatgcatctaaaataac

SEQ ID NO: 17851 - DNA, 11629 bp, Chlorella protothecoides
  modified_base (2103)..(2148): a, c, t, g, unknown or other
  modified_base (8594)..(8603): a, c, t, g, unknown or other
cggcgcggcgcgcgccgcgccgcgcctcgccccggaggcccgtgcggcgctggagcgcgaggcgctgcggtccaccgacagcgacgaggtgccggcggcgggcgccgcgccgctccccgacggcgaggacgtggagtggttcaacatgtgctggcgcaaggtgtggcgcgtgtaccagcgcggcatcgagtcctggctggcggagatgttgcagccggtgctggacggcgtggtcaccgactccccggtccccgccatgctcaaggtgtggagtttttttgggggggggggggtcgcgtgggaagggctcagggtcgaggagttgatcccagcaggggactcagtaaggggcaaggctcagcccactggcatcctgtgacgtgggaacacgcctgagggcccctcgtctcctggccatcccccactcctcttccccagctctctgcctgtaagtactgacctccatcccctggggtcacccttcccctggctcgcagcgcatccgcatcatggaggtgaacctggatcacgaggccccctacttctccaacatgaggcgccgctcctcccgcaaggcaagcctgggaggcaggcgcccagacatatgggggtgggattcaaaaggggtggcagaaatcgcgtgtgttgtcgatgttggtgttagcgctcctggcgcctcccctggtgagcaggcttgcccatcccacccgtgcaggactctgatctgtcgggggtcgtagacctgcggtacaccggcggtgcccaggtcgtgctggcgctggaggtcggccagggccgctggaaggccaaggtggggggtatggccgagggttggcctcttgggaccaggatgaagggggttgctgcgtcggtcctgggtgccagacggctcgtgctgcccgattcaagcgtgctcactgttgtgtggcagtggcagggctttccaggccagccgggatgggacgccgacggccccgtcttcaaactccccaaacctgccccctccttccatcccgccctcctcagatcccggtgctggtgtctgacctggacgtggaggccaccgtgtggctcaagctgcggctggcccccatggcgccctacatcggtgcggtgtcctttgccttcgtggggccgcccgccatcaagatccagctggcgccctacggccgcgtgcgcctcatgaacatccccgtcctccaggtgggagtgggccaggttggacgcgtgtgccggggctgggtgctaatgctggtgattgagcgagtctgggtggctcagagggcccgcaggcgccgcgccgtggcctcgttcccatcggctcttccttccaagccccttccacaagttcccctccccgccaacccctcccttggtcacctgcttaccctccactctgcaaacgacactcgcccttcccgcagcccatcctgtcgcggctgctgacggtggcgctgccgggcctcatgactctgccccagcgcctggacatcgacgtcccccccgctgtgaccgcgatcgcggaggccgcggtggggagggacgccatcatgcgcgccgtggcttcggccgtgcttcaggcgagaaactgggaacgtctgtgcgagaaccttgtgccctgcctctgatccttgcaccccgggccggtgtgcccggccgcgacctgctcctcgatgcccgggtccaaaacaaaacacgcctcgctccttcgcctgcctcctcgtctccaggcggatgcgctggagcacgcgctgctggcggcgctgccgctggggccgcagggcgacgctgggggtgtgtcccttcccgatttcttcacgggggagctgcaggtgacgctggtggaggcgcgcgccctccccgtctggggcttcccctggcagagcaacccctactgccgcctgacgctgggcgggcaggcggtgcagtcccggcgggacagcgagacgagccacgcgtcgcgccaccgcgcgcccgcctggaaccaggagttcacctttctggtggaggacccgcgcgtccaggtgaggaaggggtacattctcgggcagggaacatggtccgtcagagctcaccctcctcccccccccccccaaacccccnnnnnnnnnnnnnnnnnnnnnnnnnnnnnnnnnnnnnnnnnnnnnnatgcctcgctgcaggtgctggagatcgtggtccgcgactcgcccatcacgggcaggacggaggtgggcagggtggtcttccccctggcccgcctgccgagcgagggggtgctcaaggcctggctgcccgtggtgaccgacgccacaggcatgttgcctgcgaggggtggagaggggaggagaggggaggagaggggagggggtgcggggctttgggccagggtgttcaggtcgctccagcaccccgacgctgcttggcttcgggggcatgagtcagctttgagtcatcacagtctctggagcctgacaggccaggcgacgccccggcgacgatccacacatgctgttgtcgagtttttgcattgcggcactagatttccagggctgcgccagcctttctagtcccttctcaaaaccacaaagaaaacccacaccgactttgcacacatcgtaggccagccctgcgggggcgcggtcttgctggagatggagtacacgcccttccacgacgagagcgaggccgcggatggcgccgacccgggctccgaccgcgcgggggcacggagcgggggtgggcggccggggtcgcccgccctgccgcccgggccctccgcccaggacattgtggacgtcaagacggcggccagcgcttcctccagggcgcacgtcgccgcctccgccgccatgaccgccgtggcggtgaccaaggtggcggtggggtcgtctcgctttccctatcgccccccgatgatgctcagacatgcttcacaacgcagggcgggcccgcgcggggctgcgtcgccctgcgccgtacccctcctttggctccaccaccaccaccacacacacgcacacacacacagctccccacctccaccacatatcatgcaggccgctgcggcccgcgccgcggcgcgcctggcgcagggcggtgcctccgtgctgggccgggcggggggtgggtcgggggatgacgaggtcgaggctgtcgctggctcaaaggagaccaagacccgcagtacgcccgccgtccccagggccgacgttgggcccggcgccggggggaagtccagcgacgggtctgcagacgaggacggtgccctttcagataaagaacgcccagcggcgccgggcccaggccccgaccctcggggcgtcccgtcgctgccggcttacgccgggcccgccgacgacctacttcccagctcgatgcaaaacggcagtgtgtccgcccccgactccgcgccgtcgccgcgcgggctgcgccagctggccgacgcggcctccagcgtggaggacctggtgcagctgcggggggcgctgcgcctcctgacccaggagatcgacgagctgggcgggtcgggcacggcggggtccacgggcgcggctgcggagctggtggcctccgcggagcgcgaggccacgcaggcggtgctggcgggggacgtggcgggggcggtgcaggccctgcgcttcgccgcccgcgcggtggagaccacgctggcgcaggcgggcgcgcgcggcatgcaggccggcggcgaggggggtgatgggcggtgcgttgagacggaggggtcggacgcgggccgacgaggtgtggacgaggaggccaacagctcggggcgggagccagagttcggagctctccactcttcccaggtcagcggggtgtgggtgggcagcgccgccgaggacgggatgagttcgcgcggcgcggcgctcgacgctctcctggcacggtcgccccaccacgcgcaggcggggttgacgcagagcggcggcgcggcgctgccggctcgcctcgagccaagcgcttcggacctggatcgccggctggcgcgcctggcgcggcgacgcctgccctggtggcggcggtggctgtcctcggacgcacctgcggcgggcggcaagggcggcgtgccgcagggaacgcggcgacgtggcgcggggagcgagccgccgagcagcggcatgccggtggaggcggcggctgccgaggcggcggcggggctggacggtgccgcgccgtcccttgcgggcaggcctgccgctgacgcagacgggggagcacctcctcccatgcccttgatggcagggccgcaccaggagtgtgagggcacgaaggaggagggtgcggcagcagcgcaggccagccttgggccgcagggaggggacactgaaccccggcttcccaaggtgattgcgtgcatgcagctgctgcattgaccaggggcttgatgactaggagtgctggtcgcacaccgaatcatgaccactcgcccttgacactggcataacaacaaccgattcccgctgccctgccatgcagacgaccgagtcagaccagcctgtccccgcgtgggtcgtcttctgggctctgtccgcctcggtcacggccatctacctggccttgctccttcagaacgcacatcacttgaagtagttgacttgccttacaccttctcccccagctttgacgctgctgttcatcttctcaggcacacacggagcaagcagggaaggaagggcatgggctgcgttggtgactacgtgctctgcagtcggcgcgtatgggtctcacaattcaatgcacagcgcagactcccgacgctgatggactgcgggctggatgccctgagtctgcagcgactccgccaaaggacgatggacacaggccttacccttgactctgccctcacagcaacgcctacatgtagagcccaaagtatgtggccaagctgttgccctgtcctccaacagtgatatccgtgcccctgcgcggcaggcggatgccctgcacggtgccacttgtcactgcctgaccctgggggtggcacgcagctttggcgccgatcctgctggctgtcgtttggtagagatcagtgccatctgctgcggggatcaccgccagcatgcctgccagaagcctgatgacagagtcaacagagtcgaatctccgtcctcccaacaccctgtcagttgcagtcagagggatgaacgaggttgtgacccatgtcgcaggcgtggtgcttcttgacaggatgcacgcactggtgggtgggctgcttgaatgattgattgcgctatttgttgaccctgtcagacctggcgatcactagacgctcctcgggcctcattcgcctgtccatcagaccctccagcacttcaagaacatcctctaaggatagttctggctgcattgcgtcgtttgctggagtcttgtcgatgggggaatcggagatcagagtcctcaagctgttaggtgaggaaccacctccttcctcttttcgtgcctgaaagttggcggacgcaatcgacatggcagcgtattgtgagcttccttgaaaacgaattaacagacacttgccaaatatgatctgtagaaaataattatgttcgcttccaaactcgtaaaaggcatcccaagggacactgccgcgcttttaatcgccctcggagtcagagtatgggaagcgaaaaccctcgcaacccaaacgtcgaatcctcgatcttgccggtgttggacaagtcgggtcgccgagtttctcgccctcaatatcatcgtgtatcgaatcgtggctaggatgttcaatcggcaagtccattcttctgctttgtcgagtacgaacagacagactgtcaagaggtgacacgtcccgccgatcctaattaagatccatcgatggccgaaaaggcaaacattgattacgaaactccccttggccgctttctagaagtcttccagctgtgaaactgggtatacgggtgcctgaaattcgggatcaggggacaagtccgcgagctcgcacgcaagcgccacgtggccgacagtttcgggttgatggcacactcgctgcttgtcgtatacagtaatagaaacaggcacaccagaatgaccattgggagatctactcgggagtgtaattgttatttttacctttcccccaaaacggtggccctgctggcttagacgccaatgtatatcacatcgagctccgggttggaccccgttccggctgcggcaaccgcgcgctgctgacgtcctcaccagcgtccctttgtaccacaaaacagcagcctttccgattatgcatgcgcttacaagagaatccaatctcaaaaggcatcgttgtgcccttttcggctgaattagtcgggtggagaagttcatcaggagcgattgccctgtcgcccctttacctaggaccaaccccagcccgcaacaccgccgctttgcgtcgatttgggcaccttttgcataattcgcttctttgtatacatataatcagggatggaggcaaaatccaagcctacggaggagccgcagcccatcaccgcggacatggcgcgcggccccgagtcagggtccgagaccaaagaccaggatctccaggacgtaaaaacggaggaggggaccgatgcaacccccaataagcgttttgggaaagcattcctgcgcgcaacgcccattctgtgtgcgtgacgggatgtgtcctgggtgtgggcgcactgcatggccttctggcagtacttccaagaaggccctcccaaaactttctccctcccaacgcatcccataccctcattgcaggtaccgagctgtgtgagcgcctggcatactatggactatcggtgcgggccatgctgaggggcgcacagcctggggtcgtgtagaagggtgtgccactggtcaattcctcaaccttcccacaggattagagccaaccgcgtcacacgcccctccccacccactgtgcagacgaacatcgtcatgtatctcaccaacaagctcaacctgaccaactctgacgcagctcaatcggtgagtgtgacgctgctgtggtgaattttggagcaataaggctctctggagtgagatggtattctgagatgtacaccacctgcagacacagggaggatgtgctggcactggcctcgctacccacgaatggctgccagacctcggagccgcccctgccccactattcgccttccctccaaccgctgccaggtctccgcctggattggtacctgctatgtgacgcccatcgtcggtgcctggctggcagacacctacacgggacgcttctggacgatcctgagtttctgcagcgtgtacctggtggtgagcaaagcgcatggcaggctttgtggtgggaggtgaaagaggcacgcaatggacagtgggcgccccaagtggccgaggtacccctgcgaggagagggcgggtgagcgggagccttatctcgaagtgttctcgtcactgatgcccctcaccagagccgggccggcttcagacggagcaaaagcttcccaccctcattcttcccttcctgcagggcctggtcggcctgacggtgtccgcgggggtcccctctctcaccccacctgacggcgtggcccccagcagctaccagacgggcttcttctgggccttcatggtgggcgttgagggagcaggggctgatgcaaggagcgtagccatggcaggttgagctgtgatgcagggcgcaggggcccctgcgccgacgaacccctcaaccaaacctctgtccccccctccccccagtatctggtctccatcggcacgggcggcatcaagccctgcgtctccgtgtttggcgccgaccagtttgacgagggcaaccccgaggagctggccctcatcccacgcttctacaactggttctacgcctttgtcaacatcggcagcttttttgccagcacgctcgtggtctgggtccagaccgacgtcaggtgggccggcggagggttcacctggcggggcaagctcacttcgcaaccctggccgccctggggtcagagaggagggggcctgcggccctcacacgcaggggcatggagcgtggtgggtggggtgccgtggcactgctcaccgctcgggtgcagcgcagccctccccctaacgcatggctgaccgcccagggctccagtgccccaccccgacactcccctgaccgccacgcagctggatgatcggcttcctgatccctaccatctcctttgccatcgccatcatctgcttcgtatcagggtccaggtggtaccgtcgctgcccgcccggtggcagccccatcaaccgctggttccgcgtcctcgccggcgcctgcgcccattggagggccaaagtgccccacgatgcccgcctggtgggtggcggccctggcagtcccggctccagtgggtgggagggggtgggggaaacactcgccaggggagaggtcagctcaggccccttgccttgcccaggaagcctcgggacatttgctaatcgctggcttcctgagactgccggcaaatgtccatcccaatgctccaccccaccctgcatcacgtctccccctatccgatcctcctgtcttcccaaccccgtccgctctcctccccccccctttcccagctgcacgaggtggacacgcccatgannnnnnnnnngtccctggccagaccaagatgatccacacgcccgacttccgttggctggacaaggcggccacggcgactgaggcccccggcgtgcgggatcgctggctggtgaccgtcacggaggtggaggagctgaagtgtgtggtgcgcctgatccctttcatggtgatcctcgccgtctactttgcaacctatgcccagatgtccaccctcttcgtcctgcaaggctccgccatgaaccgccacctgggctcctgggcggtgccccccgccatcatctccaccctggacatcatctctgtcctcatctgggtccccatctacgacctggtcatcgacccctacttcaagcgcatcggccgccccatctcccgcctcctgcgcatgggcatcggctttggcatcgccatcatgtccatggtctttgccgcgctggtggaggtgttccgcctcaaggcggtcagggccaacaacctgcaggtcggtgtcagcgggtgtttgtgggggaatcaggcaggttgaaagagggtcgagagacggtggcgcgggccacagggcatgctcctccgtcagggccacaacacccctgctgcaccgcgtaggagggggtgggcacaggcgcgtgcacgacaccgtcaccgcatgcaatccctgaatcctggctgcatcttggcctgctcacggcgtgggacaagcgcggccgccaaggcctccaagcccgctcgcccaccatatgcaagtcgtacatccctgacgtcctgccgcacgtcctcatgctgaacttgtgcacacccaccacaccccctcccactgcacccaccttccccatcccttctcctctgatgcaccagaacgtggatcccagcgacaactcggtgcccatgtcggtgtggtggcaggtcccgcagtactttgccgtgggcatggccgaggtgtttgcctccgtcggggcgctggagttcttctactcccagtccccagaggcgatgcgctccatggcctctgcactcaacctcatcgccatagcgatgggaagctacctctccacaggcctggtgagggcagggaagcgcactagggggcgaggcagcgacagtcctggggctgcagagaaacagggctctggctgacaggctctgggtgctagcttgtgctagcaaaggacggctccactgcggcctgggtgcctcttgcccacattcccctatcaatgtcaggctgccaccgtgaacatgcgcaggttgccatcgttgccgccatcaccaccaagaatggagctcccggctgggtggcggtgagtttgggaagggagttggagggcctcctgagggggtccaatccccagacgtagtaggctaaaacgtatgagcacctcagcctggcgtgctttctctgccccacagaacaatctcaaccaaggccacctggactacttctttgcaatgctggccgtgctcatggtgaggctgggtgtgtaggagagtgggggactgcagacccgtgccagggggaccaagggctgcatgcagtgagatgttttccattctcggagtgttcacatggccgctgggatgactagggtggttgaccccccctcaagcctttgtggcacgtggccctatcccgtttctttacctccgcagtgcatcgcgatcctggtctacatcccgatttgctacaattatcgctaccgccaagacccctccgtcggcctcgccctggcatccaccgaggacatggagcgggcgctcggacgtgcttcagtgggggctcccaatctggtgagcgacgtgagggtgttttcgtgcacagcctcaagtgtgcatcagaatccaatgtcggttgcggccgtaaaaaaggcagtcattcgcccatcattgctccctcctggccgtaattctatttatccagaccgaatatctgaccgttggccaggcaccatcatcataccttgtcgtatacattcatgtcacacagacgctcatctcttcacgcatcaacgtctcccgtgaactaaagaggacctccgccgtccccgcacttcatgcgcacgagatatcctacaagtccctccgtctccaggactgatccctcaatgcatgagtggaggcgctgcatctccactcacatcctcatgcaccaaaacagcatctacgcaataaacccaagttctcagttttcgtttcaaaatgcgaactccatcttttttgattggctgtagggttcaaggccatagctctgcatcacaagtgttagtactgttaatggacaaggttccaaattttaaatttgagtggtcaaggaagctgttagacacgcaggagagacttccccgtgagaatcattgaaggactacctacagctcccgactgctgttgacgtgttgcttgccccccacctagcacctggagccggtcagccttttctctcgggacgatccgccgcaaatccgcgcatctcaccttccgatatactctccaagagcagccaggcgtcaagtacatcctttccgcatggcaagatacatgtctcagaggccacatagctccgcatatttcgcagagcaaagggttgggtttttggcaaagcgtgcttgtgtcgagcttgtgtgtccatctggcgccgggcatcccaaatctacgtaaaaatcatggccccgagaattctcgcgcttgctgccgcggtgctgtgcacgatcattacatgtgcaggagcccctgtgaacaggtaagtaactccgtttacaggttttttgttcgacgcatgggggtgttgctggatgcctggcatgtggggaaggatccgcgccttgatgggagctgcgcagaggctcggtgcgacttcccggtcagccgtacacgatgcgtcagcccgcagaatgtcggtacgatatacgaagctcatggctccttccctcctaacccagtcctacttcggggccaccgatcttcgtggcgagtggggaagcctatggatctgctcgaggtgtcggtgcgagtgccggatcctccgcggctgcgacgagctcggacaca

SEQ ID NO: 17852 - DNA, 225 bp, Chlorella protothecoides
aaaaaaaaatgtcatgggagtatttcattgcgtgcaggtgcgcaagcggctcgatggcgcttacatagaaaacaacactttctttatatttgtagtggcctttcagggcatatacgaacattaaatagacaatcgcaatttataaaaatatgtgaaacttataatttacattacaaagttcctgagactttaagatatgaaaatgcttggttttcaggttttttt

SEQ ID NO: 17853 - DNA, 184 bp, Chlorella protothecoides
atgattcaaaattattttgaatcatttgaagggcggcatagccaagtggtaaggcaaaggattgcaaatccttcatttcctcagttcaagtctgagtgccgcctatattatatttaactaccaactaaaaaatgacattagttatcgctcttactttttttgtacaagttacgccttatatata

SEQ ID NO: 17854 - DNA, 61 bp, Chlorella protothecoides
ggggtcgccctccggcccgcgacatacccggcaatgcaccgtgatcccgcactctcaccgg

SEQ ID NO: 17855 - DNA, 638 bp, Chlorella protothecoides
aacagccataatgattttggatcttttttataattgtttcttttgcgagttattattttaaagtggtccagatataccttgtttgcgaatcattaaaaaatgcattagcataaacacggctgtaaaaagaggtaatacaaaagtatgtaaactgtaaaaacgtgttaatgtggattgaccaacagcaacacccccacgtaaaagttcaacaacacctggccctattactggaatagcatctggaacaccagttacaattttaacagcccaatacccgatctgatcccacggtaaagaataacccgttaccccaaatgaaacagtacatacggccattaatacaccagttacccaagttaattcgcgtggttttttaaagccaccagttagataaacacgaaaaatatgaagaatcatcatcaaaaccatcatacttgctgaccatctatgaatagaacgaattaaccaaccaaaattaacttgcgtcattaaatattgaacagaagtaaaagcttcagctactgtcggtcgataataaaaagtcatcgcaaatcctgtagctacttgaactaaaaagcaagtaaatgttattccaccaaagcaataaaaaatattaacgtgtggtggtacatatttac

SEQ ID NO: 17856 - DNA, 298 bp, Chlorella protothecoides
ttcgtttattttacttcgtatatacttcgtacatactttgtacatacttcgtacacctaagaatacgttataaaacgagttttcactggtaatttggaatctgctagtcttgcagcttgtttggctaattgagcagaaacaccatcaaattcaaataaaatagcgcctcgtttcactcgacatacccagtattgaggggcccctttacctttacccatacgaacttctgcgggtttttcagatactgcaatatcagggaatactctaatccaaacaatacctaatctcttaaattttc

SEQ ID NO: 17857 - DNA, 254 bp, Chlorella protothecoides
aaaaaaaatttttgaaattacacaaacttataatgagcaaagcattagagcaattactaatttaattgcagatttttgcagtattttcagtatatttattatattctcttcgatgaaacctcaaatgattattttgcaatcatttttggcggaatctctctatagttttagtgatactacaaaatcctttttattaattttagggacagatttacttgttggttttcattcaccaagaggttggaatatttttt

SEQ ID NO: 17858 - DNA, 190 bp, Chlorella protothecoides
acattattaatcattttattctagcatattatggtaagtagcaacagtagaaggagatattctatttaaagatctaaagacccaatatttaaaaattgtatctaaaaaaactggaaatgttgatacaaatagcgataaaaatagactactctcagaaaagccaaaatgtataaaaatccactttaaaaaa

SEQ ID NO: 17859 - DNA, 71 bp, Chlorella protothecoides
gaggctaccacaggctggtgctgctcttgctgctcatcctcgccgtcctcaccatatgcctgtgtcgcatt

SEQ ID NO: 17860 - DNA, 78 bp, Chlorella protothecoides
ataaaaaagctagttgaagactattttaatattaaagttttggcggtaaatacacaccgaccaccacgaaaattaaaa

SEQ ID NO: 17861 - DNA, 245 bp, Chlorella protothecoides
agatgcacaggacttttggtgctcatcggcaaggcatgctgccatgctggaccggataactctgggcgcgccatgaaggacaccatttagggacggcatgattttctgcactcggtgagaagtacttcccaacagggagaatcaatcaccgagtgatcccagagcgtagaagttatgtgctcccaccacttgaagatttgacaaggaactcaattaagcagaagtttcccagttgtgctcacgta

SEQ ID NO: 17862 - DNA, 167 bp, Chlorella protothecoides
cttgtggcccttctggatgaagcatggaccactgctcactactcagctcgtccagacagacgcatgtgccacactgctccctgtcaaccccacaattgcccagatgacaaaattgcgggaacaggtaaggctgctgcagtgcagatcaactgctgagaattgcggcc

SEQ ID NO: 17863 - DNA, 252 bp, Chlorella protothecoides
caagagggggactgaagcacaatgaatcctggttgccagtgtagatgtcataccaccctcgggtcgaatgcatgcaggctcttgctggcgaatgccaagttggacagcaccagcttagactttggttttgcgcgttggcacacgggtcaacataccacgctgcagttgtgaaatgactccctggggtacatggagtgtgtccttctttagcacaattgggacggtctcgatatcgccaacgtcttcctgatg

SEQ ID NO: 17864 - DNA, 240 bp, Chlorella protothecoides
ttttttatgctttaagattaacagactatcataaaataattgtacagctacagattttttaccatctatcattaataaattaataaatttattactattgattacagtatttcttgtagtcccgtattgtttttgaccgttcatataatttatttattatatcgtttattttttaaataagacactaataatgctttgttttgtctaaaataaattggatctattatatccatttttttt

SEQ ID NO: 17865 - DNA, 76 bp, Chlorella protothecoides
gcaggaagggtacaagtcatgcacatggaattttgtcgagagaaatatctcactgggtgggctggaggtctcgagt

SEQ ID NO: 17866 - DNA, 279 bp, Chlorella protothecoides
tgatagatataacattagttggtatgtaagctgaaacgtcaccttcctgtgtttctactactggaagtgctgtcatacttccaccacctaacttatcactaagtttagcagctcgttctaaaagacgtgaatgtagataaaaaacatctcccggataagcttcacgacccggaggtcgtcttaataataaagacatttcgcggtatgcttgtgcttgttttgttaaatcatcataaataacaagagtatgctgtccattatacataaagaactcagcta

SEQ ID NO: 17867 - DNA, 148 bp, Chlorella protothecoides
ctggcggagcagcgataaaagcgataataaaaacagtagttgctgttaataatgtagggatcataagaacaccaaaccaaccaacatataagcggttttcagtgcttgttacccactcacaaaaacgagcccaaaagctagctctttc

SEQ ID NO: 17868 - DNA, 76 bp, Chlorella protothecoides
aacacaccatcgagttgaaggaggggacgcaccccatcgcgcgcgcgccctacaggaccgcgccgccggcggcgca

SEQ ID NO: 17869 - DNA, 86 bp, Chlorella protothecoides
catcaggtcatcggcccgcggcagcgggtagcggttcttgatggtcgccttgttgagcgcgcggtagtcgacgcacatccgctgcg

SEQ ID NO: 17870 - DNA, 312 bp, Chlorella protothecoides
ccagatacaaagtacggataagtatctaaaatttcaccacctggaccaacaccataacctaatgtagcaagatggggtaaaagtattaaaccttgctcgtacattggtttttctggtacaaagtgagcaacttcatataaattcattgcccctgcccaaaatacaattaatcctgcgtgtgcaacgtgtgcacctaataatttaccagaaaggttaattaagcgggcattacctgcccaccatgcaaaaccagtagattcttgatcacgtccaccgattaccaaactactattaaagagcgtttccacgtgg

SEQ ID NO: 17871 - DNA, 173 bp, Chlorella protothecoides
tccattagggagatgttactaaataagctggttaactatcaagcagattcactatcatacatatttactaaaagatatatgttatagtttattttatatacttttttataatttatattgtaagagtgttagttaatcaaaaagcagggaaaaaatagattataaatacctac

SEQ ID NO: 17872 - DNA, 448 bp, Chlorella protothecoides
gaatttcgctaccttaggactgttagagttacagccgccgtttactggacattaatttaaaagctggaatttgttttatttttgcaaataaaacagcatcaaacctctccacttaagtttccagcaccgggcaggtgtcagaccctatacgtcgcgttaccgctttgcagagtcctgtgtttttattaaacagtcgttactccctattttgtgccaccacttaaatacctataacaggtatttctacatggtcctccttatcccgaagttacggaggcaatttgccgagttcctttaatatggttctctctacgccttagtatattctactcatcctccagtgtcggaaagtacggtgtctaaatcttatttctaattaaagaaacaagctactacttttttcctggaataggtatatttcaaaagaaatccgtttatcttttaaaat

SEQ ID NO: 17873 - DNA, 71 bp, Chlorella protothecoides
tttaaaatttcttgatgtatactatattacgaatagtacctattttaaaagataaacggatttcttttgaa

SEQ ID NO: 17874 - DNA, 335 bp, Chlorella protothecoides
ttaatattggaatataaagaagttttgcagtattttggtgagcatttaacgcagcagatattttcgccatttgcattaaacttaagatgccttcttgcatacgggcaccaccagacgcgcaaaatattattaaagtaagtccttgtgctgttgcatattctattaagcgagtaattttttctccaacaacagaacccatacttccacccataaaagtaaaatccataattccaacagcaatgggaataccttctataaagccagttcctgtttgtatagcatcctgtaatcctgtttgttcttgcgattcttttaatctttcactatattttttt

SEQ ID NO: 17875 - DNA, 432 bp, Chlorella protothecoides
aagattttaccaaaggatttaaagatgttgttgatattgcttcattagctgatgaattattagacacacttttatatttacgtggaatgataacaaatcctgctctggcacaacgtgcacaaagtttattattagtaggtcctccgggtacaggaaaaactttattagttcatgcattagctcacgaagcaaaagttcctgttctcacattaacggccaaaggaagtaaagagcctgcagcctttgagcgtttatttacagaagctcataaactatcaccgtgtattgtatttcttgatgaagtagattcaatcgcatctgtacgatctggtatggatccttctgaacatttgatgaaagtcattcgtcaaggtttagatagttcgtctaatttagctagaagatccagaaccgataatgcagttcctgaaa

SEQ ID NO: 17876 - DNA, 103 bp, Chlorella protothecoides
tataggaataatctatatagacagatatagcaataatctatcttatttaaaacgagtaaaattattaaagaaatttatgtacatttagtggatgcctagacaa

SEQ ID NO: 17877 - DNA, 73 bp, Chlorella protothecoides
tcccgacgagggcgctttgaatgtttttaatgattcatcggaaaataccccaacgcctcctgtatgaaacgtt

SEQ ID NO: 17878 - DNA, 137 bp, Chlorella protothecoides
tccggcaggtttaattacagtgccttttattgaaaatattaataaattccaaaatccatttcgccgtcctgttgctacgacagtatttttagttggtactgttgcagcaatttggttaggtattggtgctgctttac

SEQ ID NO: 17879 - DNA, 220 bp, Chlorella protothecoides
attttgaatcatttgaaagagtgttcagatttagaataggtgagtaaacccacctatagaaccctcgtggttttatcagcttagaatgttgctccttttcagtccttacataatttcaagctagttaccgcagagtactaaatcatatttacaatactacttttagtaataataatttgtcaagtaacaaaaaacatacattacaataaatattaaaata

SEQ ID NO: 17880 - DNA, 858 bp, Chlorella protothecoides
cccccgcagaccggtggctggtcgtcagcgcacgatgagtatgaggtcgattacgtagcacccctgaacttccggccttggagttatcgggacctgtcaaccggcgagctcctctcgcgtccagacccttcgaatctgcttggtgctcaaggggcacgcggtgccaccgacctcatgaatgatgatctaccagcgccatggcgagcagatgccgctctctttagagttctaccgagactgaatcaagcagagcagtccttcctgatcaaattgttccagaggtaccattctactggggcccggccaaggatttctagcttggcggcctaccacgagttactccaggacctcccggtacggatgatcttcctgcaaggccaaatgtccttgaagcacggatgtcctactccgtcttgcgtgttccacatgtggaagtgttcggtctatcacacgcatcgcctcgttgccaacccaccatgcatctttcctccgcatggggttcccttgcacattgaaaggattcgttccgtgcccccgcaggcatttaagacgactagcctgttggtcaaggatggcatcgagtatcaggtttcacacgtggagagtgtcgagaagatcattgagcatgctctgagaattgacggggtgagttcacgcattgtgcgctggctcttggtgacgaaggcgagcatagcttgcgagtcgacgttcaccttcaactgtgcactactgcattctgtctgtcatactgggaagtcctgtggcgggttgaagggatgggaacaggaagggaggggggttattggtgttgggggtgtatggtgtggggattgtgtgtgtgtgtgtgggggggggggg

SEQ ID NO: 17881 - DNA, 256 bp, Chlorella protothecoides
tagctgcatgtgttgcatcaccaaataccacagcttttttccctgttaaattttgacaatcaatagaacgcgaaaaccacgcagcttgggatacaaatcttgtttgttgatcaatatatttttctgtattaaattctatatcagggttgtggtttttaataatagtagaaatttcacgaatacaattagctgtatctacgatacccattggggttattccaacataaggcatggaatattcgttttgtaaataatt

SEQ ID NO: 17882 - DNA, 80 bp, Chlorella protothecoides
taaataaccctgagatccgtgttgagttcagagcgttttactgcgtgcgaggcagagagtcagcaaccgtacgggtgaat

SEQ ID NO: 17883 - DNA, 8436 bp, Chlorella protothecoides
cccccaccctcccccctccctgcctccccgcagcgcaagtgcgacgcctactaccgcgcgcagctggagcggcgctgggagcacggcaggatcgaggagtacgagagcgtggacaacgccgatttccatgtcggcatcatggggctgggcgtgctgggcggcgccctggccgaggcgctgctgcgcaacggctaccccgtcagcgcctggacgcgctcgcgccgcaccgagccccggttcccatgccacgcagggcgcggggagctgcccgccttcctctcttgcgtgaacgtcctagtctgcctcatgcccatcacggcagagacggagggcatgctgaacgccgacctgctgcgactgctgccgtgcggggcctacctcattaacgccgggcgtggggccatccaggtggaggcagacctggtcgccgccctggatgaggggcaggtgggtggctgtgtggattttttgggggccctcttggcgacgaaggtgctgggtgtgggtgttgttgcagactgcgcaatggagagaagatcgaaaacctgagtagctgggttccaagatctacactacgcccctgacccccggccagttgtacccggcaggctgaccaccatctcccatcagacacccggggctccctcaatccatgcacacagctggcgggcgtggtgctggacgtgtttgagcgggagccgctggaggaagagtcgccgctgtggacgcacccaggcgtccgcgtgttcccccacgtctcctccttcacgcccagggacgccggggtcaagcaggtgctggagaactgggcactggtcaaggccggcaaggaggtgcccccggagcggcacatgcagcgccagagggggtactgagggcgaggcctggcagggcatggcctggaggaagggaaggggggggagatcccgcatcccgggttgacggcaccagagtccgtgccccggtgctgcctggtgggacgacgacacccaaccaccctgcatccggatgcacatgtgtgacctcgtctgcttcctgtccattgtttgcccagtgtggattgctgagcgagtttgcaatggcagtttgggctgatggccctgcctcccatgcacgctatagattcgttctactccaggatgtgggcaaatctaagaagcaggagctagatgcatgtgtgtattgccatccggccagctgccgttgtccagggggtccaaactggtcctccactccaggctgacacccttgactgtgtggaatgctgtgttcccagaagagggcggctgtcacacagtggcggaatggggatagaacagaagttgtctgtcaaggtgtgagccagagaaggtctctgttgcacaagttgggcctcaagcggtgccccatccgacagccatcacgccgccgcccggcactccgttggcctaccacgcctcgtccacgccaatcgcatcggtgtatgccgtgccctgggccatcacctgcccgagtacatccccctccgtcagcaggaggagcgggggcgggggggcgtcgggcgccggggccgggccggcggcggtgatgcggtatgcgactgccgtcagcggcgcgctcgcagacttggccacctggacgtacctcgaccctggcggggtcggtgggaggaggttgaaggaccatcaagggttctgggtggaagggcggggttggacaccggtctgaatgctcagaacagtgcctccagactcctgcgctcacgaccgcccaatggcccagcggacactggcaatctcgggaccccctcaaaccccccggacccctcaccaccctccagctggtggagcatgaggcgcgtgttcacggcgtgcgcccacagcgggcccagcgcagccgccacgcccccgccgcccgcgcccgccacctggttggtgaccagcaccgggatgccgcggcgccgggacagggccttgagtcgcgccgcgacggccgccagctgctgctgccgggcaacgacgcccttgaccccggggccgtggtcgaggcgggccagctgggcgacgctgtccacgaggacgagggagagggggagggggctggcctccagggcctgcagccgggccaggagctcgtgggaatggcggggtcgcagcaccagcaccgactccagcagccgctccttgtctccgggggcgagccggccctctggactacgctgccgcgcgatctcctccaggctgcgtgcatgtgggagggtggagtggggcgggttggtgggcttgggcatgccgaggattcggcctggggagggtatgtgctcatcaaatggatgggaaagtgcgattttcttagactactctgctcgagactgttgatcacacaaggatgtcagggatggggatctggagcgccgtggcagtgcaggccatgctgcagcagtctgctggtacccacccaaggcaaactttttgggagtccgatcagagggcagatgtgcatagcattacaataatggtgcaggaccccatgacaagcagcagcagaaaacctctcagcaccttaccgaagagagctgaacttctgctctgtgtcgatgtacaggacctgggctccagcgaggatgggggtcgagcagcagatgtctgccgcagccgccaggcaaaactgtggagcgaggacggggcaatgtaggatgcagttgatctgggtcgcatggggaacacttttcaccagctgttcccagcggcctcccggtcagaaaattatttgaacccagcaggaaaccacgcagtctatcaatcggacagagtgactgagcgaggcctcccccaacttcagagagattgcctccccatgccaggcacagcctgcatttcttggtctcccggttcctctccatacctgcgtttttcccagtcctgcaggaggagggccgggaattgcattcaaccttgccaatgcacttgatgtcagcatccaacggcaagggggatacaaccctcttccttgtacagcccacaagcagtgagatgcagggcacctgctcacccgctggccccacgatctcggtaacgctgccgcatgggaagccgccgtgcagagcacgatccaggtcgggaagacgcgtgggcagggggtgcgctgcgtcgccctgttggcgcagcatggcgctggcctggtgggaagggtggcggtggctggctttggcggggaaggcccgggaggccggcctgcaataggcgtgtcctgcggcagatcatcatccctcgacgggcttgcccaacgacccccctcccctcaccgtcaccaagggtggggcggtaagctgcgccacctgctcccgcaggcgctggaccacatggtagggcacgtccaaggactctaccaggtcaagggtggtgcgcgtgtagaagtcgtgggccgtgtgaatgcccgaggcgttgaggcgaggttgcagctcgcccagcaggccgggtccggtcagcagtctgcgagcctgcatggtgtgagtgtcgggcaatctcgaaatcgttgtcaacgtaataacagcacatgcatgtgagtttgggccgttggacctggttaaagcacaccatgggcgtcgatggcccctgtgaatctcagcgtccgcccacgggggtgctcccccttcgcatgttttgcaggcccttcttctgattattgtgagtagaattcatagtgacgagcatgacatggcagcccagcccagatcacatacccgctgaggcatggcagcccgcctgtcgcatagaggtttgtacgaggggtccgccgagtttccttttaccacccagccacgcccatcgacagcgacacaccactcccctaacagcaccaggaagaagattggcccggggcgcattcatgcttgtccttgtatattgcctcggaagcctgtactcgctcaattctatgtaaacatgaagcttgttcccattacatatgttcttcacacgtccaagtctgcctgcgggttcggcgagcccagtgcagcgaagaggagcgcagacaccagctgctgactgctatcggataaggtctaatccttcttggctgacacctatgctccatgtattgcagaatcaggcggggatctcttccttctcaagggtagtagtgttcagggactgctggatggtgtcgatggtcgagttgagctgcgcaatctggtctgccaggttctgcttggaggtctctgcgtggttttggatgtgggggcctagatttgagcatagccaaccatggtgccagcgcgaaaaagagcaccacagcccgagattaccctcctcccccgccacatccacaacatccaaacccctccccccctagccttctgtcccgctccagcctcacctgggtccacatcctgctcctccaggaaacgtggcaggcgcagcttctggtcttctcccagcagcgccttggagatctaacgagaacgggagaatgtgttaatgtgaggtgcccgccatgtattaagctgcaaggcgggcgtatggagatatgatacttgcagccagacaccgcagaggtgcctcttgctccaggtatggcgtctcacctggggtgcaaaaacgtagcccagagccccaaagactgcgccccctacgaaaacgccagaccagaagccgccggcaccgtccctctcagctctgggagaagggatgtgcgatacatgttggatggctattgaaatgggtgttaaaggggaacaacagcggccagataggcataccttgggtgactgccaaccctgccaccaggccccggtgcctcgagcatcatcccgttgccgccacgcccatctttcggctcgcccaccttgagacaatatgggaccttcggggggcgggtgcgggcctggagagcgcggcgggcctagcgccgaagacgtgggactgcttgcggaagcctgcaggggtgtggggtggagggtgagtgccgcgaccctccgcagagggtcagccacaccggcgagcttccgcacccatccaccacatccactcactcagcccggtggaggggcgggcacttagggtctgcatggagctctgcacagtgacaaccgcagatcaccggaaagggaagcgacgagaccagggatccctgggctgggcagatgttcagtttgggtaatgcctctgacaccagtatgagcctttgggatggtgggcacggagctgataccgcactgcatcctgccagattgtcgtgcgtctcgggggagcagcatgcacgccgtgaggtgccgacgatgatgatgctcctcccattatgatgtcgcgggtcccccccgcttacactcaggtcatgttgggtctcggcttcagatccattccatcggacggaacagggtcctggagattgtgctgccttgcgagtcggcgtggtgctttgccacctgcgttcagctgcatccccccagcggtgctaggggcccgggagttcacccgcaggctcaccccagcatccctccgcatgacggcgacacagaagccctccacccatgtggatctggatgagtgcatgcgggtggcactggaggcggcaacagcggctggcagcatcatcagggaggcctgggacaagcctcgccaggtccacctgaagagtgagcttgggctgtggctgtgggaggctcccagatgatggatccggtgtggtatgcctgccccgcgacacctgtagtacgcgctccgcacagccagcgtggatctggtgacggagacggacaagcagtgcgaggaggagatatactcccgcctgcgggccgccttccccgaccatgcgttcattggggaggagggctctgccagccaggggttcaccgcggagctcacagatgcccccacatggctggtggaccccgtggacggtgagtcggcgatttcgtttgggtatgtgaggtggggcagtgctcactcgacaaccaaccctggtcgatgtctggccaccacgcactgctgttggcgtgtgggctggcacgttctttgttgtgtacgtagggaacggctactgcgatcaacataattacctgcctcaggcccggctcgcagctgcatgaaatgcgccatgccccttccaggctcaaagtgcatccatgattcccctgtttcctcctcagaaccctcccccttcccccttcccttcttgcacacacacaggcacgaccaacttcgtgcatcgctaccccttcacctgcgtcagcatcggcctggcggtgggcggcgcccccgtgctgggcgtggtggccaatcccatcctgggcgaggtgtaccgcgcgatgcgcggcggcggcgctttcttgaacaacgagcccatccacgtgtcggccaccccggacctccagtcggcgctgttcgccacggagctgggcatccggcgcgacgacgccttcctggacgcagcctttgcgaggatcagggagctgctgcgcggcgcgcgcagcgtgcgctgcggcggctcctgcgccctcaatctctgcagcgtcgcgcagggcaggcgcggcaggcggggatcggcggtggcgtggttgtgtgtgggaggggggggatggagggcagggccttaccgtttcggtgttgcgctggtggtgtgcattgacccaccgtgatgtttattgccgtggggttcaggatcttcaagctcacctgtgccccgcacgcagcccatacatactttgccaatttcccctccccccccctcccccctctccctgccatcctgcaggctggacgccttctttgagctgggcttgggcggcccgtgggacatggccgctggcgccgtcatcctggaggaagctgggggaaaggtgctggacccggcaggtgagggacattcaggggtcatggggcaacatccaggagtgctgcaagggcctggcaccattcctctgtttcctgcatgcagtgatttgcggccgggggcatgctgcgtcagccagccaccgggtgagcaggcgtgtcatgccgggtcctgcgtcgaccgccctgaccgcggcatccccgcaggcggccccttcaacgtcatgagccggcgcgtgctgggtaccaacgggcacctggcagcgcaggtgagctccatcctcgcggcgtgccctcttgccgagggcgagccgcgaccactggactgaggctgcgggggaggatcagcctcctgggaaggctgggagcgtggttggtgcgagtgggaccgtgcccgagcgaaatctttgacccgagcgatctggaaagcaagggagaggccctcccttccggaagtccagagtcccagctaaattcgccctcgatgtcccagcactgcgcctgcctgcatcttctgcgcaagtaataacttttgaacaacattattgtaaagttccaattcaaaggataccggctctgactgcctcaactacagcactctgtgtcgggcccttccacgtaaatccatcatactccgacctgccggccctcccgcgggcccattcctgcgcgaatgcagctcgactgaatcatcatgaccactctggttctggcacacgaggctggaggtccttcccgacaccttcccgtgacggggaggccctggttgaatctgtatggtgtgaggctccgggcaccagagacccaccacgtcgcgctgcaggcaagccatggcatgcgcggcatgccgtctcaggaatggtttcgaacatcttgaagggcccaacacctgcccatgcgccttccgcctcatctgccctactgcatccctgaccccccctcccccccccacccctggtgacagggtgacgcagccctcatccagcgcctcctgcccgacgaactcctgctggcaatcctctccaagctccccgcctctggcctgggggtggccagctgcgtctgcacgcagtggcaccgcgttgcccgcgaccccagcctctggcaggcgctgtgccaggaggccttcggccgcacgctggaccggtccgcgctgctgacgcaggtgcgcaacccgcacggcggcagctggcgggccatgtacctggaccggccccgcctgcggtacgacggcgtgtactgctcgcgcaacacctacatcaagcagggcatccgggagtgggcggtgcagaacgcggtgcacatggtgtgctacttcaggtactaccgcttctgcgccgacggtgagttggccagggggaggaggaggagctgaggctgggccgggaggtgtggtggcgtggtcaggggggggtcattgcgcagtgcatgccagcgacggggccgagcagtgtgacgaggtttgtggccggacagtacgtggggagcgaccctttacagacaatgcagctgcagttgcagacggcttcatgggcagggcacgtcctatcacacacttgcacccctgcgcgacgacttgcacccccaacctcttccaccccttcgccaaggactgccccccccccca

SEQ ID NO: 17884 - DNA, 78 bp, Chlorella protothecoides
caccagcacaaagaggtgtcaacgtctcgctgccaacacctatgaaataatccacacccgaagccacacctgtcttga

SEQ ID NO: 17885 - DNA, 618 bp, Chlorella protothecoides
cgataaaaacccatatgttgttattacggaaacacaagattctgtaaggagaatcgaacagagtgtcgaccagttacaacaagtcactcgtgaaatactacatacgataaaaacaaaaaggagagataaacaaaatactttacccctaaggcaaccagctaacaatgatgtctacttttatcttatgagtctacaaagagaatttaaagaaaaaaatttacaatattctagattcagagttgcagttactctattgtgggctgctggattgagggtaaatgaaattcgaaacattacacaggatgatattgattcaattatacatcacaaatctttacaagtctatcaacctaagactaataaatatagattaatactttttaccaaacaaagttgtgatcagtttagagcacttgaaaatgagtgtactattgtttttaacaagtattctacattatctggaggcatcgccgaaaatagttggatttattttattaatagtagattgttagagaagactcgacacctaggactcaatattaaatcacactcttttcgagttaattttgtaacatcactcttaaaacatgcacctttacaaattgtatcaaatttaat

SEQ ID NO: 17886 - DNA, 71 bp, Chlorella protothecoides
tcaacaatgcctcccgcatgtgagatggagcggcatgaggcttacgacatgcgcagggtcttgcatgtcaa

SEQ ID NO: 17887 - DNA, 1317 bp, Chlorella protothecoides
tcttggacctcgggcctctcgcatgttgctgcaatgtcagggcgggagaaaaatggtcaggtacactggacgttgctcccagcccaaacctcctgacggtgccagccatggatctcaagatgacttctatgtagaagcgtgcacagagagatgcatcagcaagctggtgcggatgatggaatgatggggccttgctgtggcaccgggatgagacgcccagggcggtgcgctgcagcagagacattgcgcaccccatgcagtccacccttcggtgatgctgcagtctgccggcctccctgcacggcttcccactcgcggtctatgccaggaacaaatgacgcaattttgtgcccgaggaggcaccacatgatatggtcagtaaggtctaggcatggcgtggggcagttactggtgatgccatcgggcggtccgtgtctggggcacgggaatccatgaatcacacaccctgcaaatttgtcatctcaatattcgattcgtgcccctccctcccccctcccttccacacgtccctgggagataagatatgtgcgccgagaaggctcgcgtaattccagaagccactcttcactgcactttttgtcgcggcctggaaaccacatcttcttcttcgccggtcgcatgtgcccgcgcgctggcttttgactattctggagtcaacggcatgctgtactggttgagaggtgtgagcccctctgattctgcattttcattttatgaagaccaaacttgtcgacaagttgtacctcgaccaggggaggacgcgatcgcgggggatgcagtgtgagcatcgggctccagatcggggaatggatcccgcatgcatcgggggtgcaccagagatggcatccataccccgccccctgcttgccaaaagacattttggataaaaggggtgtggaggaggtatggtacggctaggggacatctgggttcattgactagcattacctttgttgcattggctgagcctcacgcctatcaatcctgtatgacatgctcctgtgttgaggccagtgcacccttccccctcttgtttccagccccattaccttgccgcacagcgccctgagccctttcttcctgacttggagtcttgggcgaccctttcaaagttttgcctgtttatgacctattctccaagcggctctgctgtcaaagtcagtgccccctggggtttgttatacatgggcatcatgataccctggggtgcacacttgtgggacccgagccatccaacctctggcactctctccaggtgcgtctggtggaaccccagccgcaaccactcacaacaac

SEQ ID NO: 17888 - DNA, 103 bp, Chlorella protothecoides
caaatttaatgtctcgtctttatttggataatatctatcgtattttacagtagtgctgatattagtatgtcctattaaatttgatacaatttgtaaaggtgca

SEQ ID NO: 17889 - DNA, 766 bp, Chlorella protothecoides
ctaaaatcttgttcaatacatagaatgctcttgataaacatttttgcgtttgttgaagattacagatagtaatatcattacgtatccctaaatgatattgagacatagaaggatgccatgaattagtttccgataaatagatagatttatgaccaaaatgagttgcttttctgtaataattagtagtttccttatcgatacctatactccttgttttgggactagtttttatggttcttttagttaatctaaaataaaatgaaccggatttattaagaggagtgtaatttgtggaccaaaccatcctattataaaaagaagatttaaatattgaattaggcatagggtttttgttgttttataaaaactacttgttgaaatgaaatttattcattttagagcgggggtaggacttgaacctacaaccttcagattatgagcctgacgagctaaccatttgctctttcccgcttttgtttctatttttgggtatgataggtctcgaacctacgaccatcaggttaaaagcccggtgctctaccaactgagctacacacccgtttaaaataacgttttcaacattaatcaaggttgagggcagaatcgaactgccattataggatttgcaatcccatacattaccattatgttacccaacccttacctcataaaatgaggtgatgtttatatcttctaaatttatttaaaacaaatccagactttaatacctactaaaccaaaagaagtatttgcgcttctagaagca

SEQ ID NO: 17890 - DNA, 382 bp, Chlorella protothecoides
aatataaatagcaacaaaaacgttctgtttttaatatatacttattatttttctaaattttcagttgagcctagggctcgagatgctgaattataatagttataaaataaaaaacaaatagcatatataaataatatacgactatctaaaacattttctagtacactccaagcactacttacaagaacgagcatagtaagtcctaatagcataacaactgcgtaatgatatatcagaccactttgtaatctgctccaatactgagcaagtgctggaaaactataagcaataccagtaggtccacaaatttcaaaaaatcctttatcaagagctttaaaacttacattataaccaaaagacatagtgttttttgatatgtaat

SEQ ID NO: 17891 - DNA, 80 bp, Chlorella protothecoides
ccagcccccaaaagcgacatcgtcacacctcagaagggagacagaggcagcttgtgccaaccaattctgatgtatgcggt

SEQ ID NO: 17892 - DNA, 74 bp, Chlorella protothecoides
tctgaaagcagagtgttgcaagggtgaagagtggctggatcaattgcctcctcgcaccatgcccctcccacagc

SEQ ID NO: 17893 - DNA, 315 bp, Chlorella protothecoides; identical to SEQ ID NO: 6949

SEQ ID NO: 17894 - DNA, 74 bp, Chlorella protothecoides
gctgtgggaggggcatggtgcgaggaggcagtcgattcagccattcttcacccttgcaacactctgctttcaga

SEQ ID NO: 17895 - DNA, 203 bp, Chlorella protothecoides
atgtacaacaatcgatgagcaaaccatccgcgcactgttgctttttgttgagacctctttgctgctgcccttcacccatgttcaagccaagatcgaggcttgtactgacatttgttgctcattcaagatttcgggcctgtgaacaataattgctgcacaagagatccctctctcgaggctctgcgcatcgtagacccatcatg

SEQ ID NO: 17896 - DNA, 140 bp, Chlorella protothecoides
tataggttgccgctgtttgtttgcaggtgatcgatattccataaaatgagaatataaatatttgcaagcttctacttgagttacaggatgagatattaaaccagcatcaattaaaatggcatcatgccgtgtaagtcttt

SEQ ID NO: 17897 - DNA, 176 bp, Chlorella protothecoides
taggaactccagctctagatttatctaaagatttagaaacgatacaatcattattatataaaaacggactatctgccaaaaatttttgtataatagtgtttttatattgaaaaatacgtatattattttttgtatccagacctaaatcaatttttagattagatattttttttttt

SEQ ID NO: 17898 - DNA, 135 bp, Chlorella protothecoides
taacgaatgcatttttttcggtaatttatgcgtgttttttaatttaataaaaaaacaaataaatagatcgcataaaaattataattctaataaattaataaaaaattttcaatatattatggcaagtaaaaaaaa

SEQ ID NO: 17899 - DNA, 67 bp, Chlorella protothecoides
aaatcgaagacccagtaccgggaatgtaagtacaagtggttgacctgcatctgtacaaggtgagccc

SEQ ID NO: 17900 - DNA, 61 bp, Chlorella protothecoides
tgcatgatgtggttgtggtgcaggtactgcaccgccaccgcgatctgcaggaacatggacc

SEQ ID NO: 17901 - DNA, 8252 bp, Chlorella protothecoides
cggcgcgccccgccccgcctccgccagccaggcgtcccggaagctggggctgagcgcggtgtcctgcgccaccgcgacgccctgccccaccggcgccgagctggcgcgcaggagcagggcccgcgccgcgcagacgcgcgcgcgcacgctgtcctcctcggaggagctcaactcgtcgtccgaggtggaggcccagctgtcggcgtcgtcgtcgacgccgcccctcgcacggtggcgcgggctggggcgggggggcttgggcgtccagcgcgctgccgcggcgggcgcggcggggaggggaatgtccgccgcggcggactttgagggggaccaccgggggccagggctggacgaccccagtcttgtctgcgggctgacctgcggggtggggccagggctggacgaccccagtcttgcctgcgggctgacctgcggggtggggccaatgaggaggctgaggttgagggggcggggaggcaggggaggggcgggggtcagtgtagcgcagcccggcgaggtgccccgcgctgaaaaacctggcacaggcacgatacatgcaccgctggggcttggcactctaaaatagcgcacacggggcggatgctcgcagcgcagcgaggacggcattagggaagtggagccccccgatcacaacctgatgatcccagcccgacatccacgacccaggcactcactcgcggcaccacgacctccttccgctcgggcggggggggtgggaggctggctgctcgctgaggggctggcaggaccatggcagccgacagggagctggcatgctggccccttggcacggccctggttatgccggtggactgcggggagggacggtgggcagtcatggttagactccggtgaaagatgtgcggccctgggatgcgggcgccaatcccggacccaccatgatggggaagctgaggcccgccggggccgtcgcttgaggggagctgtccggggcagacggaaggttggcggtggagggggcatcaaaggggctggcgccctttgcaagaagcatgaggggccggggcgggcagggagggagtcccctccaccaccccagggtgcgcctatcagtattctttgtgggtgccggctctcccggtgcagcccaatgctgccgccccgcgccgtgatgggccacccaagtccaagcaaacaaatatgagttctccctgcttgtttacgggcacctaatgaagcgccgggagtaacaaacattgcgcgcgccaggggtagatcacgcgggggcatgacgccatccaacccgaccgtcagattcctccccaagccagcaccgagctccagcaaggtcagttccaactctatgtacagactatctttgcacgacagaagcacgtatcatgacccctcatcattgggtctgacaagctatcgtccccattctacattgcccgagtccaaacatggcgttacacacctttcaacgagtatattagcccttgaagctcttcactttgtcgccccactcctgaatcaccagtccgtcctcatactttgtgttcttccagctctggcgattctgcatggccccagcgtattcgccaatcgcggggaaggcagtgtacacatcccagtcctagagcatggacgggggagagatcggacaccatcttaacaacctagacacctcagacctgacgccagaccctgcatcaacagcctgttgtcgcaccttgaactgcttggtgaccagctggacatggtggagttttggagccagctcaaggtcgttgggtcctaccgacttgccatgaatgtagggcttgtggctctgcaagccatggtatacaaaatgcattgatgaaccaacgactgctgtcagtgaacaagtcaccgactgtacagtgcacggaggggtgcgcactgtccaaatccattgccgctccctgtttcccacatctgccccccccctgcctgtaggaaggtgtcaatctcctgcagcttggtcctgagatatgaccgcttctccttctcttcagccttgtcaaagctctgcaagtaactcacaaaagctgggaagaggccctcacccctgcagtgtggaggggacggctgatttcatcagcaatgcctccccgccagttgcctgcatgatttgcaatctctgacagagtccctgcgtttgttaccagagtccaacctcctcgacatcaatctttctctagcaacaactcacacgttcttgctgtcgccggtctttccaagagggggctcagggatctcatcctcgatgtagtccacaatggctgctgaatctgcaatccatttattggagttcaggtcctttacagcaggaaccttcttctcaggatgggcctcgctcaacctgcacagctcggaagccagggattggccggcgctctgatgatagaactacccctaatgcccaggggaaccaatcttaatgcccctagagacctgctcatcacagagctctacataccactccggcttgtcatgggtgttgacgtagtgcttgacatacggaatttgcttttcttccagagtcaacagcactcgatgtgtgaaggggcctgcgcgcgagcagggaagcctaccctgagatcctggtcgatgatctgattgccccaacagcatacatgcgctctgacaggtgtccacttgaacatttgttacccaaactcacagtcgccgagtttgccctcgaatgagctcttcgccccatccttgggcagccccttgacggcaacctcgaatcgctccttgccggccatggccttggctgcaaccgtcaagaactgcctccttgaactcagcgagggagatggcgtcgggcggacggaggcgtggatgttcagcatcggcctcataatgtcggaactgggtgactggcaggaccgaatcgagcaccggaatgtgcttgcacaatgggaaatgcctcgtggaatcacacactatcgcgaagctgcccggccctccctcagcccaagctccttcgcatcatgaagcggatatgacatgacttctccattgagaaactcgaaagtctttgggcgagtgggtcggtttcgtgggtggataccgatcattttgtccatcccactgcaagcaccatgacgtggagtgagcatgctgcagagcatgaaagtgcagtgcaatgaaggccttggcatcctcggcactcaactgattcaacagaggcttgcgccagtcgggaacccctgcaagatcaggcttggatccggggagtgccccatccgccacctgcccccagccgagcatggcggcagccccttcagtccgtgatgatgtccgacgccagcttcttgatgctctcgcccatggccttgtcggccgctgccttgcactccgcctgcacggtggccgggtccaccttggtcacgctcacccgcctcgcctgcggctccctgttgggctgaatgccccgcagccgccgtgtcaggctcaccaggctggcccaggggtgcgatccccggcgcagggtgtgcgcaaacaggggccgcgctccccccaggccgccgcagcaggggcaggaggtgaagcggcggcccaggcagagggggcaaggctcctcgtgcgacatcttgccctcccaccccaccacgccgcgcccgtcgcacagcttgcacctgctggtgtggggcggggtggctggcctgagggacagaccggctgggcgtgcccggcgcaggatgcaagcctgcccatcgggggtgtgcgatcgggggggtgcaggctcatgctgcccgctgggtcattcccgcacaccctggcacccagcctcactccgtacacgtgcctctggatgccaaaacccttgcaggcccggcagctgtggactgccttccagcgcgctcgcaggatcgccgcgatgatggcggcgatgagcagggccagccacaactgcatcacgcgaggcggagggttgtgttggacgacacactcccttcctgctgaatgaaaatctttgggatggactcccggccacacatgcccaaaggctcagcgacttgtgcccattgtcaagggtcggggacaggcctctcggcatggaggcttcccggtacgtggagggccagccatgccacaccaggccccagcaagacctccccacccccctcccaattcttcctgtcccaaccacaacgcttctcactgggagcagggacggtgacagaaggctgggtccagatctcctgagggagggccccgctgaggtgcgcagagccagggtgaaggggacgctggcgagggtgggcgcagcagcccagtcctgcagcttaccggtcctcagcctccgcatcagcgctccgatccgctgaaggaacttctcatccaggcagcgaccgcatggctggggtgcagtgggccgcagggaccacggaggaaatgatccggcgacggcggcaaagggggaccaccgggccctccagcgcccctgtgatgtggtgcggacttgcagggtggaagagccagatcttaatgaaatggggcagctatgctgggggtgtatcaggcatgacgacccgggcatggaatgctccgagaactggaaggaagcttggttccgtcaactgcgccacgaatccatcaggcacagtgcgacggtcatgagcgggctggaaatgagagaatgccaggtcaatggatacctcctgtgagccgtatccctgttgaagcctgcgggcctcatgcctgggagctcaagtacggtgcggtgtgtgtccatgtggcccgaagcctgctgcttcccgcctttctcgcgtcgctccttatcttggcaccttcagtgttgcaagcttggaagcacatctgaaaagtggggcaccaccactctcctcaacttcaactcgaggaagatctcaaacatgttgacgagccttaattccgctttcgcggggttgagcctgcggccaccggcccaggcacggagaccacagccctttctgagctcccgatccaaggagacgacggtcatgaagagcaggcacactttccaagtggaggtaagctcttgagctcgaagcgggcttggcgtggaggaggatgagatcctatgcgtatgcggtggagcacgcttctttggaagctagaacgggatgacccagaccccgatccgggcccgatgcagattgtcgtcggcagcgaggagccgcaggatatcgcactcaagcgattcaagcgggaagtcatgaacacgggactcgtgcaggaggtagggatgtctcgatggaagggggtttttggggattccatcaggttctacatccaaggagcgtgtcttgagtactgaccgtctcatcctgtgcgtgcatgggtgcaggtgcggcgcaggcgtcgcttcgagaacaaggtggaggccaagaagcggaagaacagggagaaccagctgcgggcaaagcggtgaggtgatggactgtgttgaagtgcacgcatcaggggtggcattgctgtgcttgctatcatgcatacccctgcacaagtatccgacacagagtgccattttcagccactctgccctgtcctcgcggcataggctcacatctctttcttctcatccctatgcagagtgcggcagtatggaagcagggcgcagaagcctatggctggccttcaaggcccctcagtcttcactgacctgttcggcagcctggacgacatcttcgctgacgactttgacaatggggcaacccagcagccgcggcagtacaacaacaactacaagggcaatggatcgggtggaagcgggaagccttacaatggtgccaccaaggctccaggaagcttcacgccgagccacacagtcaacaagcctgtcctcgcggagcagcgatgatggctggccatgttggttgctcgttgctgcacatgtaaagcacacagctttctcctgtcagcgggcaggcttcagtctccactaagccacagttaactggactcggaggactgggcggcggtaaacctaaacttcctcctgcaacgtctactcatccaactaagccgccaaaagaggatgcatctttactggggagggcgcgtcaatcgcctagcttaaaccccttggcgagaagcttgcgaggcacaaacctgatcgccgctcgtaatactcctcgatccaggcacgactacatttcagtggaattcgcgttgacattcacccgtgcataagcatcgcgacagcttgcatgttgacgtcgctgcggtacctcgcctctagggtttccgtggagcctggcaatgcccctggctagatctcggaaccagcaaagcgcttactttgcgatcagtccctggcaaagtaggagacataccacggcgctgccgtcgggggatcacaccgtcgcagaggaggccctgctcgctcttgcaccggcggcagggccccttggcgaggagacatggcccccgccgcccgagaaacgatctaaccctgcagcccccttggtggtaaactggaagcggcgctgcgtgggtggtgaccctcgggaccccctgcctgtcaccgagcagggtgcagggcctcctgcccagctggtacccagcagcctcgacccagggaggcacgacgacatccacgcgccacccagcagtctccagcccggttccctacggctggagggcactgcccacctagcctttcaccctgatggcagactatcaggtggaagatgagcccgcagagttttcacccggagcagctggatcctgcgagctcggccatctgcaccccacgtgcttcatctcagtcaaatcctctccatgcgccatgcagggcacatcctgcaccctaccccggcggggggctggggctccatgggcctgatgggccgccgcctgaccagctacagggagtgcacccgcgatgcaggtatggctctggtgtgcggctggaaggttgcggtgcgttttgcgtccccatggtgcagtgtgacgcactcccagggcgtcaggcatgcaatgggcgtgctattgctccgtgcattcccagagctgtcatgctgcccctcgcccatctggctcccccattgccacagagtggcagctctacctgctgaccctggtgaccaacatgggagacctacaggccatcgccgagtgcaccagcggcgacgcagcttgcctgaggtgcgcctggtccctgcagcgggagcatgccactccatcgtacgctcaggatgattcgcatggagcacaccccgatctcgctgagcctgcctcaccgcagggcaccggcagagctggaatgcatggagcttgctgagctggggcgcagcctcccagacctgaagcccagccgtcagtggctgggcctggacttcacatgcaccacactcctggtaggcgagacagggccaggggtatttccgatgtgggaaaggtacttgtttgcaaccggtggcatgctccgccatgccggcaccatcgctgctcgaaccacccgtcgtggtgtcaaactgccccgcgcacagcgcgccgcgaccccgtctcgtcacccctgcaggtggacgcagaagcgcagcgtcacctggcgcgactcagggtgggggcctggggagagggggcctggtgctgcatcggcccagccgctgtcaccctgtgtcaaggcagggggcgtggtcgccccgagatccccgaggggcaagcgccaggggtgccgctggccgctggacggagggtggttctggacgacgaggacgcatggtagccctgtgaatccctgcccaccaaccgctcgctgattggcctgaaggcccagtgcccaggaatcatgacaccgatggcgggaggcacgcagtgccagcaggcgtgagcttggggagcaggacatgccaccgctcgcatggactcccaggagcacctggcgcccgggggggtccatcacttggtcatcttgccgtcgcggagcttcttgcgcagcttggcgcgcgctgccttgctcagcttcttctcgcctgccgagtttggacgaggggtggtgaacttgggagggccaggcagccgaggccagcgggccgggaatgggtcccatgctggggagggcacggtgcagggccccaccggcctcgagaagcgccgcgcactcccatcctcgccgcgccccacctcccccgccacctcacactcaccctcgtcggcggcagtcgcagcggagacgggttgcacgggcgccggggcggggcgcgctgcgggggtgggcgccggctgggcgggcgccggcgccgggcggg

SEQ ID NO: 17902 - DNA, 65 bp, Chlorella protothecoides
tcagtgatgtcccggacgaggtggctgctcactgggccctgattatacaaagctggggtatcgga

SEQ ID NO: 17903 - DNA, 74 bp, Chlorella protothecoides
tccttgatgcgatgtccatgctcctgtcgggtctggtctgcggtggacacggtgcgttgcgtccagctgtcaat

SEQ ID NO: 17904 - DNA, 153 bp, Chlorella protothecoides
ataatgcgcgcaacaagaattaagccagcaatatagtttaacggttctaatgttaaccatggaataattataccttgtataccaaaagtaacacaactaataaacacaatttgaccagcaatataaccaccaaaagaaaaaacggcagctggg

SEQ ID NO: 17905 - DNA, 61 bp, Chlorella protothecoides
tggtggccgcgggagagtggacgctggcggccgagtacgtcgagacgcggcctgagttgct

SEQ ID NO: 17906 - DNA, 61 bp, Chlorella protothecoides
cctgcacacgctgctggtcacacccgtggctgcgtcgcccagcgacccggtggtactggtg

SEQ ID NO: 17907 - DNA, 797 bp, Chlorella protothecoides
cccacacacacaagccccccccccctcacacacacacacgcatgcaaacatccttgcaatgatgtgctatccatccagtatggagtttctaccggttgtgacgatcccaatgagggcgggctctgacaacgaccttgtgctgccgacatgcggggtcctggggtgcctgaaatgccgcagggcaggcctaagagctcctgcaacattctgcacagggttcaagatatcctcctccatgactacggcgacatcaggaactgggaccaaatcatgaagttcttctcaatggaaaaggttgaacatgcgatcgacaggctgggccccgcagccttcttcagcactgggcccttcgagagaacgcacgtggacctgaaggtgcactcaaatttccataacaattgcaaatcgacggctgcccatcaggtatataaactgtccatacacgcacctggcccacggttagacgaggactggatacccggttatgcatgccggtagacgttcatctcaaagactcctcggtccagctacggtgcaggcaatgtggcgaagcctacccctcttctgctaaccactccactcgtgcagattgcaagacgggcagttgcacaagcacatgcccaccgttttgtagaagcccaagtctcctccggcctggtaagatggggctcttgtctcggcctgcgtggccttgtgagaaaaccatgcaattggtggatggcgatgtaaattcatggtcaaccaagaggaccccgccccccctctcagacccctcccccccctcatatctgcgtcct

SEQ ID NO: 17908 - DNA, 446 bp, Chlorella protothecoides
tcataccgtaccgatccaccaataaagccacaaaggttgcttccctgtcggctttcaattcttcaaccgtactttctgcctcgtatcctccaaattcccacaagtttctgattaacagatgcgtaaggccttacgagtgggtctcgacaatatgcgggccaattcttccatgacagtaaaactaaagtatctgtgtaccggcctaacccaggcaccagaagcgtggacagcagggtcaaggactgcaaaactcccatgagaaggatgagccctgcatattggtggtaaccaaagatcccacacttagggctggtccccggtaaagacgcgcattcgtttagtagctcaggcatgatttttaattgccactgggtagactgtgacaaaataaggtctgatcaactctcttcgcccaaaataaaccgtttataggtcttccttttggc

SEQ ID NO: 17909 - DNA, 28532 bp, Chlorella protothecoides
  modified_base (467)..(476): a, c, t, g, unknown or other
  modified_base (2209)..(2218): a, c, t, g, unknown or other
  modified_base (2628)..(2637): a, c, t, g, unknown or other
  modified_base (2789)..(2798): a, c, t, g, unknown or other
  modified_base (2939)..(2986): a, c, t, g, unknown or other
  modified_base (3305)..(3314): a, c, t, g, unknown or other
  modified_base (4012)..(4021): a, c, t, g, unknown or other
  modified_base (5039)..(5048): a, c, t, g, unknown or other
  modified_base (6074)..(6142): a, c, t, g, unknown or other
  modified_base (6639)..(6648): a, c, t, g, unknown or other
  modified_base (8780)..(8789): a, c, t, g, unknown or other
  modified_base (9255)..(9264): a, c, t, g, unknown or other
  modified_base (11329)..(11338): a, c, t, g, unknown or other
  modified_base (12014)..(12023): a, c, t, g, unknown or other
  modified_base (12439)..(12469): a, c, t, g, unknown or other
  modified_base (12659)..(12668): a, c, t, g, unknown or other
  modified_base (12741)..(12906): a, c, t, g, unknown or other
  modified_base (13239)..(13248): a, c, t, g, unknown or other
  modified_base (13750)..(13759): a, c, t, g, unknown or other
  modified_base (13957)..(13966): a, c, t, g, unknown or other
  modified_base (14467)..(14476): a, c, t, g, unknown or other
  modified_base (14646)..(14655): a, c, t, g, unknown or other
  modified_base (14892)..(14901): a, c, t, g, unknown or other
  modified_base (16313)..(16322): a, c, t, g, unknown or other
  modified_base (16409)..(16418): a, c, t, g, unknown or other
  modified_base (16751)..(16760): a, c, t, g, unknown or other
  modified_base (16969)..(16979): a, c, t, g, unknown or other
  modified_base (17055)..(17064): a, c, t, g, unknown or other
  modified_base (17458)..(17467): a, c, t, g, unknown or other
  modified_base (18157)..(18166): a, c, t, g, unknown or other
  modified_base (20030)..(20039): a, c, t, g, unknown or other
  modified_base (20437)..(20446): a, c, t, g, unknown or other
  modified_base (20757)..(20766): a, c, t, g, unknown or other
  modified_base (22716)..(22725): a, c, t, g, unknown or other
  modified_base (23245)..(23254): a, c, t, g, unknown or other
  modified_base (23696)..(23705): a, c, t, g, unknown or other
  modified_base (24015)..(24024): a, c, t, g, unknown or other
  modified_base (25007)..(25166): a, c, t, g, unknown or other
  modified_base (25228)..(25237): a, c, t, g, unknown or other
  modified_base (26288)..(26297): a, c, t, g, unknown or other
  modified_base (27353)..(27362): a, c, t, g, unknown or other
  modified_base (28124)..(28133): a, c, t, g, unknown or other
aataaaccgtttataggtcttccttttggcattgggcatgggataattgcgcgtcgtgttggtatcatgggtgtgtctcttgtaagagagcctttgccaaaatgcttccatttgacagaattgcttcttcctgtgggtatcttcgcaatgcttgccatcttacatactgtattcagatgcggcttgcatattgtagaggaggtgccgaagactatggtacaagctgtggggtgaatcggcatcagtgttggatggtgacattgcgtccttccacactgacgttggcagcacggccaaattgattcttcttccccatcaccttgagcttcttgctgagcttatgctcacctgggggaatgagagctgatcgtgttgggggttgaacatactcccaacaggcggactacaccccagttgcatactccatactgatcagccctgcccctgcaccaactcactgggctttnnnnnnnnnnaccagcaggcggactacaccccggttgcatactccatactgatccaccctgcccctgcaccaactcactgggcttttctctccctgcattccgtccaaccggcaggactgtcatggattcaggacgtttgacatagtccagagaagctgcttcgggtattgccgcgtgcctccggaatccaggatcgccgggcctcaacttgactggacgaccattctggtccagctccttgtcagcctgcacatcgagatacatgagtctgtcagcaaagtaggttcctgcctggaggattttcgcaatgtacccaatggacatacttgtggtttcttggctgccagcctgagctgtctcgactgcagtatttgttgctcctcagcagtgtcagcaccgcgcgtagaccgtgaaaccagaattggcctgctccatttctccaccaatcccctggcgagacgcttattcgctgctgtttcatctgtggaaggcgtggacgatcgtcatcattggcctggaggccagctgcgcaggtcggaaggctcctcacccaatctccctccaacctgacactttggctaggaacatgatgctcctccccagcccagatctcttcagctgcgccttccggtcctccatggcacagtcaacgggaaggatgtccagcaatttcaagatcgacgagcggatggtggtattgggcagcgtgccatcaggcatggggtcaatccacgccttgagcactcctggaagggagcagggtagaagcacatgcagtcttctcagggccacagacaatgataaggtttgacaaaggtgataacgcacctagaagccccccgtccaacagctcgttgtgaagcttctgcgttgagaggaggtcttgcactcgcgacaacatcctcagcttgtgcgttgcaggcctccctgcacgcatggagcgggagccttgtgctagggatccaaggcctgatgctgactgcatagcaatccgctggaagaatctgagcacagcataggatgacattgcatcatactgctccggaagggggcagaggcatatatactatcgggcttgtgagcacagatctaatgtgactttgcagcgctgagcctgcaaagattgctcactgtatgcaggctgatgccactcaccttgctcgtagtccttcatgtcctcttccactgctacctccatctgagccaggaagctatcgaccagtgccttattctcataatcagtgtttgactcgcgtctcttccgctttgtaaacaacttgtccagctcatcctccagatcagactcaactgcctcgtcgtctttgttgaactgcaagcaaattgcatgaggaagcgaattttgagtgagagacgggtgcgctttctatcgggcagtgctggaggaagcagagtcacccatctggaccccttgccccgtgtacctgctgctcgtcatcatcaccgaagtcaatttgctgatcctcagccacccccgtatcatctatgaacgcccggtcggcctctgtgggggccgcaagctcctgctcatcctcatcgtctccaaaaaggtcggcgatgttgactgcaaggtcgaggggcacaggatgcacttggtcttgcactgcatgcccatgctcgtctaccgccccagaagttcttctcgccggcccaccttgttcctttggaggttctggaagccctgcaacgtctccttcatcctcactgtctccaaagtcgatagnnnnnnnnnntaccttgttccttttgaggctctggaagccctgcaacatcttcttcatcctcactgtctccaaagtcgatagctacggagtgtcccttcttcgctgccgcagcattctctgcttcctcctgcacagtcaacactcaatgcttgctacagcttccagccagtgtggcacgacacgctacagcatggtgcacaaaagagtacctgttcctgtctcttgcgctttgccagctccagcagtcgtgagcgggcgttgctcccttcatcgttgggtggcggggctgctccggaagtaccagggtcctcggcgtccgacatcgcacttttatttcatctgtgcattccttaaaagaggaagaatatctgtgccagggcttacagcagctctctgtggtgatcacatgtatttcgttnnnnnnnnnntattccttaaaagaggaatattatttgtgccagggcttacagcggctctctgtggtgatcacatgtatttcgttccggttcctatgctggcgcgcaataaccaaaacctccaatgcagcagacaggcttgcctgtcttgaagacgggaggannnnnnnnnnccccaaacttccaatgcagcaacaggcttgcctgtcttgaagacgggaggacgggtgtcgacttcttgcgaaagaccttcatcagaattgatcccgacgcaattcccctaaatcaccttggagggtgccacaatcccggannnnnnnnnnnnnnnnnnnnnnnnnnnnnnnnnnnnnnnnnnnnnnnngaagtcggcgggtgttgacaatacagctcgtagaacttgggacaaggccgaatatgaggacaaggcacaggagcgagaagttcaggtgagctcactcgatcaaggtcgggggtccgtgtgtgttgcaatcaggcgttctgtccacctcggcgtatggacatgctgactgcaggagaaggatgccgaggagagcgcgctggacgctcgcaagaggagacggctaggtgatctctggtggcattgcgggggggggggcctatgtatgccacggggtacagtctgaaggcaacagcatccgtctgctcatagctgtgacccnnnnnnnnnncgggggggcttatgtatgccatggggtacagtctgaaggccacagcatccgtctgctcatagctgtgacccttgtcctccctactcgccgccaaccactgcagagcgagacccgctgcaccagggactcattgtacagcgtggaaatctgaaagctcgggactaccagctcgatcttgctgcaaacttgaacaagacgcagatagtatctgtgggtatgcccctaaaccagcagggtggctactattgcagcgtatgtgactgcaaactgatggactccatgtccatgctagaccatatcaatgggaaatggcatcagcgggcactgggcatgactatgagggtggaggcttccaccaaggaacaggtgtgggatgggggggggggattggatgcccgtcccttggattctgggttcagtttcgttaaagaattcttcatgcggtcagaaagactcttcagatggctgcaattctcagagtatgcacctgcgcgtgcctggcaagccacctgatcactcacagcattcactccatctcaaaaagtgtaggtgaagaaccggatagagatggcaaaagctcgacaaaagggatctggcgagcagggggcgtatgtgccagatggtgggtgcaaggggtccagggagctttgatatggggctgaattgatgtttcgcacacatacatgacatgtgctgcnnnnnnnnnnacctagggagctttgatgtggggctgggttggtgtttcgcacacatacatgacatgtgctgcgtatcatggcgttaccacatgtgcatacaccttcccaggattctctcttcaagccctggaagcacctagtgagccaggaaatggagacggcagtgaaggtaggagtggaagagcgggatggttgtagtgttgggagggagtagatcaagagattgccagattggcaggcaggtccatttggtcgaccaaagctgtacgtcacccttccactaccccatcctgcagtgtctgacgaggacgaggcggcggcccaggatgatgcaatagacccagagctggcggccatgatgggctttggaggctttggatcatcaaaagcataatgctgagggactgtttgtctcccgtcactctaaatgtcaggctggctcccgcccagccacaaaccttgctagcaactgagtgtgcactgacctcccgctgccctccttggtgccttgcaatccactggaactgcacaactgagagtgtaatgtacatatctcagacacagctttgatgggtgctcgccgttgcaagggattgcgtgtgacaattaataagggcgaatcgcagccaatcacagtgaggacctctcagatggcagatcagatcaagacggaagtcctgctgaggttggggcaaagagaagaggtagaagatgggtttcgttggcaggtcatggttgggcacctcacaccgcagcgtcaccatcatgcgatccctttccaggagacgcaggcagcgatgggggatggggcgccctgctggcattcctgtacacgacaggcttgttggcggccaggagggaggctgaacggaagagttctctgacagtgacctcgcgctggcccacctcctgctccactctctgcatggagatgagggcggttaatggaagacttggaatggtaatggtagggtacaggtttgcatcgaccacaactggcatccctatcatgcacactagcaagtcnnnnnnnnnngtgagggcggttaatagaagacttgaaatggtaatggtaggtacaggtttgcatcgaccacaaatggcatccctatcatgcacactagcaagtcaggtatggagacactccggcataatgcgtccacactgactctccctcatcccctcgtcaaagcacagtccctcttcccagccactaacttgcactaaacaccaacctcaccctcttcatcatggccacgtggtgggataacctctgcagctcctcctcgtcgggcttgccagacgccaccagcgtcgacagctctgagatggcatcgatgtacagcgccacaacctcatagtcctccagtgcaatgttgtgatgcaggagggtgtggtcgtcctcgtacccaacctgacgcccctctgcagaggctgactggttgaggcctccctctgttccccgccgcttggtcatggtggagaggctccggtgcagggccacattgctggcagccccagagggatgagatggctgcggacggccctcatcactctcctcgggctgcgaagatcgagagggacagcgacacatgaatgtgaggggcaggtactcgatggtgcagggaggggattgcagttcagggccagattggcctgaatggtctccccaagaaccaggctgccagtgacatgcatcgagcaaaagagggctgcctgctgctttgtggcctggcatatgaaccacttaccatttccaggaagcggtgtgcggtgagatggatggccagcactcccagggtggcacagatgatgatggcgaagataccagtcgtcaggatgtcatatccccactgctcccattgtgcataatcgggttggccagccttggccgcttggatcattgccaagggcgtggctgtggcagatgaagaaagaaagtgggagattgaaatgactgcaattggtagccaggatagttaacatgcacctcaggggaaatgctgcatgttgttctaatccaggccatgccatattcatacaggcacatgtgggtcaccannnnnnnnnnnnnnnnnnnnnnnnnnnnnnnnnnnnnnnnnnnnnnnnnnnnnnnnnnnnnnnnnnnnnagtgcagcctgcacggtggccttgggcgtccaggccagggcaaagaagatcttctctttggtggtgtacccaccgcgtgacatggcaaagaaggtcacgatcatgcggaggatgacacctggacggcatgggaaacgattgtggacccaatgggtgtgagtaagctgaggaaggggtggccccaacaagattagcacccagacacagcttcaaagctcactgacgcctgctctccccaagccatagccccttgcctgtgcagatgatgaccagagacttagggatggtaccagagctcagggtctggaaattgatcgaggccccgatggtcacaaacagcatgggctccatcacccaggaccagatgacctcaaggaaacgctcaactgcacgggagcaaggatggtgtgacgcttggcattgcgttaaacagtaccatgcgcctgcgatgtgagcgcaagatgtcacacaatggctcaaggcacagccctcacgtnnnnnnnnnnctgtgacgcttggcattgcgttcaacagtaccatgcgcctgtgatgtgagcgcaagatgtcaacacaatggctcaaggcacagccctcacgtcacgcaggggcactgatccgcccagagcagaagcccacactgctcccatcgtaccctcggttgagaaggtgaagctgggccccagggagccacagcgaggcagtccccgctcccagaagttggcggtggccagcccgatagtgagggaccccagagcgccccccgagagcatgccgtagtactccaggaagaacatgatcagaagggctgtagggcagcgcgggcagcatgagacagtgggatgcagtatgttggccgtcggtgctggtacacccttgcgagtgcctgacgccacagcaaggcacagcaatatcctgcatccatcaatggctcaaccttgagggtataggtcggatgaagtccaaaagcctcccccgggaaaagccacactggccagatctcttcaactcaccaccaccgtagatggctaccaggcgaatcaggcgtgaataaaagatgcgggtgcacccaatgatgaaaccaccgagtagacctcccaggataccaaagacaacctgcaaggaatgcacggtcgtaatcagtgaccagtgcgaagtcgacaagcaaaccagcgaggctcgagggccctctggacaaggatgatgcatcctgctcacagcctgggcaagacaatcctgaatagacccacctgtacagggccctgagcgatctcccatccaagattcccagactcggggcccccagtgatggcgatgtgggagaagatggcaaagccggtgatggccacaatgtcatcaaaggaggcggagatgacgatggtggacgggatacctggatgtttgggagcaggcaaggggcctggttggcagcatgttgcagggcacacaatccttaaccctacccttgatgtgcacactgccgatccgtgggactcccagcccccatgagcatccagttggaggtataccttgatctttgcccagcccagtcttctgcaacttgaacatggcagggaccaccagaccaggaccgactgccttgaggatgaagcccatggtgaagccgagaaggatgggcatgccaaagagcgcaggcgctgcatgtttgacgccaggtgggttgagagatggtgtgactcgaggcaagaataacaccacatgatccaactctgaatggaggtgaagcgcatgcacgcacagattccctgattgctctcgatccgccccggccattgtcacctgtggccagcgcgccatcgtacaaggcctcgaccaggcctgggatgagggccaatcggatggctgggtacttgtaccgcctcattgtctgcatggggattcaagagaaaagaatttaaatgacagatatcctgtatttgtcaaacgggtatgcaatgtcctttcggttgcaccccttgtcgcgctcgggacagggtaagcaaaagcattggatgtactgctccacacaagcaaaccaaagctcccctggccccactcatccggagcctagcactcactccaagatccagctccaggccgcagcgcaggaagatggtggcgagggcagcagccctcatctgagtaccccatcgaggtgggaaggcatccaccgccgaccaggggaggttttgcatgaggaggcccgcgcacagcatgccgatgacacgcggcagcctgagctggaaggcaacgaaggcaccaatgttggacgcgacccacaggagaagggtgcaccaggctgcatgccccggcaggaacacgctgccgatggcaaagtatagcactatacgagatggggtgcggggtgggagagtggggtggggtggggggcagcagatcgaggagccagaagtccccacatgtatgcagggctctggtgtgctggaagggacaggcagctggtatgccgggcacctacctccatagacgaccgccgcgaggatgatcacagcagcattgatccgtgtctcctctggaggaggggagggagtcgcggtcagcgaggcaccccaagcggggaacggtcacatcctatgggtcatcggggtcctgaacctctggacgcacaccttcctggggnnnnnnnnnnaggaaacggtcacatactatgggtcatcggggttctgaacctctggacgcacaccttcctggggccttgcaaggtagtagtaggcggtggcgaccttccgcgcgaagggcgaacgctcctgcttgtagggagtctcaacgccatcgacattggggccctgcacggcttcagcaatcgccggcgcatttgctgcactcggatctgggccagtggacattgtgcaggtttatgcgccggtccaaagcgcgtgtaggggggcttgagcgtcctctgggtgcctcaccaccttggactgcggacacgcgcgctgcttaatgtatgctggaatcgttgaaagccatcttacaatccttcaagatcgacgctggctctcaggaggacttgcatctcctgcctgcccgacactggactgcccccgagattgccacgtgctggaaaagggcgctcgtccagtgatcagtttcgnnnnnnnnnncaggacttgcagctcctgcctgcccgacactttactgcccccgagattgccacgtgctgtaaaagggcgctcgtccagtgatcagtttcgaaaacaaacgggagagtgggattcctagaggctcgacagtgattccgagtttgctattcagatcgatcccagtgcttactgcgaaccagacctgatctgggggcggcttgagcgacaagtgtggcggtagtaggacgcctccagcatgggaattcaggtgcagcttccccacttcgtgcagacacgcggcacgctccaccgccacaatacaacactctacaggaagagtcccttcgatcgcaattgcagggactcaccaagctgttggcagataatgcaccagggtgcatgaaggagcagaagtttgaaaactattttgggcgcaagatcgcggtggacgcctccatgcacatctatgctttcatggtgagggttggtgagattgtaacctgtgtgcattgatgtcgagtgcaaccgcttatatatggaatcgctaggggcggcagggcatcgatccctgcaccacatgggaccatgacaacagatatgcattcgatgcacggcctgcctttacctctgcaggttgtggttggcaggactggagatcagactctgacagatgaagcagggaatgtcacgaggtgagggaagttgaattgggtgttggtgtcctgccacgtcgattggatcgaatacgtggctttaacgctcgtaatcggatggcagagctcgcccagtcatgaaccctctgcccacctctctccagccatctccaaggcatgtttttccgcacggtgaagatgctggagtctgggatgaagcctgtgtaagtgggtggagagcatgctgtgcaggcctgctccttcacctccccccatgcctgtcaaccttaccttaagatcgacctgtgcattgctaatcgacgaatgtgctcaagtgatccgttcttgtcaatcatgcgcaatctacatgatgtgcgatgcgcatgtgggactcattctcccccgaggagcaccggcctgcggacagatggcactaccattcctcctgcgccatcgcaggtttgttttcgatggcaaagccccgacactgaagtctgatgagctggcgaagcgatactccaagcgccagactgccaccacagatctagagacggccaaggaggtgggcactggcctttgttgtgcgtgccagcccttccctctgatcctgagattgcactgaagtacgggtgcacccgtaacttgtgcccagccccaagccttccctccacatacagactggtactaaggaggatgtggaaaagtactccaagcgcaccgtccgtgtcacccgtgagcacaatgcagagtgtcgccgcctgctgcagctgctgggggtccccatcatagatgcgccctccgaggccgaagcacagtgcgcatccctatgctcccagggcctggtgtatggcattgccacagaggacatggacgccctcacctttgccacaccgcgcctcattcgtcacctcatgtcgcccgcagctgccaacaaacctgtcaccgagtttgagtatgaccaggtgcgtgcgggtattgtggagtcgatgggagaggagggcgggtgtggaggggagagaaggcgatggaaagtggacatccggaaaggctcatgctctcaagctcctggaccttgcacatgagacagagctagagcagccagcagcctcacccttccgtgtggacccaacctcgaaccgattcttggatccacctcctgctcctcgcaaggtactggctgaactggacctcacggccgatcagtttgttgatctgtgcattctgtgtggctgcgactataccgagaaaattggcaacattggacccttcagagctctccaggtgggggtgggagtccatgcttgggctgctggctgctgggaagacactcgttatgatcatctagaaaacccgctgcgctctcaatggtgccaatgtcctgacaattgccttgcagctgatcaaaaagcatggcagcttggaggccacccttnnnnnnnnnnaatctagaagacccgctgcgctctcaatggtgccaacgtcctgacaattgccttgcagctgattaaaaagcatggcagcttggaggccacccttgccgccctggacccggagaagtacaatgtgaggagcatgcagttactggaccattttgcgtatacgatctggcatgacagagaacggaaaccagcacgtaacatgcatccgatatgcctgggtgcatgacaggagtatgggcgcccgcagttaaggtgtcatccactcttgcaccctcacgcacagatccccgagccgttcccgtacaaggaggccaaggagctcttcctcaacccagaagtgctgaagcctgagaacattccgcccatgaaatggacaagcccagatctaggtgggacgaggagcatcaattccagagggaccgcagagttggaccctctctatcaagccaaccagagacagatcctttgcacaccccttttgtgcagacggattgctggaattcctggtgaaggagaagtctttcaacgaggagcgggtgcgcagtgctatccagcgcgtaactgcggcaaagagcaagagtaatcaaggtgtgtcttgccagggcatggggaaggcagaagtccggcgtgaagaacatggtagaaaacacagaacagacaggtttgccctgagcaactnnnnnnnnnntgcggaagtccgtcgtgaagaacatggtagaaaatacagaacagacaggtttgccctgagcaactccacctggtggggcctcctaccatcaggcagtttgcttggcttcccatcccaacccacgctctgaatttgtgccacagggagattggactccttctttgggcccagcaagacgcccccttctcaagcccccaaacgaaaggaggcgggtaaggttgtgccgcctccgaaaaagggcaagcttgggggattcgggaagaagaagtgatcagcttcaggcggttggcactctgacatgttgtggagttaatttgatgtatactgcatggccccggcagacaaagcttccggcgcgatttgtccagatgacaaagattcttgaatattagggttcagcgccctttcctctcggnnnnnnnnnnnnnnnnnnnnnnnnnnnnnnnagcatgccgcatggcctgagattgcctaaagtcttgcaataaattagcgattgaacacaaggctgcatcgaatcatcaggtaggaattgcagccccactgctgccggtgttatcaatcagctgtctgtgaaccgttggggtgtagtgcggttgagacgttgtccgcatttaacggctgcgtaaggcgctnnnnnnnnnngcgtaccgcgtgcgcgctcagtatcggaacggttaacaagaatttgggtcgacgtgaatgtcgtctgaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccactgctgccggtgttaccaatcagctgtctgtgaaccgtaggggtgtagtgcggttgagacggtgtccgcatttaacggctgcgtaaggcgctgacgaattctatcccataaccaactcggcttctcatcgtttcaccactgtagagccgtggaaatgccgggacctcggcgagcgaagctttcgctcctggtcacagctgttttagccatcacggcgacccatgcgtacggtacgttgctcttcatggctctgctaaattcgatatcatcttaccatgccatgaagactgattagattccatgacccgttccgctaccccagagtgccnnnnnnnnnngcacatgcgtacggtaggttgctcttcatggctctgctaaattcgatctcatctgaccatgccatgaagactgatgagatcccatgacccgttccgctaccccagagtgccctacgacctgtctgcccaccgccaactgcaagtgcggaacaagcggcattcctggaggtctcgatgcgtcggtcgttccccagttcatcgtcctcactaccgacgatgcggtcaccctgaagaccaaagcatctcttctccagatcaccgacaaccacgtcaacgacaatggctgtgccatgcctgcaacgtgagcccatcgggaggttggccggggtgcaggatgcatctgcgttcaatgccgagcgcttttctggtcctgcagcgccgatcattctccacccagaccttcacaacactactcgcggtcattaacgcaggtggtttgctccagttgacaatacaagtgtctcgctggtccagcagttgttcgtgaaaggtcatgaaatcnnnnnnnnnntcttcacaacactactcgcgatcattgacgcaggtggtttgctccagttgacactacgagtgtcccgctggtacagcagttgttcgtgaaaggtcatgaaatcgccacgcaaacggtatgcatctggtcgatgagcactaaggggtcacgtcaaaattgaggcaagagccacccatgaagctcaaggagcgcccaccnnnnnnnnnnttggtcgatgtgaggggtcacgtcaaaaatgaggcaagcgccacccatgaagctcaaggagcgcccaccgcaatcccttccctctctcatccttgccctcctccctgtctcccgggcccttgcagatgagcggcacctcagtggctagcctggaagagattgtcggggccaagacttggtacaatcaggtgtggtggtgaacgaggctgctcagtcaagaaggcgggggcacgagaggactagagcatgcaccaagacaatgcccaggttgatggaaaaggggttgtaaatactgggaacctccctccccgcagacggccaagctacccatggagaagatccaggggttccgcgctccataccttgccttctcacccgagcagcgtgccatcctgtctaacaacggcttcaggtgcgcaccagggtggctgtgctcgggggcagggagatctgagttttgggatccagtcgaacaccgtcggttctgacctgtgcaggagnnnnnnnnnnagtgcagggagatctgaattttgggatccagttgaacaccgtcggttctgacctgtgcaggagtacaccctacagaggcagccagctgtgtgatttactcggcgccatgctttgcatttggtgaccaccggatgtccttcaatgcgccttcctgtaggtacgactcctcnnnnnnnnnncacagaggcagccagctgtgtgatttactcagcgccatgctttgcatttggtgaccaccgggtgtcctacaatgcgccttcctgtaggtacgactcctccatctcggagtccttcccatccaccacatctccaagcgccacaaacctgctgtggccctacaccatggactatggcatcccgcaggtgagcctatccatatatttactacaggccgctctggctggagctaggcctannnnnnnnnncatggcatcccacaggtgagcctctccatatatttattacaggccgctctggctggagctaggcctatcgcgatgtatcaacgacccaggtcacctcaagatctcacacccttgcttcaccgcaggtctgcacgaccggggtgtgcagctctgacgaggtgtatgcgggtctctgggagttcccagtgtgggatacccagaacagcgacgcaagtctggcgggcacgatgaacccccagggcgatctctactccctgtacaagctggcgcttgacaaccgccgctccggcaaccgcgcgccgctgggcgtgtacgtgacggcggcctggctggaggcggagcccgagcgcctgacccagctgaacgctttttttgactacgcggcggccctcccctacacctggctggtgaccatctcccaggtgctggactggatcaacgaccccaccgtggccaccaagtacgcaccgacctgcctgtcccccgatcagctcctggcagagctgcctggggtgaagatctgcacccagcccaacgtcggctgctcctacgtgagagggcatggggttgggggggtgggggggtggcaatcctcagcagcatagcatggggccacatacctctttttggagggaggtttcagcatggagatgggaagcagccccatcttgggccccgtcgctaggctgctcccgatgctcttgagtcgtgggatgtgaagagtgggcatcatgctagttcccaacccctcttcctgccaaactgtgcaggggacgtgggactcggaccagtgcttgtgcatctgccagggcgcggagtcgactaccgggggctactgcagggacgctgtggggtcctgcacagtgagttccgggcagtggggtggcggggccaggttgggaccgtgccttgctctgtcttgcagctacggcgggggccgctctgcacccagggtctggttgttctcagactccaaacctgaggaggtgagtgggctctcaccggccttctcacccccaccgactttcccatccccaccgaccttcccatttccaccaggttgccaagggctacgactttgcgagcaaggagtacatctgccccataggtacctccccccccagcccgcccccatcacctcccccagcggtggccagccccgtgtctggacccagctgggggcccgctgagtccatagccccggtccctgcccctacccaggtctctccctccatacagctttcagacgggctgtgcggtgagttggtctgctcttgggtccggcagtggggatggggtgcctgcctgagctgcagggcatggtctgttgggcatgccaaccgatctcacagagggtgcttgagcatggcatgctcgcccgtgcacggctcagaccattgatctgacccttnnnnnnnnnncaagtacatctgccccataggcaccctcccccccagcccgcccccatcacctcccacagcggtggccagccccgtgtctggacccannnnnnnnnngctcccgccatgccctgccccagggcatgacctgctgtcctttgccggcctgaccatctccgggtacgagtccctgaacgatggctatgccgtggccatcaaggcgctggacggcagctgtgaaacctgcgccatggcccccgtgacggggaccatcagctacatctccatcgacatggtgggtggctggtagctgtgtgcgggtgtggtcggggaaaggggtcaggtgagggaggctgccccggtgttgtggggcgtgcatcgcaccaggtgtgcgtccacacgatagcgtcgcccgcaggtgccggcgggcatggggcgcatgtggcagtnnnnnnnnnnggttgtgcgtccagacgagagcgtcgcccgcagatgccggcgggcatggggcgcatgtggcagtgcactctactcggatgcccacaatcactccagcacgccgaccaccacgtgcatctgtctcgcgctcaccctgcgcatcagcctgtgtggagtcgtctggtggaccaggcgacacgagcaccccccccaccccccacccccacccnnnnnnnnnnncaggggtacagcgtgacgctgtccagtgtctccatccgctcctcctacgacgtcctggtgaacatctacgtcgggnnnnnnnnnnaggggtacagcgtgacgctgtccagcgtctccatccgctcctcttacgacgtcctggtgaacatctacgtcggggagagcgccgccaacaacggcatgaacaacgcgctgtgtgcccaggtgcgtaggtgtgcccgacgtgggaagcgggggctctgggggccgatggactgactgtagatctacctcgcccggcaaatactgaggctgcagagcccagtgtgccctcgccacctccccgcctgcccgctccctcgacgccgtgcttcctccaccatcccctccgccccacctgccccgccccgtgctcctcaccgagtcagggcctcgctctcattccccttcctccgccccccccccccgtcagagctaccaggtgagggctggcggcgctnnnnnnnnnngcctgccccgccccgcgctcctcaccaagtcagggcctcgctctcattccctttcctccgcccgcccccccgacagagctaccaggtgagggctggcggcgctagcgaagtgccctgcgccgccaccggcacgtacgtgactgtccagaccaagggcacgctgaccctctgcgacatctaccccgtggtggcctcgtccgcgccgcccccacccagccccgtcgcccgctcccccgtcatcgtggacatggacgtgacggggctatcgaccgccgtggtgaccgcggcgggggcccccgccatctgcggcgtcctggtcagcctgacgaacgacgtgtcggccacctgctccgtcacctctgtggcgggtgtgccggcgggccggcgccggctgctggacgactcctccgtgcacgtgacggcggtggtgcagaccgcggactctaccggcttggtggcctcactgagcaacaccgcgcaggccgccgcccggatcctcgcggcgggagccgtgccggtcaccgcctcctccatcatcgtgagcggggggtggtgtttctctatggaaggggggagggggtatgatggaggggtgtgtgggcggggaggcttgtcatggcgtcgcttactatattgagggcgttgatgcagaggaatggtactttttgggaccctggaaggagcattggnnnnnnnnnnggtcgcttactatattgagggcgttgatacagaggaatcatactttttgggaccctggaaggagcattgggtggcaacctgcttgccagcgtcagtgttaacccatcccgaactcgttgggcgcggttcggcgccggctgtcagggcccgcaccaccgcctaggaataggccctgcaggcaagtactcagcatcggccccccttccccttcaaacccgcagaccgggggcctgccatcccctccccctggcgagattcccagccccccaccatcgcctggctccagccccaacccacccagcagtagcgggggcaagtccagcgtcggggccatcgccggtggcgtgatcggagggctggtggctgccgcgctgctggtctggctgatcatcgtggtgggttggggggggcgtcgagaattggtcggggtgaagctcgagccttgagccaaggggcaggggtcgagacatgattgtgccggggccttgacgaggacgtctgggatgcgtccaggatgcatccctgcgtccctcaggcttgcaccagctgcaaggggccttgaggctggaggtgtccccggcaggctgggctgtgtgccaggtggcagtgctggttgatggcgtcccacacccccaccgcaaatgcacacgccgcaggtgcgccggcgccggcaggccgccgagggcgatggagacatccccgccgaccccaagacccctcccaggcccacggctgccagcaaggccaaggagacgaagcagccccgccggcgcgggcctgccatcaacagcatcgcgaagactctccccgccggcgcgactggtgagggcccggggctgttggaacttgtgcagggtcgcgccggcccagcttgccctgtggctgcaggccgcgcaccacggaatgtcctcggccgcagcatgccctgatggggaccctgtacgacgtgccattcgcatgcctgggagctcacaccacgccccctccccccgctacacgaccctggcagccaccctggatccccagtcggccgagaagcccaccatgtacacgtccccactgcgtgactttgccaagagcatggaggccgcgaccctggctcaggccaaggacgtcgaggcccaggtggaccccccctccaaggagtagcggaccctggaatttggcaggtgccagcggcccccggtacctggtggtgggagttttgacgggatccaccccacatcaggcgccaacgcttgctcctttgtcgccgacgcatgctctccaaaccctttccttgcccgatccaagacctgtttgtaatacgacagcacaccgcctgtagtagacacctcccccctcctgacgcctctgcctagcgggttacagacgggtgctcagaaggcggcaaagcccttcttgccattggacccggcgggcacgacgcgcagcacgttgaagcgcacggtcttggacagcggccggcactggccgacgatgacggtgtcgccctcgctggcgcggaacgccggggagatgtgcgcggcgatgttggtgtggcgcttctcgtaccgctggtacttgcggatgtagtgcaggtagtcgcggcgcaggaccagcgtgcgcgtcatcttggtggacttgaccttgccgaccaggatgcggccgcggatggagatgttgccggtgaaggggcacttgtggtcgatgtagttgcctgggggagcagggcatcagagggaggggctgggtgagtggtatgcaccgcccagcgtggcgagggggtggcagaagccctgcttggtcatagggagagcagcttgggacaggcagcctgtacctccacggtcgcaacaggatgccgaccgttccctgcttggcnnnnnnnnnnggccctggttggtcacagggagggcagcttgggacaggcagcctgtacctccaacaggatgccgaccgttccctgcttggcacagcaacaagacctaccctcgatggcctccttgggggtcttgaagcccaggccgatgttcttgtagaaacgagcaccggccttcccgggggtcttcttggtcgacttgttgtacctgaaggattcgtgagatgtgggtcaatgagtgtgcctgtcccgaggtcctcaatcccttcccatgaggtggaatcgttgtgttcctgaatgtcgtccttctcctcccgcgtccgagcctcccgagccgaacgcagggtgagaacaccggtgagcgcccgtcctgttcgcagagacaatgtggcgccaggcctaagcaaacnnnnnnnnnncgaatgctgtccttctcctcccgcttgcgaggctcccgagccgaacgcagggtgggaccacccgtgagcgcccgtcctcttcgctgagacaatgtggcgccaggcctaagcaaactcccaaaaggcgcactcaccccctctgggcaccaagctgcctctggaacgccctctcggtctgcaggtgagcgggaggggtgtttggccttagcggtcatcccgtgcgcccagcacggcgtaaagcagccctgcgcgcataccgattcctacctgatccgccatattgacaaagccccgcttcacagcctcgggtnnnnnnnnnnatgagtgggaggggtgtttggccatagcggtcatcccgtgcgcccagcacggcgcaaagcagctctgcgcgcatcccgattcctacctggtccgccatgttgacaaagccccgcttcacagcctcgggtacttgcgagtcgaaagagaccgtgtcgggggccggccatgagctctgtacaggccgccgaggtggtcaggtactggagcctctgcagtaccaactggcctgttcaggcagctcccgccagtcacgcaaatgcattgcgcatttcctgacaccaaggattttgctccaagcacagtaaggatatttggagaccaatgtcatgttaaaccgaaaatatcgcgggagacatggtggctgcatcgctggcaaggcgtgtaggcttgtggggtactccactgcaagcccttgcaggattcgagatcccactgagccttcttgcatcccattccctgcctccatcaagcagtcatcagacaaatgtgctaccaacgaccacttcacataccttaagtccccctcagcgcctgcaaagtcaactggatgtgctgagtgaagccgatgatggggtgatcaaggtaatagtgacaaaaatcgtgacacatgcttgcattccattcctgtcaccagaaatgagctagtcaccgagatgattacccacaaccaggcgatggaccagtggagtgagttggtacgagcgcatcttcctctctgtgaggcatcagcggcggcatcagccatggtgcatggcgccctccttctggatcaacagctggaccagctggctgaggatgatgatgacgatgacgacggcatggatggcactggtctgatccagcacacctcagagctgccagcactgggtgagaggaaggagtggtgctatgcaaggatcgcagagctggcgcagcagaatgatgttggagaccccgctgccagccggtcggatgcattagctgcccttgtacaggtgaggggagtatggcttctgggatggcgccaacagctagtattaattccatcgtggtggaagctcaccgtctcgcgccctactactcctgcagaacctgcacagcaacaggtctctgtgcttcaagccctttgagtggctgtacactggtgtgactccgctgcgccttgccgccgtcctccaaggcggcacaggcgcgccactgctcatgggcgttgctgcagctggaattgcagatgccaaagggataccagcgctggtgctgccattccgtgagatggggcaaggggtttctcaacccagaacgggggcagcagcccggtctgcgagggcccaccttccgaccattccaagctctcagtggtggtatgtctccagtgttgatggaggagatgcaggtggcgcagctccagtgtgcattgatgtgacgaatgggaagcgtgtcaaaccagaggaggtgcagcggcaggggatggccttggcgaccacgcaatggaggggtggagtggcatgctgcaagctgatccttttccctcgcatgtggtcgaacaccgcattcgcatgctctgacatttacacctgtccctctccatgctcagtctgccgaggacagtgtgctgggcgtgtggaggggcctggtgaggctgtctatggaagcctatcagcgcaggggcgagagcgatgccgtggcgcgctggacccaccttctcctgtctctggatgctgatgcccccgagtgggaggccatcatgcctgggttcacacggtgatccctgcgggaacaggcccccgcacctttgtgtatgtttgttctgcttgcctcccttccattcttacaataactgactcccttgcggaccttgttgttccgagcacccagccgtcccccctactggatttgaggttttgcaaagcaaaggtttcaatgtacatccataatcccgcttgtcacccatcttttcactcctgactacnnnnnnnnnntccccccactggatttgaggctttgcaaatcaaaggtttcaatgtacattcataatccctcttgtcacccatcttttcactcctgactactttccaagcctgaggctttgcacactaacaagacagtggatactctggttgcatacctcagtggttaagtgcctggagcacccccctgacaatggtgttcttccccaggcgctgcaggacgcccggcgagcccgcagggggcccatgcattgggtcctgcgggtggttggcggactgcgggccggcccctgcagcaggcaggcccagcaggctcagcaccctgtttagggccagcagctggcgattggccgtgaccagggccttggtggcctggcgagcggagacgtcggagccctacatgatggcgtgcggcaggcagtaggggccacatggaatttgacagcagggaatggagggaaggaaacgcagggatgcaggagcggggtcagaccgtaggcctcttcatgccctgcggcagcacagggcaccnnnnnnnnnntgggggatggagggaaggaaaagcagggatgcaggagcggggtcagaccctgggccttcttcatgccctgcggcagcacagggcacctggatgtgttgcctaggctcgccacttcacccttcaccccctacaaaggggccaaacctcaccttggccctctcgagcttgttcagggtggccatgtggttctgggccttgagggcgagcatgcgccccaccccctcgacggtggccacaaatgcgggtcgccttgaggcattcagggcacgagcaggggtggggaggaaggcacggatggtagacaccagggccaggaacagctcctgtggtgcggcgacgtgcagtgttgtaattttctgggttgtgtggctggagtttcccagggcgggcgccaccccggctcgctacctatgtcctccagatcccagccctcacctctttnnnnnnnnnncgggcgggcgccaccctggctcgctgcctctgtcctccagatcccagccctcacctctttgtcgcgattcctctggaggagggctgcaaggaggagcagcacctcgtcggtggcaagcatggcatccaggcaggacctgggaaggtgggcgacatgtggggacggaatctggaaacaaggataattcctccccttggcagggcacgagttggcatagcgacggatttcccctctacacatccccacatggcataccccccccctctctgcttcccgttaccgacacacctgttgcgacccatgtgagccnnnnnnnnnnggtggggtcggaatctggaaacaaggacaattccttcccttggcggggcacgagttggcacagcgaaggatttcccctttaaacatctccacatggcataaaccctccttctctgctccccgttgccgacacacctgttgcgacccatgtgagccaggcacatcaccgcatgccggatcgcctcgggctgcacattggaccccgccttggtccccgagcggaggacggccatgacgatgggaagcgcggcgtcgtagcaggtctgggcgcaggcattggaggccgccgtgcacctggccagggtctcccaggcgccgcatgcctggggggacacgaaggaggagaggagtggtgggcgagggtggggcccgtttgcgaccccgatgcagcagggcacccttccgcggtgggaagtgtgctgcattttttataactcacttccttcacatcccagcctcgtcatcccagcgctcactcaccacttcggggaagggcaccgccgtgaggctgctcagcgccgtggcggtcctggacgccagggtcgtccgctggctggggggaagcaggtgcgccgcctcggtggccacgcgcaggcggccgcgagcctcggccagccgccgcttctgcgggtgcgtctggcgcacccgcccaccccgccacgcagcctggaggcgcagagctgccgccctgcgccgccgcagcgcgcgcacgcccagccaggctcgggcctgggcctggattacgatggatgcagcgcagcgtctggcatactccgatcgccaggcgcgctgtgcgagtacgacggcccgcctgctccggttggggggagagggcgagtttgtaaaacgctgccaatataccaccccccagccttggcagtggaatcttatgtcctgggtcaggggagtggccatggagaacaataggcttgggaatgcccctgctgcactcatcaccctcctgtacctgagcttcaagaaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgccgcgcggcgtgagtagtcttgcatcgcgcgcgccagcgcctccatctgcgccttcatgnnnnnnnnnntgagaacaataggcttgggaacgcccccgctgcactcgtcaccctcctgtacctgagcttcaagaaccgagtcctggcgaggaagacggatgcccatggcgcgatggtcgcccgagcggccgcctcccgggccgcacgtcttgcccgctccgccgcctcctgcgctgccacagcggccaggtggcgccgctccaggcactcccgccaccccgcctgcaggcgccgcgcggcggccgcgcggcgtgagtagtcctgcattgcacgcgccagcgcctccatctgcgccttcatggccgcgacggaggcggcgcgcacggcctccaggtgcgcgcggaaggcgcgctggatggccaccgccgcgccgcgccgccggtggtgcgcgcggcgcgccaggaagccgcgggcgtgcctatggtgggagagtcacggacaggatggtgtgaagttgactgagatcaccgtgcgagaagtccacttgtaatcaagacaaacatctcaccccatgcacaaacatttgcatccgtcccacaacccaccgctgcacgaagatcgcggccgcgtccagacgcaaccgccgccgcgccgcgtggcccctccagacgcgctgcactgccagcgcagctgcatgcagcctggcccgctcccgcctggcccgccagccccgccacgctgcctggacggccagtgccgcgctcttctccgttgccagccgccgccgtgcatggtgcccgcgccagtgcctctgcagcatctccgccgcgccgcgccacgccaggaatgcgcggcgcctgaccgaccccctccacatgcgctggatgcgggtggccgccgcatgcgcggccgccaggcgcgccgctttgactgctcgccagcgccgctgcagcagcaccgcggcctccctcaggcggcggtagttctctgcatcgcgcgcctgcaggcggtgctgccgccagtgtgcctggcgagggatggtggggtcaggggaaattgagggacacgaccagcctggactgatccccgggggtgagtcccaagcctcggcatgcggcgnnnnnnnnnnttccgcatcgcgcccctgcaggcggtgctgccgccagtgcgcctggcgagggatggtggggtcagggggaaatgagggccgcgaccagcctggactgatccccaggggtgagtcccaagcctcggcatgcggcgtgagctgacgcgggtctctcagtcatcctggtgggcacaagtagtgtccctaaggcgcgccccttcccaccattttcccccacctcccatacacaaacacacctggatgatctgagccgcacgggctctggtctgctcatggcgccgcaccgcccatccccgggccgcggcctgaattagaatcgcggcgctgcggcggcgggcgagccgcgcgcgctccagccacccacgcacgtgcgcctggagcactagcgccgcgcgccgcgccttgaggaaagcgcggcgtccgtggctggcccgccaggcggtctgcatcgcggcggcggcgagctcttggcgccgcgccgtgcgtgcttcagcgagctccgccctgcgcaccgccacgccggccaggaggcgcggcagcagcttttcctcgagcacttgcctgcgcgcctgccggccgtgccagagggcctgcagcgtgaccgccgccgctcgtgtcgcatggagggccaggcgggcggccctgccgcgccacagcgcctgcagccgagttgcggcttccaggcgcgccgcccggtcccggcgcgctgcctccaggccactgaggaagacgtgacgccggtacgccgcctgcaccctgctcgccgccgcgatccaggcgtgcaggtgcgcgcgcgcggcgcctgggccctgccgcggcgcggccgcccggcgccgccacaggcgctggatggtcatggccccccgctcctcgcgagaggcttccagcaggcggctgcacatgccgcacagcgccagcaggacggagcggtcgtctgtaccgtgctccaccacgtcttcgcctgcattgggtggaaagtggggaaaaggggccatcgtcggggcgtagcatgtcgtccatggcgcctaggtgcagctattgcgcaatacaccgagnnnnnnnnnnaggaaagtgggggaaaggggggcatcgtcggggcgtagcatgccgtccatggcgtctaggtgcagctattgcgcaatacaccgagggcatatatacatagcgggtacaaggagaggtcagaggaaccgggcgtctatagaaatacgccaaggatgacaccatctctgcatgccccggcgattccccctcccttgttctactagttccccaacccccagcccttgtattcagacctgacagcagcgcgcccgagccgcccagcgcctccatagcgagggccacccggtcgaagttggactgcaccccggcgcggtactgcctggcggcagcatcctcccggcacgacagcgcccagactgcaggcggagggcggcggggtagatggtcggcagattgtactcaacaccggcgctcacaacaccgggatgcctcccagttactcgggaaattccgcctctgacatacagggcatccgcccaaactcagcccctgcataccccatcgcgccagtaaagtaatcccatcaccttgctgctgaggatcctcggcgcccgtggaggccaggagggccggcggcacctcataaatctcgctccgtggcagcaccgcctcacccaggtactcccgcacctgcatgggagttggaggtctaggagttcaggactccgaaaagccacaacatccctggaacccgacggaccacccctcacttccggggccagtacacctcaagccggctcaccacaagctttcccctgcagnnnnnnnnnnaagaaactcaggactccgaaaggccacaacattcctggaacccaacgcgccacccttcacttccggggccagtacacctcgagccggctcaccacaagctttcccctgcagctcccagcttcgcatcccttgcacaacagcctctcatcccccaccgccctccgcctggccctcgttcatcagcacgcagcgtaccagcaggcagagcaggcgcccatctccgtacgtggcggcgatgttcccggccgcgccctgcgcgcagcccgtggccgccgccgcccagcagagcacgaggcggaggaggcctgctgcgggcccggcgtccgcctcgacggccgggggcaagaccacgccggccaggcgggccgcgtggtcgccaccctgcccgcccccgcccgt

SEQ ID NO: 17910 - DNA, 129 bp, Chlorella protothecoides
ttttttttttaccataactttaaaaagaacatacaaatattttttatttatatttgctttgtttttaatacataaaaattaaaacataaagcacaaaattttaagaatattataaacttaaatttttct

SEQ ID NO: 17911 - DNA, 218 bp, Chlorella protothecoides
aggaccttattccgctttaactcaacaacctgttcgaggacgagcaagaaatgggggacaacgtttaggtgagatggaagtttgggcgttacaagcgtatggtgctgcttatactttgcaagaactaataactataaaatcggatgatatagatggtagaaatgaagctgttttgcgaattttttataataaacctattgaaatgaagcaacccgaaa

SEQ ID NO: 17912 - DNA, 74 bp, Chlorella protothecoides
ttctcgtagaaaattggtatatgtatacggaaactatgttacttcgagaaccattgccattaaaacgaaatttt

SEQ ID NO: 17913 - DNA, 103 bp, Chlorella protothecoides
gaaaatactaacttaacattagcttttattattattgggactgaaatgcaccgtaattctagaggaaagaatgacaaccttaatgtcaagtctgaaaataaaa

SEQ ID NO: 17914 - DNA, 1370 bp, Chlorella protothecoides
cgggggccgccgcgggcgcgccgtccggccccgcgctcgtctccacgggcgcccccaggcggcccagggcccgctcgccgccgccgccggcctctgcggcggccttcttcctgccgctggtggccactgggaggagggcggcgcggacgcgacccaggcgggccctcaggcccgggatccgcgagccgcaggcctccagctccaggcccaccagcttctccaggagcgaggccacgggcgccagctggcccaccagctcgtccttgtgattgtccaccactgcttgttttgggggtgggtgggggagagagacgtgacggggacaggagcgtcggtgggtagcgaaacagcaaactttggggcatggcaggagcagtccagatggcagcaaaaaatcgtcactggtcatcgggggcgccagcatggtgcctgggctcactgcacgcccgcgccgggccaagcagcgtgaagaagatcgccagtagcgcccacagatagacgctggtacaacacctccaaggttcccctgggtgattgagcaaaggcaagaccatggttccccatgtcgccaacctctttgccccctcccccatctccccggggaccaaggacgtacagagggctgccaggtgctccaggcagagcagggccacctccacgttctgccccgccaccgagacgtcacgctgtgcgccgaccttcgcgctcagcgtgccctcccgcaccgcggccaggtgccccgccgagtcctggctgtgggcgtcgctgagcaggccatgcactggaattcagatggatggagcgcaaggagctggatgcacggcacatcgcaagtatgttgggtgggaggagcgacatacagaaccctcacgcctgtgcaagaccatcgccagcccgtctgctacatccactccacccgccagcgttcactcccattccaccctccgacccaccagcgtccaccaggctcgtccatgaggcgtccagcgcagattgcagctgggcagggggggaggagggttgcgaagggggtgttgagagggtgcctacagtgattgccagccccagtcaaggtcccacatgctgcaagcctcgacccacttcctgaccaacaggctcctcgacgccgacccaccccctctcaccccgccacaacccaatcacacacctggaggtggaaggcgcagatccagaccgcgcgcgcctgcaccggcgcattcagcgccctccagttggacgcgatctggaggagcaggccctgcacgtcctgcgccagcgcggcggtgcggcggtgcagcccgaccagggcctgcgggcccgtttggacggcgcccgcggcgtcgccgccgggctggccggcggccgtctgg

SEQ ID NO: 17915 - DNA, 242 bp, Chlorella protothecoides
ctaatttataaaatataaataatatttaaaatagagtttagtatggatttgctcttttattttttgttaaaaactataaataaaattggaatattgctatttttacacattccacctattaacgtagtagtcttctacgatactaaaaacttgttttcaggttagtttcccgcttgagatgctttcagcggttctctagtccgaacgtagctactcagctatgctattggcataacaactga

SEQ ID NO: 17916 - DNA, 158 bp, Chlorella protothecoides
tcttattataataataagatgaaggtatagtctgaaccttaagtaattagggatttttctaagtaattagaacttgtttattaaaactgtaatctcatttaatacgtttgtaaacgcttagagacagtatgtatcctatctttttggggtgtaaaaaa

SEQ ID NO: 17917 - DNA, 217 bp, Chlorella protothecoides
atatatatattataaaataagagattatgacaacgtatcatcaattagtcccggctaatttcgtgccagcagccgcggtaatacgaaaggggcgagcgttattcggaatgattgggcgtaaagcgtgcgtagattgtttttacttatttctatacacagatataaatatcatttatattgatagaaaatttatataaataaaaacttgagtatttat

SEQ ID NO: 17918 - DNA, 362 bp, Chlorella protothecoides
cctgaagcaccgccacgtgtaaaagcttccacggccggctgcccaaaatgtggatcccagattgcatgagctattggtcggatatgaagaggatcttgaacccactgctcgaaatttccttgccaagctacatgaaaaaggtttccagaagtccaaagaaatataatcgctaattggccaaaatgtgatgcaaatattttttgataaagacgttcttcagtcataccatcatgactttcgaaatcatgagctgtggctaaaccataccaaagcctacgtgtagttggatcttgtgctaaggcttgactaaattttggaaattttgttgccattttataattctcctattaaaggcaatcttt

SEQ ID NO: 17919 - DNA, 74 bp, Chlorella protothecoides
cactccagaggatgagccacgcaacatacttgaagagatcgtctggtgggtgccttgtgcatgaggcatgcatc

SEQ ID NO: 17920 - DNA, 904 bp, Chlorella protothecoides
gagcctgtcgcattgcattcatcaaacgctgaatagcaaagcctctacgcgatttcatagtggaggcctccagcaatcttgaacactcatccttaatacctttctttttggggtaattatactcatcgcgaatatccttaagagggcgttcagcagccagcttgcggcaaaactgcgtaaccgtcttctcgttctctaaaaaccatttttcgtccccttcggggcggtggtctatagtgttattaatatcaagttgggggagcacattgtagcattgtgccaattcatccattaacttctcagtaacagatacaaactcatcacgaacgtcagaagcagccttatggccgtcaacatacatatcaccattatcgaactcaacgccctgcatacgaaaagacagaatctcttccaagagcttgatgcggttatccatctgcttatggaagccaagcattggggattgagaaagagtagaaatgccacaagcctcaatagcaggtttaagagcctcgatacgctcaaagtcaaaataatcagcgtgacattcagaagggtaataagaacgaaccataaaaaagcctccaagatttggaggcatgaaaacatacaattgggagggtgtcaatcctgacggttatttcctagacaaattagagccaataccatcagctttaccgtctttccagaaattgttccaagtatcggcaacagctttatcaataccatgaaaaatatcaaccacaccagaagcagcatcagtgacgacattagaaatatcctttgcagtagcgccaatatgagaagagccataccgctgattctgcgtttgctgatgaactaagtcaacctcagcactaaccttgcgagtcatttctttgatttggtcattggtaaaatactg

SEQ ID NO: 17921 - DNA, 728 bp, Chlorella protothecoides
gatttatgtttggtgctattgctggcggtattgcttctgctcttgctggtggcgccatgtctaaattgtttggaggcggtcaaaaagccgcctccggtggcattcaaggtgatgtgcttgctaccgataacaatactgtaggcatgggtgatgctggtattaaatctgccattcaaggctctaatgttcctaaccctgatgaggccgtccctagttttgtttctggtgctatggctaaagctggtaaaggacttcttgaaggtacgttgcaggctggcacttctgccgtttctgataagttgcttgatttggttggacttggtggcaagtctgccgctgataaaggaaaggatactcgtgattatcttgctgctgcatttcctgagcttaatgcttgggagcgtgctggtgctgatgcttcctctgctggtatggttgacgccggatttgagaatcaaaaagagcttactaaaatgcaactggacaatcagaaagagattgccgagatgcaaaatgagactcaaaaagagattgctggcattcagtcggcgacttcacgccagaatacgaaagaccaggtatatgcacaaaatgagatgcttgcttatcaacagaaggagtctactgctcgcgttgcgtctattatggaaaacaccaatctttccaagcaacagcaggtttccgagattatgcgccaaatgcttactcaagctcaaacggctggtcag

SEQ ID NO: 17922 - DNA, 61 bp, Chlorella protothecoides
tggagggccccggggggccgagagggggggtggatgtagataactcgcgcacgggctgcag

SEQ ID NO: 17923 - DNA, 119 bp, Chlorella protothecoides
cctggcacttgaatcttcctcaagctttcacgagtttacaaagctcgcaccctgccaggtttgagaataagtatggtacgcaagatctttgataccttgagatgttgtggcagcgaagg

SEQ ID NO: 17924 - DNA, 77 bp, Chlorella protothecoides
ttagataattttaacattattaatcatttttaattatttattaatagtgtgatagcttgttattgtattagatgata

SEQ ID NO: 17925 - DNA, 368 bp, Chlorella protothecoides
aaaaagcagcaatttaaaataccttatttattaaataaatcagatttattttacttcgtacaccaagtacaaccaacaataaaatataaattaagacttatatttaattaaatagtgttcaatttttcctgttaacggtacagctactaaaaaataaaaaaagaaaaatactgaagcaagttgtccaataataatataaggatcttcaacaggtttttgacctatccaacttaataagaaacaatcagctaaaatacaccagaataattttctatgtattggtctgaaattgttactacgtataggtgacgtatttaagaaaggtaatgaaaataaagaaacaaatactagagcaatggctgcaacac

SEQ ID NO: 17926 - DNA, 65 bp, Chlorella protothecoides
aaacaaatactagagcaatggctgcaacaccagctaatttgtttggaatactacgaagaatagca

SEQ ID NO: 17927 - DNA, 66 bp, Chlorella protothecoides
acgaagaggctggcgacgacgaagaggctgacgagtacgaagaggctggcgacgaagaagaggctg

SEQ ID NO: 17928 - DNA, 61 bp, Chlorella protothecoides
cagctccgagacggggaggtcgcggaaggcaccgccagatgccgttaggatgatgcgtcgc

SEQ ID NO: 17929 - DNA, 90 bp, Chlorella protothecoides
ttttaaatttttaatcgacccaccttctggaacaatttcattaattgagattcctaaatcatttaaaagtctttttaattctcgacaatc

SEQ ID NO: 17930 - DNA, 87 bp, Chlorella protothecoides
taccattgcagcaaatataggtaagtttgaaaaactaaaacatatggcaatgttaactcgtgattataaaatgcattctattataat

SEQ ID NO: 17931 - DNA, 73 bp, Chlorella protothecoides
aaaacggtctataacctaatgggaaattttggatatgtacaggtgctgaaataacaccacatggtatatctaa

SEQ ID NO: 17932 - DNA, 272 bp, Chlorella protothecoides
tgatctagtcatgaacaggttgaaaaaatgctaacacgttttggaggaccgaattcacgtctgtggcaatagacggaaatgatttgtgactaggggtgaaaagccaatcgaactcggagatagctggttttctgcgaaatttatttaggtaaagtctagaatatatataacaagggggtagagcaactcgctgggtaagggtggcccaaagccttactaaatccaaggaaactcctaataccttgttatactctcctagaatcagactttgg

SEQ ID NO: 17933 - DNA, 223 bp, Chlorella protothecoides
cgtggagggcggcaactgatctgacattcctatgaaaccctcatcacctttgcgttttcccatgcaagaagctggactcgctcatagccctctgtttctctcagtagcctacatgcttgcaaggtgccattctttgtgtacatcacgcaacaccccttcattctgccactcatgctcaagatatactccatcatttgcataccacttgaaggagtcaagaata

SEQ ID NO: 17934 - DNA, 105 bp, Chlorella protothecoides
ctatcgctctgtactcgatactcttacgtttatacgatataaacgaattaaaaatgcctcttgcgatgcgttcgtatccctactggccacgacggggtctcccga

SEQ ID NO: 17935 - DNA, 149 bp, Chlorella protothecoides
ggttttctgaacactgcgccctgaggatgctggcagaaggtgtctaatcggcccgtcttgaaacacggaccaaggagtctaacatgtatgcgagctggtgggttgcaagcccatgaagcgcaagtaacctgactggtgccaaggccggg

SEQ ID NO: 17936 - DNA, 228 bp, Chlorella protothecoides
actgcatacatgagctccagctatcctgggggaaacttcggagggaaccagctactagatggttcgattagtctttcgcccctatacccaagtccgaaaagcgatttgcacgtcagcacatctacgagcctccaccagagtttcctctggcttcgccctgctcaggcatagttcaccatctttcgggtcccaacaggtatgctcgtactcaaacccttggtagaaacg

SEQ ID NO: 17937 - DNA, 268 bp, Chlorella protothecoides
ggatccaagtccatggcctttattagctagttttgcagtatttttttcaacaacaggtggagtaatgtacatgcatgcatattctggtggaggtattttattggcttttggtcaattatcactattttatgttatgtatgtatggtggagagacgttattagagaagctacatatcaaggccatcatactactcctgtgcaagtaggattacgttacggaatgttattatttattctttctgaaataatgtttttctttgcatttttt

SEQ ID NO: 17938 - DNA, 125 bp, Chlorella protothecoides
tttttttattaattttattaagttattttattctgctttaattttattaattttttagaaaaacaaaaaattagttactaactgtcaaagtaatagaaaaattatctgcaaatttattacttttt

SEQ ID NO: 17939 - DNA, 65 bp, Chlorella protothecoides
acaaaaacgagcccaaaagctagctctttcacgtctttctaaaattgcagtcataattaattcct

SEQ ID NO: 17940 - DNA, 96 bp, Chlorella protothecoides
tttctaaaattgcagtcataattaattccttatatttttataaaagggattctctcaaaattaaaattatacaattatgtataaatatttgcatta

SEQ ID NO: 17941 - DNA, 108 bp, Chlorella protothecoides
gaggggtgacgccagaggtctgcaggagggttagggttagggttaggtttaggttaggttaagttttagtttttagggttagttttagttttagttttagttttagtt

SEQ ID NO: 17942 - DNA, 322 bp, Chlorella protothecoides
caaactctgaatactagaaatgacggtgtagtagtgagactgtgggggataagctccattgtcaagagggaaacagcccagaccaccagctaaggccccaaaatggtaatgtagtgacaaaggaggtgaaaatgcaaacacaaccaggaggttggcttagaagcagccatcctttaaagagtgcgtaatagctcactggtactagcgtttttgcgccgaaaatgtacgggacttaattatctgccgaagctgtgggatatatgaaaataatgtatatataaaaatacaatttatatcggtaggggagcgttctgctttaggg

SEQ ID NO: 17943 - DNA, 86 bp, Chlorella protothecoides
ataactgtccttgatttatttttataatttgaccattaaatggcgagacaaaattgtgataaattggttgaccccatcgtaaaatt

SEQ ID NO: 17944 - DNA, 88 bp, Chlorella protothecoides
tgctcctatcccgtcgcgatgaacttccccttcaaattccacaataaaagcctttttgaatgaggaatacctaacatgcatcatccag

SEQ ID NO: 17945 - DNA, 122 bp, Chlorella protothecoides
aatgaggaatacctaacatgcatcatccagggaaggcttacctaaacaaaagcctccgctatgtctcttatattctgaagaaggaaatccctctccttctcaggcattcctccttcgtcagc

SEQ ID NO: 17946 - DNA, 448 bp, Chlorella protothecoides
ttttttaattttagtaaaattttaaaattaaatattgcagttttttctagagacgaatacaatattataaaaatataaatatacaaaaattttgttaaatttccgtaataaaatataaaggttcaaactgggtcgatgcccgagtggttaatgggggcggattgtaaatccgctggctttgcctacgctggttcaaatccagctcggcccaaaaataaaaattaatttgctgactgactactttctgtttttacgtaaagaattaaaagaaatgcagtaggaataataataaatagagcagttgcaattaaaccaagaatatttacttccattaaaatatatcctttttatttgttaagtattatatatttaaatccgattcaataaaatttaaataaaaaataattttttaatttatcctttttttattctactctaaaataaaaaa

SEQ ID NO: 17947 - DNA, 68 bp, Chlorella protothecoides
aatacggttatatcatttcgatgcaaaaataataatggtcgtattaacacattatacaaagaattttt

SEQ ID NO: 17948 - DNA, 65 bp, Chlorella protothecoides
ggggaagcctccggagagggggcccccacatctgcattgatggtgctgcgagacccatacggctg

SEQ ID NO: 17949 - DNA, 305 bp, Chlorella protothecoides
tcaaataaatagactttgtacttttattatttttaccaatactcgttagttattgagcttataaattaagaaaaccccattatataaaattttggtaaaataactatttttaccaatattagtgtaaattaatagcatcgtttaagtagatacaaataaggattgtaaatacatatgcttgtaaacaagcaactccaatttcaagtcctgtaagagcaaaaactacagcaaaaggtaaaactgatgctactgatagagcaccacctacagaaagcatagtccatgcaaacccacttaaaattttt

SEQ ID NO: 17950 - DNA, 447 bp, Chlorella protothecoides
gtacagctggtttattatttcattttgtaactcaaaatggagggtttttagtaccaagccgttggcaatcactagtagaaatgatttatgagtttgttagaagtctaatacaagaacaaatcggtgcaaaaggaagaaaatactttccaatagtatttaccctatttgtatttctattatttacgaatttaataggtatgattccgtatagttttacagctacatctcatttagctgtaacttttggattatcactttcactctttattgcaatcactattattggtttccaaatacatggcctacacttttttagttttcttttaccaaaaggcgcacctttaatattagcaccattattagtagttttagagttagtatcttattgcttccgagctattagtttgggtgttcgtctttttgctaatatgatggctggacatactt

SEQ ID NO: 17951 - DNA, 170 bp, Chlorella protothecoides
tttttttaaaagtaaaaaactttgtacttgaccgtacgatgttttatactagtaaaattatatctgatattaatagagtttcttttatttgctcaatagctattagtttagcaactcttccttattatgcttataattatatattaacaggaccacttggttttgtttca

SEQ ID NO: 17952 - DNA, 322 bp, Chlorella protothecoides
tagatgcatctattcaaacaacaagtggaacaagtgcagcttcaacagaaattacaaaacaagaagaagtaatagaagaaaaaactacttttgatattattttagaagaagttccaagtgacaaacgtgtacctattttaaaagtaatacgtaatttaacttctttagatttaaaacaagcaaaagaagctattacagatttaccaaaaacaatcttacaaggtgcgtcaaaagaagaatcagaaacagcaaaacaacaattagaagctgcgggcgggaaaattaaagtatcttaatgtttaaaaatatttattatttataa

SEQ ID NO: 17953 - DNA, 953 bp, Chlorella protothecoides
gaatgggagcaggtggcacagactcggatgattgtctcgagtacagtggggggcccaggccggttttgctctgttgctggctctttcacgactctcccccttgttgtgtgatgcgaactgacattgacacattgtacgagtttaaatggcagacatccacagatacaaagggtagcatgagccccccagggtgtgatccagcggttgaatgggactaccagttcagggtcagtgtatctgaggtcccgccgccagtcgtgtaggccacgacctgggcgtaggacgcgagagctgcttgtttgctgctgagattgatggaccaactcatcggattgcctgagtaggatgctgtgctcacggtgatcacgccacccgtcgcagcgaagaaggcggagttcacaccgtctggtttgttggctccaaagttaactgagaatctgaacgtgttcccactctttgtgatgctcccggtgatggaaccatacagtggtggaggtggggcgggtccaacaggggttggcgcagggttgagcagagtcaacagtactacttctttgagaccaaaaccattttgtgacattgatgcagagccagtgaaataggatgctgctatcgttgccggttggtttgtcagggataatgtggaggtagcagagctgggagcgagtgtgttaagcttgctgagcaattctaaggtggatgagatgagtgtgcatactatcacagacggaacgtaatcggttgtggtgactacacatttgatgtccactcgaccatcgtttggagcactgaattcgactgtggctgatgcttgtggcggttgtggtggaggtgagggaaggggtggaggtggtgagggtggtaaaggtggtgaggaagggggcctggggggagagggcggcggcggcactggaggggggcttgggggtgacggcggcggcggcaatggaggg

SEQ ID NO: 17954 - DNA, 109 bp, Chlorella protothecoides
ttgtcttttttcaaataattggaaaaaaatttaaataatatgaattaaattttctattatttaagagtaactatttcaattttaattaaaaaaattactctataattaa

SEQ ID NO: 17955 - DNA, 205 bp, Chlorella protothecoides
tacctaaaccatctaatacacggcctaatacacctttacctgatggtacgtcaacaatggtacctgtacgttttactaaatctccttcgctaatagtactgtcactaccgaataatacaacacctacgttgtcattttctaagtttagagccatacctttaacaccacttgcaaattctaccatttcacctgcttggattttttt

SEQ ID NO: 17956 - DNA, 94 bp, Chlorella protothecoides
tcaataatagataaagcgttacatatgtaaatgttataagaaaaaagagtacataagatttccaaatttatggcattatctttaagtgaaatat

SEQ ID NO: 17957 - DNA, 732 bp, Chlorella protothecoides
ctataccttcatcttattattataataagagttgccgtgttatatctttaatttaaaagatatcttaattctaatctagaactaaatataaattataacttatatttgtttacatagatatagattataatttaaaataaatgagatttattatgtccagttgtttttattagatatagaattaaagtcgttacggggtcactgaaatataaagaattgtgcacagtatatcatgactttctaggcaaaatagactaaagagatacacattttatttcttatattatagacttcccacggtattcccctaatgagtgtatgaggctactattaggacttcaccgttatgaggcaatttttacataaggattgctccttaaggtcgcaagactctttacgacgtattaaacccaactcacgtaccactttaatcggcgaacagccgaacccttcgaaccttctgcagctcgaggatgtgacgagtcgacatcgaggtgccaaacgattccgtcgataagagctcttgggaatcattagcctgttatccctagcgtatctttgatccgttgagcgagagcctttccacgaagtactcccgggtcactatggccgactttcgtctctgtttgacttgtaagtctcacagtcaggcaagcttataccattacgctctacagctgatttccttccagcttgagcttaccttcgcacgttttcgttactttttagaaa

SEQ ID NO: 17958 - DNA, 131 bp, Chlorella protothecoides
ttctttcgtcagcacaagtgttggaacctgctaaaaatccacctggggacgtgccacgaccccttctcacaccattccattcagctcaaattcgccatctaccagaccttctgacaacatggcgcgcaagt

SEQ ID NO: 17959 - DNA, 138 bp, Chlorella protothecoides
gaaaaaacgatttcattaaaccactaaaatttaagttggatgaattctctactaaacgtcgtaattgctcttcttgcgaaattgttaaacgatgacgctctttaaaagcaagaagccctaattcttttgttggagctt

SEQ ID NO: 17960 - DNA, 85 bp, Chlorella protothecoides
ctgcaaaacttctttatattccaatattaacttcaccaaccactggtggtgttacagcgagttttgcgatgttaggtgatttaat

SEQ ID NO: 17961 - DNA, 5263 bp, Chlorella protothecoides
ccccccccccaaatctcatcctcctcacccgcacgtccaggtccaagtccttcagcgtcacaaagggcttggtctcgcgctctgcccctgcggtgcggccgtatcgcgaccctttgaggtcgtaccgccggtgcagacgcaggtgtgtgggcagcgcgttctgcatgatcaggaagcgcacctgttgaggtgggggcggggggaggggggggagcgtaagatgtcatgccagggtgcaggaacgagcccagagacgaccttgcaagtcaacccgaaggagatagcttcagcctggctgcctcctcactcaccctcctgcccagcagcggcgatacacggtgcacgccgaaaaagcggaccagcagagtcttacgctcggcctttacatgcttgtagtacatggggatgaagcggaggatgagcttcatctcctccttgcgcaccgtcttggcaacaaacctgccggggagggaatgggatggggctgcgagggtgcatgctgtgtgggcgatgggcggtatgtctagagcgccaggccaaggcgttgtggccaacctttgtgtgaacctgccagagagaccggactctaaaccccatccccccacgcccagcttcccccagtggccccccgcaccggtcgtcgcccgatatgaggaagatgctgccgctctttcctggcgatggcagcagtcgaagtgcctcgccgccggtgagggagagcaggtagtcgctggaggtcaggaggggatgaggttgaaggaagttaaggtttatttagagcacatgcacggcaccctgatcaccggtctggctcccatccacaagcaagtccaccaaccctttggaggcctaaagcaccgtctcctcacccgttatcaatgccgaatgcttctctgagtgcctggaagagcgagggcaagtagtccttccagacaaaaccgggtacactgcctgtggccggaatggcagccttcttcacctcctcgccgttcaagtccgcgtccccattcccggaatccttctgtggatggagcggttgctggaatgcctcctgagcatgcacttgtgtgggtgacatgacattggagcgggatgtgtgtgcttcccactccgcagggcccagccctgcttgcaggggcaaggtcgatgcctgcatgatgcactttccacccacgatgcagcccaccatgccagaccctcccagcctccccacctgcgatctgctctgggctatgctgtacgtgagcccaagctgcagctgctgcacaaggtcaaaactggaacagggagcagagagggagtaaggtgagaggtcggtgcagggggcagatgcacgcctcatagacgcatatcttgcaagttatatggtaccattcctggacctgcagcgaccaaaaccccttgtagccccagcctcacctccggtggcctcgatacactgcctctccaggacgtggcgagcgatacgtttccttggctgcaaacggcaagggagcatacagcaggctcaagagaagatgcttttcgagaacagagacactctagatgggtggggcaccagtattattcggcccatcttgagaccatgcacgaggcttggccctcaaaagtgcaccagaaccaccaacaaacaagccttgctcaccctttttcctctctttccggctggccttggtcttgtgtgagggacccgccacctccaggatctcctccttctccagcttgccgttgtcgtacacacgcatgctcacggcggacttgcccctgcgcatggagtgggatgctgatgagctgctggcgagcccgacgccagggagtaattaggggcccagtcacacacccaggtgaattgcccatcctcagccagcgtagcacaggggcgtcagacttgtcgagcacccgtctctcagcggcgagcgaatgaacaagctcactccgcaacccgaaacacacggccgaatactcacccctccgacccccaggatagccgccccattcagtcagctgccccttctccaactcactttgccagcgtgtgcaccacctccccatgcaggtgcccggccatccagttgccaaagtaggcgccgccccccgccgccacatacacgcctgcgccgtgcgccttgccgccgctgagggtgccctcatagcgcgagccatcggccatcatgaccaggcccctgccctccagctggccggcctgcacctccccaaagtaggtggcgccgtcggtgagctggatgcggtgctccccgtcgggcagggggtagagcggaggctcgcagaccaccataaggagcccggcgggggtgagcggcgcctctggcccctgcacgatggcaaagggagagtgcccctgggacaccgtgctccactccgccgccggctcgggctcggaggaggtggtgggggtggcgtccgatccattcaccctgggggcgggcatcccgtgcccaggaggaggcctggtcaccctcgccccaggatcaccctgccgcagggcggaggcccggttgggggggcaggggccagcggagacggggacaaagtgaaggaacagagagcagggccgatggcgacgctgatcggaaggtcaggtggccagtaccaggcaaaggggggggccggaagcactcaaacctcgggattcattgttgggagctcgcacaggagccgggagccatgcaatccaggtacggctgtatgttcagagaacgaatagtcgggggattccaggagcggaggcctgcgcggtctgatcacgccatccgagcgcgtacgtcgtcgcgcccagggtgtcctttgggcccggccagccagcgcccgctgagaagcttgaacaagagctgctcgagttctgctggctgacgacgagggtgtccatgctccatccattcgatcactgaggttcgattgttctttcgggagggtggctcgaaattaatgccgtgcagagcctggcacaactgaatggcagcccagtcctacgacctccgcttccggcatatcaacggagacatcgggcccatacagttcccgctcgcagcctccgtttcggatgttaaactgaaattgtggcaagactggcccacaggtgcgcatggcgaggtcccggtagagttggactgggtggccctgccctccgtgttccagcacctcggtcgcctccccaccacgcagacgggcctgtgtctcgggaaaggcccggaagccccgcggaggtcaagctcatatgcagcggccggtttctggatgatgcgcagacgcttaagagtgagttggggaccaccaggctggctgtggaggtggcagcctgctgcggggaaaggtgatgggcatcatgcggacctcagaaacagggccagccattcatcccctgcaggtctaaccagcatagtggggccacctgtcaaggaccagcttgtcaccatacatgtggtccttcgccccgtcgatgccgaaaagggagccgtaggtgcggcaccccaggatggcgccttgagctgtgtgtggccggtgtcaccccaggagaatggccctgcatgccagcacagcactcaagggcccatttcacttctttctatgcaggtccggccccagtcagccactcgtcaagatcctgctgcgtcatctcttgagaacagaccccttgcgctctgccgccagaccttgcagacactcgacatgccgcaggctacccagtacccgtgcccttgttattttcctcgacttgcaccgccttcatgtcagggcgtctgacacgacagcctatgtaaacctcgatcaggcctcactctggattatgtgctgaagtgcatgggcatgttaaggaggggcgaggcactggcattcagccacatgggcatccttctcattcgtcgccagagccttggagctcttcgtccagatccagggagaactcctcatcgctgggcgccgcctcggcatcgctgtccagctcggcagacgcatcctgcggggcgcaatgtgatactttggacgatgccaaggaaacgagcacatgtgatggccaggtagcaggcggcgctcggccgctgggtcaaacacggtcatcagcccacccacctgggtttctgccaattcgtcctcaaagtcggaggcgggggccgcctcatcatccgtcccctcggcctgctcaggctcggcagccactgccaggtctccctcgaagtaggagggcttgaggcccagcgagacgcgacccttctccagatcgatcttgagcacgcgcgcgagcacgcctgcatgtgtgaaggaggggttggtaggctggagtcaagcttgaggtcggatgcatccccagcagcactcaggcagcagcgccaggtgagggctattcaccgatcccttggtcacccactttgaccaggggagaagagcgaccctgggttcttgacccgggtatccgccagctgggatatgtgggccagacctggacggagggggtggagaagggtaaggcagagctcaggcctcgatgggtgggggtgggggtacgcaacgcagcctcagggtttggcagcggcagagcgcagcgcacaggtgccgggagctcatgccgatggccgtacccagcaccccggcgcccgctgctgctccccaggggccatgagctcacaatcaggctcgaccatgaccagctgttcactggtcctcagttctcatgctgtgggtccagtgcacagtcgtctgccagcatgcatggcctccctgtgccttgccagacttcaccgtttcccagatccaccagctggaaccccctttcccacccccatcaatgcacccagcccaccaggcacggccagcccacccacccgaggcgccgccctccagatccaggatcaggccgaagttctccaccctgcggaccagggccttgaccgcgtcgcccaccgccagccggcccagcgcagcgacgtcccgctccggccgcgttttcctcgccttgcgcgtaagctccaccttcccatcctgcacgcggatgacggaggcgagcaccagccgccccacggggaaggcggcctgcacgtcctccacgcggctgccctccgcgttcagcttggacaggcgcagccgcccgtccagcgcgcggcccagcgccaggaagacgcccgcgggccccgcgccacgaacgtaccccgccacgcgctggttgggcagcaggctggcgggcgtggcgccgcgcggcagcggcgccggcagctcctcgccggccggcagcatgggcggccgagccgcg

SEQ ID NO: 17962 - DNA, 264 bp, Chlorella protothecoides
aatttttatttctgatattaatagcctttatcgcaaagttttaacacggaacaaacgaattccgcataaaatgcaatttactgtatttgatcctgctttaagtagtagttggaatttatggtgttttaatttacgtttactccaagaagctgtagatagtttattacaaaccggaaatgttgattcaaatcaaaatgaattttcaagtttttcaaaacaaggaaaaaacacaaaagcccttatagactccctaaaaggaaaaaa

SEQ ID NO: 17963 - DNA, 78 bp, Chlorella protothecoides
gtgctgcagaagtgcatgtacgtattggtcgtcatgtcaaaccgccgctcatggttctaggcggtggaggggggagca

SEQ ID NO: 17964 - DNA, 4527 bp, Chlorella protothecoides
ccccccccctccaccatcccccccctccttccctgcccataaacacgcccaccatccactgattcatcctttggaacccttgggactgggggccgtgcgcggccctcgctttctcggggtagctgtcaattgatcttcatgaccctggccgtgctgtgtcccgggcggctcgccttgcctgcaagccagaccccgagcactgagttttgtagtctccaggatcttttcagtcgacaggagggtggccaatcggtggacttgggacagaggaatgagttgaccgcagggttcctggtcacgaagaggatgcatggtgttacatcattctagcagtccatgcctcgcagtcaggtgcaggacatgcgggagatgggtgggcacggtgcctgtcccccaccctgggagtggctgggcctgccccttccccgagtgggtcagagggtccaagtacggtagcagcagccacgccacggatcgcgcggcgggtgaggtatggccagcccgtgccgccgcgcactttgacagtggggttggtcgtggcccagcaccactgctgccgtgcgccttgcgccgtactcaagttcatgggcccctccaggcacgccgctcgccctcctagtccagcagggcgccgacgactccggcgccgacggtgcggccgccctcgcggaccgcgaagcgcaggccctgctccatggcgatggggtgcatcagctcaaaggtgcaggtgacgttgtccccgggcatgaccatctcagtgccctccggcagcgtcacagtgcccgtgatgtcggcggtgcgcaggtagaactggggcttgtagttggtgaagaagggcgtgtgccgcccgccctcctccttggtcagcgcgtagagctcgccggagaagcgggtgtggggcttgatggagccggggcgggccaggacctgcccgcgctgcacgtcgtcgcgcttggtgccgcgcaggagcaggcccacattgtcacccgcctgcccctcgttcagctgcttcttgaacatctccacccccgtcaccgtggtccgcaccgagtcgcggatgcccaccacctccacctcgtccccgaccttcaccacgccctgctcgatgcgccccgtcaccaccgtgccgcggccctgtggggaattggtggggtgtgtgtgttgggggggaggggggggggtgtaaatgagagcaggggggtgaagctggaaagcatggagggggtactcaagtgtgctgtgaatggtctggtgacggtgggacaaggccaggccgcatggacttctgaaactttgacagggatcccccctctgaaaacacatcggacctgaatggagaaaacgtcctccacagacatgctaaagggcttgtccagggcgcgggtgggctccggcatgtaggcatccacctccgccatcagcttcaggatggcgtccctggggggggggggcagggaggggacagggtggggaacgtggtggggcggcccagcgcggggcaggggcgtgcgacgcttggcgcatgcgccaaggggtttggggccggtcagacacgcatcaacgtttcagtgggccggggcgtgttgccccggccctcaataggaaggcaacagattactgtaatgtatcatcaccccgggccctgtctcaacaggcaggtgcgtgcgctcaagggcagcacgccatgcacagcttgccaggccatccataccacagctcacctgccgatggggtggttctcgcccttaagggctgccagggcagacccacgcacgatcgggatctcgtcgccaggaaacctgggtggttatgaggcggttattttggggtcgtccacgtgacaaaggtgggtggtgctggtggggtgcgggcgcgctgttaccagaccacagcttcttggggtgcctgttgggcacagcagccacccaacagccccgcaacgcgctcacttgtagaaagagaggagctcgcgcagctccatctccaccagctccaccagctcttcgtcctccaccatgtcaatcttgttgaggaagcagacgatggaggggacgcccacctgcaggcagggtttgggggcgaggtgctccttgcaaggggcaggataatattcaggcatgggaagcagtcattagggcagtctgcagagcactgcaacacgacacccgctttcccaaagagtcaaacacacaagagctaaccacccccagccaccccttcgcttcccaccgtctcacctggcgggccagcaggatgtgctcccgcgtctggggcatggggccgtcggtggcggagaccacgaggatcgcgccgtccatctgcgccgcgccggtgatcatgttcttcacgtagtcagcatggccggggcagtcgacgtgggcgtagtgccgcttgtcggtctggtactccacgtgcgcggtggcgatggtgatgccgcgcgctttctcctcgggcgccttgtcgatctcgtcgaaggccacggctttggagttgccggcctcggccaagacctgggagaggaagggtgggtgctttctgccttgggaaatccccgcgctcggtaccacgccgggatcgaccagtctatgctgtgccaccgagtgtccgaaggattaattccatacctcccggaagcgagccgagctgacatgcattgccttccctgctcgaggggcacgtgcaccctgtctccgctcaccttggtgatggcagccgtgagggtggtcttgccgtgatcgacgtgaccgatggtgccaatgttgaggtgtggcttggaacgactgttaatatcgtactccgcgctgtatggtcggctgctcagcgtcaggtgcaggggtccggcgctgtgcgaggacagggcgagactggtgatggacccggtggtgcatgcgtatcagtctctattgaggcatacatcaaaggatgcaaagagccggattttcctgcgctgtcctacaaaactcacatccgtgcgacctccgcctgtgtcgccggcccagcctgcacgagggtggcgcatcgggccagggcccccgccgcggcacgccggaacatcctagcgcgtcaactgagtgtcagtgtgcaagcagaagagagctgcaggggcgtggaggccagggttgagcaccctcaagacgaagcgtgaacctgtggcccttggtggaaagcaaggagaccaccaccggactgtaccccactgacgatccgcattccatgggtgctgacacgaggtggggcatcgaaagcatgagagaggtgaatggcttattattattccggcttcaccactcgaactcgcaatggggcgttgcatcgccggccgcagaacgcgtgtgctgctgatgggaaccttgccatgcaatagctggcttggtggggcgtccggcacgtagtataccgttcctcgctccgccatcggccatggaagacacctcgaggtatggccattgcattttttcagtatatttccaggtctgctaccgaatcatggttgcctctccagccattcaaaggacatcctaaactaccaacccaatgccaggcccccgctcctgtcacccgacctgccccgcttcccgggattctgtgatggtgaagatggcaatcctgaacctgactggagccctcccccctcgccgttgtcctgcgaggatgtccatgacatggcccccgacggcgcattcctgaccctggagggattcagggcgcactcacagctcgcccatgtcgccttccaagcagcacgggtgagggtgcgggtatgggagtagcagtcttgcagggcatgggactgcccttgcacgagcaccgccagcgactggtggagggtcgtccatccaccaggtccatcaatgttgtcaggatgagggaaaaccccactcgccgagctgtcatgaggaggaggaacaagatggtccagcactcccattgcataacactgtttcggacagttctgcagaggaggcagcgtccgacgccgagtccaaacacctggaggtgctgcggggatgggggtgctcggtgggtggtgcaccttgcagaagccttcatagtctcctaccatcaggccccgaggcccaatgtctggcagaggcagcccctcagtgcaaggatcactgggagtgtgacatccattggtgatgcatgccgactgtgaggaccccacctggcccctgacaggatgaggcagaggccttccctgccgatgacgtcatcgcggctgcgctggaatccgcgggaccccggcgcctcccggccgacgtgcgccccggcacacctgctgccagggccgtcgacttggcgctcatcaggctgggcgccgccagctggacggccctgttcggcgaggcggccgccgagcggggatgcggcgcggggaccggtggcaggagcgtggccctggccgaggccctcaaccccgagcacccgtgccaccacgccgcgttcgctgaggcgttccgcgccgcgcgcacggggctggcgcgcgaagccgcgcccggcgaggccgctggccgcggcggcgggtgc

SEQ ID NO: 17965 - DNA, 75 bp, Chlorella protothecoides
gagcagcacagcatgatctcttgttgatgtggaaaagtgtaatgagtcgatgaaatctgggagccaccgctgcaa

SEQ ID NO: 17966 - DNA, 357 bp, Chlorella protothecoides
attaaaaacattggtaaaaaatatatttttctagcataataatactaaattaagtaaaaaattgaatagtagttttgaacatacaattcaattgctcaaaatatattattttggaggattcccgtgttattattagcaaaattacctgaagcttatgctcccttcgaccctattgtaaacgttttaccagttatacctgtattttttttattattagcgtttgtttggcaggcgtcagtaagttttcgttaaagtaaatatttaaaattattatattattatttaaactaatataagcttttttctaatacaaatttaacattatttaaattttatattttacttcacctaaaattt

SEQ ID NO: 17967 - DNA, 179 bp, Chlorella protothecoides
taataatatttaataaatgctatttactaattttttaagctaaaattattggattttaatattaattaacttataaatttcctttacgactggcaagtaatataataacaagtgggccggccgcaataattaaaaataaacttgttaattgaaaaaatatttctaaattcatgatgtat

SEQ ID NO: 17968 - DNA, 92 bp, Chlorella protothecoides
atacaaaaatcatagctaaaagtacaccaaatcttgtataaataatttgaatgtttgccatttttagataattaccaacccaaccttggtgt

SEQ ID NO: 17969 - DNA, 69 bp, Chlorella protothecoides
ttgaatataaattttcaaaaaaccaattacctgagataaaagtcggcgattttatccgtcttggtattt

SEQ ID NO: 17970 - DNA, 78 bp, Chlorella protothecoides
tgaagcgcgcgctgcggccggcgccccagactcgaagggccatccctcggttatttatccggcccttattttattcca

SEQ ID NO: 17971 - DNA, 86 bp, Chlorella protothecoides
aaattttttaaaggttataaaaccccatctatttttcttataaataatatttctgatgttttatttaaaccaggattttataaaat

SEQ ID NO: 17972 - DNA, 8132 bp, Chlorella protothecoides
tagcgctggactcggagatgccagaaccgaaagagaactgcagcagcttcctgcaacaggaaatcggagagggagttggttcgacaggggtaagtcgactgctcgatccttgagaatcgtagcctcattaggttcggcgtgacaagctggggagcgccacttgcaaggtagtggcgcacccctttaagggcagaccatcaaccaggatcatcgagcaacccttcagtcgtgaggcacttcctctctatgaatgagggtgctacagttcacctgctcaggccttcggcttccgtcgacatgatgagggcgagaaatagtacggcggtgcatcgcgccatacccatggtgttcacagggcacagagagaagccaacagcccaatggcacccagatccagatgactcgatgggtgaattgattctatggcggttcaaagtccgcccctaccctttatcgacaggctgcctggtggatgcaaccttgtcaccgacagcacctggaagttgtactatcctatgcccgaccaccggagattcggtcatttcttgtccttgacctagcacaggccagacgaccacacatacgcctactggctgtagcaaggaacgttaaacctcatatcggaccgaaatgacgccaatcggagcggctgctgccttagaagggtcctcccacggccatggcgtgtccggcttccgatgtttcaggggttagcccatccaattccggcggattgcctgaggcgccaaaaacggcgcagtcttgctgtaaaacgtcgaacgcgagtccacgacaggacgaagtagtattatgatttgaggagaagatcaggcaggtctccaaggtggatttgcggtatcgcccacttgtagaatgcagtatgtgctcgtacgtggcaagagtccggcaaggttggaccggcttccaaatccaaagtgcatgagtggcccagcgcaccttgccaagattctgtagcgattctgctccggcatccggtcttaaggttgtcaatcaggtccgcccatgtacgatctgggtaaacaaagtttcggtagcgaaagagctggagcgccaccaaatttcgcgagtccacgacgtgctcgctcaccgccagggacatcttgccggaaaacgtcggttgggatttcgtacatgtgcttgtggccattcatgaacggaatgaagagggtcgatcgacctccccccgttcaacgattcccctcatcctagctcgtcgagcatgtgacgacgcgcggaggggggtcgaacgttattttatatgccgagagtggagctaggattctcaacgcgcatcggcgcacgcggtcggctgccaccacacctcggcgcaaaaatacggcgtgcttgcgatatatcaagctaaaaatcggctcgattgagggtcccttcacgcaactttaaggccgcaacgacccccctttgtcttccacccgcgcgcctcgccatcggctcatggaaatccgagttatcttcaaggcatgtcagggatctgcctcgactgtgagcatgttcagcagagagtggaggtgcttcatttgtatagtggtgcgactcacttaaacctagaccagagccctgaatcgctggcaatgtcacctcgcacccccgaacctgcaccatcctgtccacgtctagtcatgaatgttggccccgctagcatgtgtagtgcccttgaagggtgtgaagaagattccaaggtcgtgcagcaggctcaacttggatcagcactccatgctcctgggttccaaggtcacagtgtattgaaggttttcaggtcgtttgaggatggggttggcccaggggcgacactgcgcaggcatgacattcagggtgtggacagcagatgggcaggttgtccccgcaacaatggaagcaggttaggaaggagctggatcgatcgccaccaaacccattggtttgggtcacagggctggcgcacacgtgttcaggctgttgggatgctctggcagccatgccttccgtgggattgggggccatgtgggattgagaccagcatcccggtggcccatgcattgcagggcctgaggtgtccccttttcagccggcatgccccagcgcaaccatgcagagtgtgtttgggtagcccagactctccatcttgcagcttcagagggacacccctcctgaactgcctgtgctgtgccaccgcctggccccaaggacattgccttgatgcccggacctgtgccggccctgggagggtgcaggggcgcaggcccccggctcgatgcactcagagccttccctggggctctcggggactgggatcgcgcagcccgaagggccacgcaagccgcgccgccgtctacgggccctgcagcgccgagtgtcggcgcatggccgccatgtgggccgtggcgaggtgctccctgccaagtcccgaaccccccagcttgctcacgcctgcgggttgcggaggggggcccgcatgcattcaggcgagggctcccatgcccagggtcacacgggccccgcccagcagtccgcgccaggcatcgcctcccagccgaccccgacgcactcaccggcaagctggccgtcgccgttcacccgcagacagaccagggcgtccatgagggcttcctcctcggcggtggggtccacaaccagggcgccgccaaagacgccgcaggttaggggggtgagcgggggctccaggcgcagggcccgaggggcggcgggcccctctggcgtgtcgtgcggcgctggcgccgccgcgccgcccgccccctccggctccagcgctggcaggcggagggcctgtagggcggcgagcgtggccagcaggcagacgtcggagaggctgccgtccgcgtccagcacgtacacgtcgcagtaggccacccagaccgagcggccgccggggtgggtgagctgggcgaggtcgcacagcgcaccagactctgccaggccgcccagctcctccgtcagccgcgcggcgcgcgggctgaccaggccgggccggctgctggccgagcacatgggcggcagctccacctggtggttgttttgggggggcaggggatggaaagcggcgaggcgtgggtgggcaggggtgctgccgagcctggacaggatcactcgccggggctcctgcattggcacagccagtgcgggggagaccaggtgcccagtcccccctcccaacctcagctgcacccacctgcacgatgatgctgccctccccgggccgctcgtcgtcggggctcgccacctccagcttgatgccggccagggccgtcgcacggcccagcttcaccagcgcggagcagtctgcgccggccacgacgtcccgcacgatgctgatgggtcgctcctgggtgaggacgcgtccatcggggcgcatgccctgtgagacgaatttggcatagtactcccgggggtagaggcgggcgaaggcgtcgccctccagggaaactaccatgcgggcaggaggctgggtgtatgttgaatgggaaactctgcagatatcattatcaatatgggatgggaaagcctgcccggctgaacccatgcgcaaccccctgtcgtgccaccggctggcccgcgcccggcctgccgattctcgcagtggtgagagtctcctcccggtacccatccctagccatgcccccgcgcccggctctgcttcgttacacatggtacccagcggaacatgaggaattggtcaggaggcccaccctcagcgtcaggggcggcttcacaggtccgccaggcactcctgggccagcgccttctcctccaccagttcgtccccggtggtcttcagcagctgggcggagcggtcgtcgatgtccaggccctgcagtggtgatccaggccaggggggaggggggtgggcgcagggccaggcaggggcccggtgcgtaggcttgcagggcagcaggcctcgagtcattcaggtctgcagcttgcaaggccgaggcgtgcgagtgcgggcgcgccgtgcaggggcggccaccacccagtgctctccgcgagagtgttaaccaacgttcccctccggaccccctccacacctgcacgatgctccacttcccgtccttggtggtgacggggaaggagaagatgacgtctttgggggcgccgtagcttccatcggacagcacacccatgctcacaaaggtgccctctgtgggcgcccgcgtgtgagtgtggaacgtcagtctccgagtgtcgagcgtctggggccagtggcgggcggccatggcgctgcctcgtgcagattgcgtaccccaggccgccggcagagcgtgcacagcaggaggcagcacgtgctcgagggcaccgggaccccaaagtttcttaaaccccccctgcaaaaggaaacacatgcacagcgacactcccacacgccctcccatggccggcgccagcactgttccacagggaagcatggtgatggcaccccggtttaccctccaccccgcctcacctggggtgcccaggacccagtcgcggatgtgatcgcaggcggaggaggcggcggacagggcactggacagaccgcgggcctgtgacatggaattcgaagaggtagaattaccaggcctgccccgccctctcgtcccaggccagcatccgcggccatgtaccaccagggtcagagcagccccaactcatgcatgcctcctgtgcggccagccccgccctgcccttcaagtgccgccctccagcaccccgccacactgctgcaccctccagcgccccaggcggcgcctcccccccccctttcctcccccaacacgcacacacgcacacactcaccttgatgatggccgccccacgctgctgcacggtggtgatgaactcaccgtccagataggcgtcgtccttgaccacctgcggggtcggacggggggccgccagggttggcagggattgaggggggggtcccgcggaagggcatgccagggcggggccatggggagggggcccggtatggaggcccccaactcatgccaccaccgacgaggagctccgcaagccgccccacctcgcgcgccggcttgccgtccacagtggcgtggttgacgtccgggtactgggtggaggagtggttgccccagatgatggcattgcggaccttgcccacgtgcgtcccggtgcgctcggacagctgcggtgggcggtagggggggtacagtggtggtggaggagggggagggaaggggctggggggagagccggggagcaaggggtcacatgagcgggggtggggccgccagcacgccccgtcggtcgccagccaggccccgacaccgtgcctggctgcggtccaacacgccccggcaccgcccaggagatgtccaccccccttccagccgtcccccgcaaggtctcacctggcccagggcgcgattgtggtcgaggcgggtcatggcggtgatgttctcggcggggatggagggcgcattctccttcaggatcagggcgttggtgttagcggggttggccaccaccaggatctgcgtgggagcgggttgtgtcgatgggatgaggggagaggatcgacggctcccacgcattcctgcccctgccggccgtggaggcgcgtgttgtggcgggggtggaggcgggggcgctcgagggggtcaaggcgatggcgaggtgccgggcacgatcaccccgggccgacgtcggactcgccccgcccgcaccttggcattcttgttcccatgcttctccagcgcggcagcctgggccttgtagatggacacgttcttggacatgacgtccttgcgctccatgccggcctggcgggggaggggcggaggtgaggcgtggggcaggtgaacccaaggggtacggcgacgctggccgtcaggggggagtctcagcgtggcggctgtcctgctgggctgtcgccaagcacatgctcctttgtttccaaaacccatgggccaccacccatccagatcgaggagggcagcacactctcactcctaccttgcgagggaacccgcccaccaggatggcgacgtcaatgcccttgaaggcttcattcacatcggtggtagcaaccacgcctgggtatggtgggagaatgatggggtgtcgtggatccgctcagccggggtggtgcaggccactggcccggcgcccggcgccttacctgccagcagggggtatgcggagtccaccagctccatacgcacgccctccagagcctgcttcgcgggctcgatgtccagcaggtgcaggatcacgggctgatcggggccgagtgcggccccgcgcgccaccagtggggccaaggcatagccgatttggcctgggcgggaggggaggaagagttgcgtaattgacagtgtgggtaatcaggggggggtcgcaactcctcagcgagctccagcctgcctctcaccagcagctccagtgatgagcacgcgcttaggttcgggggccattctcgcgcagagggattggggaaccgaatggaagattgatcggacgtgtatgactaatctgaaattatgagggaaggtgcacgcctgagggtgattacccgttatgtcgtgttactggaaaacagtccgtcgtcgcgatccacgttggcatcgggtggagggggtgggggcgtctgtgggtggtcgaaacacctgcgatcaggattgatgatggaccagtgcagggccccacatccgagagcgaatgatatccaggtcaaattgccatccaaacttggattgttcttggatgtacgggacacgagcctgcgcatacctcaacacaggaaaggcattgatctcaccagcaagcatgttgacatccctttctatcaatcaatgttgtatcaatatgtgcaagcaaaacactttctcccttgggaggatgtcagctcatctgttgataattgtgaacggacagcttggtcttcgcatgctgtttaagggagacagacagggactggggtatcagaggccaccaccctattcctggaaggagaatgtattcctttctcctcgagagtcgcaccaagtccacttttcatcagagagcgtatcggttgtttggatttgatcaccttacgcgatggtgtccaaacgtccattgacatgcatgtcacgtgcattgccagaatactaatgcacactcctttccattgacatacgacagtattatgccaaatatgcagccattctcgttgcagatgtcggcagatgagtcagtctctgggagccaattggatggcattccagctcacctcgaccctcctcaggagaagccttggggggattacaggtactcgaccactttaatcttcgcttcaaagacgagtaataccacagcatggcgcatgggtttccgccggtctggcgtttctcatgtcaacaagttgtcacctgcgcgacacccgcagtagaagatttgtccccgtgggattagggcacacgccccaagtcctagccggggagccggcctcccggactcaccctcatgatccccatgcatctttgaaggcgtcccatcgtcctgagccatggatgtgaggacagtggttgcgagctctcccactcacacagaactcctgtgaatggagtttaactggggagcggagaagcaaggcaacgaggcatcgacgagcctgggcgacaacgggagggaaaacctcatgctggaacttgacgacaaaacactgcaggtaggatgcgggagtcggcgcggtggacttttctctgactcaaccctcctcgccagctcagggagtctgcatggctgttcctctcccgattcagcaccccgtttgcgtgtgggcttgccaggatggaccacccgtctgcaccatccatgtgcagtgtctcgtgggatccggggctgcgggtctcctagggtctcacgacggcccggccttcccgtcgacctctgccgggcccagcgggagtggccgggagaagcggaagcacgatgactctgccgcctacaactggatggccatgggagggtttggcgaggaggaggaagaggaggcggacgactcgggtaggcggagagctgctcatggcccagctgttgggaggcccacccgcttgtacttcaacactgggacccaccctgttgcaaatggccccacgggcattgcccccccc

SEQ ID NO: 17973 - DNA, 80 bp, Chlorella protothecoides
gtggacagcctcgagggaggaggcacctgctctgatgctcggggatgttggggctggcgatctggtgacagaaagccggg

SEQ ID NO: 17974 - DNA, 61 bp, Chlorella protothecoides
gtggtactggtgcgctggggaggaggccccaccgccctcgtggccgccgccaccgccagcg

SEQ ID NO: 17975 - DNA, 2004 bp, Chlorella protothecoides
gccctggggccggcccggggcccccgcggcggccgcggcgccgcgcatgcaccaccagcccagcttctcctccctccgctcctcggtgtccggggagaacctgggcggggaggagacggcggccgcgacggccgctgccgcgcgccccgggccgcgcggcgcgtgcgtggcgttgtcgctgaagctggcgggcgtgcactggtggtaccagacgcccagccacgccgcggagctgacggcgggctactacaacacgccggagcgcgacgggtacgccgcgctgtgcgcgctgtgcgcgcgccacggcgcagcggccacgctgacctgcgtggagatgtgcgacgctcagcacccgcccgaggcgctgtgcgggccggagggcgtgctgcgacaggtgcgcgaagccgccgctgcgcacggcgtgccgctggcgggcgagaatgcgctgccctgcttcatgccggcctccgtggacgaggccgcgctggcgcgcatcgtgcacaactcgcgcgcctggggctcgccgctggaggaaagcgcggggcgcggggccgggggcgggcgggacggggcgggcggcccgccgtaccaggtgtggaggggggtgagggaggtgattgaaggggaggaggggcaggatttttttttgggggggccccccttggaggccaggcacgtcggccgtggagttcctcggtctgtgagctgtttcggaagctgcgactgcagcttgctttgcaccgacagcatccttcaagcgggacctgccatgccaggggcatatcagcggcaccggcccccgcagctccaccctttcctcatcccctagaaaagaaccaacaaaacattacccccatcttgttccccacccccatcacagctgccgcccctgaggggctgcaccttcctcaggctgacccgggagctgatggcgccctcctgccaggagcactgggtgcgcttcatggcacagatgagggtcaacggtgggcccgccaggacgcagacccagaccaagctgtaggtcctggcgcgggccaccgccgcgcctgactgcagggcgctgctccttggcatggatatccgcagggacgcagggcatcgctgggatgcatacaataagtattgttggacggaatcctctgtccgccggcagcctcgggccgaggtgcgaggcgttgttgatgacatacacggccccgactgtaaatgaaggtcggatgaccatgccgccggagtgagcaggggccatgcatgtcagacggggtggggggtgtcggtgagaaggccgaggtacacacgctttgagcgcgcgaatgcatgggcatcacaacgagcaaaacgattggggtttcgcatcttcacggccctggcgcaagagcccacaacccctccttgacatacgatcagccttcacaacataatgggtgattgtggtacatcaggcctcacctgaggggaggaggtggatatgggagccgggatggcgtgggacgcactggcgatcggtgcgcggacgccgagcatcccagccagccccacgcacgagttcacggtcccaggctcaacaaaccaagtctatgccgtgtatggaacgcgcgatgggggcctcgcgctctgctgcgcccaggtgggagtggtgggagggtgactggaggtgttgacggggtcttgtgggtgcgatccccagcctgtgatcgccatgtgactgacccctcccgctcctgcacaccggtccacaactccaaaggatccagagtctgctcggccatctggcgactcggtgcccctgcacacgctgctggtcacacccgtggccgcgtcgcccagcgacccggtggtactggtgcgctggggaggaggccccaccgccctcgtggccgccgccaccgccagcgaactagtcgttgtctccctggccggcaccctagggattggcccctgggagagccacgccgggacaaggacgggcaaagtggtagcgcgccggcccctgccctcccc

SEQ ID NO: 17976 - DNA, 91 bp, Chlorella protothecoides
ttttacttcgtacaataaatgaaatttatacaacaatatcgaatcgaaataatacgctaatttgctgctttttactatatttttattagca

SEQ ID NO: 17977 - DNA, 89 bp, Chlorella protothecoides
aattgaaacttcttacaaccaatcgaatttattctcgatataaaacgaaatgtaggtataatgagggcggaatagttcagtggctagaa

SEQ ID NO: 17978 - DNA, 64 bp, Chlorella protothecoides
atttttaaatttgtttttaaattcatctttattttatattagaaaaaattactactaaaaagat

SEQ ID NO: 17979 - DNA, 272 bp, Chlorella protothecoides
ctttttctaagtcgccggctcattcttcaacaggcacgcggtcagttttaaaaaaacctcccactgtttgtcagcataggatttcatgttctatttcactccccttcaggggttcttttcacctttccctcacggtactatttcactatcggtcatctaggagtatttagccttacgaggtggtcctcgctgattcacacgggatttctcgtgtcccgtgctacttgggaaaaacacatagttaaatttgaatttttgacgactggactttc

SEQ ID NO: 17980 - DNA, 70 bp, Chlorella protothecoides
gaggggtgtgctaacaatcgaggtacaagaaacacggattgcactgcatgactgcaaggtttcagagagg

SEQ ID NO: 17981 - DNA, 72 bp, Chlorella protothecoides
gcactgcatgactgcaaggtttcagagaggacaatgaatgcgcatcgatgcaggaggcgaactacgtcgaga

SEQ ID NO: 17982 - DNA, 222 bp, Chlorella protothecoides
cagagcaggtgccaaataccttcctactatgaatcgccaagcctccctgccttgaccaaccacggtctccatcccattgagagtacgcatttcttggtattcatctcagaatttgggcaagactcatggagaatatcaatcaacctattgtctggctggattacagcgacaagttcaaggtgtttccgtgggagatgagtttggtctccggcttgaggcatc

SEQ ID NO: 17983 - DNA, 118 bp, Chlorella protothecoides
ttatgcaaaatcttttgcttttaatttatttttagaatttttaataaaatctattggttttttatttaatgctaaactttgttgtatattaggtaatacgttatcgtgtatttttttt

SEQ ID NO: 17984 - DNA, 382 bp, Chlorella protothecoides
ttttttttagagacgaaacaaaacatcattatgctttactttttggtgttccatagagtgacctagattgttttctagaaataaccccttgtaaatctaatcgaccacgaactactttgtatttcactccaggtaagtcttttacacgaccacctcgaatacatactacgctatgttcttgaagattatggccttcacctggaatagaagcaataactacaattccattacatagacgaatttttgctacttttcttagtgctgaattaggctttttaggtgttcgtgtgtatacacgaaaacatacacctcttttttgaggacatccagctaatgctggttttttacttttaagttttggagcttgtctagagcttttttt

SEQ ID NO: 17985 - DNA, 663 bp, Chlorella protothecoides
tcagaacgtcgtgagacagttcggtccatatccggtgtaggcgttagagcattgagaggagtcttccatagtacgagaggacctggaagaacatacctctagtataccagttcttgtgccaacaggaaacgctgggtagctatgtatggagaagataaccgctgaaagcatctaagtgggaagctcacctcaagatgagtgctctcttttctaatttagaaatatcggtcacggcaagactagccgtttgataggtattaagtggaataccagtaatgggtgtagctgaaatatactaatagaccgatcgattttgaccagaaaatacaaaaatttattttaaaatacctagtgttcatgcttgtgtggaaccaccttattccatcccgaactaagaagtgaaacgcgcaaggggcgaagatactaaaaggggggccttttgggaaaatagcttaatgctaggtaattaattttaaaaatacaatatttaacttcctaatttaaaagcttctaaaaaaatacctaataaaaaaccacgcttaaagatattaattataattttcatttttttaataatactatttttatgggtttgtttgcttaatacatcaaaaaaggagtagttaaaaaaatttaataattctaatataatattaaaaaaaa

SEQ ID NO: 17986 - DNA, 67 bp, Chlorella protothecoides
ccagcgacacaagaacctggacgtgaaggcagtgaagaagtggagccgccaggtcctgctgggcctg

SEQ ID NO: 17987 - DNA, 125 bp, Chlorella protothecoides
ggtttactaattctttttaaatttgtaatacaaggtttaccagcagagccatttgatattaaacccgttttcttatatttaagactaacgattaattcgtttttgtttatatctaaaacggaaaa

SEQ ID NO: 17988 - DNA, 280 bp, Chlorella protothecoides
accaaaatagaatctttagtttcttccccagacggaatttcatctttagaaaaatctttctgtttattagatttttctttatcatcaatcatactttctacatttgactgagtatcattcactggattgtgtagcgtgatattgtctaaagacttggtatctgtaattttattttctagatccgttactgctaaatcagttgacacactattactagtttcaggttgtgaaatattagaacttgattgtgatgattttgtatcaataaattttaaaattt

SEQ ID NO: 17989 - DNA, 316 bp, Chlorella protothecoides
ctgattgagattgagttactctattaaatcctaaattttctgctaatcgctgtcctttaatatgagtagaaaccacatctaatgataatttttccactcttctcacccacgcataatcagatcgataagataattcctccatactcactgtaatatcctctcccggataaactaaatattgacccctattaaaaggaaatagttttaattccatcagttttccttcagtaatataactgaattcaggagaaatatctggtaccgaattatgactaaatattgtcgattcaaaaacgtcgtcttctgaaacaaaacc

SEQ ID NO: 17990 - DNA, 258 bp, Chlorella protothecoides
ctctttattttgaaacccatcaacgaataaatgattagatatatgttcaagtcccgtatttgtaagatcgttggattgatatgcaatatcgttattatatccagattcttttcttgcacctactagataatattgtaataataaattttttaaattacgtttagatgtgtttgtttctaaatttggtgtttgtttagaccaaaatgagtctgatactaaagaatttaataataatttagcactaatattttctaaaaa

SEQ ID NO: 17991 - DNA, 87 bp, Chlorella protothecoides
ggcggtgcaggaggatggcgagaccgaggcggtgggcctggaggacccccgcatcgcccagctggtggacgagtacgccgacctctt

SEQ ID NO: 17992 - DNA, 61 bp, Chlorella protothecoides
ggatcgtggctgctcctatcatgagcttacttcgcttcaccatgcttgtacatgctctgtg

SEQ ID NO: 17993 - DNA, 225 bp, Chlorella protothecoides
aaggtgtaattacaccttgttgtccagttatactgcaaatttctttattacaagattctaaaagttttgcgttttgagaagcatcacctagaccacgattaattataatttttttaatatgtggtacttggtgtttgtttttatattgatattctttaaaaagttggggaactatttccttttgataatattgttgaagtcgttgtaccatattaatttttttat

SEQ ID NO: 17994 - DNA, 266 bp, Chlorella protothecoides
ccatttgttctcaccaggtttaatatttggattttctgttaacgcagataatgccataagtgcagatccaggaagcatcggtacttcatcaccaggaaaatcgtatctttgtaatgtttcacgaacctctaattctactaattcaattaattcaatatcgtctacttggtcttctttattgataaatactacaatattaggaacacctacttgttttgctaaaagaatgtgttctttagtttgtggcatagggccatcagcaccag

SEQ ID NO: 17995 - DNA, 62 bp, Chlorella protothecoides
aataattttcatttattttacttggtacaccttgaaaattattatacaacggattatcattg

SEQ ID NO: 17996 - DNA, 43438 bp, Chlorella protothecoides
  modified_base (34849)..(34907): a, c, t, g, unknown or other
cgggcgcgcgcagagcgcgcgccgccgccaccactcctcgccggcgcgccggagctgctggccgccttgatgggggcgcgctccggctgcgccgccgcagggtccacggccgccggctccggcggccgcccacagtcatcctcgctgtcgcccgccaggcccaggcgctgctgctcgccctccgcctcatcctcgccgtcccccccctcgcccggcatcttgatgctcaggcggtacttctgcaggtggctcttgatgtggtagatggtcagccccgacacgcgcatcagcttcaggatgcccttgggcgtggctttctcggggccgcccagctgcgagaccgcccgggcgaagctggcgtgcaggctgggcgtccagcgcagccgcgacttgctgttggatggcccagagtctgtgaagggtgcatggggcaggtgtggactgctttgtgcatgtgaaggctgcgatgctgctgtgaggcaaaacggtgattccctatcagcagtgggtccctgccccggctgcagatggggaagccagacgttgcaccccgtgcccacaccacagaagcacaccttcgaacttgaagttgtctggcccatcagacatgccgggggccgtggaggaggcgggtgacccgccgatggggagggccagggggtgcagatacacaccgtaagggtgaagcgtggcggcgacgccaggggcagaggagccaggcccgggaccgagccccccggtccagccggtgcctgttgcagatgtgctggcctgcatttgctgtggatgggagggcacggcaggggtggctgctggccacgggggtgcggtcggaagtcgccgagcacgtattgccagggcccttggacagcgtgtcgagcgggccgcacgagcccccgcgccagggcttacctgcgcccaagacggctcaagaaggttgttgagcaggaggtccctgtccgggcccttcatagaggagccgaagccatccaacggtgcgccgaggccccagtccaaacccgcgagcaggcggacgtcctgttcaggctgcggccagtactccacattcgcgcgctggcctggcagtccgggcaggccctggccaccttcgtcatcatgtttcatgtcaccgggggaagactatcgcatacggaccagtgaacgggacaacggcacgtgcagggagctgacgccctagagctgcgcgtactgccgaaggagcttgacaacgcccgctccgccctgggggcggaagaaatgttggggtactgctctgaggcctgcgcaggcagccgagtcagccaacttgttccgcggggcaccacggatgcactcaacccttatttcccgccgaaaaccacgtgggccgaaatcgtaaggggaggtggtaagggaccctttccccttacatgcccccatcggtgcaagctgaattacgtccagtgccagcagtctggagctgtttcttggttccttcagctttcacgggagctcatatgcatgggcagcctgtggtgggttggctggtactatgtgtctgtgtggtgagaaggttaccactccgatgttatgatggtcacaatgagggtgacagctctcctaggatataccatggggtaaaggtatcctcctctgggtggtatgggctacactcgagggattagacctcgctgggggaagtttgtgtgactgaatcgttgctcctgggcgccaaggggcgcgagtggatcaggtgcggggggagtccgcctttctctcgcacagacaccctaccagctgagaagaaacacgacgcctgcaccactcagaattagatatagttgggagcagttgacattgagcaccatgatgtccgctgtgagtggcgcctttgctaacctgcacatttcgagccggccgagagcccagcttagtttcagggcgtcagtctgcccgggatctatgctaggtaaatagaagaaacctttggctgattgtttgctagtacatggcctgtggtgctctgtatcgcctcatgccttgttcccctcccacttctcgcagtgctcccccgtcccggtgtggctcgctcggccctcgctttcctggtcgaagccaagcagaactccctcagacgcgagcgtacctcggaaaaggcgcggctacgaaacaaggggcggacctcggagatcaagacccgcatcaagaaggtggggcctaaagagggggctaaagtggggggcgtggagcaacacagggagcggggcgacacactggtgcaagtccaaatctagagattggttcaaatctctgacactgaccgaagtgacttgcccctgtttcctggatccaacccacatactcccacgccgccccacaggtgctgacggctgtggatgcggcccaggccgaccttccgaaggccgagtcggacctgagcgagctcgccgcgctgatgagcgaggcgtaccgggtgattgacaagggcgtgagtaagggcgtgctgcacaagaacacggccgcgcggcggaaggcccggatcgcacgcgccaggcagaacctgctcatctctgcgggcctgtacaaagccccagagagcacccccgacgtcccggaggccagcctgccgtcggagaacgacggcatctctccctctgagctcaccctcgtgcgttgatgggcctgtcggggcatgcccctcacgctcaactgtacacatatctctcgtctgccaggctgggaaggggggttcaactcgtggacctcatgcctgggtggcatgccggggtcagggcagagaccgggctgattccttgctcgagagcgaggggtatcagtacctttgggtcgtcgctatcatggtgcattgcatggtattcagccagggcagtttggaccagggcaccttgctgcttcacctccgccagtggctggggagccatgcctggccaatgaaaatgctgcactacagccgcgccgcagcagggcgctacgctgcgcatgctgccccgctcacgctgctgcagcggcggaggtcgcctgctgggcggccgccttgagccctgccgcctgcaccgcggtgcctgcagcatgggttgggtagcgagcggcgcatgggaggggaaattgtgtagttgcagtttcaccaagcagggcatccaaagcttgcgtggaccgccagcaagtcaaaatacccgggccgggtggctcccaggagggtatgttgaggctgggatatttgaccggactcgggctgcatgaccgctgatgaacagtacactttttaaaggctccccggctttcatctgggagcagcccctgctcccaaccaccccccgtttaaccccccctctccaccaaattcccactcacaggccacggtgttgacgatgtcggccacggtgcacccacggctgaggtcattcacgggcctcgccaggccctgcatgagcggcccgatggcgatggcccccgtggactgctgcaccgccttgtacgtgttgttccccgtgttgaggtccgggaacacgcacacagtggcccgacccgccacctcggaccgccccttgaccttggtggcggccacgcccgggtccaccgccgcgtcgtactgaatgggcccctcgatggccagttcggggcgcgcggcgcgcgccagcgcagtggcctccgtcaccaggtccacctgcggcccggcgcccgaccccagtgtggaataggagagcatggccacacggggctccacgccaaaggctgcggcagtgtcggcggaggtggtggcgatctgggccagctccgccgcggtcggctccacgttcaccgcacagtcgccgtagaccaggacgcggtcggggaggcacatgaagaagacggaggagatgaggcggcggtcgggggtcttcagcacctggagcgcggggcggatggtgttggccgtggtgcaggtggcgccagacaccatgccgtccgcgtcccccattgccaccatgattgtgccttttggttggggggagggggagggggggggagtttcaagggggccgaggtcggcctggcggagtgcatgggtgcgagaagagacggaggtacatttctgaggtgggtgggggacgtctggtcagggcacgggtgccaccaatttggcaaaccccatcaaatagcagtggctgcctggaagaggcatgggagctcctctcttccctcaccccccttccaaggctctttcccccctcaatgcttaccaaacatgttgatgtcggtgagctggtccagggcggccgcctttgtcagcgcctttttcttccgcgcctccaccaggaagtcggcgtaggcgtcgaggcgcgtcgaggagcggtggtcctccacctcgcagcgcgacacgtccacgttgaagcgcgccgcagcggcggccacctcccccggctcgcccagcagcgtgacgcgcgcgatgccgcgcgccgcgacctccgccgcagcgctgagcacgcggtggtcgtgcgcctcgggcagcacgatgcgctgcggcgcggcgcgacacagctcttcgatctgccagacgaagcgcttgggcgtcaggcgcggctcgcggtgccccgccatacccgaggccacggcgtcaacgtccacgtgccgcccgaacagagcgcgagcctcgcgcaccttgcgcaccgaggtgggcaggatgcccgggttcacgcgcgccatgcgccgcgcggtctcgaacgcgccgtgcggcacctccagcaccggcagcgtgtcggggcccagccgtgccatgatggcatggaccgggggggtgatggcgcacgccccaccatcgcacagcaccaggccgcccaggggcgggcaggcgccggacaggctggccgccgccaggcccagcaccaggtcctggcggtccttggtggtcagcaccagggggcggaagaaggtctggccctcagcttcgcgctgcgcgcggatcgcctccagcttgtccaggaagccgtgcaccgattgggccgccaccatgatccccgtcacgtctggggagggaaggggggtgggagaggggtgaggattgtcaagtggtcaaggggtggacggactggcgttggggaatgtggttttcaagctggaatgcacctcatgccgattcaggccgccggggcaggcagagatgcaggcggggggctgtgccaggcagaggcatgagcccaggacgtgaggcctgggcttgagataggtgcaagcctgccccaactctacccccaaaacgattgtcctaacgtccttcccacacaccagagtcgatgagctctggacggccgtagatctgcttggcgcccagtgcgtttgcaaactcgttcaccctgcgtgttgggagcgcaagggggggactaggtcaggctgcgcatgcgctgggaagtcaatcaatgaagtccctaggcagcaccaggcagctgtcgggtcgggcagccagcctgccaccgccgccctgtcaccgtgtcacccaatgtacaatgcctcgccctgttgctgagcaagcactgcatgcaaatcaccccagccccccgccgtccgccgcacatattgccgcccacccaacctcgcggtgccgatgatgcggtcgtaggggatgccgcccgcaaaggtcaggccggagtccgccagctcggcggcgacgcccgacacgatgtcggcgtgggcggcgagggggaccttgttcagcagcaggcccaggaccgaggcgcgctcggcctgcagctcacgcctgtggcgcagcgcgcggcttgcgatctcggaggcggtgcccgggttgtcgcgattcaggtccatgatctaaggggggaaaggcaggtgagggagggggggaagccccaaggtcagaagagcgaggtacaggcgaggggttctggttgctgtagggccctcggagagtagcttgctccacagcatgactctaggatgccactaagacctggaatcaggcccgcataccgactgtgcactccactccttcccagcatcacgcccaggaatccgagcccaccccaccatgaggatggaggtgtccagctcggcggcaatcttggcgttcagctcgttgtggttgcccagcagcccgcgcacggtggcgccctccagcaggatcacgtccttggccttcttcattgcctggtatttgacgaaaatctgcgtggggatgttggggggggggggcacaaaatcagacacacgaactggcaaggcgtcctactgggtatgaggcatgtatgactgcaagcaggtgaaagaactggaccgcatcaagtcatggagcaagaccaccaactttccccggagtgctgcctccttcaatccaccacctaccctgtccatgagctcatcgaatcttcccagggtcaacaggcgctttgcctcctcctctgtcacgccatacatgctctcagaggggtctttcaaacccatggcgtgcttcatcctgggtggcgaagccatgaggagggagtgtgaggactcggcacaggcaggccctggcaagcaatctcactttgcggggtgctcatcaagaagaggcatgccatccacatcagaggcggccagggctgggcatgggtttcagtcttgattcctgtaacaaagcagcacggcgccatagcaagattctaaaccctgcatggcgactcccagcatgactcacagtgctacgtgcttaggctcgccggtgtaccgggacgctccattcagggggtttgccccgatgggctggaaaaagccaacatgcggcgtctggcgctgaaagtagtccaggaggcccagcagcacgggggagctaccttggagcgcggacacgtttgtgcagaagacggtgtcggcgtcgtctgtcagactgccgaaggcggcacgaggacactgccacctcggatgcctacagcaggtacaatatatagatcatggtttgaatggcgctaggggcatcacagtacgcgagtaggtgcatcaggccggttcatggtcgccaagcatgcatgggctacgtgcgtgggcagggccatggcacggccgatgcttaccaaggggaggacaacgcacggcgaactcccctgagagatgcgacgggaggccgcatcctgaaacaccaaaactcctggcttctggggtatcggtgaacagtctgtcgaaaaagatcgaggatgcgtgccgaaatctgaccggcagctccaaagtttcgttccccgaaggcgcacgatgatgagatcagataacgttgagaacaaaacccttttcctagcagattttaaaaattgatcaagattgcgtgcgcatgcggcgggcagacatatagtcgagcagccacgagggagggagggtggtcatctcggcaatcggctcacgcgacccacgtgcgtgtgcatgttgcatgactacacactacacatatgtaattctcttttggtgtaatcgatgaggctcctttcagcgactgtttccttccttcctcgccttggatgattcacagcggggtgctccattatcttgcatagagactgcatgcaccgccctcctttcacctgccccccccccttgagaaccccagagaccgtgggcccgcacgatggcgcccgcaaaaaatctgacgatggttatgaatgcgggcagctcgtcccttaaattcaaggtgttccaagcgctaggcaatgggcagttggagtccctcgcctccggactgtgcgagcgcatcggcgacactgccaactctaggatgaaggtaggatgggtatacgatctgaaatctacgtcgattctcaagactctctcctcgtcgtgcagtgcatgatcgccgatctcaccccacgtcatctgccctcggtcacgtagtagcgggtgtcgtgagatcatgtgatttggaaatggcatccaaggtcccggtgaatccctcgcccacggacccttcaacaacacacacccccacacctggcaggccaagacggcggagggcgggagtgtcaccctgcaggagggcttcaacgaccaccaggacgccctggggctggtatctcgcttcctggcagacaccttttcctccagctttacccgcagcgtgcacagcgtgggccaccgtgtggtgcatggcctggacatcagcgccccggtcctcatcgacgatggggtgaaggccgtgatcaagaaggctatcagcctggccccgcttcacaaccccgccggcctccagggtatcgaggctgcaatggccaccttccccgcggccccccacgtcgccgtgtttgacaccgccttccaccaaaccatggcccccgctgcctacatgtatgccctgcccaaggagctgtacgatgagcaagcggtcaggaggtgaggccttcactatccccaagaggaggtggaggggaggggtggaggggggtgtcgccagtgtctgtgagtgcaggaatggtgaggtgtgctgcggagttgcctgggaccccggtgggttgcctggggcagcagtcctgcatcgattttacacagatcaaagtaccttgattcagaaccttgtcaaaccgctcctgccggcacaagcgtatcgcagtaacccatgagctgtcacatccacccacaccaggtatggtttccacggcagctcctacaagtacctggtcccacgggcagccaagacgctgggcaagcccgtggagagcctgaatgccatcatttgccatctaggtatgcagcgcggggagaagggagcccggggggggccggatgaggatgatgctgcatacatgggtggatgccagggaagtgagtgactccacattccgtacagcggcactaaatgaagatatcattgtgcatgaagaacatggcaacttgccgcatggaatacagcattgatcagtgacccctccctctctgtcctcctttttggtttgcgtgcaggggccgggagcagcatgtgtgccgtgcgcggcggccagtcagtggacaccaccatgggcctgactccgctggagggcctggtcatgggcacccgctgcggtgagctggacaggggtggggacagctggaggtgtggcttgtgctgggcgggacatcggggagcgcggcgatgcgatggcccgtgtccatattttgtatggaaccagttgagattgtgcccaagtgccgcaagtctcgaagacgatagcaccaaaatgctgccaccacacatatggtgcaacacccatttgtggctctgcgctctcgcccattccgttctaacagcatcgtacacgagcttttatgcacgatgccaacttgctgctctccactgcttcacccaccatcacatcccctttcaggcgacattgaccctgccattgtgacgtatctgttgggccaaggccactccggggcggaggtggatgcgctgctgaacaagcggagtgggttcctgggcctgaccgggcactccgacctgcgcgctgtcatcgacggcgctgcagccggcagcgcccccgaccggattgcgctggacgtgtggcggcaccgcatccgcaagtacattggcgcctacgcgctccagatgggcggccccctggatgccctgatcttctccgccggcataggggagaacagctccatcctgcgcgccttcctgctggaggggctggagtggtatggcatcgcgctggacgaagaaagtaataaggcggccgtggacggggtggcgggcaacatcacggcgccgggggcaaaggtgcaggtgctggtgattcccacggacgaggagctgtccattgcggagcaggccatagaggtcgtggaccgcacctgacctgggttggacgtgctgcagggaccccgctcaacggtgcaggagcatctggctgtcaggttttccgtccctggcaccgtcctctgccctgcagactctcggcactggcacgacaggggctcacgaggtttcgaccttttaggtctgctgccctgatgatggacaggaaggggccacaccatgccctggcgcaccagcctgcctgctctgcgctctgccatgccatggagttttgaagctgcccatgtgcgacgtaccatagcctgcgcttcactattcctccatgtgcggcttgctgttccccggccgccatcggtttccgaaggtctggtcagcatgcagtagaattgacgatcacagcaccctttaaactgatgggcgtggaccagcacaggaggggtgcttgtagtgctgtgtcgacatgcagactccatgccacggattccgccacgctccacccccccagccatcatctcaaccatacagtcaccctctgcaccacgctcatcgtgcagtttacgtcacacagctttgagcatagacaaggaagcatgcacgtatgagcacgttcacagggacaggcccgcagaacccccacccctgtggggagacagtagcgcatactcgccgtccacccaggactccacatccctcaggaaaacgccgtatgccacggcctccagcacggcgcggcgctgtgtccccactgtcagggtcagggtctccaccttgccgtcggccaccgcctgggggttgatgcacggtgtgggttgaacagaccaatggacggggcggcgcaagagcgcggctcgctccttcgcacactggggtggcgcccagcatcccaatgccccctgccccggccctacagcgctggcaaaagttccaaaaagagctgcacacccaggaacgagctcaccttttgcacgcgctccatgagatcgtccagggaggcgatgtccttgcccaccgcctcctgcatctggcgctgcagcgccttggggtcgccaaacagtgccttggtctggcgctccaccagggcgccgccctcctgcgtcaccagcctgcgctcggtgaacaggtggaacatcgagggggagcatggttgaagattgcttcgtgccggaggcggggcgcctggacgtcaggtcggggaaggccaaggatacacaacagctgcagccattggtgtcatgcatccagcaaggtaggggacgcccccagtctgtttaccctgccacgaacaatccttctgcctccccagtccccacccacttggccatgtccagcatcgtctgctggtcaaaggactcgacgtagcgccgcagcgcaccctttgtcttcttcaccagggccgaggtcggcggcggctggtcggcgggcggcctgtcgctgctggctgcctcactctcctctgccggcttggcagccgctgcatcgctccctggaacctcagggtggggcgtggcaccttctggaagcccgtcgtccgcctgcaggtcgagagtatgggagaggggctgctgttgaggtgatctcggagaccggtgttgagcatgctggcaacctgaactacacgagcagtcagaaacacacgtcttcccccaaatcagccggcaacagtatgtacaggcggagcattcaataccagggtgtccaaccgccctgcgatccagactccacaaaacacaccgcagagaagaggcgttcgagcctggccacagcttcctcctggctctccggcagcatgtccagcgacttggccagctggaagcgggtgtccaccctccgcaaaaagtacccaaagagcaccgaggcagcgtagacctgtcatggcagggtgtgtttgatgatcattcggagcctgagctgctgcactgccctcgcaggccagagcctgagctttgcagccccaaaaatgtcacggtaaagtcagggcacgcgctgcaccacccaccactacgacacacctgggcggcctgcagggcggacatcttgatcttggtggcagcgtaggccattgaggcgggccccagcacgcccagcacgtgctccttcaccatgtccagcgcctcgcgcgagtgcacgccctcggtcagcgcgcgcagtgtgtcggagctctcctgcacctcctcgatccggggcagcatgtccacgcccaggtcccgaaacttgcccaggatgcagacatacatgaggtcctccaccgcgcggccgcgctctgcacgctgcacctcggccatgcgcctgcgaggaagaaagggaggggggttgaggtgtgcgtgagcgtgcaaatcagcagggggaggggaggtctgggccacggagcgtgcaaggagatagctgatactggcaaggcaagagagtcgtggtatgaatggtcacgagtactcgctctgcaaaggtataaaagcacgcagagcatgtgcaggcagcgagccgctcctttgcaccccctctacctggacagaaccagatctgtggaggtgctgctcgtgccctccccactctcgctggcctggtccttctcctttgcctcctggagcaggctgaactgccggtccacagtctcttggaagaggtggggctgtacagacaagtagtacgaggccatctctcccagggacgtggtcggtggggagggagcctgggagagggggagggtggtcataaggcagggcaggcatcatagatgggacggaaaatagttttgcatgcacacgaaatgatggtgcccaggacatcgtcctcctgaagtccatcactgtgctcaccagggctttcggagcggggttaccatcgggcgagtcgtctgccgcggcagcacacaccacctttccggccctctcgttcctcatggtatgcaatcgtcgggccaaggccttctggctcgcatcatgggggggccgcgcccggaagggcgcaccacgcgtcaatgccaccggcctggtggcagcgctgggcagaatcgcatgcatggtcacagcgcctggcatggatgtcaagccttgcccggatacagttgatgagcttcaatctagaccacagtgcagggcaatggggcatcgtgcactgcacccacccctcaatctgaggctgacgccctcggcgccgcgcgcgcgaagagaggcttcccgagcttccctggcctcaattttgtggctttgaaggcgcgggaccgttggcgggtgcttgagatggttacacgcagggtagacactcggcaacctgcatcccacacattccacaaccctctgttcgcagatgggattcagtaggggctggtccgccgcgtgtgctgcggcgcgtgcttggagccccgtcccggagcggggggcgcggccggccccacagagccagcaccctggctggaatccgcgccgttctgcgtcaggtcccacaggcacacccgcgcgtcctcaccccccgtcaccacgcgccccccgcccaggggcagggcgcaccgcacgatgtctgcgtgcccaccggccagcacgctcagcggcgccctgaggggagccacggcatccgagtctacgacggggtagatgcccaggccgccctccaggctgccccccaacaggcccagcgtcccggaagctgcgtcgtagctgcagcccaccaggtaggacacgccgccctcgaaatcgggtgtcagcgcggacagctgcgcacgagcgtccgcgacgtcggccagggagccctggccacctgaagcggggcagggaggcactatacccttggtgccacacagcgtctctggcgggagctgccttgcaggtacagagaggaacggcacaaagacttttgcccgaatatgttgagagcaccgtccatccagacaccacacaaccgcactgtcgggagcccacccgccaggtttctcacctccgccctcctcgttgcaggcggcctgccactcccagaggtgcagggtctcggtcccggtggtgcaccacagcttggtccccccctgtccgtaccaccccgtggccgccacggcattgtcgatgttgagagccgcctggaagctctcgtcctcgtctgcgtggtggagggggggcggagggtgggatgcagtcgaggagtctggcccttggagagacacgcatgccaatgcctgcacgtttgctgcaccagccgcttccgggcagggagaagagggcagctcggccagcgcgtcatctgcacacaccccacggagccgaccgcctgtggacctggggcccgggacgtcccaccgccaagccccccacaggcagggcaggcggtggatcccatacaccagcgccaaccagcgagcccccccccacacaccctgcccctcacccagtcccgccgagaggtcaaacacggccagcaggccgtcctccgacccggagaccagggccgccggcgcgtcggggtgcagctgcacggcggtcacgtcctgggcgtgtgtgtcgccccagtgcgccatctggcgccccgaccgggcgtcccagagggccaggttgtccgccaccccggccgccaccagcgtgggccccacggccacgctcagcgcctccccccggcagccggcccggaactcctgcgccacggcgccggcccgcaggtcccaggcccgcaccaccccgtccccgctggcggtgtacagggctgcggggctgtgcgccgcgctcaccatgcccgtgatggagtgcgtgtgagccttcaggtcgccggtgaagcgcaggcccgaggcgctgcggggcggggagggcaggaggctgaggtgtggcgtgtggtgcaggtgtgttgggaagagtagggatcccggggcctgacggaatgccttgcatggttggggtgcctcaagggccaggcaggccgacagccacttggagggcacggaggatggtgtgactggggcagcggggccaagcgtgcacgcatgcttaggggaggccatcggcaatgcacatgtgtgggggtgcatcaggtctcgtgatgaaggaggaacctccacatttcaccatgagatgatgtgggtgtgttgacagcagccttgcatgttggggcatgcatcccatcctcgttctcgacacatcctcctgcggacgcatccccgagcccccgcatcatgactcactctgtgcaaaagagcttcactgtgcgggtggagagggcggcagccaccaccgactctccgggcgtctgggccaggtgtaggacgtagcactggtcccccggagcatagtcggtacgaactgtggccagacacttggctttaccgggtgggtgggaagggccggcgtgcgaattggagaactccctctcacccccttcgttgcttccgtgcccaaccggcatcgcggacacgggcccaccgacttgggtccgacagggtacagacccaagagtaaaacctcagtaacaaactgtatacagattagcggtctgttcaaaccagcacgcctgataggtcccgaacgatggtttgttccagggcgcgagaacggcactggcgatgcaaccccgacgacggactgggggtgcgcagcgcagagttgaccacgtagccaggcgcaacaccatctagagcagggaggggcaacaaagaacaggacacctagaaaaagacaaaagtaatactgcagtcggctgctctaccactgagctaacgacccaacccacttcagggccgtatcgggtttgaaccaatgacctgccgatgacaagcattgctaatcccccagttagggggccaatttcgcacatgaaactttccgccatttgcacggtatataaacttcgtggactgtgtgcgaacgtttgcgcccaaaactctcaagccaatcattctgctgccttcatgaagcgcaacatgtcatcacaaacggcttgagtccgcttctcaataccctgagcatcgcatctagcccacgcatccctgcatctagctcgatggcgcggttgtgggacgtctccatccgcttcggctgcgtcctgctgggctttacattgcgacacgtccttgacagactcttgaagaaggtaggctgatcggttgactggccggaacttcgctgggagggagtggatcggagctctgcaatctcacagcccacctcgagcctcctgcaggacgagggcccggcgcgcggcggggatgcctcaagctacgctcagcacagcgaggagcacaagatggttctagtggtgcgtgcgtcgggcttgggatcggaacggggtccatcggactcttgcatgagggcacatcgcttgcatgtgtcgatgatcatacgctgggaccctggcggccagctgcactggactgcatgtgcagggaggacgatgaatgccttggcgtccatacccctgtctcttggctacaggtcaacgatgaactgaagatgggcaaagggaagataggcgctcagtgtgcacacgcggctgtcggcgcggtggagctggccaccctccgggcgccgcacgtcctggacgcatgggagagcaggggccaggccaaaatctgcctgcgcgccgattcgactgcagccctggtgaggccgcagggcgtgcggggcgtgagtggggcgtgaattgggcaatgcatgaccccatgcctggcgtgccggggggtgctgccccacaaggggcaagggtcttccagggtgattctattccaccactcgtcatgaggacacatggggtggtccagaagtttcccacccatgcaaagcccactcatccaagaactccgccctcttgccaccaccaccagctggcgctggggaagaaggccagggcagctggcctggtgacatacacagtgcaggacgcagggagaacgcaggtggcgccaggatccaggacggtgctggccatcggcccagcaccccgcaccgcctttgacgccatcacagggcacctcaagctcctctgaagcccgctgtggtgctctgtcgacgctgttgtgatgagtctcagagctggtcactgggaattgtgggaggcatgccaggcaccaatgccaaccggcattcatcactggcaagaaaccagaagggcagcgcgcgtcagcacagcttggagtcctttgtgcagggcacgcggggcacgagtgcatccagcaggttgcgccccggcccccagtcgtaggcgttgtcgggagcgaggtccaggtggaggccggccgggtcgaacgccgcctgccgcgccaggtccttgcgcagcgcccgccacttggatgcctcgttggtggtggtcccgctgaggatgaggaagatgtggtaccccaggaaacctgtgagcacccagcccatgacgcccaggaagaaggtgaggcagaactgcagtggtggggtgtgtcggaaggcgggaactaggggccccggtgttgtactatcatgcactggactgagtgcgacctcgcccagtgttctccagggtgtcctcgtgtacgacacagccctccactggcatgagaggcctcggagtgacgtgctccggcgcagttcgggacgagcatggctccttcccacccgtgcgccgttgtacaacagcatagcacgatccacccacccgcgaagccccacctgcaccgggtagcgctccagtacgtatcgcagcgtggtgagcgcggagtccgagacgtactccagacgcccagagccccgccgtaccctggccagcttccatgcgccttcgacacccatgtgtccatgcatgatcctggcgcccagcacagcgccttggggtgcgagggtggaggaacgggctggctggctgggacacagcctgtcgcatacccggcacgctgaccaggtgtgcgtcactcgcagcacatcgccaggcacagcctggccagagagcaagggccctgggccagacacctcgcatgccgatgcaacacgccagccaccacgcgcaccatagatgcaaatggcagcagtggatgcgaggaaggccaggaaccatcgcaggtttcgggtgccgatgcaggtgttcaaccagatgcagtggtgatccatgcgccctatgcacctggtagagaagagagagcagggtatggcacaagtgtgtacacctggccgccacgtggcgggcagtcctgcttgtataccatgtccagcaagctccaagttgctgttgcatcacgcaggccgagggagccccaagctgcggctataaaccagttcccagcctgcaacgaaacacactatgtggtgctcctgcgacgccgtggcccaggcccagcacatacctgttgcacacgcgacagtgcttgctgcgcgcaggtttggggatgttgcaggtcgcacatgtgcggggctggtacaggacaccatctaacctgtactgccgattgtactgctccacattctcgggtgtgacgacgcctgggtcagtccagctggccagcacaaagaacacaagggacggcatcatggtgagcgttccgctccatctggtggtgtataggagcggaaaggggggtgtacagttgcgcagaggtcatactttgcctttgtgccagcaaatcatcccccaagctctctcctaaagaggttgcggcgtgaggtgtcctcgaaacacccccctcacatgtgccaggctgggacggttgggagaggaagcaggctgaagaagtacttgcagtaagagtagaaggccgcgccgaaaagaagaacaaacaggccttgcacggcgggtgtcggtgtctcgcacagtacggtgatacaggtttcgaggcccgtcacggttcgatccaatacgatcctacgtgccgttgcaatgagaccattgtgttcctctgttgttcacgttgtgacagaagtaattccctgaaactcacctggtaaggtgcagggccgctcttgagcaggtgctccgtaccgtccttaatggcatgcccacgtatggtgtgagcgtgattttcgtattcagagtcgagtttcaagcgtgggtaaactcgatcggtcctttgagtgaaatcaacaggcgattccacttcgtccattcttcatccatgtgtgacttgcgagactgcgcccaggcggacaatctggcaatgccggtcgacgttctggtgcaacatatcatctggtcatgtcggagaaatcaatgctctgggcgcattcataatgtcagtggctgcatggtagtatgagagacgatgctgccagccggcagtggtgttaccgaggcatgttcagctgccatcatgcgcatgcaaggaatgagagtcctatctagctcgttggatgggactatgggaatctacttagcatgcaaggtctgctcgcttaaagggcgggacaaactcctcgtattcttcgagaatggatgcgagagtcttccgagccacatcgccgtcctccgattgcaggcagacaaacttggcagatactccagcttggaccctctaccaccttcacggacacttggatggtggcattacgactaatcagacagcggagggggtcaattggaatgttcctgcatgctgaggccgggaagtccttgcgatcttcgcaaaatatcttcgggggaagaaaggaagatccgctgcgattttctgcttcgacgggtcagcccccgagcgaagctccggtcttaatgacggcctgcacagcaagagttctcgcctccatcttttgtagcgtaataagctttagcggcttagcttgtagacgcaccttctcatcgcttcgagttagcagtcacacttgctctgcccctcgccgtgcctcggggtccttgtacgcgggcgctggttgctgacgcacggacactaagatgtcgtcaggggtggacacggtctgctgccaatctatcgccgaactcacgctttctgttcccaccgtgcgaacctcccccgcacccgcggctgcgtccttcggcccaacgccccaagcccttgccttccagtatgcttggcaacaacacatctcccccaagttgacgcaactcttcgggcgcctggctgcagaaccggaggcgacgaatctggctctggctcaggtgcgggtcttgggttcaggcgatcccgtgtgatccttcccaggttccgcgggcacgagcgtaaccagcccctcctcactcatcccaggcatggacatacctcccggtcctgactgagggcagcaaggcccttaagactgcagagatgtgcttgaccaaccaccagcagctcatcgactttcagatgcagtggtgaggaggcggtttgggggagactgggatggagcgagttcctcactttgaagaggctggtccagctcgttttggcgtgaatggtcttgaaaacgaaccctttcgcgcacagcctgaatgtggagcgtaggttctttcttgagcctggcggtccggccacttccgctctggggccgtggtctcatccctacctcctccaaccctgcgcagccgcaacacgggggtgcagctgggcttcctgggacccatgggcaaggtctgggagaacggatctgtgcaagtcgttcagggcgcggactcgctgccctccgagtgccacccgcgcgaccgcctgaagggtgagcggacgcaaggaggaggaagtgggcattgggcataaagtgggcgagtgaactggacgaggactgttggttcctccccccctctgaaaggcgcccaaccatctgtaccgccgctgactggccgcccctccacccttcacccaccccaggcgctctgttggagagcatcgccgagatcatatacatccccatctacgacaccgcggcgacggtgtccggcggcgtgctggcggtgctggagctcatggtctcctcagatgcgcacgacccgcaggtggtggccaacaccatcgcctgcgtggcccgcatcctggactccctggccctgcacctgagctcctccgggtctggcgcgccctgctcccttccggggtcggggccgcccagccccacgcccacagaccgcgtggggtccacccggcgcggcctgccccccgtcatgcgggtgtcggcgcccgccgcgccgcagccagaggtcgccgccgccgccgccgccgccgacggccaggcccggccaccgcgcagctcttcagcggggcgcatgcagcgcacgcgctccctcctggtcatccgccccctgctctgctgacgggcgcggcactgcgtcgggcgtcgggaccctgaagccccggcgctgaggccgtcgatgcgaggcgccgggacccttgctctggccgacatcccggccacgcctaccacactgctctctcctcccctcccctcccccgtgatgggactgaacgagatccacgggcgagtgctgcccctggcacaagcaccccgcccagctggccgcccgcgcccgcgcgctcaagccccgccgtgagcgcgatagtaccccgccactgcttgtgcgtggcggaggcgctaccaggcggggcatgcgccccgagctctggcctgcgcctgaagcccccgccgccctccccggccctgctccgggtcaatggcttccaatgcacctgaaattcgtcttcgtcctctccctctggctggctggcggtggcacgtatgcaaggggtgtggcggagcgtgtgcgcgtcggtatgcatgccctttctcagggtctagccgtgcgactccatgcttcacccacccaccctggctgcctgagcccctccagccctcctttgaatcccgtctaaacctccttacccgtcttgtttcatgttccagccggtgcggatccagtcttcctcacagctgcacccagggctcaatctgtacccctttcagggccgcgaggaggacatcccccccctcctgcgtgcatgccccaccctccatactatcccaatgttggcctttatttctcctctgcggcgactgggacgccccttgttccaggcactgattgacctgtggagggatgcagcgtggagggggggtgcctcccacccctcctgcatgcctgtgtctcgccaccagcatcgtatggagacttgcccccaaaaccaatgtcaatgacccccccctggttccttttgtggggacgtgtcacccttccaatctgtttttttgccagcacttggcccctatgcgtgcttcgtcatcccaagagtgtctataatatgtgtgtcattaaaccatgcacagtcattaaatcacggtacacgagggaatcagcatcgcctgctagcatgcgcagcagccgggaagcctcctcaccccgcaacgcgttcggaccactgggcacccggcgtgtcgatggaggtgaattcgggcaatcgctgtccaccactctcccctcgaaacccatcgtcgtgccccccctccacccttgtgcccgtggcgagagggccggatcacttctgcttgacccacgacgcgatgaccagcaccatcctgttggcggtgcactgtaagaagggggagtctctggacctgagaaaggctgtgaacacgtatgtggccggcacctacggcgtgcaggtgggtgatccgggcgggggtgtggctgcttgcaggagggccctgtctcactcaccagccggccggtgtgttcctgcggcccccggcctactcccattcccggcaccttaccctcctccacaggcggcggaggaggctggggacgacatgcaggagatccagtccctgcgcgacgacatcgtcaacctgtccggctccctgcagcacctgcgccgcacgctgtccaagtactaccgcatgctggccctgatggagtcgcgcttccccctgtccaggtctcgggagggggtcaacctgaccttctcctgggcggacgccttcaagccctccaagcgcgccgagcaggcctcgctcgacttcgagcgcgccgccatcctgttcaacctcggcgccgtggcctcgcagcagggcctggcctgcgagcgccggtccgaggcgggtctgcgcgagtcggcgcgggtgttccaggaggcggcgggctacttcgcggcgctgcgggaggggccgtgcctcaggatcgagcgccccgcgcccatggacctgacgcccgaggcggcggacatgctgtgccacatgatgctggcccaggcgcaggagtgcgtgtttgagaaggccgccgcagacaggaagagcccggcgctgctggccaggtgagtgtggttggggggaaagctttcaacagggagtgatactgcgaagcatcctggtggtggggccgcttttgtagtggacatgcgcttgctctgatgccggctcggacgctttacagagagcgttgtgcagctgccggcaggccaagcgtgctggcagccacttccgagccaccctcaccgcacggaaacaaccacccccacaggctgtccaagcaggtgtccagctactatgacgactgctcccgcctgctgacgtccgcgcccctcacctcccactttgacaagtcgtgggtggcgcacgccggggtcaagtccatgctgtacgatgtggaggccatcgtgcagagcagcgcggccctggccgctgccgaccctctcgccggggtggcccaggagattgcccgtctcaaggtgattggggcgggaggccgggggacgaagtgagggaagggcgccatggaagcctgtaacgggtctgatgagggattgggtatggtgtcgtgcagcgcagttttcctacccatagccgtgcctgtacggccgtcaggtcttgtgtgagtggaactgcgcacgtcagggtgtcccctgcaccatcgatgggcctcacgacactgttttcccttgcccccgcctgcgccaggcggcccagatcgtgctggcccgggcgcgcaaggacgccaaggccaccagcaaggagctgcaggagaacgtggccgccaaggagagccaggtggcgcagcggctggccaaggccgagcgcgagaacgccaccgtgtacttgcagcgcgtgccagccgaggcggacctgccccccatcgcgccggcctccctggtgaaaccagtggcgcccgcagacctggaggcggtggacgacgaggtgaggaacctcttctcctccgtcatcccagacgccaggtggggctgggttcccggggaggagggagggccaggtgcccgcggaccgcagggtgtggggtacgctctggccagtgaagcgccaggcccttgctccttcaagcagtctcagctgtgtcttctgggtggcactctggtctggcatggaccagatcttgcatgccccatgccagccgggcatcgtctacatagaagtcctggtggcaggacttggtcgctgcgcctgcaccggccgctcaggctccctgtgacactcctctccaccgcgcagcgcaaaggcgctgtctcgctacacagaaatggtggacatcgtgatccggaaagccacggaggccctggatgcagcatccgacgaggcgcggctgcggctgagggagtgggacctccccgaggcgagtggtgaccggatgaggggggcgctgtctcgtggagaagggctgatgtgcacgtctggagcccggggaaggagcatggccgggcttgcatgctcatgtcgccgccaccccctctcaggaaactggtccgacttccatcgccccctcctccccaccgtcaggccctgcaagccctggaggccggctccgtagcggcgctgccggatgctgtccgctccgagcttgaggatgtggagcggagtgggggcctcaagcacctccaggaggtggcccagcaagtgaaggtgtgtgacagggaatgacatgcgtaccatgggaggaggccgaggcgtccctggcaagcacggacggggatggtgattgtgggggaggcatctcaggactggcggtgccatcttccgatgcagctttcaagatttcgccttggatggttgactgcatccggaatccaaacctgctcctcccatctcccaacccttgggcccgtctggtcgtgtgccgatgccacagcccttccctccccgaccgcctccaggaggtgcgccgggtggcggtggaggagctgcaggcggtggcgcgggacctggccaacgaggaggccgacgacgagcagctgaggtgcgcggcgcaggggcgcgtcgagggtggggccaggtgcgggccgcatgcgtccggggcacgccgcgccgcgcactgctcgggcgcaggcactcccgccgaccgcatggctggagccgtggcccaggcccacctcccacacacccccaagcccatcctgctcccagggctcaccacggctcgcgctggaaccgtgcacccagctcccagctcacacggggcctgcgcgacagggtggcggggtaccagtccaacctggcggtggctggggagagcgactccaggtgcgggtggcccccgggacgcggcggcacaaggatcaccccgggttgggagggatgcatgtgtcgccggtccctgcacctggctgcagccaggccgggcgtccccccgctgcctgcaccatcctggtcctcctgctggcgcacacctcgacagctcaccactcgtcgccccggtgaccaggttggagcgccgcctggcgggggagtctgcggcctttgctgcgctgggcatcgaagccgccgctgcggagatgccgcgactccaggtgggacgtgtgcactcggaggggcattctggatggtacggcccccctgctgtcttgaaccacctggcagtggggacctgtgtccatctggtcgctccttgaaaccccatgcaacccccactccccgccccaaggccccgatgctgagcgtggacaacatggggcccgctgctgcagtcacaacgctgcggacggcgctggagggtctggacaccctcagcgcccagcgcgccagcctggaggaggggctcaaggtgtgtgcatgtgcgacaagggcagtggggtgggcgggcaggagtctggattgattgcagggaggcaacctgggttgccaggcccgtcagggtgccgctgtcgggatggccacacagcgcgggacggtccgcgctcagtgtgtttgcacctgagcttgcagtgccgctcagggaaggatatctgggactctcagtcccaacattgccttcccaatcccctcccaggaacgcaaacagcgggacaacgtcctgcctaagctcctggccgcgccacgggatgctgaggcgctgttcagggaggaaatcaagaaatacgacgacctggtggacgaggtggacgccaatgtggccaagcagggccagctgctggcagccatcaggcccgcgctggcgacctacaaggccgactacggctacgaggactggaagcgggcctgcaacgtgagttgagagggggcgctgcagggttggagtatgcgcaggcagtgtgtgtgttgttaagttggtcatgcatgattcagtcgcaggcagcattccgggcctgcttcactgtacaacagctcgacaacctcaggggtgtccaggttgtggaatggcccgcacaaactctgaaaattctccatgccttcttcccagcaaggccatgtactgcaccgcaatgtaaacagaccactcaccctgttcccgccttttgcatgctctctctcattcccagagtgctgccgcgggcatcaggcagcagtgtgctcgcttcaaggagctgcaggacaacctggcagagggcctgagattctacatgagcctgcaggtgattggctgctgcttggtccatgctggggtgatgctaccttgggcattgccagcatggcaggtactagaggggcattgcaatgccgggcggcaacagggcctccacgtcgctccaggcgtccttcgggctgcctctgcgacccccctccccacctctcctcgtgctcttgcccggcacaggaagccatcgcgcagctgcgccagcatgtaggggatcacatcctcacacgtcgtatgcaacggtgcgggagcgagtgagcatgcatgcactgtcctttggattgcacagttgtgttcattttcatgagggcgtgttgtactgacttggccatggaatttgcaacatatcctgggaatgtggtatatcgcaccaatgggcctccctttccagttcctcacaccatccccttcccccataacgcagagatgagatggtggaggaactgcggcgcgtggcagagtcgcagcgcctctccaaccaaatgtcaacgatgcagctcgggccacagccacccccacctcccccctcacaacagcatcaaggatcccaggtcagtcacgtaggggctctggcactgccagggatcactgggcagctcatgctgggatcagttcaagtgacaatgagcagatagggcatagggcggacagccagttcgccacggtgcatatgttttgcagtgcatgctttcaagccccacctcacgcctgttccctgggcactcctccacagggacagtacccttcgggcccttaccatcagcagtaccccagcagcaatccctacactgggcagcaaacacagcaacagcaggggtatcagcagggtggcggccccgcaggaccctacccttctttcggacccctgagctccaaccccccaccgagtcaggggggtgggtacagcgccccaacccctccatcggactggcagagccaaggcccacaacaacagcagcagtacaacacctatggtggcggcagcggtgcaccctccacgcaacagcagcaggaccagccgccgccttcctacggtaaccccatgcaggggactggcgggcatgtgcagaatttgggcacctacctcagtgacgtgttcaggaagtgatgcgggccctgcgcctggccgatcttgaccactgcctgcccctgtccctgggagcatgattttacagcgtggactgttggaaagcatatcttctcggagcagggaagccgcaatgacggtccaggctcaggacagacccatggcatgcagcatgatgccattctgggcatgcatgcggttttctgcctcgtcaaatacaatggagtactctgcaagatgatagagggtggggtgcagagttagtctggcatgggaggacggtgaaagtctggatgcaccggggagttacggcaacacacgttgggtcagcaggccacgcattgagcagtcttagatacgactttgcaccgtcctgtgcacatactgtcatgcagtagatccagcccagcaagcattcgcacacacccaacccgcccagggatgcgcacctgcctccattacgccatctgtgcattccacgccacgctcagcaggcaggcagtgcatgaacttagcctgtggacctgccgccgtcatcatctcctcattcacctggacaggtaacatgtgtagggagggttgcagttctctgtgggcatgttggtgtgttgacagggagccgtctgaggttgtcaatcctcacagcctcacgtccatcacagaccagagtagcaacgcaccagcagcacaccacaacatcatgcactcctgatccccaccacctgtcaagcctcatacctggaaacccttgaactgacgcttcctctcctccgcctcctccttctgacccatggaggcccagacatcggtgtacacgatatctgcgcccttcaccgcctcaaacggctcgtggcttatgctgatggagctgacgcccgtggcctgacagagctccgtcgtggccgggtcgggggtgaagccctcgggacatgcgcacacaaactccatggggatgcgggaggccaacctcatccatgagtgcaccatgttattgccgtcgcccacatacgcaatctgcaagaggggcgtgggcatgtgcgtgtgtgggagggcggtccgatttcaagatggcactgggggccctcctggcaggaccggcagggcgctggtgaagtcatggcatggtatcgccgcagccttgggcgtaccccttgccgccatcaccgggtcgcccaggctgttggcacatggtgttcatctgcatcacctcttcgtaaccaaacctccaacatgtcaccttgaggttctcgagccgtcctagatgctcccaagccgtcagcatgtctgccatgatctgcaatgtgtccaggaatagctggtttggaggcgctgtcatcaacacctcccatggggtctgcaccccctcgataatgggctgctagcgagtcaatgcatcggtcaatctgaaacaattgatcgcctcacacttgcacaatgcgcagcccccattcttgcccacctggcaggggtggttgtagtctgtgaggccattgatgattggagagtcggagtactgcgccaggtcgatgagatcctggtgcccaaacaggcgggccatgatcatctcgttgtacctacaatcatgggaaacgaggagggtgtgcagcggatgagcggttctggttcctgggaacggtccaatggtacattccgggaggatggcatcctgccggccgctggcgatagagaattcctgaaagggcagactagtggcgtctcgctttgctggtgttgcagtgttagctcgcgggcagcgccccaactgataatcgtagactcttcgcccttgagaaagaacgaaagaacaataagtaccgctcccattcccccttacctgcataggacccgggcaatgtccctggttggctcacgcttgcccagctggatggtgtctggtcccaggtacacagcatttccccccagcttggtgaagcctgtttcaaaggacacccgcgtgcgcatgctgggcttggtgaagatcatggccatggtcttgcccttgaatggcttgaagctctggtccccagactttaggattgccttggcatccttggccgtctgtagcatgtgcactagctcctccttggagaagtcgtccaggtgcaagaagtgtgtgcccgaggaaggaggggacacatccttgctgctccagctcttcgcggcggcacgagcccgaatgtgggccgtacgccggcttggggaggcggtgggccggatgggggtcccgagcccgagccgctgggaccgggcacccaccggggtgtaggtgacaagcatggacatggcgcgggtcgcctgtgggacagatgcgatcgatgccactttgctcgtaaaggagattgggtttgacgctgattacttcgtaaaagcgtgcctgccctagcatcacgtggtgcggaccgggacggatgggcacgacccgcgcgcccaggctgatcgactgccacatcagggtgagcaaccctatttccccacccaccacgcgtgcatcggacaataccacgccacattcaagtgttgcaagtcacattccttgattgcctctcaaggagcatattgctgtgcacaccgcctggcagtgactcgatctacagcagggcttcgatgagcatggggccgtcgcgcgccaagcctactcctatttgcctggcgagttcctcacagcttccagcctgcactgcaggcacaccatacccagttgcaagagccacccagtatatgttgggatgacccaggtctgtaagtgaccgcgctgccgggccattgctgcagggtgggaatgggaggggaggacgacagtgaagggtgatttggaaaagaaatcaagtatctggaccgtccactaggctcacataggaatcaatggacgatctgggagtcctacagtgttgaagttatgcacccgatacatgccaataccacccacagcatattcacctgggtgcaatcctctgcttggcaagctccagtttgaggatggcatacgtccgatttgcgcacacgatggtcagtacattgagcttctcacgggcctgagtccagagaccctgggcgctgtacagcccactcccatctgcctgtgtgtcgcgaggtttgcacggggtattggtgatcaaggagttcgggcgtgccggcctgtccctcccaatgtgacgcgcagagagcagagtgcgaaacgagatgctctcgatctccacaatccatcgtttcaagtccagtttttcttctagtcaggcccacaaaccttcgcgtcccagagcagcctccctcctccctgcatcagcagtgctgcccacctgaatattgatgacacgacgagcagggcacgccatggccgccccaacggccattgggatacctgccccaatggccccgcccgtcagcgtgaggtgtgaaaactgtgggcagccggaggaggcctcccagtaggcagtcccgctggtgagtgcctcatccacaacgatagcaccctccggctgcagtgcagcaatggtggcacacatggcagccgcggtgagacggcctgtcgatatcgagggaaggggtgggactgtcggagcttcagatgtagagcccgggttcagaggggtgcttgcacgccatcgatggcagcacaccggcatcgccagccatcctttcgcctcctggccaccgccctccctgccccacccacctgtgggaagcaacggccgactcgtgccggcgaatacccccccgcagttcttgaaaggcacgatgcgaccggcctgcagttccatgcctagcagcttgagtaccgtgccaatgtgggcgtccccatcgatctcccacacggcctcctcctgagcttgggatgagtcgggaaaggcatggatgccacccttccagtgagtgcgagaccatcactgcgcgcacgaggtgggccccagtatgatttcatcgccttccccggcccatatacaaccaggctcctgcggccccagcccactcacgctctgcgtgaccaactgactgggaccgccctcgtatccaaagttggcaacagggcgtcgagcatccacgagtaccagggtctcatacttgcccagggccgccgatgcttcctgcagcggtatgcgatccagtgcattgtgggaggaaggatgcagaaggctacgagcgtgaccatcctgactgtcacctcgccacagaagggttcctttggttctcatcagcaaccagctgcagcggacctctccacaccaccgagtccgtgagcctcccaccctcacctgggggaagtagggcacacgtcgaaactttgggagaccatggccacggtcgaccctggcgaacgaattctcacacagcaggtcggcccctgaggccgctgcaatctggcccaacagccgcagcgcgccctctgggtgtgcgagtgggacggaccgcgttgctgcacccaagtcacgaggtgacggtcgatcatcacggcccacacggtcgagccagtccaccccgggctggcatgcagaggcaggcagcacctgcctcaccctcccccgaaaatgcatgaccatacagactgcccgcccgagccgcacccacgtaccgtcatcgatgagcgccttgccgccgcagtagatgcccaggcgtccctgggacgccgccctcatcgcagcggccaggtccctgacaaactcttccgtcccggggggcggtgcgggcgcggcgccgggccccgagccctcccttcccccccccttgacgccatcctcgggcgcaggcaccctcgtccaggagacgtcgtgcgggaccaccagggtggtcaccccccgcgcctccgcggcccgctcggcgaggtggcggaagtcctcgcccccggcccccgcgcggtgcacctcctcgctgaccgtgcgcgccagggagtcgatgtccatggccagcaccgcgtcggcgggctggtgccaggtggccatgtcccctaccagggccagggtgggggtgcgggcccgccgggcattgtgcaggttggccaggccgttggccaggccggggcccaggtgcagcagggccatggccggcttgcccgccatgcgcccgtacccatcggcggccccggtgcataccgtctcgtgcaggcccagcaccgcgcggatgccggggacctggtccagggccgacacgaagtgcatctcggaggtccctgcagcaggggttgggatcaggggggtggggggttggtgcctgttgctgttgggataaaatcacgccggtacccgatgtgcgctcctgacccacctggattggcgaagcagacctcgatgcccgcatcgcgggcgcctcggatcaccgctgttgcgcctgtctcagtaccagccatgatgggaaggttggaggacctcaggatctgccaaggaaaagtaatgaaccgttgtgcccgatacgatccgaagagcggagctgcagtaccgagcctcgccgagctgggcaggtcaacatttggtcgcggtggcccgggacccagcgcagcacgccccgcagacactttcaagcatcccgcagctgcagctgctcacgagagcaggcaagccacatgtgtgggcttcggaatacgagactctggcacatccgagctacctacctacaggcacatggattagtcgatggaagtgatctgagacaagttccccgcctccagtttgcatccatgggaaaaccggacgagtacaagcgtggggcctggactaccgaggcgagtgacgattgttgcgaaatgtatcgtacgttgcatccatcacatgcaagacctaagtatgatagcttatactcatgtgatcgactgcgcaggaggatgcgttgctacgacgtctaatcagcgagctcggtgccaaaaactggagtatcatcgctgcggggatcgagggccgatctgggaagagctgccgcctccggcaagtgtcaaagggactttgtgtgtgtctgttgcgtatttgtgatcgacggcagttgatcaagtgcgtgctcaccaggaagtgtggccattaggctgggaactttgtttgcatcccttgctcgcctgtcgtcctggctcaggtggtgcaaccagctgaatcccgaggtgaagaaggagccctttgatcactgggaggatgcggtcatcattaagagtcacagaattcatggcaacaaatgggcaagtgagtgctgcacctgcggcggtgggaggggtgcactgcacttcttggccgggatcgcacattgtctcaacgtggtgctcttgtctggtgtgcataagcatgcacatggccagcaagagccagcgacccagcactcttgagcgcttggccttgctcagctgcgcccctttccccacaccctcgcagtcattgcaaagctgctgccaggccgcaccgacaatgcagtgaagaatcattggaactcgaccctaaaaaggatgcatgctggtgcgtgtggtggtcaggtcaagggcatcccgacatgcccattcaccctggctggctccaactatctggtgggaggaggcatgccatccttgcactcaatccagccagtcccccatcctctcggccaacaggaagctttgcatcaaataagtacctgaagtccagtcttgacctggctgccattctcaagcagcgtcccgagcacgctgaaacctatgaggtgctcgtggtgggtgaagggtgtgcatgttggggagatggtggccgggaggtgcttgagggcatcctcgctggaggccccatcgcgtctgagggcgtgcatggtcaaaaggcccatgtgaagccatgtcgtcaggctgaggcaatgtggtgcgtgcaccactggcgcactgatacttgcaccggcctgctgcgggtttgcgtgagcccctcttcctcactcagggctcacacccctcactccctacgccgcccaactgcgacaggacagccaggccacccactccgggaccgtggcgagctgtgagcagtcggactccccctccggcattgcagacctggacctgggccagaggacgagccaggagggcgagggcccgcgtgagtatgcgcggttcatggacgcggagatggtgcacagcgcgcacagcagcctcatggcgagcagcggctcgaggaggagcatggacagtggggaggaggaggaccacggatgctccggcgactaccctccgggtgggcccagggtccacgaccccacccacacgccgagcgtcgcggtgagaggggcggtgtctcccggcggtgtggatgggggctgggagtggagggtggggatggagaggtgttcgggcatgctttaggtgcaggagtcgtcctgcgcaaggctgggaagtgaaggggggggggggnnnnnnnnnnnnnnnnnnnnnnnnnnnnnnnnnnnnnnnnnnnnnnnnnnnnnnnnnnngactgcggcgagccgctgtggagtccgtgaatccgaccccttgctagagctgacacgcatcggtgtctctggcccttggcgatatggaccgcaccaggaagctcccgctctgcatggcgccccctgcaatgactcagggattcttcaagccgctcaggtgcagcgacagacccatccccacccactcctgtccatgcacactcctgctcccacaggactccgttgccctgctggccagcctccccctccaggtgcgcgccacgctgctggaggctgccaagctcgccgccccggcgttccgggcggggctcctgcgaagtcccatgccggtgaggtggtaggggcccaggtgggcacatgcatggtggtagctgaccgagctgcgcagcgtcgtctgtggcgacggcagggactctgaggatgtttgggtgtccttccacagtgcctttatagtgcactttgctgtgtatcaaaagatgatgggagtgcttcgagcatgaggaaaacggttttgcatcccaccacctgcacacgcagctcgtgacagaggcgcatatgaatgagcagagcaggtgcggcacgagggagggagagcatggtaatgggagcaagtggaaccccctggtatactttgcagtgccttgcatatccctgcttctctggtgcttgggcattacacctacctccccaccctccctttgcagagatgaaaacttgaatgagagcgaggtggggggatatgggtgagggaggaaggggggggtggggtgcattcagacatcttccagtccagcccggaggtcaggcctggcgggtgctcgcttctgtgaccactgcatggcactgatcggccgccactctcagccgcatcccgtctgtgccccaggaacgacacatccaaagctcgcagcaggccatcgctgcagacgcagccgtgcagctatccccgaccgacatgtgagcggcttccctgtgccatctaggcgcagcggagctccccatgccaccaccctagcctcccaggcgcaacccctgtgatctcccctccttgtacaccacgcctattttgcgacagcctgccagtaataccagccgcgtaagaatggcaagggtctctggtcggacaggagaggggatgtggaccttgaggtgcccccatccccgggtcggtcatactcagtgtcatgccgagacgtctggcacctcatacggtgccagatgatgcagcgagtgcaggacctccaggcaccgctccggctggctggtgtggaggaagccgactaggcactccagggcagttgccttcctgtatgtcagcctgtccagcttcccgccggccacccgccgcggcacagtgcctgggcatacggagatgtaggaggtcgcgcacggtgttgtgtggggggtggtggtgggagggggggggaggagaggacagaaaccgcatcgacactgtccgggtggatgcgcagtgcgtggcagccaggcacttggggcaagttcgcctgtgggtgcagacgagttcaagcaccttcatgccacaaacccctcagaaccacgcacccgaagcattggagccccaccgcaggacctctctctctctgtctgtgaggagagcccccgccacgagctcgtcatagcagcgcgcctgagcctctgcacagaccctgctcctcaccgcctcgtagtagtcttgcaggtggaggccgggcagcaggaatttctggcgcaagtgcatctgaaattgatggggggacgagtgtggattgcaagctgcatgttgacgaggcgcagggaggagaatgtgcctaatcatctgtgccatgcggtctggacacaatcattccgccacagggcagggaggatggccacctgtcgctgcccgataagacttgtcacaggacagcagcccaggcggccaacttgatgggtgcaaaccattcttgtctcttcccccagcccacctcccagacggcgtcccccaggaaggcgagagctcctggcccgctcatggaacgcagctgatctggcgacggccgggaggtgggtgctgtggcatgctggtggactggcatggcctggttggcctctgcttggggtccattgcatctgcaaagtatgtgccgatgatgcacagggccacggctgcaccgtttggcatgtgcagctgtgatggaccgggtgacacattggcctgctgacatgaacaccgtcatgtagggcaaaggagaggagatacgtcgctcctggtgcctgatctatcgctcaaagctgaatgtcaagataagtacacctctcatgccctgtgtgacatgctagtggccttgtctggcgtttcagcgacagccacacagccagctagctcgggaaggatggcctaaggacgcccaactaagaaaatccaccaggaccttggaattacccagtaatggtgattacatgaggcattcgagcgctgtgccactgtgtgatgatcctacccttgtttcattcgcgggccatgtttcgatcgttccggcaaggcgcgagactcaaaagggtgctggatcacatgcgccagctcgttgcgtcctccgctcccactcctcctgggggagttttttgcttctacaaggtgttgtagatcccatctgcgccttctgctgcccattctgcccgcgcaaccctggaagaactgcgcgcagggaactcgtcgattttttgagttgcatgcgctaagcaggtctcgtacagcttcatcggacgtggatgtcctacagtgctatagatcgccagacattcgagcttcagatgggtgttggagaccaggcgtcggtggacggatggctcgaggccgagtctctgggcgacgaccgaattctctcacgatcgcccacaatcaggacgaggtgggcagggtagccaggatcttgcttgcactaagcatatgagacggaactgctgggtccaaggctccgaacagtgctctgtcgtgcatgaggtgggtgcactcaatgtagctgcatgccagctcctccacaagttagctcctttccccccccccccccccccccaacacatacacacacaccaggatcgcagctactctgcatcgaatgcgaaaatggagatctggggtcctttgcgttgccctcctcacaggtgtggtcgatcagatggggttctgaggggtcccagtatgtggctgtccaggtgtggagtgggccatactcctgccaggtgtaggcaccaagcacaacttgcacaccacttgtgctcacagttagagctgtattcagtgtgctgcaacctgtgtgtctgtctgtgtgaagctcatccctgcacgctatgctccacgtctcaaccaacggccttgccatgcgactcgcaggcctcatcgccttgacgctggtgactgtatttgtcggcggcaggtacagcatgcgatcggcacgcgaggaggtccccaatgatcgccctgcggtcactccaaagaagtcgtccgccccagaaggtagatttccttttgtttcatggcttgcggactcctcagttgccctgctcgttcccggccactccttgcgctgcagccaggtacccactccacctggtgtgcaatgcgtaatccctcgcctctgtcgaccacccacacacccttccactgcaggctccatcacgggcgacttctccgcgcggcacgactaccggggccacccacgtgccgtgtcagcgcgccggggtgtagtggccgcggaccacgggcgctgctccgacatgggcgtggacaccctgaggaggggtgggaacgctgtggacgctgcggtcaccaccacgctgtgccagggcgtgatgaaccccgctgccagtggcctggggggtggtgccttcatcctcgtcaggcgaggcgagggaggagctgtggatggaggagggggatgaggcgtacgtaacacggccaggacgcagcgtgccctcgggcactggcctcggctggattcgttgtttcaccaggcgttctcgcattgagggccttccacagacatgcggccctcacgctccttgcacgcccccttcctaccaagcaggcttgccaacggttccgcggagtttgtggatgcaagggaggtcgcccccgccgctgccaacgagaccatgttcaaaggcgcggggcctggggcggggcgggcatgccgtgcagattctgggagcggtcgcttgcctgctgcggcgccatgccagggtgccactggattgcgaggcgctttctcaactcccccagggggtttgggccactgaaagcaaggtccctccctgtcccagagaccagctgtgactctggacgatgcagcggcatgcccattacctttgtggaactacacccctcttgctcagcctgtggcactctcgacctccacctcgccccacagaccgccccgatgccgccatcaccgggggtctggctgtcgcggtgcccatggagctccagggcctgcacagcgtgcacagtaggcacggggcgctcccctggtcagacgtggtggcccccgtcgtccccgtggccgccaagggcttccccgcccacccctacctggtggcggcgctgggaaacgtgaaccagagcgcggtgctgggcgccttccccgccttccgggacgctttcttcgtgcgcgagggcggcggctggcgggccccgagggtgaacgagacgtgctgcgcgcgtcccgccctggcgcggctgctggaaagggtggcaaaggaggggccgggcgcgatgtatgagggcgagacggcggcgggactggtgctggagatcgcgggggagggcggcgtcgtgagcgaggctgacctggccggcgcgcaggccacgctgtcggtgcccagtcgggagcgggtgctggggctggagttttggaccccggggcccccgacctccgcgctgaccatcaccagcgccctccgcatcctggcaggtgggtgggtcttttggaggaggggtggtccgcgtgctcatgtgcgtgcatgagcggctggctgcctggaatggcaggtagcgtgagtttgatggtacactctcgcatgttgggggggggaaccggggccctccagggaccttgtctgatctggggacggatcctccaggctggtgcaggatcccacgggtgcggcggcgctcgcaccagcccatgtcctgcatgccccacctcgaccgcaccatggcaccgcacccttgcagggtacgacctgcccctggcgggctccggagccctgggcatgcaccgcaccgttgagagcatgaagcatgcctttgcggcgcgcatgagcctcggggaccccggcccagggtcaaagttcctggacgtggatcccgtcctgcaggaccttcgctccccttcatatgcagacgccctcaggcgagtgcctggggcgtgacagggtgccgggactggccctgtcaccccggcgcgtgcatacgtgcagcccttgtccctggtcagggctggcctgagcgcggcggctggatcctgaccatatggattccaacgcacagtcggcgctcaccttcacactcccccctggggcgatggcgtgccgtgcagggatgtcatcagggatgacggcgtgctgaacctcaccgagtatgggggccgctggaacgtcacagcgggagcgcatggcctggatgcggggacgtcccacctctcagtcgtggacgactccggaatggccgtcagcctgaccaccacaataaacactgggtttggatcaaagatcctgtccccctccacgggtgggtggtgcgaggggatgcctgccgggctaatgtgggttgctggctgccagatcaggcatgtccgtatgtgaggagccagcgatggctggggcgcctgcacggcggggcgtgagaaggtcccgggagtgctgccctccgcgccgtccttgaatgcctgtattgctggcatggagagctgcagcaacatgctgtgatgcctttggccttgagctggtctctcttgtcgggcacaggcatcctgctgaacaaccagatggccgacttctctacacccgggcagttcaacgtgtttggctaccccccatctccgagcaacttcatcaggtgggacgtggccgtggcaaaggggctgcgccgcctgccttgccaggaccgaggcgcggtgctggacgaatccgtgtctgcgactgcgctgccgtcgccactccgtgcccagcagtgcgaggcgtggcacgcggggccttgctgtcatcacaattcaaacccctgaaccttgtgcatgccccccccacgctgcaggccagggaagaagcccttcagttccatgagccccctcatcgtggagcaggatggcaagctgcgcgtgtgcgtggggggtagcggcggtccgcgcataatctctgcggtcctgcagaccgtgctcaggtgagggcaggtccctcgggcaggccacgtgaggttctgtgtgcgccctgcgcggctgtgcataacgagggtccgcgcaggggaggggctcgggtgaacacctggcgccacacggcgtcaactcgccacacagaatccatcgagtctcggccaccggtgcgcgctcgcaggctcgtggcctatggcgaacccgcgtttgacgcggtggccaatccgcgtctccaccaccagctggtgccctccattctttacgctgagaattggagtgtgggcggcatcagcttcaattacagcacacccctgctggcggtgaggcgtgcggggtgcatgtgaagctgtgcccacttgctcacatatggtcgtgagcctgtccgggtgactggcgaatgggtcgcacatgatgtgcacagggacgaccgaccctggtagcgcttgcatgggcgtgagacggcccaacacgagaccctgcatggagacctcgaaacccctcaccccatgccacccacaacaggacctggctgcgcatggccacgacgtccagctcaccaactggggcgccgtggtacaggctgtggtggtggaccccgtggtcggggtgggtcagcgtaccgcgcccaccctgcatggtgtgagcgatccgcgcaaggatggtgcaccgtcaggctggtgactctgcaggcatgacagtcgggagcgccatgttggaatcatatacttggcggattccaacattctggcctgcttggctgtctctcgcggcctggaggtgggaatcgtctcgcgcacctgggtcctgctcgctgtgcaaccaaagccgtcgcactgaagcaagcgctcatcacagcagtatcgatgcaaggattcggtggtgttcaccctgcatggcctttggaatcgggtaatgcattccttgaccctggactgtgatcgtgcagggcacacctgtgtacacccgctggaaccaggagggatctggtccggtgccccagcaggcgcatcagcccagtgctcccgacccaaagggaaatttgggacagggttcctgcacgacaccatgctgcgcgctgcaccggttcgcgtctcaatgcggcacacgaccatcccttgcagcattcgatttcggaaacggattgccacggcaatcggaccggtggtctcacgccgacaccaacgcgccaactaggcgaggacggatgaccgagatagaggcgctgcgcctgttgtacaaggagtttcaggaagggacggctgaattgaaggcgctgtggctggcctgagggagctgcaggaactcagggctgaaagatgggtactctaagggaacagctcccaccgcgtgtcatccacgacgtgttcgacgcagacgtgattgcactccttggaggcgtcgtggtgatgtaagggatcaacctgtgcctcgaggtagcagaatggtgtcaacaagcccagatcaatgaccctcccggtgccatctacgaccatgcacatcaatgtgtgatgtatgcggccccaaacggacacggcaagtttgactccctgcagggagccccagtccaacccaaaatccgcaaatggcattgcaccctccagatttcagggcccgcagctggtgagggtgacgtctctgcgccgcagcgcgtcacgctgcccttgccgtctgcccttcccgtgacctctggtgacaacgctgggccaaagtcaggccgcttctggcaggggcacaccaagtggtgcccagcaacacgagtcgaggagatgctccctagaagtggtatacttgtaacataccccgatgtccattaggaagcgggagtcctgggcccatgcatatgaatggccaagaggaacctaaaagcaacagcaggcgaagagcaaagaaggacgggagcaagtccctggtacaatagccatgcctaggcggcgcagccatgggccacctcgcaggtacaaagggaattgaccgggtcaggtgagcccagaatagcctgtcaccagaccctatccgacaacttccgccacataatgtcatttgctcccgtccctccacgcgcgcgggcccaggggggggtaggagcgcccctagtcatccaggtcgagagtctctgacgtcaccaag

SEQ ID NO: 17997 - DNA, 155 bp, Chlorella protothecoides
caagcgaacgtcattggtgatgctgacgggaactcgaaatggatggccgtacgtagttggatcccctcgcgcgctgaaacagccgatctcgtccaactgggagactgaccaccgggaattaccgcccaccccttcacaacattgcatttctacat

SEQ ID NO: 17998 - DNA, 5084 bp, Chlorella protothecoides
ctgcaggccggcggccagcggcggcccgcgccagctccgccaccgtggtggggtccccctgccactcggcgggaccggccgaatcaactttgctgacctggcgcctgcccctggccaggcgctgggcgtccagcacggcgcgagccagtgcacacctgaaggcccaggcgatacgctgctgcttggtcacgcgcccgcgccggggccgggcgaccagggcaggagattgggcgggcagcggcgcggcgactgctgctgccgctgcagcgccctcggatgcagccccttccggcggcgccgcagcgcctgggagcaaacctttgacagcggcctgcgcaccgagagccccagcatcgaccgccacattgccatcctgtccggagggctccgcttggcgcatgcgctccaggaagccgggcggtatgccgcccttggacgtcacgctggggcgattggtgagctaggtgtgagacagagttgccatgcgttccacaggggggctgttgcacacagatgcctacatcttgccaagcacaccacgccgctcggccagccctgcagcaccgcaccagcgcccacacccaccggccgacgtccacgacacttaggatgaggccctccgcctcgctatcactgccggccacgccccccaccacagcgccggccccatcagtggggatctggggcagtgttggtgctagagtggttgatcgaggggtgtgcgcatgccacctggggttggggtatgccatagtcggagccctttcctaacattgcgtggcccagatcatccatccctcgtcttctgaagcatccacatgcctgcatggggttcggaatggacccccccgcctcgccagacgctgcctctgcctggcgggcggcgcccaggctctcctgcatggcggtgagcgcctcgctgccgcgcgtccctttccagccgtccacctgatcctgttctctcagcctgacgcagggagcacaaaagagaatgggcaggcgggtgttgatgctggagcaagattctgggcggttgaagccacccagcccgttcccgcaaccatcccctgttcagagcacccacccaccgatggtgggtgtgcagggacagcacatccgggcagatggtagccatggcctggacatcttccagcgtgatgtttccaggaagctgcagggaagctagaccggctgcaaccctccgccatgacggctgtggaagaacaggcaggcgaccaggtgaggatcgattcgtaaggtgcaaaggtgctttataatgaaacaagctcaggatccccaggcccacctgatcctcacacgtcatcatcctcaggctcccgcaatcctcccgaccctctgcaccaagatcaaagcaaatcccctccaggaggcctgggctcctcgcagccaatgccatctacctgaatgtgtgtcctgtccaaaaaggacacgacattggtcagcacagagaatgcccactccaagcgatgagcttcacggggcagtaccatggcggcgatcaatgcagcgctctccgcatccctgaccttgccactgttgtcaaacgggtcggcggcgagcggcgcagcggcctcgtcgtcactcaactggttcggttctcgcaacagggtctctcggctgaaccctacttccggggatgcctctttggggcagtcgtcgccggccgcaccgccatgcatgaaagcgacgccctgcaccctcaactcagcacgcacagcctccacgtcagcatcctcccctgcattagcgccaagggggccagagccagacccctcctccgcttggagtttggcctcgcccgcctcactggcgtggcgccgcagttcctctcccattgaagggcgggcgtcaggccaaggcgctgaccggctcacggcatggcccgcgctggcggtgctgccgggccccacagacctccgcagcaacttggcgggggaaacgccggggcgggagaggtacccgggcagcaatgtgtctagcgacgtgggggaggcaggcggggaggctgaggccggagctgtggcagagtcgccaggtatctcacagactggctcactcgtcacttgaatcactgcagggcaggggctggctgtctggccattcccaagatgattgggttccgcctgcacccgacctgcccctcgactggggatccccgcctgcagggggggatggtggtgtcaagcaatggcgtccctggcattgaagcactcctcagaaagcatcgaggaagggagtgctcacaagagtgtccaggggccccagcttgaggtcggcaatggcttggtcgtctggcaggcgcatgccctgcatggagaggaggacaacatgtcagacggacgtgaacatccgactcatgaccatgaaacaggacgtgatggctttggatccatttcgctacaagtgccctccaaccttgtaaaacaattgcagtgagggagcgccatgctgcacagccagcagtcgtttcacatcacgaatggtgggggcctcctccgaaaccacctcataccgctggccccgcagggtcttgatcaccagcatgcagagtcggtgaaagactagtaattggcatcagtgctgtacaatcgcgtgatggacgtatgccgtgcttatggtggaggtgggtgggaaaacacgcgaggttggatccacgtgcgtgcatcgcccacggcaagcctctgctcccactgctattctactcaagagccctctgtatctaccttccgcaagtttcatacatcgaatcattacagatgattaggacatcgtcaggtgaagtttacccgcctcaaattccaattgcgagatgacaacagtccatcagcaacccttttcccaagtttgcgtgactcttacttgcctatgcctgcgtgtgcgcatgggatttggatagtggtgcggcaattggttcaaggtgaattttcaatgctacggacagaccctatattctctttaaaatgaacgccccagtaaatacccaccgctgcgcagacttgtcgctggaggagcagggtctcggactggatcctgtctgagacggatggatggagccgtgccagaagcttgtgttcctgaaagggcagtccattgcatggaggataaaggagcggagaggttcagggatgcttagcatgctgtacatcatcgtgatgtctgggttgcaaaggttccaggcctcaccttcagccattgcaggatggtcagcagggagcctgcttgaccatgccaggcatgtgaatgggaagcgctctctggggctgcactcaagcggcgaaaggtggccataacaacctgggatgacacaggtggggtgctggaatgacacacaatgtcaacccttgggactgagaagtgagaggtatctcttgatccaagagcacgagatggaccctcgcatgctcagcacctccccacaccacagtcatcgcctggccaacttacccctgggtgttccgccaaccaccaggtcatattctcttgcagtagcctgaattcgggcgtgtccctcaggtgcttattcctgcaataccaatggtcctttggtgagccaagcaactgaaatctattgacaggggatgcagcttttgccaaagggagctctcaggggcctgacctgcacccatcgaattcgccgacccggcgcccccttccatacatgtcgccaccgtggccagatccctgaggaggccagggaatgactgcgccgcacaggggctctcagcacagtgtatggtcacgcccgctatggcatcgcaggccaggggaaacccaatcggcatcgcagctcgccggcggaaggttgagcaccagtcgccgatgcggtcggcggctccatgcgctccccacccgacattcggccatctctgcctgcagtgcctctcccacaggtcgggttcgaatgccgaacatgccaaggagcggcactgcgtggaggtttgaggtcagggagtgagtgcggggagggtttgcgaatgcggcaccatcttggccattgtaggtggttggggttctggccgtcagcgcccatcaccacacctgcgccgcgacgcccacgagctctcgggggctgagatcactgtggaatggaggcatggagagtgagtcatgcagtatgcagtctggcatggcagtcctggggttggcaagcccggacctcccccgggcaggcgccgggaccccacctgaacagtgctcgagtcacgtccgggggcatggtctggagtccaaccatgtctgagccgcgtgtagaatctattagtgctcggtgagcggatgtgggttgccctgaagtggaacttgacggggtgggtgcgtcgcggtggggcgaccctccctgcgatatccctagatggcactcagcggctccacacggacgcactggtaaccttttgggcttcgagatctcttatttccgagagatgtagagacgcctgggtcccgatgtcccacaggattccgcccccccctgtgtctcgaggcccaaccacctgtctccgtcacgcggcgccccgacccgccgatccggcgccctggtgacgaatgctgcgcgtgcacggcgggactcctctgcacctgtcaccccctctcccccctcctcacaagcccctcactcttgcgtccaggcctttgcaacagagccacgaaccacatgatgagcgggccttccccaggcctggcgcggtcagggcagcttggcaaaggggtcctcctgcggctcctcctccccctcccgccgttcgtgccccatggccgtctccagcatgctgaggcggtggtggtgccgcgccatgtgtgcctccacggtctgccgcgccgggtgggccggcggggccggcccctgctgctgctgctgcgcctgctggggcaccccacccgcccgcgccacaaaggggttgggctccgtcggccccgcgggcaaccccgcggactggcccagggtcacgggcagggcgctggccgccagcccggcaccggctggcgtgcccgtcgtcgcgcccggcagcgggacctcgcccgcccccgcctcgtcgtgcgtggccggcacggtcagcggcgtggcc

SEQ ID NO: 17999 - DNA, 118 bp, Chlorella protothecoides
tatcaatgtccagtacagaaatataataaactaaatttcttctaaataaaaaaattttaattatgagaaaacatccttttcatttagtggatccaagtccatggcctttattagctag

SEQ ID NO: 18000 - DNA, 74 bp, Chlorella protothecoides
ctacctccgtttgccggtgcctctggggatgctgctcggaatctgagtgctagactgcaacaggaacagaaggg

SEQ ID NO: 18001 - DNA, 70 bp, Chlorella protothecoides
gtcgctggccgtcgttgatgctgcgcaagacggtgagggtggcggagagctctgggagactgtgtgtgtt

SEQ ID NO: 18002 - DNA, 61 bp, Chlorella protothecoides
ggcggagagctctgggagactgtgtgtgtttggaagggtgcaccttggtgatgtaggcgct

SEQ ID NO: 18003 - DNA, 187 bp, Chlorella protothecoides
ccagcaccagggcccacccgcggcttccaatcgcttccctctcaacaatttcaagcactttttgactctcttttcaaagttcttttcatctttccctcgcggtacttgttcgctatcggtctcccgtcgatatttagccttagatgggatttaccacctgctttgggctgcattcccaagcaacccg

SEQ ID NO: 18004 - DNA, 70 bp, Chlorella protothecoides
ggagggttgtgaatggttggcggagaggacattatgcatgcagtgaggctgcatgcagatacattctggg

SEQ ID NO: 18005 - DNA, 81 bp, Chlorella protothecoides
tagaccaaaccatgaaaccaacataaacattattgcccggcgtacggggaaggacgtcaatagtcacacagtccttgacgg

SEQ ID NO: 18006 - DNA, 529 bp, Chlorella protothecoides
tttaagattgctgagggtcagtggtatcgttatgcgccttcgtatgtttctcctgcttatcaccttcttgaaggcttcccattcattcaggaaccgccttctggtgatttgcaagaacgcgtacttattcgccaccatgattatgaccagtgtttccagtccgttcagttgttgcagtggaatagtcaggttaaatttaatgtgaccgtttatcgcaatctgccgaccactcgcgattcaatcatgacttcgtgataaaagattgagtgtgaggttataacgccgaagcggtaaaaattttaatttttgccgctgaggggttgaccaagcgaagcgcggtaggttttctgcttaggagtttaatcatgtttcagacttttatttctcgccataattcaaactttttttctgataagctggttctcacttctgttactccagcttcttcggcacctgttttacagacacctaaagctacatcgtcaacgttatattttgatagtttgacggttaatgctggtaatggtgg

SEQ ID NO: 18007 - DNA, 244 bp, Chlorella protothecoides
atttcaaggttgcctttttttatcaaggctcccacctatcctctacaatcaatatcctttttcaacgtaaagttgcagtaaagatgcttagggtctttccgtctactttggggaactccgcatcttcacggagaattcaatttcactgagaccatattagagacagcggagtaatcgttacaccattcatgcaggccggaacttacccggcaatgaatttcgctaccttaggactgttagagtt

SEQ ID NO: 18008 - DNA, 77 bp, Chlorella protothecoides
ccctgccacttcaccaggtactggtagccgcggccgacgcgcttgtgccggaggatggcctccacaaggtaggcggg

SEQ ID NO: 18009 - DNA, 75 bp, Chlorella protothecoides
ctgctttgcgactccatccttgggattctcacgtaacacaccctgcccacctgcaggacatgggagaagcccagg

SEQ ID NO: 18010 - DNA, 139 bp, Chlorella protothecoides
tgtattaaaagaacgaaaagagcaagttgtaatcgaaccccaagatgagtatatggtagaactctttgaagctgttaaagataaagggatacctgctactcgagaatggctaatggaatacatgcttgaaccaaataaa

SEQ ID NO: 18011 - DNA, 76 bp, Chlorella protothecoides
tgctattgtccctcggttgcagcttctgatctctcccggtccggccgaagaagctgatctcgccatgggatctttg

SEQ ID NO: 18012 - DNA, 183 bp, Chlorella protothecoides
tctggactaacacctaatacatcacaaatttgtaaacaatgatgatgccctaatccataaatttgtgtgcatgcttgataaattggttttttatcatttaaatgcgtattttgtatgtataccataaatatttttctatattttatatttaaatagaaaaacttaaatactgacgtatatttt

SEQ ID NO: 18013 - DNA, 554 bp, Chlorella protothecoides
caacctcgcgctgcccaaccacaagcaatttcccgcgtacacacaagactttagcagccatggctctgccccccccccccccccaaaaaaaaaatcttacacacacttccacgcatgcacacagggtggaacgctcagatggcgtgccagatatatggtatggagactgtatctccttccttactattgagccctctcagcgcaagttcgtcctcgtgagatggtataccagtgtgccacccgagcagctgacggagatggaaaggatgttggacatggtgccactacggcggagtaccctcagacaggtggagcggtaccgcagcaacacaaagcaccaatttgacatttggcctgtggaagatctgataggaccggcctacttgcagcctaacccagggcagggcaggacggagcattattttgtgaatccatacatccgttgagatgtcctgagtaatcaccatgtcatgcacactcatgttaccattgatgactcttgtggcacgaatccctgcagtccccacagcctgtggcttgtggcctggacgcag

SEQ ID NO: 18014 - DNA, 69 bp, Chlorella protothecoides
tacttgcaagtaagggtaataaaagtaccagtaaatacataagtttagttttataataatattcacatt

SEQ ID NO: 18015 - DNA, 64 bp, Chlorella protothecoides
agtgcgtatcaatttaaaatttttaaactataatttttttgtatatcgataatgcttgtagttt

SEQ ID NO: 18016 - DNA, 193 bp, Chlorella protothecoides
attaaaaattatttttaatggtgatcttctaacgattcaccaatatatgccccggctaatgtagcaaaaaccaaagcttggatggcacttgtgaataaaccaagcaacattattggaattggaactaccaaaggtactaaagtaattaatacacctacaactaattcatcagctaaaatattaccaaaaagtc

SEQ ID NO: 18017 - DNA, 359 bp, Chlorella protothecoides
aataggctaaaaaaagcataatttaaaagtttagtaatttttaataaaaaatagagtccaaataatagagtagagagatgaaaccaaccgggtctattggactctaacctttcattaaattaataaattctactgcaatggttccacgaatacgataatagactacaagtaatgctaatcctatcgcggattcagctgcagcaactgttaatatcaatagcgcaaaaagttgacctatacaatcatcaatatagacagagaataataaaaaatttaaattcactgctaataacattagctcaattgacatcaacattacaataatattttttctatttaaaaaaatgccccaaattcct

SEQ ID NO: 18018 - DNA, 279 bp, Chlorella protothecoides
cgacctgtgatgggtcatgcacagggatcagctcaggggcgggaagcgtgatcacaagttagggctcttggttctaggacatgttcttgtcagctaaaatatataaaaacgatgaacacttactcgcagaaggtatccgcgctgctaagctccaacacatagacatgttgcccatgcctatcgcagaggaagatgggaacgatgggcgaaggggtcggtaaagaatgtccggaggctcacagcttcacttgcaatacacgcccgctccagaaggcggcc

SEQ ID NO: 18019 - DNA, 293 bp, Chlorella protothecoides
ggcggactcctatactgttcctcacgcttctcgttctgagcctcggtgtgctctcaaaggtaaggtctacggagatttgtgatacaggaggcttgcgctgcacggggaggttagcgggatcatcttccttacagacacggcgcccgcacaccctcgttcactccaccagggcgcgtgcacttccaaggtcttctcactcccggcagtcgagtgagtttcggccagcaaaatgggctgtttttgttccagcttctttcatctgagtgtgcgggccgccttctggagcgggcgtg

SEQ ID NO: 18020 - DNA, 75 bp, Chlorella protothecoides
cacatattgtttggtaggatgtagctgcagggatatatcccgcagcacccccaccctccgcaccttggcggcctt

SEQ ID NO: 18021 - DNA, 381 bp, Chlorella protothecoides
aaaaaaaatgtaattattttcaaatagaatatattcaatctattttattatttgattaaataataaagtttttaagtttgccaagaaccagacttgaactggtgacacgaagattttcagtcttccgctctaccgactgagctatctcggctatttttaattgttatagtaatatattattataaatttaaagcttatagaagctattggttcaattagaacaaagttctagtttatttttattaaaaaattatgatattaaaatttatgttagataaagtaatattaattatttcacttttaattctattatttatagtaccgcaaacaacaacaagagaaaatgttatttttaaaaaattttataatagtggttttttt

SEQ ID NO: 18022 - DNA, 250 bp, Chlorella protothecoides
tttatgccggtgtaggcttccagctgttcgagactccgcagggccaactggatctccttctccaccctactggggtcggtgaggtcctatcaaaagaaagagtggcacggacatgttataaggaggtctatgagctgctacggcgcctgttgtaaggtcttgagaatccacctaggcccctgactgcagtcgcctccccaccccagcccagcctgccttgttcttgtggaactcctgcttgatctccgcc

SEQ ID NO: 18023 - DNA, 74 bp, Chlorella protothecoides
ataccctcaagaggattgctgaaaaggcacaaacatatgccggaaccttagtgtcatgcgttgagtttcaaggc

SEQ ID NO: 18024 - DNA, 210 bp, Chlorella protothecoides
gatttagtagagtactaggaaaacgacaaatcttagaatttacataaattttagaatgtctacaagcttgtcttgctgctactatagtttttgcaaaaccactacggtataacgcgacatctaatcttttttctattaatgaaaagaaattttttgaaaaatacccaggcatgattgatgcttgagataaaattctatgtaattgtttta

SEQ ID NO: 18025 - DNA, 79 bp, Chlorella protothecoides
ttgtccctccccgcactgatgtttcatatgcatacgtgaattcgtttcggtcttttgtgtcgacatcgtattttcctgt

SEQ ID NO: 18026 - DNA, 81 bp, Chlorella protothecoides
tatcattgcattgcagacatgtgcaggtgagctatccttggggcatgtaaggacagtgtgcaagggtttctcgctattctt

SEQ ID NO: 18027 - DNA, 247 bp, Chlorella protothecoides
gaccagaacacaaagctggatcctccccttattcgacagagttcagcccatacgcgatgctgtccgtggtggcttccctcactccctactcggatttcaatcagtcgcccagaaacatgtatcagtgccaaatggcaaagcagaccatgggattcccgatacacgccacggagcatcgtgcagacaacaaaacttatcggctgcacacgccacagacaccattggcacgaacgagaaggtattgtgg

SEQ ID NO: 18028 - DNA, 327 bp, Chlorella protothecoides
tctcacctgccacgctcgtcccgcagattgacatttatggacttgtagatggaagcgtgagcgaaacctcgttcgattgaggatttgttgagaatcatggcatcctccatgtcataccctgcgatcagagtacaaggacagtttcaaacagcgctgactggcaatccaatgcatcacgctgtacctcatcagctcttgagaaaacaaaatatacctgtgtatgcgaggacagctacaaccgcatttgtaccgtttgggtactcatccatgtggtacttgctatacctgcgagtatgaatgagggttcgggcttgtgcagagcctggt

SEQ ID NO: 18029 - DNA, 93 bp, Chlorella protothecoides
aatataataaatgtttcaaaacaatataatttaaaaattatatttatattttaggccctaccggatttgaaccgatgacccgctgcttgtaag

SEQ ID NO: 18030 - DNA, 227 bp, Chlorella protothecoides
gcgcgcgcgataaaccttggaaagattcgagtttaatctttcttttgcccggggttaaaggtcttgtatttccctaatgctttaaccacgctatggatgcacagtggatgcacactagatgcacagtagtattatttactagcattgtaatataaaagtatatataaaagtatattattctagtaactaataattgtaataactaactaataaactaactattaaag

SEQ ID NO: 18031 - DNA, 69 bp, Chlorella protothecoides
tatagctgaaaacgtaaaaggaaataaactgagaataagcccctgatccacttcaattgatctgagttt

SEQ ID NO: 18032 - DNA, 76 bp, Chlorella protothecoides
ctcatcctcgtcatcgaaggacagggcggatatcttgcggaggttccccctcttcatcccctcgggtccctctcca

SEQ ID NO: 18033 - DNA, 384 bp, Chlorella protothecoides
tcatttttatgcaacaagtacaattaaaattaaaatcatttgatccgttgtatattaatcaactggtttctttatttgatgaaattttatatactttggaaacaccggattctaaagaaatatttattccatctaaattaaagaaaataactgtaatacgttctccacatatacataaaaaatctcgagatcagtttcaaattaaaacatataagagatcactggtactttcttttgcaaatataaatagtctccatgcttttattgaaatttgcaaaaatctacatgtagttggtgtacaaatccatatctctattaaacaccaaagtggttataataaataacaaaacgatataataaatttcatttattgtacgaagtaaa

SEQ ID NO: 18034 - DNA, 280 bp, Chlorella protothecoides
aaattatattaaaatagatttagttttaaattttttattttggacgttttacaccatattttgaacgaccttggttacgattttttactccaagtgagtccaaagtaccacgaacaatatgatagcggacaccgggtaaatcttttacacggcctcctctaactaaaacgactgaatgttcttgcaaattgtggccaatacctgggatataagcagtaacttcaaattttgaagataaccgaacacgtgctacttttcgtaaagcggaatttggtttttt

SEQ ID NO: 18035 - DNA, 136 bp, Chlorella protothecoides
tactaagaagatttttaggtttattctttaataaattttaaaagatttttatatttataaattactatttcaaatttataaatataaaaatcttagatatataaaacgatataaattttagcgacttaataaatta

SEQ ID NO: 18036 - DNA, 77 bp, Chlorella protothecoides
taaaaaagcattttttgttagaataaatttttttgttgatttattaaaactagaaaaagatgtatttaatgtttttg

SEQ ID NO: 18037 - DNA, 61 bp, Chlorella protothecoides
agcatcggtatggtggcagcgcgccgcgggggaagtacattggggagcgatgggaagcggc

SEQ ID NO: 18038 - DNA, 61 bp, Chlorella protothecoides
gtccagcttgtagtgcttgatgtagctcatgggcagggagaagagcaggtaaaagatcagg

SEQ ID NO: 18039 - DNA, 78 bp, Chlorella protothecoides
tgtaaggttgccttttcctggagactagggtgtggatctacgctttgttgagtccgaattcaattgaccgggcgccag

SEQ ID NO: 18040 - DNA, 73 bp, Chlorella protothecoides
gatggcgacggacacggtgtgcgtcacatggtggtcatccaaaaccatgagggagaagagctcaaactgcggc

SEQ ID NO: 18041 - DNA, 348 bp, Chlorella protothecoides
aataaaccaaaacttaattttgggcttgttaatgaattagattataactttagtccgtttgctgtttctttatttaataaaattgctttagcaacagagaatccacacatagaacaaactctatgtgaagaagaatttggtagaattctttcaccgggtatttataaaactgtttcgaaaaatggggatgcttgggagatagatataagtgtttgggagccattaactacaaactcatggttagttgtttcacaaatcggttttagttatatcttctttatagtattaaaagaaacaatgatgaattacggacgtgaatttttagcatacttacttgagatttttaat

SEQ ID NO: 18042 - DNA, 68 bp, Chlorella protothecoides
aattcatcaaacatcataggaggtaaaaaacctgttgtattaaaaatctcaagtaagtatgctaaaaa

SEQ ID NO: 18043 - DNA, 63 bp, Chlorella protothecoides
atggcccacgtgccggatttcgaaacgccccctctccgccctcgatacccccatcctatatcc

SEQ ID NO: 18044 - DNA, 101 bp, Chlorella protothecoides
accaaccctttggatgagagacactgggcctcggcgcgatgtcgacccggggatggagtggcaacattctccctggatccgtcgcccctgggtccgatcag

SEQ ID NO: 18045 - DNA, 123 bp, Chlorella protothecoides
accgtctctttccacgagccccaactgagaccattcctccagacggatccaacgattcggagggacccggggccgtgcggtcgaagcagcacaacggcccgggcactcccgcaggatgcgctg

SEQ ID NO: 18046 - DNA, 246 bp, Chlorella protothecoides
cctttttcaaatcctgcagctgctgcacgagcacgtccagcatgccataaatgcccaataaagaaaaagaaacctaaacaaaaatgagaagtagctagccaacttcgtggtgacacgaaatttacagcattgatttctgtagctacaccacctactgaatttaatgatcctaatggagcatgagtcatatattcagcagcacgtcgttcttgccaaggttggatatcattttttaatttatttaaa

SEQ ID NO: 18047 - DNA, 61 bp, Chlorella protothecoides
ttgttctatattggtgtccggctaatatgaaaacaacagcaatagcaagatgatgatgtgc

SEQ ID NO: 18048 - DNA, 146 bp, Chlorella protothecoides
gtctttggtgggtgagcaggctgcagggacgtctgctccggccagtggggatgggggggtcccgaatgggtcggccacagtctttttctgggtcccaagagccctccctgctcccatccccccatccacaggtactccctgtatga

SEQ ID NO: 18049 - DNA, 398 bp, Chlorella protothecoides
taaatttgttattttccaagtaatcgatatgggttcgattcccattgtccgcttgtgtatcgagacaagtagataagatttaggatataactctatttacaaatttaggtagataaaaaaattatatcaattctgctattatgtacaaatatgttttttacagagtatagcgcagcctggtagcgtgttcgctttgggagcgagaggccgcaggttcgaatcctgctactctgatttcgtgttttatagccctgcataataaactttgttttattaaatagctttatacccaaaatttatctgatataactatataaggttgtttttagttacagtgggtttctcatcatcttgatcatcgttttatttttagtcctatgcatctctgtaccaataat

SEQ ID NO: 18050 - DNA, 74 bp, Chlorella protothecoides
gcacagacacgagtccatgccccttcagctctcccatcttatctgcccaagatccggcaacctacctggatggc

SEQ ID NO: 18051 - DNA, 61 bp, Chlorella protothecoides
aggaattcttgtggctttgtgtggggtggcttttgtgtggctgttcagggtctgcctggct

SEQ ID NO: 18052 - DNA, 235 bp, Chlorella protothecoides
attacagaacctgctgtaggagcttctacgtgagcttcaggtaaccaaatatgaacaggtaccataggaactttaacagcaaaacttgcgaaaaaagctaaccagagtatacattgtctagtttcactaaaatcagatagatataacatttcaatgtctagagtacctgtttgaaaatatattaataatatagctaataacattaatacagaaccaaataatgtatataaaaaaa

SEQ ID NO: 18053 - DNA, 227 bp, Chlorella protothecoides
ttttttttacaaatcactaaaaattagtatatacttaaaataataagtactataaaaagaaatatatcttataggtatataagaacaactactttttattttacattattatagttatgtttatacaatattttaattttattaatattttatatttttattataatgattttatttttgaattaaatatttaaagtattaaaaacattggtaaaaaatatattttt

SEQ ID NO: 18054 - DNA, 65 bp, Chlorella protothecoides
tggatagagagcctgaacgccatgctctgtctcgggtcctgattgtgcaagatctggtcgtgcct

SEQ ID NO: 18055 - DNA, 61 bp, Chlorella protothecoides
accaagaagagggaattgacagtccttactgcggtgtgcgcacgtgctgcctcgaggaggc

SEQ ID NO: 18056 - DNA, 83 bp, Chlorella protothecoides
cataccaagctgttgtcaggatggggtggcttgacttgtgttgtacttaacatggacccctgggagttattgggcatccataa

SEQ ID NO: 18057 - DNA, 160 bp, Chlorella protothecoides
ttttttagaatcaaacatttatattgtttgatatgaatataataatcacgaaattaattatttatgcctcaaataaataaactagaaaataagttagagtctgttttaaaaaaagataaagatttacagattatcgagacacctcataatgaccctgtgg

SEQ ID NO: 18058 - DNA, 3818 bp, Chlorella protothecoides
cctcccgcgccgcggccgccagccgccgcgcttggtcgccgcgcgcgcattcaatcagggccgaggccgcgagcccgctggaggccgcgcaggcgtcggagcccgcgaccggggcgcgcgcgccggtgcgtgccaggcaccgtacgtacgggaaccacagggcctgggcggggtacagcgcctgggcgcagttgatcaggtcgttgcccgcgcactctgccgcaccgtgctggcactgggggccatcctgcgtgtgtgtggggcggtagagggggggcatgggggcggtgagagctggtgtcagccggccggccagcagggaggtgctgtggacgtcccccgacgctcctccagggccaccatgcggactgggggagtccatagacagccacatgtaaatgagcagcgcctccatccaaggacggggccgccgggccagtagcaggggcaccgcgcgtggaatgaggcaggcccatgtcccagacccgcccccctccctcgcttacatggcttcggtgggcatttccccaggcaacgtagcggaactcgatgtagctggagaagccttgatcaaatagatctgaggcctgctccaggatccaggctctgcagtaggggcacagagactcaccgtacagagtcacttgcactgctgctgaggccgtggcggggcaagccagcacggcgaaggccaggaacagtggcaggatcgccccccttgcgagcatgttcccgcagctgggttccccaggtgatagtattcagtaaaggtgttcaggtgcgaggggtgcatcgcgccaatcccacttgcatgcgaccccatggaccagcaaattccgaaaccctcgcatcgcatcgcatggcagtttccacgtcagcaacagctgatccatgccgaggggtccaccggaccccaccgcaccgtcgaccttgcacgtcagaggccaagcattggtacgcagtttcgtgtcatttgctctagaacccgctacaccgtgctctgcgtgtcatgcagtcgcgttccgctccaaggagaacaggtgctcggtggtagccacggaatgcactcatcagccggaccgtctcacgccgtacaggcagcgatgctgacgccaaccgccatgccctctacgtgagacggaatatgtacggcctcacgctctgtcgcgtgactcagcgatcgcgaccacacgtcctgcgcaggcttgccggcctgaatgttgtggggaaagcgtgccatgctcacacacttggcccctcaacgccatgttgcatccagtgctcacaccgtgagcctttttatctcacaggaggctatgtggaccttgtcgcccgccccaaacaccgttctcgtcgctgaggctgccgatgcaacctggtgccacggccaggcacccagccagacacaggcatgtcccccaggcaggcatgtctgccagccctggcgggcacccatcctcgccctccccccccacccccttcctggcggccttctggaggttcctgaggccacacaccatccgaggcaccctgctcgggtcgtgcgccatcacggccaaggccctggcggagaacccggccctcatcgactggggtctcctgccccgggcctgtctgggcgtgctggccctgctggccggcaacggctacatcgtgggcatcaaccaggtgtacgatgtggagatcgacgccatcaacaagccctggctgcccatcgccgctggggacctgagcctgcccgtggcgtgggcgctgtgcctgggcctggccgccggtgaggttattgattgtgtggggctgggcgtggcaagaggctgccaggcaggcaacaggagcccacaatgagggtcctacacctgctcagggcgtgcccgactggcctacattgtctgcagcagcactccccatgccagatgatccgccccagattcagcttcacgtcctgcatacaatgacccccttctctatcctggccaccgtccagcccctcaaatctcccggtctcctgatcctcgtctgtcccttccacccctcaaccccccccaacccccacctcaccacacaggcgggctgggcatctgcgtccgctattttggcccggccatcgccaagctgtacgccacgggcttggccctgggcacggtgtacagcgtcccccccctgcgcctgaagcgatttgcggtctccgccttcctcatcattgcctttgtccgcggtttcctcctgaactttggcgtgtaccaggcggtgcgcgccgccctgggcctgcccttcgtctggagccccgccatcacgtgcgtcgggcttgggagagggggagcttgtagacccggaaaggaggggatggcatgtggggaatgacttgtttagaaggggcatgagcccaatctgccctatagtgctccccatgggttgggaggcccggagtgcaggtgcagggttgcagcagcccacctgcaagcacactcacactcctgtccgttacaaggacccacatacacatctctgcccccagcccgcccatccaccggctcctctccccccccctgagcacggtgttcaggttcatgacggtgtttgtcacggtgtttgccacggccatcgccatcaccaaggaccttcccgacatcgcgggggacagggccaacaacatccagacctttgccacgcggctgggcatgcggcgcgtggcctggctcggctcggggctgctgctggccaactacgtcggcggcgcgctggccgccgccgccaaccccgtcgcgctgaatgcgcggctggtcgtgccggcgcacgccctgctggcggccgcactgacctggcagacggcgcgcatggcggagacgcaggccggcgtcaccgcctactaccgcttcgtgtggtacctgttctacgcggagtacctgctgctgcccttcatctgacgcaggatcgttcctcccggggggctgcgggggggcggcgaccccaccccgcccatccacctcacaccatcccgtgcgcagttctgtgacaggtaccccgcgctgcgcggatgggtggcagacagcgcagcaggggtatacgtgcaagcctgggggcaagtggcgcgcggggggtgcgccacgcgaatatttatgttcaggaatggtatgtgcacggaggttccggtggcacgaggtttggggtagggcagaatggcactcgagggaatgtgggggtaacctcaaaaggggatgcagggtgcatggatcgggcagtgggcgttcgatatcaagcacggcaggagtttcgtacgtgcagtcagcctgagcaggcatgtgaggggtgcggggcgtggcgtgcggcggcgctgggcgcgctcaggcggtgaccacgtccacctcacagagcgccagcgcggtggcggccttgggcaggtagacggcgacataacgcgcgggcgtgggcgcggcgcaggtcaccgccgcgcgcgccccgggcaccagcttcgagggcacgacgccgcagggggtgaaggcgggcaggctggcagcggaggtccagggctcggagcccagcaggatctgcgccccggccaggtcggtgaagcagccctgggcgcagtcgctgcgggccttgaccaccacgcccgccaccgtgactacggagcccaggtccacagtccaccaggcgttgctcaggcccggctctgcgtggcgtggagggggtgggagggggtgggagtcccaaggcgagcaggtgccggcggtgcgcacagcctggggacgggatgggggaccctgggccagacgggagccccgggcaggaagtggatgctgcgctgagggccccccccc

SEQ ID NO: 18059 - DNA, 70 bp, Chlorella protothecoides
atggtgtgaggtggatgggcggggggggggggccggcccccccccgccgtcagcgtgcaggccagcggct

SEQ ID NO: 18060 - DNA, 239 bp, Chlorella protothecoides
ctttgtggacaagcttgtaacgccggcgactttgtttttttaaacatacgcttacgtgctgatcttactaattgttgaatagttggcataaattcctaaaaagtaaaaattaaagaatcagggaaaaatcgattaatttcaattaataatcccgcaacaactgttagacttgctaaagcaagaactggtgcagttgataaataagttttgaagttttgcatataataatttgttttttt

SEQ ID NO: 18061 - DNA, 122 bp, Chlorella protothecoides
ttttttataatataaaatttattttttactttttttattgatcttaatatattttaaaaatagtaatttctaggtattagaatttaaaaaaggttaataaaatattttaaaaattaaaaaaa

SEQ ID NO: 18062 - DNA, 61 bp, Chlorella protothecoides
tagagcagacaggttgtatgcctgatgtatcgacaaggccctgggtatgttgggaagaaca

SEQ ID NO: 18063 - DNA, 127 bp, Chlorella protothecoides
aggtgataattcatctaaacctaaaattgcaataatatcttgtaattctttataacgttgtaatgtttgttttacgttttgtgcacatttgtaatgctcatcacccacaatccaaggttgtaacatt

SEQ ID NO: 18064 - DNA, 1033 bp, Chlorella protothecoides
ccgcgcagcccgaccctgcgcgctccccgcgcgccgacccgctgctgcgcacgaggagcagctggcggcgcggcggcggaggcgccctgggcgccacgccggagctcacgcccgcggccagcttcgacttcttccacgggcccgcaggccagcgtgagtagcaagggcccgggggatgttgttgtgggcagcgatgttcatgctttgggacgtgggcggcggcacgtacctggggccccgcgctgtggcgcgtgcatgcggggcctgggctccacgcgcgtgcctccagttccccccgccctcgacatgcaccgctctgctctccacccccctctgccctcgacgcgcaccctctgccaccccactgcagagctggcgcagcggctgcgcgggggaccgggccaggccggcgcataccccaacgccagtgcggggcaggagccgggggtgtacctgaacccgaccttcagctcggcggagctgcagctgctggtggacgtgagtcggcaaaggggggtgcgctgtggtccagcatcgcatggagcttgccatctcatttcaaccctccccctccctccctcgcaggccctcctccccaagccgtcgatggcccgctgaccactggctgtgaagccctgggcggctggaattccccctcatgtggcagcatggcctgccagtcaacatcccactcgacaccgccatccctggtgccaaaccaccccattctgcggatcagaagagagcaagtagtccgacgaacaaccagacctgacatgcacacacgttgcctgaggcatgcactcccccccagttttctgtcgctcccgtgcatcatgcccccccccccctttcttcaattttctgtggagcattctgacattctgtggtgtccggcccaatgacacgtccctggctgatcttctttccagagcaaggtggtgttgaataacaccagtggtgaggtggggcttggcgtggagccggtggcactccgcggctctaggcgccgaagccgtacagggtgcggccc

SEQ ID NO: 18065 - DNA, 106 bp, Chlorella protothecoides
ttttttttaataaaatataatgtttgtatttcttttatatgcatagtgatttcaatacaaccataacctttttttgaaatataaaaccccccgtcagcatcaatta

SEQ ID NO: 18066 - DNA, 212 bp, Chlorella protothecoides
ctgatactatactatagactatcggtttgcccaaaccagtgaaaatttaaaaagcttgattcaatcagcaggaaacgtaagtttaaaatctaacgcgagtttaaaacctaacgcgagtttataacttacggatcctcagagactatacgtaacgaatcttttaatctctatcttttatgattactaatcaatttttcgaatggcttggtggg

SEQ ID NO: 18067 - DNA, 77 bp, Chlorella protothecoides
aaactaggatctgtgtgctgcacagcgctcacacacacctgcctttctgatgggatgggtgcgccgtgttgctcatt

SEQ ID NO: 18068 - DNA, 13591 bp, Chlorella protothecoides
ccgggcggggggtgggggcggaggcggggggtggtgatggaggggcatggggccgtgcaccggccatgcggagtcatcatgggcggtgtgttcatgaggagtctcatagcctgtgacagtctgctgtccaggatgatggagtcagacacccagacgcaggatgacccgattacccccataccaacctcctctcagcggcagccacatcccgcgccagagttcgggccccagcccacctgggaaatgccggcagccgacatgcgggcctggttgtagaatatccgcccaaagtgatcccggtccgggaagacgtcggcttgccgtgggaggttggcgccgcctgcacgcagtgtgtgtgacaagggcatcgcatgggcaattgggactgacttggcacaaattcatcgtggaagcgtttcttgctcctgcggtgtactttctatcacagggatgtgacgtcaccgcgcaatcgcaaccaaacacccagcacgaatgcgcaacacacagcccggctcacccgaatccaccaggtagatgcatggcagccgacactgttccgcaatctcctgcagtcgcacatgtttctgtgggcagatgtgtgagagggaaggggcccggagtctggcggggtgttgcaggtggtgcatgattattgaccaacaagttgcattacgccagcaaggccggtagctcacgcccacagtgatgcggcttagaaccctaaccaaatcgatccgtttcgtaacacatgcccaggtctgaccttcacggtgatgggaaagtatgtgcctcccttgactgttgcgtcattggctacgatcgccaccaatcggccatgcactctgccgattccagtcacgatgccgccagcggggacgtcgtccttccctgattgtgttgacataaagttacggttgtggggctggggaaactttgacatcattgctgaccatcttatgaacggcatcgcagacacccagccacaatcctccacccctcaccatacaggcccttgcccgccagctgggagaattccaggaagggagaccctggatcgatcagcgcctgtattcgttctctgggcagcagtttccccctggagtggtgcctctgaaccgccttgggccccccaccctccacagcgtgtgccacgtccgcccgcaaccgggacagcaagccgtccatgcgccccgcacttgcagcatatgcatccgagtaggggtctagaccgcaggtgcccagcacttgggatgcatccagcgcagcggcaccggtgatgccgcgtcccagtcgggaccagtccacccgcaggcgcgcacagatcagcatgatcccagggtaccaggcaataagatcgcagtctatgtatttgaaagatttatttaagtcattccgctagtggttgtggaggccatgagggggtgagaatgcactgcgacttccggtactcgccctcccccgcggaccaatttcggactccgcgaccactgctgagtcagcaagagcctcgagcctcgagatcttcagggcggggaagggtggcaatatacatggtgtcacttcacaaggtcagcgtacagcaagctcgtagcctcggcctcttcccttattcgtcccctacatgtatcactgcagcagatgttcccgggtgacagcactgtaggcctgtgccagtgcctgtgacactgcatcgccctcaagatcatgagcctgcgacagcaggcccaaccgctccagtatgcgctcctgtggattggtccacgatgcggggggaggtggtttggccggaggctttgacccagacagatgcttcgtttggctgttgtcatggctcaacaaacgggcgacccacataatcgatgcctttccagccccagtacaggcacacgccacacccttcctccccacctttgtgccctctggcagccgtgtgtcaaactcaaactgaagaggggtatggtgggggtggggggtgggcagtgagaccactggcacatgccatgggccatagcacatccaacaggaagcacaagataggtacaggccggtggtctcacggccattcaagcaccgccctgggctccagtcccctcaccttcccccccgcgctgtcgtcgcccagcttggctgccgactcggcggcactgcccactgctccagggtgcctggcctggacagccttcatgaccaggctgcccaggtggacctccacctctccacccgtagcgtcctggaaagggaggaacccatctgccagcgtcccaaaggcaaaggcccagggccgcacgcgctctggcgccctgcgtcatgaggcagggtgttggcgagctccggcggtgcatggagggtctccaccccaggtgcgtaagcccgacacccttcagtgcaccctctcacgatgctcgtgacccccgaaggggcatgccatcactgggcatggcacgggcgcccacgcccacaagggcccccgtcacctggcaagctccacgacgctctcccagccctccagattgctgtggatgaacctgggtcttgggggccgcgccccctcctccactccacgccaccgctcctcccaggcggtcatcacgacgtcggcctagagattgggggcaaggtgggcaggtgaggaggcgggcgatgaatgcatgccgacgggcccgcggcgacaaggggtccccagccccagtcggggccttggccgcccagcctgtgccgttcaacgctcatcaacagcatcccctctcaccccccccacccaaaaaagaacctcaacaaccacgtccctggcctgcatggccatcaccagccccacccaccatgtcgcagtagctgcccgagtccagcctccatacgggaaaaaggtcaaagacgacggtcccctccgggtgcggggctgcccgcgccggcgcccgcgcccagtcgcccgggtacctggcctccagatcggccaggaactcccgcggcggccgtgcggccagagccgatgccacgaatccgggagtgccctgggtatctggcagcgcggtggccgccgccagcccgcccccgctggccagcagcaggaggtgccccagcaggcagcccacctgggccaggcaccgtgggtgggaggccgaggcctgggcatgttggggaccggcagcgtcctggccggccgccccgactgtcgtcgtcgctccatcctgctcggtcgctgcacccgtcgcctgttgaacgtcgtagccggccaggagctggtcggtgagcatgagcgtctcgtgcgccagcgtgcccaccagcggccccacccccaggcgctcggggcgcgagcccagcgcgcgcagcgtgccgtccagcgtggcggtcgccagcagggccgaggtccccgcccagccgcgcaggtgcaggccgcagtaccagttctgcagcaccaggaagcggcgggagctggagcgccggccggcaaagaggaacatgcgcgggcctggcggcacgcgcgcgttgagccgcgccacgcccagtgccaggcgtgccagcgcgctggccagcagggaccccggcgtgagcctcactcgctccattctttccagctggcgcacctgggagggcgcgcgtgtgtgcgtgttttgggggggtccccgggggatgcctcgggcgggcacatcgcccgaggcgatggtacatgccacgtcctccccgactgcacatccccccagcaggtccacgagcgggcatgggcgtgcaggccgccgtcggccttgcctgggcggcgatgagcagctcctgcaccgcctgcgtcagggtggtctccacgtgggaggccgcctccgcggggcccgctgcccaggcggtcagcgccccgtcctcggacagggcccaggtgacgggggccacgccgtcgcgctgtgcgcgctgcgccatctcctgcatggggggcggggatggtggatgtggccgggacacgggcgggggacaggggggtgctctgctgctgcctcgagtgagcctgaacaggaggaccccttgagagtccctcaccacacctgggtcagctcgaagccagcaaagtggcgccggagggtgtcgcacacggcgggggggtagggctgcacgcccagccgtcggcgcaccagctcctcaaaagcggtccacagttccaggtcctgtggcgggaaggtgggggcatcctgtggcatgcaagggactgcgagtgccctgcggctgctcagaaggtgaccagggccgctgcagccaagagtgcaacctgtggcacgaaatttgagccgggacccacacactttttcacgaatggcggcaagcgacacgtcgctgtggcggaccgtcagcttgaactcgagggtcaccccctgcatgaactccgcatacatcctgcaggggggtggcaagggctgggccacgtgagaacatgcaagagtgcgagcctgcattgacatgcagcttccactacggtcatccttcaagatccagcacatcacccccttgcctatgcatcctgggtttgtatgcatcattgcaaaggtagccctccagagcttcatctggcaggctgagcacatggcgggtgattgggtcctccaggaaagtctgcaaccggcctgttgatggtggcagggagcgctcaggagcgcgtcatgaccacatacccatgatgaggaagggcatcgccctcacctagaactccagggtcggcgccatgagtccgggcgcattgcagtgtttcaaccgcaaaaccctcccagtctgtcacgagactgggcccgagcaaggtccccatccgtgcaaagcaacggatgcagggatggagccgaggaaccaaaggggaagtggcccactcagtgctcccaagattacacgagggatccctcgacatgcgcgcgcggacatggagggcttggcaccatgctctgatccgcgcgccaagatcctcagcgaagttgtaaccctgccaatcccacacaccgatgcccttgatcatatgatctcctccctgtgattgtaagggtcagacggccttgaaattgcgcgcctaccggcactcctcttcacgggcggtacgccgacaatggaggcgacctccacccgcttcgtggaggggttcctcaagtcatggggtgttatcatggcctctgagatcggtgagccgaccggatgtgcgttgcacgggtgtttgctttgttattggtggagacctcccaacaagggcaccggcgccacctcccggtccccgacgtcaatcaatcctgcaggcgacaagacattcctcatcgcagcagtcatggccatgaagcaccctcggaaacaggtacgacgatgttcggatggcggcggggtgtcggagggggacagtgctggtgagttgagtactgccagcttccagcaccccatcctcggcggctccatcaatccaggtcttcgctggcgccatgtcggccctggcgataatgaccgtgctctctgcggccatgggatgggcagcaccaaacctggtgagacccgtgcggtctgtaggagggaggaggcctctggtgcccagatcgggatgcacagcgagtctgtgcactgagtttggaagagggtgccgccgctggcattgcccgcccctcccatgccgccttggcccccaccacctgcaccccagatctcgccggtgtacacgcactacgcggccaccgccctgttcttcgtgtttgggctgcgcctgctctgggatgtggcgcgcgggagtgtggaacccgagggcgacatcggcgaggtggagaaggagctggagatggtgagatagggggagggtgtgtcccctgcggtctgcacccggggctatcgtggccggctgcagtgcccctccacctccactgtgcagaaagcagtgctgggctgggctggctggctgcctgtccgaaccagtgctggctcacagcggggccggcccctgcctcacgccctcctccccccatacccacgccctcaggccgaaaccgcccatcctccgcaaccgcagaccctgcgcggcggccagccggcgcccactgaggcccgggccaagggcctcgccgccagcctggcctcgctccaggcggcggcgcgccgcgtcttcccggccatcctcctccaggccttcacgctcaccttcctggcggagtggggggaccgcagccagatcgccaccatcggtgcgctcaagggtgggagtttgtgtagtcctggggggtcccgggggggtggtgcaggctgagcagggcagcccggggacagccgcggccggcatgctgatgcagcatcttccggcgccctcacctttcatactcctgccggcgccggggctcgacccgcgcgctctggcgcccctctctccgacccatcagtcaccgcctggccctccccgccccccacacaggactcgccacggggtcggacgtggtgggcgtcacgttggggggcacgctgggccatgccatgtgcacgggcgcggcggtgctgggaggaaagcacctcgcggagcgggtggacgagcgcgctgtctccgcggtgggcggcgtcctcttcctcctcttcggcgcgcactccctttgggtgggggccccggatgtgtgaatggggtcatggacgcagcggcgctggggactgcgggccagacgggggctcgacctccctctcggcgctggagcgcgacagcggcgaggagaaaggcaagggcctccccatgtctctgcgcactcgaccggtactgctgcagaggcgtgcactgcgacaccccagcgctgcagctgcactgtcactgtgtcacaagcgggggctaggtgcagctgggggcatgtcaaaatatgggcaactgggagcaagtttgtgttctgttgtgcaggacagggttcacaggcacagcactatcgtgaggagagagagggaagaggaacccgccgccgcggcaatctcagccgtcactggtgaatgcttggaccagaggtcctgccaagcccattctcaggacctcgcctcgtcgccaccgccatcaggtccggtacatgcgcggcggcggctcggccgcaaaggacggcagcgagcgcatgctgtcccctgatcccagcgtggcgctggcgtgggacaggctgctcgacaggggcctcggcggcgcggagtgggtcacggggccgaagggggagggctggccgccgccgccgccgtcggagcgctgggcccaggctcggatgaggcggccctctgggctgggcggtggaccgccggcctcggccgctgcgttccagaatgcgaccctctgcaggggattgagagtgggcgtgcaggagggggcttgggagggtgctaggggggtgcacgaacatttcttcgagccctccatcgcacgcaagactccgccttgagctgggagggtctgcgcgccacgcccgcgtcagggtctatgcaccccctcccgctccatttcccctttcctccccaccttgttcagggcgtgcgcgtcgtggaggggccgcgtgaccaccgcccagcccagcagccagacctgggccacgaggcaggcaaagaaggccagccagcaggcctggttgccccaagtgaaggggttgaaggcgatgctcacgcccgcggcggtgcactctgcaggcagaagaaagggcgacaatgggcgtgatcgtgagcatcaaatagcaccgcaccggccgcagggtcttttcaagggtcccagccgttcaggaagcacgctgtggggcaagccatgttcgtccccaggagagtctggaagctgccaggtgcctctgcacagcctgggattcgtctctgcctcagcctagtacacacaccaccccaaccccccaatccccacacacctcccacgacgaggagggagagcgcccactggaaagcgcggacgcgcacggccaggtgcgggtcgtcgcgcgcctcgcgcctcgcccgccgcgcgcggagccagaggaccaggaggaaagcggtgcgccaggtcaggtgcacgatcaccgcggcggcggggaaggtgcagagcgtgcaccccgcctccccgccgcacgcctgccgcccgcccaccgcaaaggcggcgaagaagtagccaagcaggctggtgggctgcgcctccagctccacgcccccgggcagcgtcacaaaggtgctcagccaggcgatcacggcctggcacaggccgatggggatggtgagcaggagggcggtgaagatcaggctgccgctggccctccagccgcccagagacctgtggcgggggaggggcggatcggcgaggtcggtgccagcgagcatgggcgcgaagggcggcgggcgaggggccacaggaggggtggcgaagggcttgatgggtcaccgcacccatcagggcaactcggcggttgcagcctgctgcacagggctcaatcccgcagcagcaccccacgctacagagcccctgcccctcggccagcaagccacccactccacaagcaatcccccccccctttccctccgcacccccggcaactcactccctgtcctcaggcaagcgagtgaccgcggcaaaggccagcagggcggtcaggcagcagaggggctgcagcacgccgagagccacggtgagatagacacggcagttgcgccccgctcccgaccagtcggtgacgtcgtcctggaagacgatggaggagtagccccacacgctgctcaggcgcagggtctgggtggcctgtggggagcaagatcgggggaggagggaatggagtgaagggctctagcagggccgccagaaacattcgaagggatcgcgacagggcctcccccaaacacgtagggctggtacttgtagcaaggatttctcccaagtgaagccacgcaccatccacacgatgatgagcaactcaaggatgaagcgggcctgccagaagcggttggccatgcgatgctgcggcagcttcctgctgcgaggccgccatggaatgacaaaggctgccgctagcaggcatgcaagcagtgtgacagctggggagagggaggatggggagcggtggatgcctgtggcatggggagaaggtggccaggagcagtccccagaacgagatgcccaacaacaactctggaggaggagcagggtgaccctcaccgagcacgccaaggaccgcgaaatcagcagggcggagagattcgagtgtcagtgccattgctattattcaaacgtgttccgtgtttcagtcagagagcatccttgtcgagggtggttgatcgccagttacccatacaagtggttgcgacactttggcgagcctgcgccagggagtccctgcggatgtattccagcagaaaaacaacgctttatatacatgtacctttctgatccagatccatgtgtgcgaggatggccgtggcactccgtggccaggcgagcgccatctgccatcttgctttttgaaggaacgcgataccgggggggtactacagaaatttacgtcatacccttgcgagcctccgctcatgcaaggcatcattcctccgccacagtgttcccaaaaccaacgaaggagtggctgtcttgcagaatacggtgcgaggatatagaatcgtgtggataagcgtcgtgtctgttgcacgacagcgcttgatcacccgcaatttctgcacacagctgtggaaggcaccatggccgaggtcgaggaggggaagggcctccccgtggcattgcacagggcatcccccacgcatcaacctgccagtcctcccagtgatggcagtgagaggaagggtggttccatgcgaggacttcccgtggtcatgacggtgcgtggcgatcaggggtggaggacgacaaccccaatcgttggtgggggagtgcgcccccattgacacgccgcgagctcacctctccaccacagaacatcacctgctctgtgaagaacagccagaatcgcaaggagatcatcaccatcctgaacgatgtcagcggcttcatgcgccccggcgagatggtgcgtgtgtcgtcaaagggcattctggcaggagcaaagctttcgccagggaaccggcagtatttcacccagggtttcctcatacatctgcatgctcctaccgtgctcccccatgcctgtgcaggtcgctctgatgggcccctctgggtcggggaagaccacgctcatggacatcctgtctgggcgcaagaacgtggggaagatctcgggggaggtgctgatgggcggcaacaagcccagcatccccttcctgcggcggtacacgggctacgtcgagcagtttggtgcgtgggatgttgagttctgccatgcttgctccgcgatctggcggcggtgcctggacttggtgggcgtgttaggggttgcgctaagggctgccatcgaccaaggcaggaacaggcgcatgagtggggtctccaggcagcatggcatggccgatgaatggctacccctctccctgcctgggccatgtgcagcggatccacacaccttaaaggacaccaagcataaccactgccacaccccacatggaaagactccctcaaactcccaaaccccgcatttctgcccctgaagacacgctagtggactacatgacggtggaggagatgctcatctacaccgccgagatgaagcgccccgtggaggaggaagccagcttgaaggtggcggccgtggaggacaccatcactgccctgggtctggcctcctgccgaaaggtcaagatcggcaagtgagtgcgcgcgtcgatgtgtttgggccgtgggatcggttctttcgtcgtgtgggacttggaactggatgcagggaaacgaaccgggtggggcccgcccgcagcggatcggtgccctgcccacgctgcgtgacacgggagtggcaatcttcacagctacatgcgccgagcccaccgcagccacatggcccgcggcatctccggtggccaggccaagcgcgtcaacatcgggctggcgctggtcaccaacccccgcatcctgttcttggatgagcccacctcgggcctcgactcggtgaggcggtagggtggggtgcctgggtgtggcctgctgccgctgtgatggacatgcagagcagcctgtggtacctcgctggggtccattgaagactgatgggggcacgctctcaggcacgtggtcggccagaccgttcagcactggtgctcggcgcgtggggcgccagcactggccaatgagcctcgagcccatgcgcccgacgtgcaagtgcggggttcctgaaacacgaagtctgcgcatcacccctctccccctcactctcccttgcagtacacctccaacgaggtgatgacgacggtgaagacgcttgcccggcgcggcctgacggtgtgcaccaccatccactcccccaccccctactgcttccacctcttcgaccgcctgctgctcctcctgcgcggccaagtggtctactttggccccggcggtgagtggggcgcgggggattgggcgtgcatgggagcagtccacgaaggcgtcgcaggggtggatcaggggcagcactcctccgagtgccagggtgtgtgccctgggcccagggcgctgaggatgagagtgactgcatcaaatttcctccatggccgctggcttgtcaaaagaggggaagggctgaccgcccctcaaaatggtagatcctcgtgcgggcagcctgtcgactaccagcatgatcccttctttctctggcacacacactccccccaaattcctctcctatgcctgatcaggccaggaggcggtggagtactttgtgcagaacacgcccgtcatgaagggcctgatggagggcgagaacgaggcggagtggatcgtggacctcactgtccaggcagaccggcagggcaaggcgggggagtttgccggtgcctttgccgcgtcgcggcacaagaccgtgtctgacgaggcgctgcagtccctgctgcgcgacaccccctccatgctcggtgggtgggcgggtgtttggagaagcaggaggaaggctggggaggatgtagtagggaggacagaggatgggatgcagcgcctagtagctccacgccggctgtcgcatgtcgctgccaggcccttggctgaggggctgcacaaggagcatcccgatccaggctgtggtgggggccttgtaggaggtgacttggaacgcgaagcgcaccagggcaggcatgtggcgttcatgcgtgcccatcgagcgccgccgccctgccccctgcctcgcagacgaggacagcaagaaggagctggcagtgcagcgcgagaccaccacgcccttctggtgggccctcctggtcatgatcaaggttggtggccggggtcgaggggaagaaaaaggtcacacctgtgaagggaagggcaaaggtttgacttgtctggactgcaggattgctgctgcattcacacctccccagccagtgccctctgcccgcctcggcctgtacccctccccctcactggtgatgcttctctttcctcgcagcgacgggcgttgaagcagtacaagaaccccgagtttgtcatgccgcgcattgccggctccgtcctgttcaggtggggtggcgtttggcaccggtgctggttgagcgcgagggatggaatggtgtggaggttctggttggacaaagggatggactcctggctgcacccgtccgctccacctcaatcacaacgccgatccgagatccatgggtgttgcatctcagcactcacacacacacacacaccctatccgcctcctccactccacagcctggtgatcttcaccctgtactggaagaagggggataacctgtccaccggcaacctgtacaacatccaggcggtgctcttcatgtgggtcgtcctgcccgcctacaactcggcctccaccatgcccaccctggtcatggagcgccagctgttcaccaggtgctgtttgcatcgtgcgggagtttggggttgtgctggagggtgcgttggggacatggctgtcgtggggaagcaagcaggcacagctctggatatgctgctgagctgatccatcaacacagggagggaatgggcctgccttggtcccctgccctgatgcctgagcttgtggtgggctgcagcccagtgtcgcatgcacttgatggacccacggccaagcacaaacatcgcagggagcggaatgatgggctgtaccgcgtggtgaccttcctgttctacaagatggtggaggaggtggtcatcctgggcctggtgtcgctgctcacatgtgcgcgggggggggaatgcccaggctgttcatgccagggctgcctgtgcatgggtatggggttgtgccggtttgagcctaggccatgccctcaggcatgcccctggcctgaatggtggtatctgaagggggcacagttggccttacctccgtgcactccccccccccttgtgagcagcctctggcctccctgcccccaccctccatccaccatgtgtcacctgattcccctcaaaccccattcttccccccctgcagcgctgctcgtgttctacaccgtccggctcatgggtctgtgggtcgtgttctggctagccaactttgtcaccatgatcaccggaaccagtgagcaaggggggggg

SEQ ID NO: 18069 - DNA, 80 bp, Chlorella protothecoides
ggtggccgtggcggtcatgggcttggaccgcccccccgccgcgcggtcctgagagagggggggggggggggggggggggg

SEQ ID NO: 18070 - DNA, 123 bp, Chlorella protothecoides
ccttcaccgccagcattccatacttttgaagaaattccaagtataaaatcatcttcttcgaactaaaaatttagtgtgtttttataaaacaacaaaaatctttagttacatattgatgaaatt

SEQ ID NO: 18071 - DNA, 76 bp, Chlorella protothecoides
gacaattgtatatagcttttcgtttcgctatacgtccatttcactcttgtctaggcatccactaaatgtacataaa

SEQ ID NO: 18072 - DNA, 187 bp, Chlorella protothecoides
atttttgcatcgaaatgatataaccgtattatccaaattttatcatattcctattattaatgattttagtaactataatgtagtattttctcgtaataaacttagacatcaaatttttcctaaatttcggtcgttatttcatttaccctttgattacaaattttatcaatatttacaaattttatta

SEQ ID NO: 18073 - DNA, 72 bp, Chlorella protothecoides
gttcaccttctagtttacctacaacagtacctgagtgtaaatggtcacccccagataaacgaagagcttttg

SEQ ID NO: 18074 - DNA, 62 bp, Chlorella protothecoides
ggtcacccccagataaacgaagagcttttgctaaaacacggaagtgcataccatgatttttt

SEQ ID NO: 18075 - DNA, 112 bp, Chlorella protothecoides
aaaaaaaggagatttttttatgtctaatactagcacaaccggtcgtattccattatggtttattggaactgttgggggagttgttgtattggggttattaggaacatttttt

SEQ ID NO: 18076 - DNA, 400 bp, Chlorella protothecoides
aaaagggtcacggagctgcttataaaagaacatataatcgagactttgtagtactaaattctaactattttcctgaattacagcaatatgatgaattatttcaaaatgttactggcatacaaatatcattatctacaacttctttttttaaaaaagatggtacacttttatatagtgcttccaaatacctacgtaaaactgtacaaaatatacaaaaaaatcatgaaaaacaaatctcttatagataccgtaataaaaataccagaaaatataagtttggaaaagaatatcagtagttcagtctatactataacaggtccattaggttcgtcaacactcgatctgaaaaaattagatcgatttggatcagcttgtataaatatagatactataaataaac

SEQ ID NO: 18077 - DNA, 273 bp, Chlorella protothecoides
aataatttttaaaattgatctaatttaaaattttaaaaattaaactctataaaaaaatagataaatataaaaccatgttttaataataaaagctaaatttttatatttattattccataaaaaaatagtgcatacgggtttaattactatgcaccaataacttctttcgccgcatacattatttctactgtaatttcagtaatatttcgttcacgagcaaatttctccgtattacgtttaacttttccacgaacaaaacctggtattttttta

SEQ ID NO: 18078 - DNA, 91 bp, Chlorella protothecoides
cccccaatgatccaaagccccacccaggccccgcagcagaacaaagaggatatgataatattaaaaaaacaaatcgtgacgacgacggctg

SEQ ID NO: 18079 - DNA, 277 bp, Chlorella protothecoides
aaaaaaagatttgattttggggatagagagacttgaactctcacgattcaatgaatcaacggattttcagtttttagaagctggactctctctttatccttaaatcaaattaaaatttgtttgcggatagctcccgtcgagtctctgcaccttttgctataaaaataatttttaaagcaaattggctcaggattgtcttttttatttaaagatttccctgaatttgagagcattcactattaaagtttcctctaataggctcaatttatatataaat

SEQ ID NO: 18080 - DNA, 428 bp, Chlorella protothecoides
tttttttaaaggaccccaataaagtactaactggggttaatttgtgaattaatacgtcaattttactaaaaaatataagtaataattaataaaataaactaattgaaaatataacttgaaaacaaaactgctaatacaaaaattaataataatccccagtataaactggttctatttaattctacagtttgtttattaggatttggttttgccataaaataatataacctttttcaattttacctaaataatataaatattatttaacgttgaataaattgcatagccgtaatagcacctaaaaagaaaactgtaggtactgctaatgcgtgtatagcaagccaacgtacagtaaaaataggataagtataggattttcttgctgtcatatgataaaaattctaattattctttaaaattagaaattt

SEQ ID NO: 18081 - DNA, 317 bp, Chlorella protothecoides
aaaaaattataaggagttatagcatgtctggtgctacaggagaacgccctttttctgatgttttaaccagtattcgttactgggtaattcacagtattaccattccgtctttatttattgccgggtggttatttgtgagtacaggtcttgcttatgatatttttggcagtccaagaccaagtgagtattttactgaagatcgacaagaaaccccactcattacggatcgttttaacgctttagatcaagtaaaacaattatctcaagttaattaaacaaatacctttaaattagaaatttaaaaatttctaatttta

SEQ ID NO: 18082 - DNA, 73 bp, Chlorella protothecoides
ggcagtgaacctgcgggacagcactcgtgtgttagaggaatacgatatgccggccccaaaagttacacggcca

SEQ ID NO: 18083 - DNA, 39346 bp, Chlorella protothecoides
  modified_base (15924)..(15965): a, c, t, g, unknown or other
gggggggtagaggggagggaaggtgggaggggctggaggtggggagggcagctggagtgggctggagtgggatgaatggcagtcgggtggttcctgaatcatcccctcacgccaagcgctccccacccatcgcacaggcggcggccatcccgctgcccatggtcaagtcgctgctgggcccctacctggtcttcctctgctccaccgtgaatgggtatgaaggcacgggccgctctctgtccctcaagctcatccaccagctgcgacaacaggtagggcatggcaaaggggggggaggggggggttgatctgtgcagggttgtgcacagcgccaggcatggtctcttgctgggtgacaacagcttgcagaaacctgccagcacactgcccgggacgggtgccatcccatgccgcggggcgtctcacccattgccccctcttcccaccccagggcgccaaggtggagggcaaggcgccctcggccgaggacggcagcgggggccgcaccttccgcgaggtcatcctgcgcgacccaatccgctacgcctcgggcgacgaggtggagaagtggctgaacggcctgctgtgcctggacgccgccgagcacatccccaagccgccaggtgatggcgggaaggcagtgcctggtgatgggccggcaggcctggggggtgggtgtgtcgtgcacccctcaaacctgcttctctgtgccgcacccttgctcttcccaccccttgccctgcatgcctgcatcccgttccagcaccacccaggttgatgtccacttcctggtccctcccctccatcccacccctcataccctccctttccccctgcgcccctcccttccacacccccccagcccgcctgccccaccccgacgactgccagctgtactacgtggagcgcgacacgctcttctccttccacgccgcctcggagaccttcctgcagcgcatgatgtcgctctacgtggcctcccactacaagaactcgcccaacgacctgctgctcatggccgacgcccctgcccaccacctcttcgtcctgctgggccccgtggcccccgatgcgcacgccctgcccgacgtcctcgccgtggcccaggtggcgctggagggcgccatctcggcgcgcagcgcgcgcgcctcgctggccgccgggcagctgccacagggcgacctcatcccctggacggtgggccagcagttccaggacgccgacttccccgcgctgtcgggcgcgcgcgtggtgcgcatcgccacgcaccccgaggtggtgcgagcgggctacggctcgcgcgccatggacctcctgcgccagtactacgagggcggcctggccgagctggccagcgacgacgaggggggggccggcgggggtgccggcggcggggccgcctcaagcagggcggcggcgggcgaccgggccgcgcaaggtaggggttgggggccgtgggcgggggcgaggcgggtgggagccggtgcctgcgctgggtgtggaggtttgaagagctgggccccaggaaggtgggggacggatgccatgggcccggggccggaggtgcagggcgctcctggatctcgtgtttcacccacacaaccccgtgctctgtcctccctccatgcccttcaaccaccccctccatgccctcaacaacctcgccccccccacatcatcaccaaccagcagccgggtcgctgctggaggaaaagctggcgccgcgcgccagcctgcccccgctgctggtcgctttgcaggaccggcccgccgagtcgctgcactacctgggagtttcctgcggcgtgacgcaggagctgttcagcttctggcgccgcgcgggctaccgccccgtctacatccggcagacgcccagcgacgcgaccggcgagcacacggtgatcatgctgcgcacgctgcgctcgcaggacctcgcctccgacgcctggctggaccccttcgtggccgacttccggtcgcgcttcgcggccctgctccccgccgccttccgcgccttcccccccgccctggcgctgtccgtgctggacccgcgcctggcctggagcgaggccgaggtccaggccggggtccagggggggctggccctggccaagctggacgggggggagctgtcgccccacgacctcaagcgcctgcaggcctactcggccaacctggtggaccaccacctgatcctggacctggtgccgccgctggcgggggcatactttgcagggcgactccccgccacgctgtcctacacccaggccgccatcctgctcagcctgggcctgcagcgccttgacattgctcaagtagaggaggcgctgggcctgccagcctcccagaccctggcgctgttcaacaaggcgctgcgacgcctgcacgcccaccttcgcgccgcgaaggaagccgccgtggagaggtgcgtggagggtgtttttgggcgggggagctgtgtggagaactgggcggatggagtctgtggggtagacagggcgtgctggaaggcacggcgttgtgggtcggtagggggttgctttggctgggggtcttccccctcgctgtttttgggccttctgcattcaaccctgcctgggggaccctgccgctcggaggaatcgacctttccaaaagacccccacatcaatacgccgcatcgtccacccactcattccctccaaacccatttcgagcaggacgctgccggcgcccaagccgctggccctgctgccgcacgcccaggacctggatgctgagctggacgaggcggcggctgccgtgcgcgccagcagtgcgcccaccttccggcccgaggacgtggaggagtacgccatccgctttggggatgcggacttggaggaggccgtgggcgccggcgtgcgaccagggctggtgagcgtgaaggtcgacggcgagaaggtgggtgaagggagccttgggtggaaagggcagcgtagatcaaggtggtgccaggtgctcgtccctacctaggtgcatggcaaggcgcctgacaagaccccccctccccccccatgcacaaacaaaaccagacacccaagaagaagcgggagggaggcaagacaccctccagccggtccggcatcaagtcgggggggaagcggaatgggacccctggcggacccaagtcgcacaagaagcaaaagacgccagcctgatgggccaggtgcaccttcccttgcccacgtgtacgagaactaggctgcctgccagaccactgcatcagcttacagtttggagtcctggtgcttctgcctgccagcactggcctccgtcgtgtgtgtgccatgagtgtgcagtgaggccgcagcagacggcaccagcaggggcaggtgtgattcaggtcagcaattgggccaagagcccacaccggagaataaccccactcaggcagccacagttctacgcctccagctccgccatgaactgggcgtcggtgcgccggtggccgcagatgttgcactgtgcgacggacgcgctgtccgggctcagcgggcacagcgtgccgccacactcctcctgcgggcacacgaacttgagcaggtacatctggacgtacgcctcgtccgccccgccgcaccgctccggatccggctcctgccccgcctccagcgcgccttcaacctgttgggcggggggcagtgctgcgtgaggttatgttagaccatgtgcagggcggcatgtcggggcgagtgggcgcacgccctgtcggccagacaggggaaccgcatgccgccgcccaccttgcagcgcgggcatgcacaggagaagccgtacacctccctgcagcgggattgccgctcgtcgtactcccaccacaggggaaagtagctctgcgtcagctcctcgcctgaggggggatggagggctgtggactcggacgctctcccacctattgcccaataggcgccacttgccaaggaccccccacctcccaaaccacctgacccaccagctgggatggcatgcagggcccggaacgtgatgcccgtgtttgaccccgggtcgccatctgcccgggcctcgtcaaaggcatcctggcgggcgaggttgggcaggcactcgtggttgaggcgggagccagttgcgcagagcgcagaccccctgatgggcccgtccgcgaccccgggttccagcgcgatgccgtaggcgttggaaccgtcgcgctccagcaccgctctgacctcctccagggtcaagcccgcgccgtccccgggcagcctggcccgcagggcggcggcggcgtcctctggctgggggcagcccggcgagagggaggtcagggcctgcagccgggcggtggaccccgtgtccccggcggctgcggcggccttcaaggtcgcgacgcgcaggaggagcagcagcgccgacgcctcctcctcgcccagaccctcgaaccgggtctccgcttccgctgcagcgacggcggggttgtggctgccgggatctcgagccgccgcttgggcgcaggccgaggagcagaagctggcccaggaactggaggatgcccctgtggttgtgaacagatggatgtgtccatctgcacgtcatggggcaggtgaaccccaccacatccagtcatgcaaggaggtgcgcaccgtcggaaggcaaccgcctcaggcagtggaggcagacctcgtatctcagggagaattgtgggtacaggacgagggggtagtcggttagtactgcctccccagcagcaatgtcgcgggtcgccaccagcccgaggccacggcctgggacaggcttctcctcatagcactgcatatcccatatacaacaagactgattcctttgatccgcctccgtcccagcatcaatccagatgaaggtgtggactggatggcaaggcggagcaggtccacgcccgcgccctggaggaggcacgtgatgtttccggaagtgggttgtctggggaagactctggaaacctggtgtgggacaaaacttgagagcgcagcagacccgatacatacatataaaaacttactaatcgcagaatcacagcaactgcatttgaggagctgcatcgacgatgtctgacatcctgaacgatcacgacatggacggtgagtatagtactgtgggatggccttgatgctagtgcggatgcggacctaccgatgagcaatcggtgtgatgttatgatgcgggtgatctgccatgcggtgtgcaggcgacctggcgttggaggacgagtttgctgaggccgtggacgaagtcggaaaggagattgatgtctcggtgggtgctttccgctgagttgggggggtgtacttgtggcttatgcctgtccattatgggcatcagccagcatcgcccatgtacctcggtatccgcagaaggacggcggtgtgcgcaagatcatcaagaaggttggggccggctacgaggtcccagagaagggcgacaaagtcacaggtctgtttggcttagggtgacgaggaagattacttccagaaggttcccaccttttgcagcgatgattcttgtgttactaaatggtctgaagtaagtctctggctcttgtgtatggtaaagggctcatctctggcacactgataagcgacatcttcatctgataaccctttgcagtgcactacactgggactctggaagacggcacaaagtttgactcttctcgggacagggacgaccccttcaccttcacccttggccaaggtgcgggggtgctgggtgaagattctgttcgagcccctttcggactgtcgaagtcgcgacaactagccacttgcaggctgccagttgctccatgcacttcacacttggcgagccggtacattttgcaggccaggtcatcaagggatgggatctgtccgtggcaaccatgaagaaaggggaggtaagcatgcaacgtctcagagagtgtgtggtcctgatgggcctgatagggtttctcatgaattcaggaagggcaacaatccagcacctgctgcctgttgcccaaagccgacgcccccatccttccccctccgtacaaacagtcggccaccgtgatcatccgcggggattatggctacggagcagccggcagcccccccaagatcccggcgaatgctaccctccactttgatatcgagctgctgagctggcggagtgacaaggacctcaccggtgcgttgggtggcagggaagcctgtatcgtgatagagccaggctgcacaggcttcctttcaatgggtgaagatggatcaacatatgataggaggtgacatgcataggttttatcattccagaagggcagtaatctgtttttcagcaatcctcgctgctcaacccctcccctacaccaatcatccacctcctgcaggtgacggcggggtgatcaagaccatcctggccgagggcaagggctgggccaaccccgggaaggatgacgtcatcacgctggagctcaaggccacgtctctggagggcaccgacacggtgtacacctcccccgagggcggctaccaagtgaccctggcgtccgggggcgcggacgctcccttcttctgccgcgccctggaagtggcactgcccaagatgaagaagggggagcgagccacactggtggtgaagccgcagtacggcccggtgcagggccctggggcgggcgaggcgctggagatcgaggtcaccctggtggactggcagaaggtggagcggctgccggggggcgtggtgaagcggaccctggtgtccaccgacgagtggcagacgcccaacgaaggtggggcgctgcggtgggcgttgcagggaggttgacgggtgtgtctcgtgcaagatggtaggggttgggccggtgaaggagtggtgcttgagtgggtgaagcaaagggcgatacacgacagccgcagcctcgcaagctccgccactgatttcctacatccctctgcaccaggcgcgactgtgaccctggcctacacggcgcgcctggccgtcgatggcacggtttttgacgagcggaccactgagagcccgcttgtcgtcgagacggacgcaggtgagggcatgtggctcttttgtccttggtgtggtgatgtgtaggaccaggggccacatcagcgcatagcactacgccgctgtggatcataaccgtcaagctcatgggcactgatcaccccctccgctcatctgacagatgccctgccagaggggctggaggccgcggtcatgaagatgaagaagggcgagaagtgcgttgtgatggtgccggcggcgctggcgtatggatcagaggtgagctcctcctgctggaggttgcagagaggtcggctggggccgcatctctgcaatgcagtacccttggtatgaccaggagtatgctggcgggcagtgcaaatgactttcacaaccattgcctcaccccaacagggctccgaccagccgatggcgagggtccccgccgacgtcgatgtggagtatgaagtcacgctggtggaccagaagcaggtgggctgaaactgtattcgagcattattgcagggtcagaaagtgtggtctgggtgactggcaattgccaccatcatgtcattggtggcacagattgtgtgagtgcgcgcatggggttgcagcgggtcaaacagcccccctcattgccaacccctgccgtcagatacttgctgcacaacccctactgggatgcctgcatggtccttcctctgtttctccgggctccagatacccttgccaaatcttctctccactggtaaaaccccttccacacaggccaagggctcctgggagatgtccacgcccgagaagatcgcggcggccatcgcccgcaaggagaaggggaatgcgtacttcaaggccgggagggtgggacgtgcggtgcgccaatggaaccaggccgaggagatcatcaagtgagggggaggaggaggcgagggatgggtcaggttggtatggggccctggtactttggatgaagatgattttttcctcagtgacatgggacaggccaatcatgaattcttgtcagctcagcacacccgcagcaatgacaattgggtccctcccaaacctacactgttaccccagccttcacctttcccctcctatccaaccctgctcaggtatgacgacgccttcagcgccgaggagaaggaggagtcgcgcgccgtgaagaagtcggtgcagctgaatctggccgccgcgcacttgaaggaggggtcctggacggaggcgcgcaaggccgccacctcggtcctggaccacgacagcttcaacctgaaggccctgttccgcagggcgcaggcctacctcggcacctttgactttgtggaggcggagcaggacatcaagaagggcctgggagtggtgagcggtcggatcttgagatggaaagggggggtgtgatgcatttggcatccttgcgggcgcctaggatgcctgctctcagccattcacggttgaccacatcatagctgctggttgactgctcagcagactactgacacgactgtgcctcatcaacacattcaatctgctagcctcgtccaaaccaccccgcccgctgcctcacaggacccaaacaacgcagacttcaatgcgctgcaccgcaagtggaaggtggctcaggcggctgccggcaaagcggaggccaagctctacagcaagatgttcgccccgcggccctcagccgcccgcccgcaggccgcagaggcagcgccggctgctgaggtggcgccagctccagagcccattgccgctgtctgagcgatttaggcgagctgctcgtgctgccacccttttgggggaaccgctgctgcagtggacagcaagcaacaaggaattcactcgatatagataatagcatgaccgccgcactcatggacgccagaggcgtgcatgcactcggtcgtatgtgatcgttcattttctatcgtgagttgcgaaacagaattacaaactttgatgacacacatgggtagacaggccagcaggggcaatttgtccaagtgaagcagggactgctgcaggagggctggcgagggcaaccagagtcctgtgagaggcaagaccccattcctccctcctcgagcgcaaggcggccaggctgcgcatcagggtgcgtgcctgcgtgggcgtggccagggcctcaggcctggaagatcctggggtccatgagcttgacatggcggaccacaggctcaaagtccatgtgtgcaaggacatcacgcgctatgtccacgccaggcgcgacctccaccagctccaggcgaccctcgcccactgcaggagggtgggaggaggaggagagggaggaggagctcgatgggcataggaagggcaggaggctcatggctgtttgctgttgggcaatgtgaaggcattctcgtgcttggtttccagttgaactcccttcgcgttaccccccccaatatcggcataagcctgagacatacacacctaggggcctaaagacggcacgctcggtgacatacagcacgggtcgtccctgggagagcgccgccgcaaacgtcttttccacgacagccttgatgaatttcctggtcctgccctcctgcaggatcaccagcttgccgccctggatgctcacctggcaaggggttgggtttggttggaggggttgcagtacatagggtgtttatttccaaaccggatcatgcagcagggatacagttgcataccccgcctgctcctcaggtactcgttccacccactcccaacagagaacccgcacccaccttgagcccgccggaggtgaaggtccccacaaacacgcacttcttgctggactgggagatgtcaatgaagccgccgcagcccggcgcccgcgtcccaaagttatgcacgttgacgttccccgccccatccacctctgccatgcccagcacacacacgtccacgccaccccccgagtagaagtcgatcatggaggcggtggggaccagggcctcgcagttgtaccccgacccgaaacgcaggccccccgccgggatcccgccaaacacgcccgcctcggtggtcagcgtggccgtggcaccggcagggttgtcgcgcccatggctggccttcagcacggccacgccctgcggtgggggtggaggtgcagcatggaggtgcgaggaggaggaaggagagaatggaagggggggagggggcggagggagcccagattcagaggggggtccagacctctttgagatgggctgaggggaccgctcctaaagggagagtcgtgcctacgttcacagatagtgcaccaacgccccgcatccaacacacatgcatcacaccgctgaatgtgccctccacccctcacctcgggaatgccgacgcctagattgaccaggcagtgcagggtgtctatttccaggaaggctcggtgcgcgatgatcttgcgctcgttcatgggcaggcgggcaatggcatgcaggggcgcccgaacctcgccgctgttgcaatggggaatgaaggagcagggccgtggccagctcggcaagggccgcaggaacaaacacggtgttcacagccagcgcaggcgcctgatctcattcgtccctgatggcaggtcctccgccccagaaaaagtccaactgagactcataaacttgccccgcccacctgagcgctccgtcgtaggcccctggcgcgtaggactgggggtggtcggcagcctctgccaccacgatctgcgtgcagcaaggcgcttgtctgtgaggtttcgaaccgggaatggtgccagcactgggcctgaaactccatcctgtcgcacaagcgcaaccctccgccggctctcctggcaggagccccatccaggtcaacccctcccccactctttctcccaaccccaccccccgggccctcaccaggtccaccagtgaggcatgcaggtggactgcgcgggagggaaggctgtgccggtccaccacccgctcgacctgcacgatcaccaggccgccgctgttgcgcgccgccatggcctggtgcagctggtccaggtacagcacctcgcgctcgaaggacacgttgcccgccaggtcggcggtggtgccacgcagcagggcgacgtcgatgcgccgcggcggctgggcggagcgacgtgggttttatttgtcacgggccaaggcacgggagatgcactgcgtgttgacaggtgggaggcgcaggggccccaggcgacccagcgcctgccctcatggggactgctgccccatggccagtaagacaaaacgtaccaacaacacttcacaccccttgacccttcaatacccgccttgtagtggaggtactcttcgccgttcagggtcatcagggacaccacgtcctctgtcgtccggctgttgcgcttgccaccctgggcgagcaccaggagaatcgagggtgaaagagcgttgcagttggaaatcggcacatcatcagtataggaccttcccctacacaagcagtcttctcctgaagaagagtggcaaaaggcccaaaatcacataagaaggtgctcccccatcagaacaccctacacacacaccttctcccgaggatccacaaaggtgccgaggcctgtcttggtgatggggccgatcctcttggcagctatgtcgcgcatcatgtgactcactggcagacacggaggagggatggaatttggggcatggagggccgccagggcatggtgattgtctccaaagatggacataatgtcatgcagcatggggcagtctgtgtggccacagccatttcactgcgacccctgtgtccctcgtcttttcatgtgcccccagtagcccggactcacacactcccaggggcaggttgtgtgcccggatcttgttctccaggaccatccttccaagcttgggacaagagccgatccagccatacgtgacggcctccaccaagccttcagtggccaggacatccagcccggcgcccttgctgtttcccactgatgcgaggaagatgatgctgaggttgcgaggggtgcttgtggagtcgtagcgttggcgcagtgccttgaagagactgtctggaggaccgctgcccacaaagccagcaacctgcaattgaggcggcggggtgggaagagatctcagtcgtaaaacatgttgctctcatgctcagacatatttgggcccttcctcttactcatgagtagtgtaatgtacagattaacacccgatctctcgttttggagcgctccctttcacactgtgccggaatgtctctccggctgtcggaacaagccaaccgcgcttctcgacaaccccaagatcgcccgtaagtggatccccatcgagctcgcgacaacactccctctgacattcgacaccacatagaaatagtactcacagtaacaatgctgccgtccttgatgcgcgctaccgcctcgtcggcggtgacaaccttgttgggggcctcatgcagctcgtccgcccgacacccctgccgctgcaggggtgtggagcaatcggatctggggctcccctccaaggcatcggacaggtgcctgatgcgcctcattgtcctgtcatctgccatgcttggcaggctggaggtgtattctatcggagttcgctatgcagaaagacaataccagtggacgaagatcggcgcattcacagcatgccgcttgctcgtaatcgcttgaagggcagcaggttgtattgcaatgcccacagatctccaaaccttgcgtcggcggccatgcagatcatcggaatggagggtaggtcccctggggcgcaaaaaaccgtagtcacctccccgcgtccccgtcagcagttcggcctgagtggaagagcttctctagaaactgatcacaccccaatacctcacattatgttgacgtaaacccttcttgctggtactagttccatactctgacacttctgattctggtcctcagcagccatacattgcaaggttgagaggcagaggctgggtgcacgtgcaaacacattctccccatccagctgccgcatttcgcatggatccctcaccccatcagacatcatccaggtcatccagggtggctgctgcggcgtggagctgggccttgctgagcttgatggggcgtctgggtggcagaggcccacatccccccgcctgggccgcagtggaactggccgcctccagcctagcttcggcggcaaatatctcctgcaccgccgcccggatttcctccggcgccggtcgctgcgcctccccgaacgtttcacccagcttgctctggatctcctgcaggtttgttgtgacaagtgggctgggatgtgttggcggtgtccctgctcgagggttctgtaggcggcacccagaaaactgagtatttgcatcagcacatgaaaacccagactcctgcccagggtgcaagaccacaggctcccctgacagcgaccaagtcaccgccacatgcaatgacccctcctcgtgccgcctggcacacaccgcaacacaccgcaacacaccgcaccttgagccgggcctgcttctcgcgctcctccttctccttcctctcggcctgcagcttggacacctgccagatgtcctccaggttctccaccaccggcacgtccgggtgtgcctgggtgcagggtggggcaggggggtgggaggggcgctgagtgcaggttgccctggtcgttgccaggagagcttgggtgcgcttgtcttccacacaccctgtacaagccttgagccggcccccatcaccatagtgggctgcagaggggatggcctccctcccatccactcccaaagtctgcaccccaatccttacccccacccacccacccaaccacacccacaccttgatgtactcgtcctctggcgtgcgctgcaccgcggcctccccatcgctgtcccagcccgcggcgtcgccgtccaggaggtatgctgcccgagcgatctcctcccaccgggtcgtcaggtcctggaccggccgcgccgcgctttccagaccctggccagcgcagtcctgggcctgcgcccctgggccggctcgggactcctccacctcagcatcttccccggccaccacgcagcgtacggagaacggcgcgccgggcaggggcacccccccgctggccaggtgcaggcggtacaggcctggagaggtcaggcagtactcgcagtcgtaccgccccgccgcctcgtcccacgccacgcgaaccgccggtggggccgggccgggtccggtgagctccgtctccagcggcacgcccgtcgcgggggcaccggctccgcaccggttgccgtgcgcgtcgtggagcaggacgctgaagcgcgccgggcggcctgtgaccgcgcgcccccggccctcgccggtcgcggcgctgcggcgcgggcagggcggccccgaatcgacgcgcagcgggtagggcgaggcggccacgtgctcctggccggcggtgacgtgcagttcgtacaccccagccacggtggcgacgtaggccactgcgtaggagccgtcgcccaggtcccgcacgctgcccgtcacgacggcgtggggggagtagagtgccgccgagaagtcgtcgccgccctccagccgtcggttgccgtcctcgtcacgggcctgcatggagggggaggggtggacggtactcgatcccggaggctgccgtcggggttggtgcatggacatgcgggcatgcacctccacggtcaacccctcttcctgccctctgggggggagcacgaacgcaacaacccacgggaatcgcgccatggcgccggcgtcaaccccactggccctcattgaaccctcctgcaactcctgccccgcaccgcacctggatgacaaaggacgcctcgaccccggctgtggcgtgtgtgaccccggcccccgccacacggcaccgggagggggcggcagcggattggacccaggcgtccgcctcccactcccccttgaacctggtgccatccgcgaacttgcacacgccccggccatgcctggcatcccgcagccactcccctggcattggggtgggggggcaggggtgaaaatgagatcgtcggtcagatctcaaactatgacatcctggaaaacaaaagttcagcctcactcaagaccaccgacccctcctccactcaccctggaacttgtcgccgttggcatagatgcagacgcccttgccggagcgctggccgtcctcccagtcgccctcgtacttggacccgtctgcatacacgcaccgccccttgccatgctgcttgcccgccttgaacatgcctgtcaggtgtgggaggggaaggggccacatatgcactctggaacagtcgagactgccaggcctttatggcaacaccctgctatccttgcaggcgcttcccagtggaataatgaccgacaactgctaggtcacaagtataccaccccagggcaccccacggccccgtagtgaagcccaacgacatgcctgacatagtgccagacacaaatatccctcgacactccactcctccggctcaccgatgtacttatccccagcctcgttggtgcacatgccagctccatcctgcctatcctccacccagtgcccgttgtacttgtaggcgccatggctgtagctgcccttcccatgccggagcccggcgcgccattcgccgtcgtactttccaccatcggcatagaggcacttgccctcgccgcactgctcccccgcctcccactcgcccatgtacttgaaggcgccgtgctgcagaggtgcaggaggaaagggagtgcttacttgacgcgatgcagcaagactgcaatacatggaagatcttgagaggttgagcctcaacagtaaggtcatgtgcttgtcagaaggccttcagggtccaaaattaggcatcattcctacacagtctctcattccaacgcccagcatatatgttgcccttgccacgcgcatcccccccccccccccccccccccagggnnnnnnnnnnnnnnnnnnnnnnnnnnnnnnnnnnnnnnnnnntccaagggctcactttgtacagtacgcctgatccatgctgcagctcgttcttccagcccccagcatactcccatgagccgtcgcgagccgccagcttccccttcactcgctcccccgcctgccactcgccctcgaaggtgctgccatcctcaaacaccatcactccccgccctgtgtgtggggttgggagatgggtggtggtgttgctggttctttggcctcctagaatcttgcaggtccaggggcgcaggccggagcagacgaccaccatagagcaccccaccctgatgcaaaagcaggctgccagcgtccccagccccaccatgcatcttgtcggccgcccactccccctcgtagcgagcgcctcctttgaagatgtgggcgccccagccctcgcgcaggtcctccctccactcgccctcgtacacagccccatccacgtaggtgcaggtgccactcctgtgcagggtgcagagcattggtcacgtaccaaggatgcatcacagtactcaggaaggttgtgtgtgccggtgcaaaggccacatgcatggcgaggagaccagggagatcttggactccaagacacaccactctgacaatgcgcatgcaccatccaacccccccaatcctacccttgcgctttgtcgtccacccagtcgccctcgtaggtgatgccagaggccaggacgagcctgccacgcccgtcccgcttgtcgtaccgccagtggccgacatatctatccccggagctgcaggtgtggtcgcccttcccgtgccgcagggggcccaacatctcgccctagggtgtgaagttttgtggcagtgtgcacattgcgatgaggccggggttggatgcacatggccaccccacaagagctacccagtggtgccaggccttacccagcagagcactacaccgtgtcaccttgtaggtatctccattcacataggacacagaggtttctcgcacttcaaagtcctggggactctggaatccagcagcaatagtttccctgtgtggtaacaaagaaggggagtaaatatcggcgctccaagaacgagtaacgcagaagcaccagggagttccctccaggtggatattgggtctgggtggtgcatatatacatgcatgcgtcactccagcatctgagggtgcatgcttcccacatgccagcaaacactgctgagatccggtcaaacccggctgcatttgacttacgacatgtcagggttgggttcaggggtcaccgccacacccatttcgctcatgtagacctgcaggcgcagcttctcgacctccttggccagatccaggggggccgacgagtcgtcggtgatgtccttgaaggacaccatgtcggcctcgcccggggttgatggcagtcaaagcagcaccccctggtaagaagcgcaggatggagactctttggatgcagtgcaggtcttgaatcaaaatactcgtcgtgctgccgagcggaaggggcgatctgtgcgtccccacgcgtggagagctggtgcaagcttggtgtcgtgcaagtcgtggcgcgctctttccgattgagatcttgtcgcctctggtgagggcagtccaggaccaatcaagtggggtaatagtgtcatacaccaacaaagacaattgtacagaagaagatcgagtaccaagcctgtctgcaagattaccgattgcctgaaccgccatgctggtgcggctgcggctaacaacgtccccacccaccctctcaatacgccacactccaggcccgctgcagcggcggcagtgcagcgtgcagctccgtccccagcgcctgccagtccggcttgccgtcagggccatgcaggaggtccgcctgctcgacgtcaacctcgtcgcggctcatggtctgcgtgctgggcgcgcccgccgggtagctgatccagcccagtggcgcggcgctggtcgccgaggtggcggtggagccggcatcgtcggtgacgccctgcttagccctcagcgccgtctccttggccacctccaccacggtggacagcactagcgggttgcgtttgaccctggacttgaagaacttgggcgggtgcgccgtcatcttgttcacaagctcctcccgttccctgatcgcctcgttggcgcctggtggttgtgtggggggggggagaggggactgggatgatcttcaggctcagcctgccgcggacgagggtgcaggcagatattctgccctaacccctcgatcccgccctcaattgcgatgaggcgcaatgctccccaccccagccctcaccctctgcgcctgcaaaggaattagggaggacgtccaggatgtgcatgccgggtccgtccacgcctcgcaccgccagctctcgcagttccctggagaaagggagtggcgggattttaggcactgaactgtcgtgggaaaggggctcgcccagcacagggcaggcagacccgcaggcagcatatggactaggccatgcacaagctggagctggacaaacgcctcccacagcactttgacaccacgccacccctcccaacgcactggtggctggcgcagtagaaacacagaaagtgcactgcgtatgggttgggggagggtgttcataggtgcggcatgccacgagctcgtgggttccttctcttgcgctcctggcagctgctgtgtgtgtggcggcatgcaagatgtctccaccaacacattcccttttgtctcacctaggaagtcgtcgatgcccggaggcaggccaaaggtcgaaggcaacttgtatcgtctgcagtgcagtggagttggcatcaggctgtgcagtccagggtctgcaaactgaacatagtgctccgcatgagcgacagggatgagcagcagggatgagctctcggaaagctccgcgccgtcaacagcaaggaatgggcctaggctgttggctgacccacttgcacccctacttctgttccaacaagcacacatcgcaccgtcgcattttctctcgcgcgtggcagctgtagaacgccccaaagttgaacagcacgttcccacagaaggagaagatctggccaatgccgcagctgaacacgcacgacatgaggcagtacatcctgtggtcggtgaggagggatttgcgggatgctcagggagcagggatgcctcagtctcgggcgctcagtccggtccgggagcagcccacaggcctgcatcatcagaaacacacacacagatgtttttgaagattatcccccgcaccagcccccagaaacggaatacacacaccagcagagggctttgatgtcggacttgtagctcttgtgcccgatgttctggtaggggaagacgtactcacggcccaggttggcggcatacaccgcccgcgcccaccgcgtctggcgcaggcctgtccagtagcactcctcgcaggtcctgtggcatgggtcgggcaaggactctcgcagggccagggcatgggcttgcaggcgcggcgctggggtgtgggcgcgcagtcgagctgcacatggcccccgactcttggggatctctgaggtctgacagaaccgtgtggctgaagccatgcatgcagggcttgggtgctggcatggagagttgcggggcctcaaatactgcacccccctaacctcaccttcccatgcacgccccccgccaggccagcggattccacttgaaggagtcccagcaaggtatgtggacggaagacttggctgttttattcttccagaacctgaaaaggggccgcccgggagctggtgaggacacagggcagggaaccgccagggcacccacgccaaaccctcattcctccatcccggctaggctaaggtacaggatcgtacccaggatccccacgcaccacatctcgagcaggccgttggtccatcgcccctcgtttacaacttcgctgtacagctcgtagatttcagacaggggtagaggccgatggtcgcggaaatcgctgtgtcgcgtgggagcctgcgccattatggtgtccgtccgagaccagctcgtgcagacgctgccgcacgcccatcgctcgatggctttggtaactgccgccatgctgcgatgagagtggtccgcgcagcctcagttgagcgctctcgcgggatgccgaaggtatggtaatgagtgtgctgatttgaaggccctgcgcgcaccaacgagacaggcagatcgccctgcctctgaggccggagaaatgcactcactcaactctgcgtgctgaccaggatgagcctgcgacacctccgcgagtttggcccaccgatggcgaatgcgattctgtacgcgagggacagatcattctaccattttggcgggaattgttcattttgggcccctgctcgacacccaccgacatgggtatcgccagcggcacgctgtcctggacagagtcgcatcctgacgaatgcttcgcaaacccaagagctcgaacgtgtgcattctgtatgcaggtcatgctgatccggcgattgccaccctgaagtgatcgagaggggacgtccctcattcgcgcggccatgccgccgcgcgtgacgcgccccgaggccaatgcagaggttttcaaggcccccctaccccgtcagaaccggaaagtgctgcctacattgacccttgatcggtgaggggtgtggtgggggagggccttctggggtgaaggggcccagccagtgcatgcagtgccatgaagggtgatttccacggcatgcaccacccttcacgaatcttccgacatcttccactccttcatgcgatcgtcccccgctcccacgcctcccaggttcgaccagcaggtcctgggcggccagctgtggctgccggcctgctccagcctggcgccgccccccacatccatcccgctggagttcgatggcgtggaggagtacgtgtctgtcatggagccgctggtgctggcggaagcgcgggagtcgctgcgcggtgagtgggccgaggcctgcgcgtccggcgcagcgctgtccgtcaccgtggcgggcttggagcacctggagggcggctgggcccggctcagactggcgccccacggccccgtcgccgccgacaagctgcgctacgccgccacgcccgggcgcgtggcggtgctgagctccgaggagccgccacgcagcggcgccctggcctgggcggcccgcggtccccccgacccgccggcgccggagtcggggtccgcaggtggattggggccccgttccggcggggatgcagggcaccgcgacgacggctcgcctggggcccaggaggatgccaggtcctccgagtcctgcggcagctgcgacgcgccgccagggaagcgcgcgcgccgcagcccctccgcgcccccagccggggtgcacatggtggcggggacggtcagccagggccgcggcggcagcgaggtggaggtcagggtccacgccgcgtgcgagagccacgcccgcggcgccgcgccggggccgtgctcggccgcgctgcgcgcgctggaggcgggcgggccgcgccgcgtctggtggctgctgacgggccgcccgctggtcagccagcgccgggagtttgacgcggtgcaccgcgccgtctccatgagctcggccctcctgccctacgtcctcaggccgtccctgctgcaagtgcccgccagggcctacgccgaccaggcatggagtggcggctctgggtgggaggagtatccctggttcgattgcatgatttgcatgcctgcctgcctgcatgtccgcatgcacatgctttggggcggctgccctgtgcccgcttggacacagcctgggctcaaccaggccagaaatgggggaacctccaggccccagtccttgttggccgttgcccttggcggctgaaacctccatgtcacgtccccgagagcgcaggagctgaggcagcggctgtggccgcctgcagcccgcacgccggccttcatccggcacctccagcagcagtatgactacagccagctggtggcgatcgaggtgtgaaggggttgggcgggaggagcaagggagcattttggagttgtgtctgcacagaaaggctgcatgaatagatcttggaatccctggccagggatgggcaggaatcggatgattccttagtatggaccatgccttgattcagcttgccaggtcagagggccatgtgggaccaagcatgccattctcaggaccaagaataaccccagtgcacccctaccgcaacagatggcggcctgtcacctgggaggcggcggtccggatgctcacgggacggtggcggcgcctcccctgcccttcaccctcatccagggcccgcctgggacggggaagacgcacaccgtcaaggtgaagctgggggaggatcttggggtgattcgatgagagacctttgcatgcaagggtgtgatgccccccagggaagaccttgtagtgggtgcctgggcggtcattccctcgtgcagccagccgcatgccgtctggtgcagtgcatctgtgtgccccacctgccccttgtaaccaatgccactctgtgctcacccatgctcccaccggtgccggctccagggggtgctcaatgtgtggcaccttgtggcctaccaggcctactttgacggcctcatcgctgcggcgctgcccggcatcgcacccacagccccgcgccccgcgccggccagctgcctgaacaatgccggcagcaaccttgtagaggtgtgcggagcagtggagttgagcttgagcgtggggttgatcgatggatgggaactggggcaatgtgcggcgtgccatcgagacgatcacatcgtgttgcggcaccaagtctgagattgcgaggacctctggcgacgaggcggtgaagccgcctgattgtctctcataccagactccatgcgttccctccctctcgttcttctatcagtcccacccacccagcccaccccctttcacaccggccaggccctgagcaccgacctcctgtcggggctgggcgcggctgtggtgaagacgcggccgcgcatcctggtttgcacgccctccaacgccgcatgcgacgagctgctggcccgcgtcatggcccagggcttttgcgacggcagcggtgagggaggaagggtcatgtgctctgtaggagcagggagcatgtggcagcgcagggagcgatcaacagcttggtggttttcgaggggagctgaggtgcaagcaggctcttgaaagccttgcgtccccaaatccaccacccctgcttgtcaccacatgcgccctcaacatcttcgaccgctctccatgacaaaccacacacccctcaccccgtgcaggcgggcgctactcgcccaacgtcgtgcgtgtgggcgctgatgtggacggcgtcatctcgccggcggtgcgcggccgctccatcggccgcctggtggaccagcaccggaccatgatccagagcgactggcagcgccgcttcgccgacgcctcacgccgacgccagcacgccggccgcgagatcgagctgctggaggccgccctgacgcgctgcgccgacgaggcggagcggatggagctggccaaggcacgcaccagagggggggcgggggggcggggtcagggggcatcaggggatgttttagtgtgtggaagaagaatgtacgggagatgggctggcgggctgggtcgggccaagggtagggtggtggtgggacggtagccagggcgcattgacgctgcctcggcctgggcagagagcgttgctcgcgtgcaacgcgcatggcggcaagatctgagcgtgggcttcggcacatgcgcaccttgtaccgcatgcggacctacctctcccccaatgaccttctgacgcatcgttctgttccttcaacgtccatcccccacccagcctacactcgcccacccgtcctcgcagcggctgatcgacaggtaccaggtccggctccgcttctcccaggatctggagagactggaagctgcacgcaccctggtctggggcgcgcgggaggagtggcgtgtgcgagaggtgggtggagagggctgggctggtgggatgctggtgcaggagcgcatggagcccgggcctgaagtgaggaggcggggagggcaaagagggcgaggggcgcttggcgacacccccaaccaaatcaggacagccgcgcatggacctctgtcatgcaggccgagcaggcgatcgagaccagcctgctgctggaggcagagatggtgttcaccaccctctcctccacccagcgcaagatcttccagctggctgccgcccaagtgccgtttaggacgggtgagtttgaggagggtgtaaagtgggcatggtccttgtcaagactgcagagcctgctgcaggtgacacaccacgcccccacctgcatggcctgtatgacaaacttcaacacccgttgccatcccacacagtgctcattgacgaggcggggcaggcctcggagatcgcggccctgcagccgctgggatttggcgccgagaggtgcgaggggcctgggcgagtgcacttggtgggctgggagtgggtgggatgtctgatccatgatcaggatttccatgccctgcaatgtgtgctgaagtgtcgccagcagtcaccatctgtgcctggctgttcgtattcctggtagcccggtctttaatcactcctgctttccacctgcctcgcagggtggtgctggtgggcgacccgcagcagctccccgccaccatcctgtcagagctgggtcgcgagatggagatggagcggtccctgtttgagcgcctgcagcgctgcggcgcccctgtcagcatgctgagtgtgcagtaccgcatgcaccccgccatccgccaggtactgtttggggggaggggctggcatgggacaatctgcgagagaaaacccacagctgtttggacctgattgagcaccggttaatcttgagccagagttctttacctgctatccatatatgaactcccccccgccctcttcactccccccacactgccaaaatgcaatgcacatgcgcagttcccatcggcctacttttacaataacaagctggaagatgcagcgtctgtgcttgagagacccgacgagccgtactatgcgcacccactcatgaagccctacgtggtatttgatgtggctcggggtcaagaacagcgcgcccgggcagccaccggatccgtcagcaacctggtgaggttgaatcaggaaggcccctgggccgctttcacggcagcgtacgtatggtctggaaagcatgacgctcaagcatacatttgcagtcactctgtttctgcctcatgacatctgaaccctggccccactgaagcaaacttcactcctgtgtctcccagatcgaggccgagctggctgcggccctgttccacgagctccgtgctttcctcatcaccacggccaaggagaaccccggcgagatcaggggaccgacgagtgtgggtgtcatcaccccttaccgagaacagcgggccctcctgcgcaaggtcttccaagatgtggtgggcaaggttgcagccgcagaggtgagggcggtacatgcagggtggcagtttcgttgaatttcctggctgtgcaaaatcagacctttgtgacttgggttgcctctacgactctgaccaatgacagagggtcctagtctgcaccaaggcagccagcaacctgcaccttcctccagccccaccaccccaccgcctgcaggtgatgatagagacagtcgactccttccagggcaagcagctagacgttgtcatcttctcctgcgtgcgcgccggcagcggcggaggcctcggtgcgtgatgagttgtgttgggtggcggcgtccaaagcacagtggatctccatacgtcctgacagcatacagatggggtttgttatatggatatcaacctagcatctctaccctctcatgatgaaatgagtgttctgcgttgcccacgtcgccaggtttcatcacggacgtgcggcgcctcaatgtcgccatcacgcgggccaagcgggcaatgtggatcttgggagccgtggggaagctgcgagctgatgccgcctggggcgccctcatccggtatggtgatgcagacctactttcagggaatttggaagacgtggtggaagcacgagtgtaaaaggctgcagcatgtctgcgttcgagcttgcagctccatttgcatcgggcgaggtgaagcagtgaccttgtgcacggagctgattgatttttattgttagtgtataatccccctttccatcccaaccaagggacgccgaggcgagaggggtcgtcatccaggacgcggatgccaactccctttttcccgacatggagtactggcagcgcaaggcggcgggcacccccgcgccacaggaccaggcaccgacggcccaccccgcggggccttgcctgccgcgccagtttcccgccatccccagccgacgatagcagtcctgggaagcatgccactgtcgctgcacattgtcggagcatgccatttgggataacttccagctgggccgccaggaaggctccctgcaatcgcattctcttttttgccgccaagactgctcttcccgggaggaccaaggcttccccctgtccaaaaggctggcatgccctggcaacacgttttgccacatttattccaataatctcacaacttgttatgaggctcagtcagtgggatcgtaagtcacgagtcaaggtccaggattccaggagcagcacgtcctgctgccccttcatctcgcatcagcatcacagctccccatccagatacctgcggccctgcaccctaggtggagtccaggatggctcgcacctgggtcaacctgccctgggcgtcgacgtttctggggtcgagcgcgagggcctgccgcaggtacggcagcgcgtcctgggccagagcgcgcgcctgcgcccggtccagggtcagcagggcgtcggccgcgtcggtcagcgccgcgccggcatgctgcagcacgacggcggtctgtgggaggaaatgcagattgcatgagatagcttgatgagtggctctttgtatagagtcctacctgcccaccccagcatcctgaagtagcagctcaatgggggccggaaaagcggcccaaaccctcgcccaggacctcaggagtctcaacgaaccactcacaaacctggccctcggcgtccagcgcggcgtcaaacttgtcggcggcattctgaaacagggctgctgcctcctccaggctcccccccgcctccctcgccagctccccccgcaggcagatgcagcgcccccaattgagaaatgcgcgcgcgtcgccggggtctgcctgcagtacctcgcggtatcgtcgccccgccagcaccagcatgtccccggcctcggcggccaggcgggcggcggcctccgccagcacggcgccgcggtccgcctcgccgggggcgcccccggccgctcgtgtgcgcgacacactgcgccatatctgcatcttcagcctgccgtgggcctgcagcacgttgcctgtgatttgatggggatcgaggcaatggagaatacgtgcaggtggctggagacaccctgtgggcgataaaggctcacagatgtgagaatatattcacggacaaactacaaagaggtcacagcattcagttcctgaaacacgacccctccctcccacacgaatggcctcacccaggttccctgtggccctgaggtcgcctggcgcgtcctgcagcacctcctggaaggcagctgcagcctcccagaacgctgagtcagcgagtcccaggtcggcacctggaggggtcccagcgcgccaggccgggtcagtactagattcgcaagccaagcccaggcatgaccaaatcaccccgcaatctcctcacaagcacaacaacaaccggccagcaacatcccaccgctgacctggcgtggaggccaggatgcggccggccttgaggcgctgcaggccgaggtcgtaggtagccttgatcaggctggggctcttcccagtggaagcggccattgggccatcagtctccaggggttcaagacgggaggcttctggatcgcgatccggcgcccgagcagcggccaccccaccgccgctcctcttgccgctgctggtctgcgtggcatcgtgagctgtctcgtcctgctgcgcttctgcgaagagcgaatggtggtcgcttggcacgggaggcccatccccgctgttggcagtgacgggtatggtgaaaaccccgtcctccactgcggcatctgtgggagcgccgctgtccctgagagatgctgctgctccggaccagccgccgacatctgcccgccactggtcattagaatctgcctgccatcgctcgacggcgtctgcctgcagccgattctcaggatctacctgccaccgagccccagattctgtcatcctgttcgtagtctgagctccctctcgcgctccatcagccgcccaggaatcgctgccctcaacccctgcttgcgttgcgccacccgcctggtcaatcatcgctgggtccctggaggaggttccagcctcctcactcccgctgctgccgcccgaaagaatggcagcctcatcatcatcctcccggcgggctgcaaccgcaccctcgagctgcagccacgatggcagcgccgcggcctgtccaccccgagcctgcgccattccctcctctgcctcctcccgcgtcgcacccggttcctcggccgtgtccgcccgcaccaggcgctgcatgcgcgcgtacgcctcctcccgggtcgctggttctctgccgttgcgtgcggcctcccatcccagctccacaccctccgagccgtccctgacggctaccggctcgccgggcgccgcctcacgctccggcacagccacgcgctgtgccgggacgtccaggaccagggcgtcctcactccgcgacgggagggcctcagtggtcggggaggcctcgcccgtggcccccgccttgcttgggctgcgctccgccgccagcatggcccgcaggtcggcacgcagcaaagaaagcgctgccaggacaggttccggcgagccccgcgccgttccctccgctccccctcgcgccgttccctccgctcccccttgcgccgcctgcccggcctccaccgccgcctgcagcgcgtccagccggcctaccaggccgcccagcgcgtcggcggcgggcgccagcgcgtcctccagagcacgcaggcgccgccccagcgccgcccactgctccgggtccaggggccgtggcgaggctggctcaccctcctgccgcacctgccgcagggcttcccgcacctccgcgcccagcgcgtccagcaggcccgcggtgtcggcgccaggagcagccgaggcgccgcgcacgccagtcgccgcctggctcgccagtagcgccttgagctggtcggcctccttccacagcttgtcggtgaagaaccactgtgggcgagatcatgtcaggggtgcacaggctcatgaatacgagccacatagcgtgttggacattcagtgacgcgggccattgaccaacccatgccacccccaggatcacacacagagcatcggccacttacctgcatctcctgctgcttggcggccaggagcccggcgatctcggaagaaagctgctcctggccggacgactgggtctcctgcagccgcgcctccagggagcgcagggcggattgcagccccgccacgtcctccgctgcggccgaggagccggcgccccgcagtcggcccacctcccccgccagcccttccagctggcgggacagacgcgcgcccagcttccctgtggccgctgtcacatcctggtggaggatctgcgtgctgctccctacacagactccgaggtgatggggtgggcacttacatgcacactcctcctgcattttgagctgtgccctctggggcggagtgggacatacgcattctgcagcagctgcaacctccctgcgcgtgtccgcaatgagagcatgcacatcccgctgcaacatcatatgtgcctggccctcaatctgtagtacgcaccacaacccccctcaccggtgctcaggacggaggcttcgatggtgctcaatttggcctccaccagtttgagggccgcctgcaccccagacccgctaccccgcatctcggcggcgagcgcggcgttgtcctgcgccgtcctctccgcctgctcccgcaggacggagaccagcgccgccgccgtgctggcctgtgtggcttggattgccagcctctcccgctgccgactggcgtaaagggccaggatggggagcaggaccggcgcagctgtcagcatcatctcccccgtgatgatgaaggccagggcggaccccacggtgcccagccatgctgtgacgtccagggtggtccagaaggtctgccagccggggttggggccggtgtccgaccctgcatcaggagggagggccctcgcacacctcagcccggtcctgtgcatgggcccgggccgcagtccgccccgaagccccgccaggcacagggaaggtcgtgtgtatcggggaatccgggtaacatgtgctgcagtgccagcccatgaggtatgcctgggagcgagtggccgcgtgtgcgtcagggcaagggacatgctggggggtgaggggtcccggccctagggagcctgctcgtcaagcatggcgcttgcccaatgttcagtgcatgatttctctttcactcggcgtgtgcgatagggacatctccctggcgtcaggacgtggacgcgactcgcgctctggcatgtgagatcggccccggatttggcacctgtctccctggaattcaacgcaggtgctctcctctcacagggatgcccgtcagtacagaaggctcggggtgatagattttccagaacacagccagctgtcaccttctgaccgatgtagtacaggtgacaagcccacgggtccccacggtgtaacaacagaggcggccggggcaccatgccccgcttatgcctgctgccggggcttgagtccaggaaggaggggcggcagcacatccttcttctccccgccacccctgccggctccgctaccatccacgaccagcacgacgtccatgccctgcggtgcagcgccaggtggcaatcagcaatgcttgggttgacaccgggtatgtagttgccacagcatagtgaccgtgcaaacacatggtttcacgagggtgctgcccctcatgccctgctgcgccctgcacctcactggagaccatgtggtgagcattgtccagacccacctcctcagtcggctcaagcagggccacaacccccggcccgaagaaggactggaacttctcctggcgctcctcccaggccgaccgctccatctggggctttgcggcaaactccaggaccagcgtgtaggcattctccgggccccggacctcctcccgcacccccttcagcttgggggtcaggcgccgggccagcccccgcggctgcccgatcttgaagatcctgaccagcgcctcgtcgagatgctgctcgtccccatacctgaacctcgtcacatcctcccgaacctaggtgggagaagggggcgaggggacatgaggcccagatttggggacgaatgcaggtcattccggcgagggccagaggggccagaggggcgagtatctggcacattctctcctgtgcgatctgacgagatgggtatcagatgttctgaacccaggatgcaagcatgtcccctcctccccaaatccctgtgctgaagcccaagactctacagcctttacacccctctgcaccccaaaagcactcagcacggactccacacctgtttctggatgtctgtggcttgtgattccctggcagccaccgcgctgggcacgctgcggcagggcacggggggcagctgcgcgtaggagagcgcgaagccgagaagggtcaggggaaagccataaatgagcagcaggctggagacgtcgccgccgggcaggagggagaagtaggcgcagaagccgtacaccatgagacccaggcccagggggctcaggatggtaccgaatgagacctgcacacagcgggagggacattgtatgggggcaggtgaagtatgcccagtttctgtgccgtgcagactggccagcatgagtgtggcatgctggcaggattgggcaggaattgaacaattcatgcatgaacaagatgcagacttgcaagtgagaggcacagatccatccagtggccatcccagcagcaatctgcctcccccatcccaagtctcacccgctcgatacggaagtcagagtccaggacatactcctcacttgctgtagctggcttggcataggtctgctcagatgtcgagtttgcttgcacaagcgggtgggggctcctggcaagtgttcatggcggggtcagccccgcttaggatgcatggctggctccatgacaacggatgccacgacatccagcactgcccaggatcctgacggacggcattgaccccgaaggtacccgtacccatggcatgtatgtataaaacacctttttgtcagcctgcatggcgtgaaggggtgggcatggcgagcacggagggcggggggtccccatgtccgtatcgctgccggtgtgcatctggggctggcacagccttgtccagccgttgcgaggggggtggccactaatccaagcattttcgaagaggtgtgcgcaggtctacgctcttgcgggtcctatgcacggatgtttcgatctagcatcctcatcgagccctgcttcgcgccccgaaggggatcgctggaccgtgcagggtcacacattcttgcatctccttgccagggagcagggcaggaggattacgtggctgagcccctggcaggagccagtgcacatcccaatggagacttgttgggatgattttcaatcgatgtcgctcaaatgcggcgctccagcctccacattccggccgacaggggtctgaaggcggtcacttgccgcggcgccccactgggcgaaggcccggcggcatggggaagatggcccatgcctccctgccgggcagtggcctggtgactggcccaaggctctgcctgcgggttggtgtgggggtggaagggtgtggcggcagagttgggggcaggaaaggtgccggtgcagggaacaccctcttcccgtccccttctctccacacctggcgctggtaagcatgctccggctccccctcctcatccgaataagccctggacaggtgcggaggagactccccgtcccagtcgtccgcctggccccagtccgaatctcggccggcccaatcgtgcgcctgatacagaggctctgccctggtcgcgaggtgcccttgcaggccggcccctgggtgcccgtggcgaggtgctgcaccgccgccgtaccgctgcgccgtaccgccgtcgtaccgctccgccgtaccgccgcggtaccgctgcgccatacccccaccatatcgatccgccgtaccgccgccgtaccgctgcggctcgcgccgcgccgcgccgtggttgtccctgggcgcggcgaccggcacgctggagcggaggggcttggacggggacgcacggccgccgccggcggccgccgcctcgcgccgtgcggccatgatctcccactccagcccggggacgcgagcggcctcgcccctcgccgcctccagctctccctccagctccagcacctccccgcgcagctcgcgcacctggcagggtgaatggaaaggaaggagtatgagtgtgccgcaccggcgaggcatggaggtgcggcggccgcggacgactgcatcgacatgccgccctgcagctcgcacacgtgccttggcctccaggtctcggcagtactgggccacccgcgccgcctcgtcctcggcgaccctggacggggccgggggtgggtgcgggatggggtccaggcggccgaggcaatacacgcgtggcaggcgggcaggacgaaggaggagcacacagcccgtcccacggacccctgccagccggcatcccccggcatccaccctgcgcatcacacggccaccccaaacggccaccccacctggctcgggcctcggcttggaggagctgttcgcgcggcacattgtccgcgccgggccccctcccgagaccaggctgctggctgtgtcgaaacggcggggagcggctggggtccatgggggtctgggctgacggctgcaccgccctcattcccgccccagccgcggcggcagggcctgggaggccggctgcgggcagggtttgtccggcggaaggggacctggtggcggccgctggtacctggtcgacgaccgcgtggggatgtgcgccggctgcggccgcggcggtggccgcggccctctcgcgtcgtcgcagggtctcgtcgctcaggcgcaggtcccgcggtgcctccgcggccccaggccatcgtggcgacacgccgccgccggcggctggcgacgatgccggcccctgcctctgcaccggggacaagaggggcctggcctgcggggcagccgtgctcggggtcaggctggtgccgcgcgcgtcgctgaacgcctccccgccggtcagcagggacgcaccgtgctgggaggaggtggcggtgtgcagcggcgactcggccgccgcggcgtcgggcgtggcacccgccccggggcccgtcagcgggcccaggcggcgggcgaagccagccagcagcgcggcgccattggctgtctcctcctgccgcacggggctgtccagggcctcggccagggattcgtccatggccagcgagaagcggcgggagtggcgctgggacggtgcggcaggggtctcggcaccctcctctgctccggtagcttcggcgatgcctgcaggtgggtcccagtgggggttaggaaggtgaggagggtgcaaggtggcccagccaaccacccagtcagtccaacagccctcgccgaccagtcaccacagcaaagcagccccacctggcatgcccggggcctggccagggtccacggcatcggctgtgtggcccgcggaggccagcttgtcggcgtgggcctgcgtcacaggagggggagcatggggattcaggggcagtgcttctgccccagcacgcgtcaggacccaaggcacaccttcctctccgtgaccctcagccacctcacccccctccctgccttggcccaggccttggcgtccgcctgcatgcgtgccacgtcgcccccggcctccacattattggcagcggaaacagaccccggcacggccaccgccccggcgggcaggtgggccttggccgctgcggccgcctcgccccgcgtcgggctggaccgggtgacggccgagaacagcgaggccaggcgcgaggtcgcggccgccgccaggcccctggccgacgacggctgcggcgagcgggcgcccagcgggacgggctcggggctggaggggccggagctgactctgggcgctggctcctgcgcccccggggatggctgggtggcatcgagcccgccggtcgccggcgcgtgccacgggctgccgggcgtcgcgcccggcgggaggcgggccaggttccggccggctgaagtcacgggcgcgaggctcgaccaggggttgtccggcaggccgcctgcgggctgggcgggtgcgggctggggctcgggggcgtgccacagggggttggccagcgtccttgggaagccgcgggggctggcgtcctccggccggcggcccggcacgccctccgcgccgccggggctggcctgcagctgccccgcggcctctcgaacgccaccggggctggccccggcagtcaaaccaccctcccgtcccggagactggccccacgcgagcggcaggcggccgcgcggcgccgcagacggcctgcccttcacggtgtctgcggtcttgtgcgagacgtgggcccgacgcgcctcgtccgcgtctcgctgggcgtggggcgacgcgaagggcgaggagggcagcgtgccgtccgcggcgagcggcgccgcccacaggctttgggccccctcgccgccgggtccccagggagcggggttgggcgccaccgtggcggccgacttcaggggggactccatcgcgccaggctgtgggcggcctccctccgcctgctgcaggcaggtcatgtccagggcattgggcaggaagccgtggcgggcaaacaggttgcggggcccctggctgccgggcgaggcgaccactgccggggcggccgggcggccacaggcgccctggcgtgcggctgcgtcggatttcggggcagacgctggggatatggcctggggaaaagacttggctccgggcctggcagtggccgcctggctctcgtccttgtgaatggggcaggtggactgccccatgttcaaggccgccgcccctcccagccctcccacgcccggggcgttggcgccccctccggcccccggcgcggccaccgcgccaaacagggcgtggagcgagccgacggcgatgcgctgcggcgtcgctcccgccggtcccgcgccctgcgccgccaggacccgggcgccccaggtgctcgactgcgctgcccctgccggcgtcccgctcgcggcggcgccccccaaggtgggtcgtgggctcagtgctgtagagggcggggcggcggcagcgtggtctgcatgctccccagcatcctcacacccatcaggtccagcggagggcccggcaatctcaccacctagcccggcgccctgctgcgcctgcgtcgcggcggcggcccgggcggccagcccgcccatcagcccggccagcaggcctccgggcgcggcccccgatcccatcgccgcagacccacatcgctgcaggcccgacggcgtgtgccgcgcctcggccggcctggcgccccgcagcgccgaagtcgcggcgtcctcgccctcgctgccagaggacctgcgctgcggcgccagcgggctgcccaggctggcggcggaggcgaaggccgtcagcgcggaggccatgcggcttggggccgcgctctcgtattggtctgtggacccgccggcgtcggaggaggaggaggcctttgtctcctcctccccatccccggcatcctccccggcgccagaggcgccgatgctgccagcgggggaggtggcgccggaatgcagcgcggcaaaggcgttctgcagggccagagaggcgggggccgccacgtgctcgcgcgccgacttgatggagaactcgccctcggtgggcggctcggccggcgcgtgccgccgcagcttgttgcccgcccgcgccgtcgccagctcggcgtcgacgagggacatgacatcctgacgggggctgttcggcgccggttcatcttggccgatggacgggaagcgcaggggcaggccaaatccttttgcttctggcctgggcctccagggggcctgcgatgggtttcagtgagtgcaaaccttggtgtatggtagcgtgcagtgccttgcccagcgtctcgctccggcctcccaaggatgaggtgaaacgcgccaagcttattataaagttctgcatacctggctggcagacggtgagcccgcctcgtcgccagactcagcgggtgctgctccgacacgctgcggcaacaccccgggcaacttggtgcggttgacatgcaggtgaggttttcgttcagccatgtgcacatcggccattactgtgcgtatatcacgccctacctcttccgcttgagccgtgtcgtcggctgagtctaacgccagcttccggaggaggggctgggcggggtcaggggaggtcgttcgggagccagcctcagcgaaaagtgctgcttttcgtgccgacttccggccctgcttgggccgcatgatgaatgacctccgccttgcgagagaacctgggcgacgacttgcccagtgactcttccttcctgaactcccgacaagtctggttatcccgagaacagacacagcaccaagggacttttcctctgagatgttttccgcaattatctgggaatcgagttcttgttgtgtactttttcatgtttgtggtgcgtccgcttcgttctccgagcaacgggacggcatgctctccagcagtggtgtccagctgctgccgaacgagttcatatttcccgccacattcgggaacttggggcatggcaaatgatcttccccacttccttgcttcgtccccagcaccgatcacatgacattacaccgcacagtacgcccgtccctgccctgcaactcgccgtccctgtgcgtcagacccagcgccgccagcagcagggactgcgcctgctccccggcctccggattgggcacgccctctgcatccgcagcgttgtccgccgcagccgccaggcgcaggcccagctgttttgttgcactgtgcagatcccgctggtgtgccgcctgggttgggtggaggtgtggagctggcaggttgtaaaacgggggtggggcagcctcccaggactgatgtgttggccatagtctgcattcattatgacgcaatactttgaacagcgatgcagggagaaatgtggccatctcatcaggcaggccacgaggcgcaacagaggcacggggtgcacctgccatatcagggctagggttcgccttcctcatgccgattcctgggtgacaatagtatgcgaggttcaaccctggcaccctggtacccccattacttgacaccctcccatatcctattccccataacaccacaaacgtgcctcgggcgaccacagccgcacggtggagtcctggctcccggtggccagctgggggtagcccggtcgggccgtgccagactccatgctgctgtcctccccctggagcagcacattggtgagccggccgctggcgtactcccagacaaatgcggcgcccaggctggaggggcagatcagggtgtcgccgcccagctggcacagcgcggacaggctcatgtgctgcatgccggagccctcgggcaggccgctgccgccaagcaggtcgtaggagcgcgagtacatgcggcgcgggctgacctcctggtcggaggcatcgcccatgtgatctttatttttgggagggggggggaagaaggaggcttgcggtcttgaaggcattgggaaatcgggcacaggttgaaaagagcaagtctctcgctccaggcccaaaattgcaatgcctcctcagtctgcagcctcttgtgtgagtgctcagcgcctaaattgagcaggccatgcttacccccggccaaacccacgatgactcacggctgccaaacacgatggcccccagccggctgctgtcctcccggggtcctggcgatgcagtgggctgctgtcgagccgccaacgtcctcggcacggccgggaggccccggccttccggcggcgtgcgcgccgccgcgccgccgggccccagcgccgcgccgggcccg

SEQ ID NO: 18084 - DNA, 61 bp, Chlorella protothecoides
tacgggtactcgaggatctcaccgcggatgtgcggtgcgggagcgcagacttctgtgcgac

SEQ ID NO: 18085 - DNA, 65 bp, Chlorella protothecoides
gcggtgcgggagcgcagacttctgtgcgactctgcccggtgaacattcgccttcccaggccgact

SEQ ID NO: 18086 - DNA, 62 bp, Chlorella protothecoides
gattgcagtttgttggcaatcaactcatcagtcccaggcagcgccccctaccgaccccatcg

SEQ ID NO: 18087 - DNA, 61 bp, Chlorella protothecoides
cccaggcagcgccccctaccgaccccatcgccgacattgctctgatcagccgaccgtcgca

SEQ ID NO: 18088 - DNA, 61 bp, Chlorella protothecoides
tcattactagcaggatgaaaatgtgtcgggtgcgtgtgtcgccccttgtgagttgtgccct

SEQ ID NO: 18089 - DNA, 20786 bp, Chlorella protothecoides
gggggggggaaagggggggggaaggatgcaagcattctctatattttttacaacctgggcataagtcacagtacatgcaaacgtaagagggctgcggattgcatgataaaactcccttcccttatggctgacggctctactgacatcgccctgttctatatgcaggttcctattttgtttgcatgggcccttgtccggcttaaaaagtgatacaggcgcacaacagccagcaggttgggaaaatcttgatcattatgtatacctttattacaaaggggtagctcgtattcgagggctgaagccaatgtattggtgtagttgtagattagtcattgtattccaaacccatcgtggcttgaaactgacagtcgcatctgtctatttcaggctcatcacactcaagtgtacagtactcttagacttccgtgctcgcagggtctggacagggcgtcaggcaaactagatcattgcggctttagtcttacaaaatcgatgtcaggttcaaggtggctttgtcttccgagttagctgcggcagtcatgcgtgcgactgatattggaaccactgtgtcagtaatgatgccaaggtttgtgggagcagcttggcgtccctcaccaacaaatagtagggaaaggggaaggatttcagatacttttcctcttcaagcttgccgccattgaatgagaaagactacgcaggggggttaggatagattgggcattaaacctcggtaaaagggtgcgggcgcactaaaatccgatcttcctcggtaggcattgcagcttacctttctatccagaagagacatattggggttgtccaggatgatgaagacgaatagaacgccggacttcatagtggtttcccttacgagagctggcaatccttgggactcattgatgttcccatcggcaaggatgatgaccagttgctttaaagtggatctcaatgctccctgctggcgcagacttgccgttttgagcataggatctagggtctcgagcaaggattgcactggagtgtcggagatctggttgtcgaggtcgaatgtgagctgagggagggaaggaccagagatttctgtgggttggcagtcaagaaggaagaccgggagctatcggcccgaacgccaagagatatggttgaaaagcaggtgctcggcatttacctgttcaacgactcgagcaccatcagcgtccgagaacggcttctccaatgggtgcaggacttcagcaccgtggttgccaccaaacttgatgatgccgagctcgccgacctgagatacagaacatagatgttggagcgttggaatacatcctgcaacaatcaaggcaggcccctgtcacagaactccctggcttacctccaatcgcgacagcgatctactgatgagattcaaagatcgcaatgcatcgttcgagcaacccatttcagacatggatttggagttgtccacagccaagaccacctgatactttcgtgtatcaggtatgctacggcgcatccaaatcttgtcctttcgaaattgggaagctatgtaagaaatcacctgcggcgcgtttcgcagagaattctgtaaactttaccatcttctcagcgagcatctaatgcagaaccaatcaccggatgtctgatactcacccgcttcatgttgatccttttccctgatctgtaatcaccagccagtttctttgctgttgatggctccagaatcaatctgagtctctctgttagatctcccacaaggccagcgttggcaaagtcgaaggacttccagatgtgctgattacgacctgtgggattgtgagattgcgctcaaaatctcatgagtggcaccctggtaactatgatcaagaatgccacaatagacacgtaccttcctcccttggtttatgtgtatctggcgatgattttctctgagcggcgtcctgcgatagcatggcaaccccttagcgcttccattgaaaggggaaggtcaagcaatatttatctgcaccacgactgtcacatccaagagcgggatatacctcgttataggcgacttcacgcctgactcgctcctcctgcatcatgttccccatcgccgttatcatctctccttcatctctctccgtcacagatgccgttgtcggagcagcatcttcgtaggagtccgcctcctcgactctcagaggagaggtgggagctggggcagatgtcggtgcctccgccattgtttgggcatcgtccgtcattcccaagcgccgctctccattcttttctgttccttcatcaggggcagcctgctcttgcgcgtccggaagctcttggtcgatttgtccgtccgcggctgctcccagtgtctgttcgtcgcctgcagccacctcttcctcctgattgagatatcggtaatcagcttggcccgctgcttcttcaacagcggctggctggtcgcccttgtcagcctcttcgtcgtccaccatcgacagattcttcaaccaatcttgaagagcgtcacctgtcaataatggcataaataataaaactggcatgccactatttctgcgtcacatgagcactatccataaatggtagtatggctgtccatcaaaccctgaaataactatctctgcttcataatgcaggcttacccaagtttctgtaaggattcttctgctgatttctcctcccatccgctgtctgcccttgaggcgcagcgccagcatttgtatcttcgccctcagcatttagagctgaagccgtaggaggctccttcccttcctgagccgcatccgcttgtccgaccgctgcctctgtctgatcagaggcttcctccgggggagcttgagatgccccgcttccctttgacgcttgctgatcgaatttgacgttctgctcgggcttctgaggtgcaggtatctgatcgatttgggtgggattatcgacgtcatcgtcattttcagaggtctggccatcgtctctgaggaaaatatagggattgtggggatctttgtaagttccgacccgaggcaattgatagaacgcgagcctcggcgagtttgtttcatggttgactgaaagtgactcacattctcttctcggctccctctcgttcatcatcatcaccgtctggctctccctcctcatcactgctagcggcatcgccagcggcgtctgatgcctgagaggccgaggtttcatcctcgcttccctgtcacaaacaggaggcgatctgttttagaagtctattaagtacgagccttctcccgacaggatttgcagactgctcacctcagacatggcatccatgtcatggtcgagttcaaagggtgctgcctcctcctcggcatgggtatggttatcatcatccaccctgcatatgcaaacagagggattgtggtatgcgagttaatattctgtatcagggtgcaacggggcacatgaccacctcttattccaggaaaacacctgagctactcacattcctgaatcctctactccttcgtcttccatttcacttggggcgtcctccccttcgttcccgccaccatcttcctccttttctctggcgtcgtcagccccattgtcgtcgccactttgattgccttcctccagtccagccacagtatccgtattgcctctggcatcctcaggactggatccagcatccttctcgttcacctgaaaaagacgaaaaggattgtgtcaagcgggaaagaatatcctgcattggacacccctgatacctcgccttgatgcgatacataccgtatcattttgctcctggttctcggctgccctctcgtcgacatcttctccagcgtcgcccgtgtcacccatttgtctgtccagttcgtctccctcgttttcatcttcgctgcctgaagagtggggaggtgaaatatccaattcttgctccatgagcacttcagtgttttaacccctgcccggctatatgattgttgcaatcattaactcacctgacacttcgtcctctaatggcgcaatatcctccatctgaccggagaaatcgtccgccatctcaatgcctacgcatatgtgaattcagatttagatcaatgtgtgcaacactgggtttgacagccaatgttttgattatcaagaggctcacccttcgcgtcgttgtccattgtgtcctcattgtcgccgtcgtcctgcttgtccttgtcagtccctagaagctggtcttcgttgtcaatctcatcgctgacatccttggctccctttgttgatccgtcacccatgcccgtgccttcttgtgcagggccattctcgtcgccagcttcacctgagcagatgcatgaatttgtctcccgattaggtataacgtagatgcgttccaacacagaacaagaaactctcgccaccttcctcaccgtcatcatcatctggtcggcagaatccctcggagatgaggccacagaataaggatgtgatgaagtaggctagcctcgaggtagctgcacccacagaggaaatgctctccatgactgatttcagaatgcccagggttctctcaagggcgtccatctcgctcccttgaaggtctgggtggcctgcagaaaatctaagcacctcgcgaaggctgatggaaaccttctccacagtagtcttgagtatgcccagccaatccaggtagacgtccagtctctccaagctcgtcggttcagcttcggggatgtctgcttcttggagggagagcagctcgccttggagctgtgcaagatactccgcgaacactggcaggtcagagctgtgctgcctgaggctggctgctgcctcctctccatcgggtgctgcagtgctctcggtagcctggaatgcttgcagaacgtcggcagtgaagccatctgcatgagtcttgcaaatctcctccacttcacgctccatgcttctcagactctgctgcatgctctccattaggtccgaggctcgactgtgcacaagtccggtcttgaacaagggaggcaaagccgtttcgctgagtgctgcttgtagtgcggccacccggtggcccatctccaggagggtgcgcatcactctttgctgtccacttagctctgcagatggctggtgtggcaagctgatgctgagacctcggcaggcttcatcaagtactgtcttgatcgtgaggagacgaactgacatactcctatgttgcgacgtcagagactcagttgacccgctcaagccgccatcaggcgctggtcgctttgtgaagacagccgccctgatcaaggtactcgctcgggtgcaagcattcaaactctcacgagtctgttgcagcatatacacaatgtgatgggtcatgtgttgcgcggccagagcatggtgcggctccagatccgcatgtggcgacttctccatagcctgcgcaagccaatatacgcttcatggtctattggagagctttacggccgggtaatgctctgtttttgccacacagagaacaggccaaccttcaggaccatcctcacctcgtcgaccttcttcatacgcagaatgctcttgtaataatactcattgatggtctcaactaggttggagattttggtgccgtcctcaccagcgacctccgggaaagcctgtgaaagaggtataatagagttacagttatatcacattatggatccttatgaagggttttccctaataaaactcccatacgaactcagcaaacgacaaaagcccattctttggcagatacctgggtgaaactgcagaagacccctctgttctgtgccgggactgcaatctcggacttgctgatgccaatttccgagatggcatcaaacagatccttgagggccaggcgctttctggagatgtggccccgcgctgtgtccgccctgagttgcgcagtcctctccgccagggtggagatgaaattctcaaagtgagccaccagtgctgctgaacgcttggccatcgcttgctgcatgcctgcagcagcagtgcatggcattgtgctgccatcctcgatcctcttccctccctcttccagcttccctggctttccaggccaccgagcttgcatgtcgtcgaagccgctcctctccagggtcaaggttaggatggggcccgctggagccttcagtatgtcattcactcggcgtgtcaaccgatgcagctgacgctgatgcttctccacaatgacacgagaatcgtcataacctctgaactcccacttttggagtgcaacgtactcctacaaatgtgcacagcagggttcgtgagacggaaagtagcagttatgttgtatgtcagggcctgatgccgtatgcgccatggcacaatgttggcagaggaggtgtaccgcctgatcgacggctggttccctgttgcacatatcccacctcaccttgagttgcttctcttgaggtttcagctcctccgagatcttagcggcaatcaattcagcgaattgagagtagtagccgtgtacgttgagcaggattgtccggtacatgcctgctcggcttgtctgggctggggctcctccagaggcactctgatcgagcacattgagatggcccatgaagctgtgcagcagggccagccggtcagcaaactcccctatcggtgaagtctgcgatgttgaatgaaggagcaaggtcaggatccgatggtgagcagatcaataggcggcgtgagcctaagccgggcacctcaatatcaggtcagggtccgacccacctcaaagagagtctgcaattcaactatgacagtgtcaaactcagcctgaagctcccctttggcggtcctgatgagcagctcgtaaaggctaaaccatgcctgtgacaatgtggggttggaagaggccgtgatcaatacccgtgcacaggatattgccacccatgacagctgcccagcaggcaggcaccttttagactccggacttccacgccggtgggtgcatagccggatgcgcctcaccttcctagccttgttgctgaagtcaagccgaaccctcgatattagcgaccgccaaccttgcaactcaaacttgcgccagcgcgcagccaaagcagccaggggggcaagctccttcgccaagctgacgtgcttcgctgctgtcaactcccactgctgggcacgagccagcaacagttcgacaccggtcaacactgttttcagcggactaccgacatccagctccttcagcctctcagacactctcaggacctgcaggaagtcacaacacgtggttgaatgggattgttatgtgacacgaccccagctcctggcatagaagccgcccatagctgtttgctagtgcacaatagtagcaaacctcccccatctcacttgcacgaggagtacatgctctggccactccgcaagcagctccaggagatggagctggagtgcagccactggagctcgtatcaacagagcttcctcacttgagggagactgaatatcaaaggtctccacgtcagcttcgtgagaggccggcttggcaagggtgtggaattcctgagcgaccgccgtaatatgtccagtgaatgtctcccggtcaaggcttgaatcaaatgtgctgtccccgccggcgatctgtagacccagctgatatgctgataagaaggcggcgggcgaccgtccggcggccacaacctcgcgtctcgaggcgaagagggccgcataggccgccgcgaggcgctcaaggacatggcccttgagggtgcccaccagcgcaaaggctgccttctgctcggggcctgagacttcattaggtgcatcagcgacgtcatgatcgagctccaaatctgcaaatgccagtctatgatctgggaattgctggttgtaggcatcctcatcctcctggatgattttgagggggaagggagggggaagggcatttaatgtctggaggtgcccaagcatcatcccgaagcccagggttgttagtgcgcatggcatatgcatggaacaccctacctgctcatcaatggacagcgtcaccgccttggccttggtcttgaacacgagtgcggcctcctcttcgaggcgtcgctcctcgttctgcacgtcgacccacacttgcagcagtgcgccgtagacgtggtgcacagttttccactcggtctcgttgacgagggggactcggctctgctgtacggccccaaggtagcggctgcagtcctccaacacaaagagcagcagcttcaggcgggctgcaagagcgcccaccgcctcctgactggggtcatgggtctgcctgcccctggccaccagctgcggcaccagcctgggtgtaagatgcagccgcgccggctttgggtatcgcatcagcgtcgccagctgtgctgacacgccctgggaatctgtgccgccaagctggcgtgcagtgaccatcaagttcaggccatactgaagctcgcccgcagcagtttggaccggctcaaggatgtctcgatacgatgggtatcgctgaagcaggctgttggcccacgctgcgcaagactcctgtagactggtcgccacatcgagctgggactgagcctcagcatcataggtacccagtgactgcatgtgcataggaggtcacagatgagtgccacttcatgattatgaggatgacatttcctgtggaagttactccttcagcatacatagatcggctgtgaagatgatacgctgcctgacggcggacacccctctgcacagcatccctacctcgatcagactcctgactggttctgtggagccaatcccagagcaaaagcggcagacttcgctcctaatctcaaagtactggggtggcagggggcgcggcgtgcacaagtgctcgaggcgctcagcggaagtcgccaggtccttcttgctttttgcagctgccagtaggtatggaccttcatcgccgccaccttcaccaggttgaaatggcgcaggagcattggagaggggcaagtggtcgaaaataggaaggtaaacatgggaactcagtgcacatgccgcgtcacggccacttacacacctggtaattgctcaaacaggatcctggccgtctgttctggctccacacgctcttgcagaatggccaaaatatgctgcctcttcagagatacctcagctgcggggtcacatgccgcaggagggatgcagaggtggaggcggcccaggcccaggagagcccaggcttttccaagggccagcatgtctgtggggaggtggtcaggccgatgttgtcagacaggcacagcagaagtccttcagcagatcccaacacactgcgcagggctgcgtattgggccatggagccaccgagcgcacttggctgacacccggcgccagtaaggggccccaaagtccaccacccaccagcaaactcctcgccatgggcaagcagctggacaatgggcatgaagcaaacgagccacagttgcctgaggccgctgtgactgctgccattcaccgcgtgggcaagaagggagacgacatcgcccgcagcaggttgatcgtggctgaggaggtcatgaatggcagcgccaaaggcttccctcagatcctcagggatggtgtcgctgtgtgccgcaagggtcgcagcacagacagcccggagtgctgctcgctcagacacggccatagcccgcgaattgggcaccctgtgccgcagcagggcctgcgcggcgccagagagctgcgccttgcgcgcgtccacggccccgatcgccacggaggtgcccgctgcaatcttgcccaccaggcgcgtcagctctgaggcatggagcctgccaggcagggaggttgccggctctgcgcacaggccgcgcagccagcgctgccatgcctctgccgcgaggctccggatcagggtggcctgccaacgctgcacgtccagggtccacgcagtggacgcgccgtcctccaggagcatggccagctgggtgagaggtgcacacgcggcggggctgtggcggccgctgcgcagcaggctaccgctcagcctccgcaggatgaccacgacgtcccggtccgcagatgatccaccctgtgtgagcagcaggcgcaggaccccgccactcccaaaggcgtgcagcgcgtccatgttggcaaggaactcctggtgcatgggaggttgcacggggagggaggaggggagatgagggcgactctcagagttccatgccatgcctcgcggtcaaggtgtccatgtgaaacaccgaagcggccgagcaggcagctcatgtttaccaaggcgcaccgtgagatccagaagctctagctgcatggcctgcccctgcttcccggccggaagatgccaggccacggaggagtggctgccatccagcccaccctgttgagcaccgagctgggaccccttcagcatcagggcctgactggtggcagccaattgcttcaccagcgagaccgaggcatcaatgctcctctgcacacgctgcctggccatgggaagcactgtctgcaaagcatcgagagccgggcgccgagcgccaggcacgcccaggctctggtcgccacagaccgagcccaggaggcacagcgcttgggagagcgcagatcgcatgtccgcgtccagggtgaccaggagagcgacggaattggcctgagcctccctgtcttcatgtgcgttgtctgctccctcctccatggcttcgtcatcctctgcagccagatcagcaaaggagaacccagccctgaccaatgcggcaggaaggagggaatggtctacttcctgagtttgcgctccaaatctggtggcagggatgggacggggatagttagaggtgcaggagggcagctcggtgtggtggggaacaatgcttggctggtgagcatcaaagcacgcactcacaccaacatccacgcgcccgtcccactcccacccccgtgcacctggccagttcacagagggtcagaagttcggcttggtcagcagcaagctgggcatcccgaggcagcaggggatgcatgccactgcgccagaggcagggctccacgcctgccacgaggccgaggctggtgctgcctgcccgcaccacctcgagcagacgggccgcatcgggattcgcagagctcgcattccccagtcccttgagaatttcaagccgcagctgtgaccagaggtacatgagctcctcatgtagcaggctgctggccatgtcgatgtgggcctcactgctgatcacatggttggtatctgggtgtgcagcccgcatcaagctccatctccactcttgaacagcagctaccctcagcacctgtgaatgaaggaaggttgagcagcgtgtgttgcgctggactcatgttacgagaggagccgtggctcaagtcgaaaagtcttgacacccttcatctgatgtgcgtcccatcggggggaactacgaactcgcaacctgtctctgaacttgccatgacagtatcgagcgtctctggcggtccgccaagcacttgggcctcccaaagacccacagcttccagtgtaggaaacaaccagtctatgatgggcagcttgagttgtgaccgcagcctctcctgtaaaatgtggacgtgttgagccactcagtgatctgagcagagctggaaggggcagcctcgacgctcctggacttaagctgaaatgcccagagacaagcccacatcatcacgatattctgacaagccctctgcccgatgcccaggggctgcgcctacctgtggatgagcatgccgccagtaggagaactgcagggggctgacggcatcctccgccgatctcacatgcaggatcgccgccatgagaagtgctcgggcctccactgctccgtgtatgatcctggtcagcaggggagcacccgcgcagggtagggccgcctctggagcgccactgacctgcacctcggccatgccgtcctctccgtcctccatggggtgccaccccctcagcagcgtgccctggtacctctccagctcgcggatcagcgcggctgccaccatgaccgcctgctggagcccaggcgcgcccagagcactcgctgcggcgtggacctgtgccagactgggcagcaggcatgagggagcaacctgggcgccgcccggtgcccagacggccgcagcgtgcgtgcaggccagcgcacggcgccagagcgaggcagccgagccgtggccagggacccagggcgcgagctcggctgtagcgccttgtgcagcgtgcagcacaacggacgcacgcaccgttgcggcgtccagtggcgcagtgttcagcaggctggccaaggcattgggggtgatggcgggagctgcgccggcgctcgcgggctgcatgagctccacccccagccgcaccaggctcgccactgcgggggtggcccgtcgggcgacagaaaaggccgtcgcatcctctgccgcagccgccacgtcgcgtgggagcggccaggcagctcgccgcacaagaccatgactgggggtcacgcctgtggaccggctgtcagcggcgtgcgcagcagccagcgggctctgcccttcctcgccgccatacagctgaccaaaggaggccgtcagcgcctcgcttgcgccccagccccgtgccacgagcgaccgcgccagcagcgcccaccgcttcagcgcacccaggcccgggggcctgcgggaatggcccgcggcctgcactgtcgccacagcgtgcgcagcgcacatgctggactgcagcgcctgctcctcgatcccggcctgctccaggacgaggcacagctctgcggtctcgcgcgcggctccctcgcccaacgtccagtcaggcagaaagagttccacgccacggttgcgcatggcccgcgaaacctcgccgtgccggggatccatcgccatgaagagccggaagtctgggtgtgtgagtaggacccggggttttccgctggcggtgccgcactcgttcagggtcaggcgcccgccaggctccagcagagggttcaaccgatccagaacggtgggattgcacaggtttgcgttgtccagcagcacccagcccccctccgtgatagccctgggaatggtgggagttggtgtatgggcacagtatcaaaaagcgctcagggggccagacgcagccacacgtcagctagccggggctggagctcgttggctgaggctgcgccgtggtcccacttgtttggactgggttgccatgaagcaggggtacctcatctggcacaggttgcccatgtcccgtgtgcgccaggaaggcctgcggtctctcacccctccctgccttggccaccaacacgcacctcgtgagcgggccatccacccactcgaagcggccagcaacgccatgctcgctcgcctctgcctccgccagcagtgcacccagacgctgctgagcaaggtccagatgggacacgaggccatgcatgcattcctgaagcgcagcagtgctgggcgaatggctcgcaagctgggccagcagcccatccactgccaggaggaggagcgaggccgcacgccccatctgctcctgcccctcgccctcgtcctgactggctcctggcggcagggcttcgcatgacgcctcccagcaccgagtgacggcagacaggacactggcggcgccctcaacattggggaggaggagcagagaccgcccacaggatgccagggacgctttcactgcagctccaatgttctgcacgtcgacgacaagggaagcatgattctcgatggtgcttgacgtggctggctggacaggggacccagccctgtgcttcttcaagaaattaatcgtgccatggccgatctcagtgctggtgcccacaggggcgactcaacatgcacagcaggatgggtccggctgcagcacggcccacggggccgccccaatcctcacctggactctccgcatgggttccagctgctcaaagccacccagcaggtcggaggtgtcggtgccctcggtgagcgacagctccgtcagatccctgccggccagctccgccagcgtgcggatgagggccgtcttgccggcccccgccggcccaaccaccaagcccatccacccggcgccgacggcgcgagccaggccctccaggtcccgccccttgctcggaagcagggccagcaatggctgtgaggcggcgccgcccatgcgaggggcgcgggacctggccacctccgccctcccgaccctcaggacctgcggggtcaggtggacggctggggccgctgcaggggcccctccgtgcccgggccaggtctgagacaggagcgccccgacccgagcccggtcctcagccgtacgcagccgctgggtgaagagcatgtgcccgtggtgggccgcagccgagtcgcaggggtcccgtggatactgcagttcatgcccgtctccgtcagccatggcgctgcccgccgcatcgcaccccgagcagtccgcggcgacgagctcgcaccaccgcaggagatcacgcaggttgaactcccaagggccacccgaggcagcaaacccagtgcgcgcgacggtctccgcctgcagtctcgccaggaaggagatcatgcctcgcagggtgcttggggggatgcgagggtgtgccgcacctgtgtgtcaagggagggagaagggaagatggcatgcgtgttgaggagggcgaatacggtctgggaacccaccgattgggtagcagccgatgggacatcgatgatccccagcacagtgccacccgatccctgtccgggttgcacagactggaaacgcgcgcccctcctgggccatgctcccaaaccactgctttctgatcaccacccaccagcgatgaagtggaggtcgtctgtgcccagcaactccacatacacacgagcaaagcggttgaggaaagacctcggcaggcccttgcgcccaccaccctcctgcaaagggttctgcgccccaaaaaccctaaaggttggcgggcaggtgaatgtctggtccagctccgggatgaagacctcggatcgatggtcaaggaccgcattcaggccctccaggacagactggctggccaggttcagttcgtcaagcagcagccaggctcctgtcttgatggcgtggagcaacggaccatccgacctggcaggcaggaatgggggcgttcttgacttggaaaggctctctgggctccatacggcaaggacgccgggagtggcatacatgttctctcatgatagctagccaacaaccctaaactactgctccacacccaccaggcaaacgtccccgctgcaccgctgtccacaggcagatcagctcccagcaggtccatcatgtctgtctgctcactgaggttgacgcgcaccagggtctgacccacagcctgggccagagcggccacgaggctggtcttgcccactcccggactgccctccaagaggatggcttttggcagctgcacaagggtaagagggcgggtggtgtcgggctgagggtccgatggaggatctaaagaagaccagagagggggttgaaggggtgtcacacccgtgcagtcgagtgtgtgcccaggggatcaatcggcctcaggtgaagaaatacttgtcggcacatcatgctgctgtgcagcaagcgctcggtagaaatgtcaagagtttatcatcaatggccaagagatcgtgatgccagtcatgggtggggcagggatgcaatcgtgctccggccgcaccctccctccccaggggctggtcacaacccatgccatgccatgcacctgcatcgcacgcagcacacggaatgtgttgcgtcgggtggtcggggcatcaaagtcgaagcgcacagcgtgctcctcctctggcccggcccgctttacgtcgacaaagaagggcacggtaccccactgctcgtggttggtgacagggtgggcacgacgctgcatggctggctgctggctggcctgagacaggcttgcggagacctcgggcgacaattgctggagcaggaacgtcctgcacgtggccgtcagctggctcgagacctgcacagacggcaagggatcgggctcgagcagggtgctggacgacgcagcttgccggggcgctaggcattgcagctaccctaggcgctacacgtggggcccaccagcccaaacagcgatcgttgaccgggagccctgccacgagccaatgcagctgctccatactcgcatgcctacctcgatgggaagtcccacgcccagacccagaccgtccagaaggatgagctctgcgccatgcgcgtacgccagcatagctcccaggccgggggtggtcaggttgatgaattccacccaggccatcaggtctcgcatggacaacgcctgtcgaaccgaggcggagatctcttggttgaaaaacgtccagaagtcgatgaggggctgcgtcacggcctgtgctgctgggacaagccgctgtctcaggattgcgtgcagctcggagggcgtagttgctgcaggcacccagatcgtggtgaagcggttgctgagcgcgggggaaagctccttcttcccaaagtcgcccccggggttcatggtcgccacgaccctgaagttggggtgggcgacgatgacctctgccgcgcttccccccttttctgccagagtgagcgtcctgccaggctccagtacgctggaaaggtgaggacagagggggggtgggatttttcatgggcacagcaacagcaatccatgtcacagactgggggtggcataggtattcagcagggagggcagatgcagcgcctcccatcgtcacacacctgtttaacctctccaggacggcatcctctgcgaggttgagttcgtcaatcaggatgatgtcgccctggaatatggcctggaccagggggccatcggcccagacaaagggcacaaatgcttcgccttcagccacaggggctctgcgcagataaacaggaggaaggtaattgtggaggagtgttatgccttgccaccgttttcaaactgtatacggggctgcgctgacatgctcaggctgcaaacaacctcaacagctctgctctttctactcagcagctgccaatctctccaggcacccctaccgacacctcgcacctgttgggccggaatccacccagcaggtcagacgcctctgtgtgctgattgcaattgaagatatggagccgctggcccctgacaaaggctgccatctggcagaccgtggtcttcccggtgcctgtgtcccctatcaggagagccggctcctcgtgtgcgaggcagcgatccagcaaagcatacctggatcagcatggtggcatggagaatcaggacacaaatcccaatgcaatcacttccctgcacccacacatgccatgcttttggcgtgtggaagctcagcggggttgccagccacagggttgcaaccaataccttcgcacccccctccttcccccggatctcacatcctctgcatgggtcgggtccagacaagaccacgcagcatcttctgaagcgcctgggtctctggacctggcatggcgccgtccagctcaccagctctgagcctagcctggagctccagcagcggcttttcgccctcagtaaagaaagcctcctcgaggtttatctgggggtacagaaaggttgaagggtgtcgcacctgccatgtcccgggtgtcgcacctgccatacgccaggtgtctaaatgcttgaagtaaaacactggtgcagccaccagacactacaccgacatctccagcatgtctgtccggaacttgtctcctcgacacaaatcttacctttacacggagctctgtctgtatagactgtcttacaatgctcctctcctcggcgttccgcagccgctctccaagcactgcaaagccgtttatggccagctcgtcgccatgaccaccgcgccccgcccaccggaagaggtctcggggggtgatgaagccgtgcctgccggcgaatacattccctgcagcccggccatcctgcaaggcttgcatgacccgcacgatgcgcccagcatcgctgttgcttatgccacacctgcgatgcagtaaggaacgcgagagtacattgcgatgagtatgtggtgcaagccgtctgattatacagactggagaggcatggatgacggtgcctcgatctatgcctgtgccctggaaatcctagattcacagcttagaacccacattcccattgctgaccccacctgtgctcgaggatggtgaccagctctgtgggtgggatgtcatccacctgcatctccaggaagcgtgagcggaacgcgcgactcagcgcctttcgccccgcgtacagaccgggcgggttttgggtggcaaacagcatgaagtgtgggtgtggcttgatggtctcctgaagctcgggcacgaacagctcgcgattgtcgtctagcagcctgtgaaaggggtggtagtagggctggagctggccaccactgctcattgagctttgcagcaggagtgtgccttatcctcaacgacgcgacagcctgagcacttcccaatgtcaggtgaggaccagtggcaagacgcccttcaactgacacaccccgacgttggtcaggaatgtgccgcggagccaagcgttccccttagcccccctggcatgccagccttccactcgctccgcaaccctcttctcccacctgttcagtgcttccaggacatccgagggggccaggttcaactcgtccaggaccacccagtcccccctgcgtgccgcctggaccagcgccccctctgcaaatacaagccggccgtgctcgtccgacacgtaccgccccaagtactcctggaggtcggtggagtcgtggttgttgatgcgcacgcaagcgtgccccgtgcgggcggccagataccccaccagcgaggtcttgccgctggaggtgggcccctgcagcaggatggggcagcgccgcaggaccagcgcccgcgccaggttccgcacgtgcgccctgaccgccggggtctccatgaacacgcggccctgggcgtcgcgctcgcgcggcactgcctcggcgggcccccgctccagccagtacccctccacgcaaacgtggcagtcgcccgggggcgcgccggcagcgcccgaggtggtcgcgccgtaccctgccccgcccagcaggtgggtctggatggcatagcgcaggcgcgccgcgctgcgcgcctccagcgcagtgccgaaggccatgtcaaagccgtcggccagcgcgcggagcgggccgtagcgggccgtggcggcacgcacatactccagagcgcggcacagcgtgcgcaggttgaagacggggcaggccccggcgccgtccaccagcccgcggtccgccttggcggcgcggtagaaggacaccacgccctccaccacgccacggggcgtggtctggcccaggtaggaggtcaccatggcgcgcaggtcctccgtctgggagggctcggcgacccacacctcggtgaaatggttgcggaggggggccggcaggtcacgcttacctgcaaaggtgggggtaatgagggtatgctgaggcatggtgtaatgcggggtcagggagtgtgggacgacgggccatggtagagaagcatatggctgagagtgcgcagagcgcggctgctctgtgagagtagacaatgcaggacctcaaccctgcaacaggtccactgcccacctgcatcggtggcggggttcatcgcggcaaagaggcggaagtcggggtggcgagtgaccggttcagcatccccacgctccgccagcaccaaactccccctgggatcctgtaggagccccgccatcctttccagggcctgcgggggtggggtaggacggtggcagaccggccaagtctgggatcatggcttggaatgctcccggtgctgtggccagtgtgcatactgctgcaacagactcagacacatgaaggacttatgctgctgtacccatggagcccgaggacacaaccacccttcctgggagctggtggcactttgtgctgattgacagccgccatcagattgaacatagcagacacctcccttgcctcggaccccgcacctctggcggcgccaggttgatctcgtccagcagcagccaggagccctgtcgcagtgcctgcaccagcgtgccctccatgaacgcaaaggagaacccgccctcggcagccagtagcgtggcctccgcatgcgccacgtccaccgagaacttgagccaggcccgccggagctcccgcgcaggtgtggatggttcgggagcagcagattccgcaagctccgccctgctgggcgggcaggccacgcccagcttcgccagggccaccttgaaggccttgaccagcctccctgcgtgcctcttggccgccagtcgggcaacgcgatcgatgaaggcgccgttgtttcccgccggccactggcgctgcaccaggtcctggaagcgctcgaacagcggcagagcggcgtcggtggggcgcacggggcggaagcctcccagcaggtcggaggcgtctgtctgctgactcaggttgagcactgccagcgtggcgcccgcctggatgaagacaccaggggcaaggtttagggatgtggagaggagcgcagtatgccacatgtacaagcaaggaggaggggtgcaggcggcaccgcatacatccgcagtgttctcctgaaaggtattgcacgcagtggcaggcgggctgcttcactccctccccagcccttgcacccacctggctggccagttgctggacgagggtggttttccccgtccccgtctcccccaccagcaggagaggctcattgccggccgccgccaccgctgcgcgctccatcagccttagcgcctgcccggtgggcgcgaaggtggagggcaggggggggg

SEQ ID NO: 18090 - DNA, 72 bp, Chlorella protothecoides
aactttgagattcgataatcttgaatggagcggggcgcttcagacgactctcttggcctcacaggctccccc

SEQ ID NO: 18091 - DNA, 74 bp, Chlorella protothecoides
tcaggccctgttccagttggtcagtgagtgagtcgagggagcaagagctgggaggcggcatgctaggtgccgca

SEQ ID NO: 18092 - DNA, 218 bp, Chlorella protothecoides
ccttgctggaggcccagcaggaattgggaggttatttttggtgaggagtttgtttgttggggtgtgtgtggtgctggatggatggatgtcgagggttggtctttgatcttccctcttctcctccctaatcatcatacaccccctactactactcctcctcacatacaaccacaacctcccaaccccccaaacccttcgacctgagctcaggcaagacc

SEQ ID NO: 18093 - DNA, 77 bp, Chlorella protothecoides
aaaaacaataacaacaccataataaattttaccaataatatcatacatacgataggtcaaaacaaactacatttatt

SEQ ID NO: 18094 - DNA, 226 bp, Chlorella protothecoides
atacagctataataaattatatttattataaaaaaactctcaaatttatcaagcaggtttttagcctccccaagttggatttgaaccaacggcccgatggttaacagccatctgctctacccctgagctattgaagacatatttaaaatagaatgtggttaaaagttaaaatattttatttctacttggtttcgacttcgtacaacgcagtaacttcgtaccacga

SEQ ID NO: 18095 - DNA, 182 bp, Chlorella protothecoides
aatatgatcattatttaatgatcatattgtagattattgtctagtctaaaacattgaaaataattttattgaagtgattagtaggcttaaattcgtctcgtcgatgggttttatttttatctttcgtaaatcaaataaataaatatcattggttttaaacttgactagaaatgtaataaaaa

SEQ ID NO: 18096 - DNA, 143 bp, Chlorella protothecoides
agagacaatacaatagaatctattgtctctaatttcaggctgcaattcgattgacatttctattttttattacactatggggcttttgttaagtaaaataaataaaaaaattaaccataggaattttgtttataagggttttt

SEQ ID NO: 18097 - DNA, 70 bp, Chlorella protothecoides
gcagtcgcttgccgccctcttgccctcaccaagcctgtgtgctcctggcgattgctttgctgttggtttt

SEQ ID NO: 18098 - DNA, 71 bp, Chlorella protothecoides
ccccaatgtagacgggcaccttgggccgatgctggcatggctgacggcaaggctcgccaggagcacgatga

SEQ ID NO: 18099 - DNA, 88 bp, Chlorella protothecoides
gtgcagcggatgacactgtaactgtgggtcagtcggatgagggaagcatggaacaggttttaggatccggtctcctcctcctgtgaga

SEQ ID NO: 18100 - DNA, 170 bp, Chlorella protothecoides
tattaagacaagcaagtatgcaaccatttattagaggtatacgtattacttgtaatgggcgtgttgggggtaaatctaaaaaagcacagcgtgctactcaagaatgtgttaaatatggtgaaacatctttacatgtgtttgactgtaaaatagattttgcttctagaagc

SEQ ID NO: 18101 - DNA, 105 bp, Chlorella protothecoides
cagcagccattaaaagaacacctaacagtttattaggaacagtacgtaaaagttgaaaaacagggtaaaaataccattctggaagaatttctaatggagtagcaa

SEQ ID NO: 18102 - DNA, 119 bp, Chlorella protothecoides
ctggatgccagcaactgtgatgcatatgctttctgctgacctgaacagggctcatgtcgaatgtacacaacctcacatggcagtgcacatattctgttgtcccctcttacatgcattcc

SEQ ID NO: 18103 - DNA, 149 bp, Chlorella protothecoides
tctggatatccgacctgcacaaggttcgaaatgacaaaattgtcaagacagaccaagaattgggcatggcaggaaatgggacccccaatccattacaggcaatactctcgtcacctgcttgcaatccaggtgcctcacccactgctgct

SEQ ID NO: 18104 - DNA, 10571 bp, Chlorella protothecoides
gaggcggggtggcaggtgacggtgcgacccgccgtcctcaagcccgctggcccccggcccatgcgcagcctcgctccagccagaacggtgcgtggggccttgctgtgagggggttgctgcataccgcccttgccgaggcgggtgtggggccaggagatgggagggtgggtgggggacatggtgcagactgttgagtccctcgaccctgataagctttcacctgccctcggtcatgaagcttgtacaggcagcgcgcccccccctccaccccacaccccacaccccacaccccacacacctccatgaacaggcgtccccggaccaggcaggcacatcctcctccatggatgtggacgacccggccccgctttccagcccgggcctctcctcgggcgtcgccgtgaagcaggaggcggcgctgctcagcttcacccaggactggagctacgaggcctcctgtcgcagcctggcccaggagctgggctggagcaccgccagcctggatcggtggatgggcgaggtactggggccccagggcgatggcaggaagcgggggcggccacggcaagccaggtgggcgggggtgtgggatggaggggcgctgagattgaggggctgagattgttcagaagtctaggaagcagcacttatgaccaacccctgccgtcatcctgtggattacccacatgtttgagccttaagctgagtatgcctgtcccccaaattcctgctgagtcagggatgtccacctggcagacggcatggtggaacccaccacgagcgaggtgctcgtccgcctgatgcaggtgattgggaacttgttgtccatgagaccggaggatgtctcacacatgcatgcgggacctggagttggactcaggaaggcgtgctgtggtccatgggcggggggcctgagctgcaaataggtggactcagtgataataccccctgtcacccctcgccgcatcaaaaggatcccgccaaccgcctgctccccgctgaggagttgaggcggaggactcggcgggaaaagaacaagatcagtgctgcggtgtccaggtacaagaagtccaggcgagaccaagacctgcaggacaaggtgggtgggaggcggcgaggggaccttggcatgcgtgtggagactggcccacgtttcagggattctctgcgtggcagacattggtaccagctggcgtggcgtgtccagatcgccctttcttggatgccgctgcagtcttgacgcgtcaagagccccacccggtgtgcctgagtgtgtgggaggtgccctgcaactcttgtgggccccccacttgcatgccattgaggaagtacctcgtggcccctgtgcagattgataagcttcagcggcagcagggagttctagtgcacattctccagcagggcctgaccctgccggattccgggggtgctgcccaggatggcgcccatgcccccctgcgtcatgtcaacagcttctaggtggaagtgtgccccatgacgtcacgctgtcttctccatccatgactgcttctttcatactaccttgtgcaaacttgccccttcaggaacttccatttcttgggaggctgatgcatcccttccgccagcaggatttggtcctaaactacaatttgatgatgatcttgctggcgcaatggcgtgcccacccctatatgcatacatgtcaggccattctctggcgtttgtgtgattctagccttttgtaagcagtacttagagcaatgtcagagggcccccccagaaaagcgttgacatcaagtttagatacctctgctgacccccccgagatgcctgcttcgttctcgcgcgcgctcatcagacttttcaacccacccatcagactttcgaagcaagtgccaagcatcagcaatgaaatcaatgaagagtagccagagtgattctcgacgtaacactgcttacatttgagcatccggcacgggtgcaggctgccacaaacatggagtgtcgtggtggtgacggcgaaggcaaggtgagcatgcgcggggtgatacggtccccgcttgcaagaacgaaggctcttcaaagagctctgaaacatatttcaaagccatttccgttactcttcgaaggagtacgcttcgcctcaagagttctgggatgaggtcgcagccgcacggtcctccggggctgggccgcagtggtatgaccaggcggtgcgatactgggacacccaggaggccagcgacgatggcgtgctggggggattcggagagctctctgaccctgatatagtggatagtaggaagtttctggccaaggtaggtgacttaatgtcggatgcttagggttgttaccacagagtgtggggaccgttgtagggtgccagtgtggatggggagcttgcacctttctgtgcgactttctggaacacacgatgatcgcaccatccattctcttgcctttgtacatccaggctctgggggtccgagctaagcccggtgaggtatcagatgatcccctggtcgcagcaggtcggaacgtttttgcgagcagtgcgattggggaatgaaatttcatctccgaatcgagcttttcagcatgttacgtcccatgctgatctcactggagaagatgctagtcttcaacgctgtgtgctgcgctttctcgacttgcagattgcggagctggcatcggcagggtgacccaggccctgcttctgcacacctaccaggaggtcgacctggtggagccatcgggtgtgtactgggcagggccactggcatcgggtgctgaggtttggggctctatgactagccccagaccacacgcagctgctttagaagtgcagggtgcacctctcaatccaccgtccaatgtccactcctcagcgcacctgctggagagggcgcggacagccttcgagggccgagctgggaaggatggcatcccacccggccattgcgtagtcaactacttccagcaggggctggaggccttccacccggagccccagcgctacgacgcgctctggctgcagtgggcagtcctgtacctcacagatggtggggctgagctgatggaggcagctgccaggggttggggcaggcgcccttcggcgatcagggatatcctcacatgattggggaccgcctccgccgtggtttggatcgatccacgctcgccctgcccccacgcaacaccccgctctgttcccactgcgtgtgcagaggatgccatcgcgttcttccagcgctgtgccaaggcgttgaagcccggcggcttcgtctttgtaaaggagaatgtctgtccagatggcttcgtggtggaccgctccgactgcagcataacgaggtgaggtccatgggtgcaacttgcatgtcagacctgccaccagcatccccaatgctgtgaatggatgcgtgcctgccacctccctcctcacatgcccccaaacccattccaggaaccacaagtattacttggagctgttctccaagggcggcctcacgcttgcacattctgccacgcagtccgggtttccacgggggctcttcaaggcaagggacgagggtggtgtggcaggacctggtctcgggctcggccagggtgcaaagtggggaatgaattcatgagcttacactgtcagcgagcgggtgaaatagctgatcgtgccccatgtgaagagagggatgacaaaccctgtcccttcacattcctcgtaccatttccaggtgaggatgtatgcactgaccgtgaagcagacgtgatggtgccatccctgggtactcaacagccagactccccaggccatgttgacccacaagccccatacatcctcccggatatcaaaactgtgtcactgtcagcacactgccaaagcacggagctgtgcatcagggggggaatccagacctggcctgccttcatacttgcctcaagagttcatcagtgggccatgagtgtgcctgccctatgagaacccgacgacggccagtgtgacccgccgccttctcgctccgagcacatgcgagcattctgtgaaaggtatctacaagagtcctggtgcatccaaaattgggcgacgggctactgtacagagcagtggggtctgcgcttcatgctttcttctccttcttgccggactcctcctcctcctccacatcggccagggcctttgatgccaggccgcctacataccagatggtggccgcagtggccccgagacccagcgccacctgagcagtagcatgacatgcagggagcgtcttggcaagggaggggttgtcatggatgtggatgctgggggcggctcagagccttttccactcccctgcgagcccacgatgcacctcctcacaccagccctggtgcacccaccgacctgccacggcgcgactccgtgccccgaggccaggtccttcccatacgcgcccaccgacacatacgcaaacgtgcctgggcgtgcggcaaggggaagggaggtggagttcctgccaaccactggcagcagatcgcacagggatttggtagacccagtccaggctcaggtaacatacgctggccgggcacgtcaccatggggccctaaacgctgcgccgcagccatgcctatgtcggccctttccctggcacccccctttccctggcacccccctccccctcccctcacctgggagcatgcctatccagctgcccagcatgtaggaccccacgtccacggaggtgaggccgtacaggtagttgctggcggagaaggggaggagcggggagaggcggagcagggtcaccacgcgcaggctgtccttgccaatggcacggtcgatggccgcaaactgcttgttcttggaggccatggcactgacccggtcgcgggccaggtagcgcgcaatgaggaaggcggtggtggaggctatggaggcggccagggagacggtggccaccccgggccacaggccgaagagggcgccggcagccactgtcaatgggatggcaggcactgcacattggagggggggtgacggtggggaaggctgagggtggcacaggagggagtggtggccgggagcgcgcggtggagggggaggggtgagcatgcgtagatagaatagaaagcggcaaggtgcgctgagggcggtggggaggctggcgattagcaatggcgatggtcatgagatgcactcggccttcgagcaaggttgcgcctgccctgcacacctgccaccagctcgagcagggcatacgctgccacatacactaggtagccctcgggtcccatggcatcaatcacgccggtgaaccactccagcgagaccctggcgacgcgcaggtataggggggggtgagtctgtcaggaggtggcattgtgctttttggtgcatccgaactcagaccaacaccacagacgcacccccaccctcgggatccatccaaccatcatcccccagcgcgcaccagatctgatccttgaagtagaagcccgcgcctgccacactgaccaggcctaccgccgccaggatcgcggcattggacttgaactcctcggcctcggcctctgttccggattctgtgtcctccagatgctctggcgtccctgagctgctgccgttcccagagctcgcgccagcgtcagctgaagtgcttgggcgtccctcttctgaggacctggaggaccaaccggcatgggcatgagctgagggggcacatgtagtgaaaccagtcccagattgatgtgatgaaggtgtcaggggcattgaccaggcaggacccaagcctcctacccatacgtacctgtgagactgcttggccgtggtcggagcttccagcctggaggctgcggggcccccgtccctgcttcccatccgcgcggccatccgcggacgtcgagatggaatccaggacgtctgtactttcaggggacatgccgccgcctgcggggtccccatgcacctcgtcatggcagcacatgcgcctgaacccggtggaatcccgaacgcacatgccctcccccgattcgcagacctgacaagcttgcgcctacctgcaggacggtcgatgccaggctcatgctggtgcagataaacattgtataggtgggtgtcagggtgcaagccgtgcggttgtgatcgtattgagcaattcacggtcacctctccgcggatagctggtgcgaagccccgcacataggctgccctccgaggtgccgcagcgggagatcaagggacgaagcttataaaggctagcaagctgaatgcatgtttactgcaggaggcataaatctgtggcgggggatgagactatcgtccccgtcctttcccccgtcctgagcttcatgcatgcccagccacgtcataatgtgactacttcctattcgacccaaagcctgaaactcccttttcgaggactggaacgcgtactctcctacatataccgtgaaatcaagccagccatatctgctggcaaggattatagcgctgagggtggtgtgggaatgaggccaggcgagagtgttcctatgcggtgcccacagggagtgtcacatttgcacacgcctccatgcccagctccttgcagctggtgagtgcgtctgtgcagatctccgtactggcaccatcaatgcgcgtgaggaactcggcccccttgcggttacccatgccggaccctgttgggaaagattggaagaggagggctgggcacgatttcagagacctggccgagtgactgacagagtgtttggacctacatccacattccaggctgtgcagtgggactccattcggtggcaggtgactattctggtgcccttcaacgtgtcaagattccccatcctgcgactgcatctcccatcggctggatacagactcacctttcaccattttgccagtgtactggctcgtgctcttcgtggcgtagtggtagagcatcatgcgatcgcccctgcgagggttcacagagccaggcgatcacgcttcacagtggtgcaggcatcaatgcctggtcgaggtccaatggcctggtgctttgatgggatcacactgtccatcgcctctccttgccaaggcatgcactccactgccagagggagcggcagtcttgagcatccaagtccgctcacacctccccgcaagcgccctggctgcacacccctccgccctcccacacccagctcacgagaccgtggccgacatggccccagtgacttgctcccctgccagggtcacagcactcgcccccgctgcatactcaaagtggtggggatccgagctggtgcccctcacaaatttggtattaacgatagacttgatctgtggcatgtgggggagagtggtgtaggtatgtcggcactctgtgcgaccttgcaaacgagagcgtcatcgacgccaacgatgtgcatgggaatcaaggcagtggacacaaatcagcgcctgtgtccgacatatcgagtgtccttgcccttactcccaccgccgcccaggccccagacgcgagggatcatacgcacatgtcgattctcagggtattgtactggcgtgcatgccaggaagttctgcaggactccgccccctggctggatcgcatggcctgtagtgagtgcatgtgggtttgggggcctgagatctgggtagttgtcctaccgcaacaagccaagcactgctcaaagtctgtgcaggtctgggcatgtaggccgctccatgaaacacgatgcacaatgggatgagtgcaatgaaatccatctgatccagcgagacatttggcctcaaaaccatctacttgtttcctgggagggaagactccttcactcacagcacacaccggcccccctctgcaggcctccgtccccatccagtaccctagccaccgacctcccgagcccagcagcctccagttcaccgccagggcaccgtgctgctcaaattccttgaggaggcctggcagccccgttgcgcgctcggccgatgccatcaccaggaactcgtcaacatcgatgaaggcgatgaaggcatggagtgggcttgcatggcgcaggcacaagtcatacagcttgatctgccggggaagggtgagggtgcatgtcaaagagtcagtggaggtggagtggagtgactctggctcaggtgtcaaggggcagatcacgtcacatgtgtgagcttgtatgattgcatgcagcaagaagggcgatggtaagttgctgctttggcatggccaggagagggctgatgcgatacgatgcaaggggtggtcgtgcagaagacaggacaccacacgctgttgcccctggctagcctccttttcagcatgcaatccacacaatgtgcaggaagtgcccccttggtctcagatgcacaaactccagtcaatctggcacctgcatcagaggcacagttattggcgtgactcgcggcaggtagtagtactccacacgcccctgattgatgaagtcctgtgtgcatgggagggggctgcaatggttggggagctgcagcctgttttgtgcactctttaccaggcgcatgcatgcccgatcagcgcagtgcaggggccgactccattgcacacagccagtgctgatcagccagtcacatccccaccaccctgtctacaatgaaggccctctcctccctccaagaggaagagacgcactgcaatgtctggctccacaggctcgggattgtccgtgtcaaacaggtagatacgggtgattcccaagcgaaggtggtagtctgcccactcccgaacatcggggcccgcatccttcgtggcggcacagatggcgacatactcctgtcccgcaggggtgccctgagcttgcttagcttccttaacatgggccgatgcgttggccttctctgcagctgagcctgcattccctggcagctgcctggcgtcagagccagcatccagagtctggccgtctcccagggaatgaacctgtgcaacccgcgatccggcttctagcccttggccgccagtcgcagacttctccagtccttctcctcggctgatcgggagccagcaggcaatgacggccaataacagcaaggcagcaattctgcaccgggatcgctgcggtcgcccgtccacgccactctccatacgatgactggtgtggacaagctccgctttccctacacagtagttcccatggaatcgtatccgcaatggacagctttgtatcacttggccccgggaagagggtcggccgggtcagtggggcttgcagctcggcaagtgtggttggctatgtctttgtggaaatttagttgtgatctctcaggtcattccctcgcggggacagttgagtgcgcactttccccggccatccgaacacaagtgtgttgttcgccgtggatctgttttgagatcatgcgcctgatcgctgccatttatatccaagggggttgcaacgagattttgaccaagaagataacatttggttgctgcctgaaagtctggacctgtccacagtaacaagaagggagcgggcttcagcgcaatttggtcctaatcgagcaggccccgaggatgcctcccattggcaggctacatgaagggcaaggatgccagctgaggctcgaaggtaaagcctgggaaaagtccaagaggcaaccacatggcgacgggaagcggtgtcaagtgatgaacagagtttgtttgaaggtgttgatgctccttgctgcggccgcggctgccaccagcaatccacagtcctcacccagccaaaaggtttcaaaaatgtttatacacagtggaagcttggccttccaaggccccggccgcttgttactgtgtgcagccaatggtgagtcaccaaggacgatgcacactggggccaactctgcgtgctggatgagcacccaaagggacttccaattactttacaggagtactgttgcagcctcctcaatgaccttccagtcatagatcgtgtaagctagactattggaacgccctagtgtcaaggcgataaatgccgaaattgccaatgctatggggcctgtgccatcgaggagcgtcaggaacatgcgtggcgaaccgaaaggtacttctccccgccccacttgattcgattttgcgaagtgccatacctcggacgcagggacacatgcagtcgagacaagactcacaagctctcctttgcgcctctcctaggccaatttggcatcggtatccttgtaaattgtgggaagtctgtgtcgtcctgtgcatctgctcgttcctcgtctgtgtgcgagagggaccgtcaggtgcagcggcgtgcaggtaccgtatcccatgactcccgcacccccttcgactgcctagccccaggtgagggtgcataaaatctcggtgtttcatgtcccttcgatccctgcatccccaccgctccaagcagcactggcccaatgtcgttaaaccaccctcccagggagcgatggcggacgggtggccccgccagcaggtccctgcccccaccttgaacggtactcagcacagcaacatgcaccccatgtacctgggccagcacgccggcctgggccagcaccccggctcggcccagctggcttccgggcaggcagcggaccgccccacccccgaccccccggcccccct

SEQ ID NO: 18105 - DNA, 1101 bp, Chlorella protothecoides
cctccacccagcccccctcctccaccacccccacgggcatctgctacagtccagtttggtgctgtttccagtgggaagatacccgtcgcctatgtgatgaccactgggggatacactccctattccatcacttgcagcctgtactcaaatgtcttcttcaaactcgcgaccacgtctgattcatcgcccacctctgctgtctctacgatcacgggggacccacagtatgagacgatcgtgccaaagtttgtttttggctctgcaaccatcctctcgagtgcaggtaacattaatgagatcgtgccgctgacggtcgtcaactcgccctcccctccccccatgtcctttcctcaccccccaccagcacttggacccattactgggagcgtcaaaaaatcagggaacgacttctcattctcaatcaaatttggaagcgtcgttcctaactacattgcgatcgctttcttcactggggacgatgcattggctgaagtgggaggcagatcgtactacggctcaacaaccaattttaccatgcagcttgcagcggacaaggaactccttgtgtcttatgcccaagttgtgggagtcacatatggtggcgacaccacgaatgccctgaatctgaactggtagatctgatggattgctgttgattcatggttgctacaggaactcctgcagtacctctgccatgctttcccattcctgttgcatcattacctacgccaaagcgtagccataccaatccaagtggacctgcctgcatctgtagtgatagactgtccccctccttgtccccaatgtaagcatccgctcacttccaggcaagagctgtagatcccaagccgcacctcggtattcccacgctaccccccttcccacctgttccggtcatactgttgtggtagtcaatcatgtgctctcctggcatttggatgttgtccttgtgaagagcaccccaaacaatgtcaaacaaataagctacctgggttgtttcggagtgggccaaaaattcacctaaacccgacgcaccaagcatctgtgctgcacccagatgttgcccaccatgtgttgtgggggttccccttgaccgggccc

SEQ ID NO: 18106 - DNA, 172 bp, Chlorella protothecoides
gtggttggcgtgagacttggctctgcttcacaaactttcacggggggttgagaaggggcgaagacatgtgcagcccccagcttggggcctgcgtgggtgaaggcccatgagcagccaccctggcaccaccatgaaccggctcacagcttgccggggcgcagcctgcgcacgg

SEQ ID NO: 18107 - DNA, 312 bp, Chlorella protothecoides
ctgaatacattagcatggaataacatgataggactctggcttatcacgttggtctgtaagaccggagtaatgattgagagggacagtcgggggcattcgtatttcattgtcagaggtgaaattcttggatttatgaaagacgaactactgcgaaagcatttgccaaggatgttttcattgatcaagaacgaaagttgggggctcgaagacgattagataccgtcctagtctcaaccgtaaacgatgccgactcgggatcggtggtcgttcattcaatgacaccaccggcacctcatgagaaatcaaagtttt

SEQ ID NO: 18108 - DNA, 216 bp, Chlorella protothecoides
gggaaaaattaccaagtattcataaaaaattacaactttattttttagatgctttagatatgttttataaaaacagcaatcaggtgttttctgcattaactccacaacaacagaaagtacattattttgaaattgctaataaaatggcagtaattaaaatacaaaactttatagttgaaaatataattgatgcatatttaaaccaaggggtttcag

SEQ ID NO: 18109 - DNA, 141 bp, Chlorella protothecoides
taaaaaactttccgaatgtaatacacttttagtaatacctaaaataataggatcataaaatgctggactttgttggctattatataatttattatttatttcttgaactgttttaaattgaataatctctcctggtaaaaa

SEQ ID NO: 18110 - DNA, 71 bp, Chlorella protothecoides
gaaaacgggaccaccatgccagacgggcctgtcatcatctccccagacggcctcttcccatccctgtaccg

SEQ ID NO: 18111 - DNA, 81 bp, Chlorella protothecoides
ttaaaaaaatcgaattgaaaatagaaagcaattaataatatacgaggacgacgggagtcgaacccgcgacccttggcgtga

SEQ ID NO: 18112 - DNA, 73 bp, Chlorella protothecoides
cagcccagcatcagcctcggcctggtgaggagggagcgcatcgggaggaagggtggggatgcgaatcgtgctg

SEQ ID NO: 18113 - DNA, 71 bp, Chlorella protothecoides
ggaggaagggtggggatgcgaatcgtgctgtaatctggctgggaccctcctgatgttccggcaagcatgcc

SEQ ID NO: 18114 - DNA, 61 bp, Chlorella protothecoides
ctgaggtcctgatccctttccagaggaccgcagggtgtgaatgtgcaggccaggcggattc

SEQ ID NO: 18115 - DNA, 618 bp, Chlorella protothecoides
gcgcatgggcggcgccagcagcgcaaaggcgcggtccggcgccggggtcgcgtcccgcacgtccccgggcgccaccgtgcccaggtacttgagcgccgcgtcctccagctcggcggggtcgaagtcgccgacgacgcacacctccaggttgccggcgcggagctgggcgctgaccgcggcgcgcatgccctccaggctcagcgccgcgatctcctcctgggtggggtcccggaactggcggtctacgcccatcatggccgtcatgatgcggtccgcggtggcgcgctccaggctcttgggcagcgcgcgcgcgtggctggcgtacatctgcttggcacgctccgcggcggcgccctcccaggccggcgcctccaggaacaggtgcaggagctggaaggtggcggcgatgccgccgccggacaccgccaggtggaagtccatggccacgtgctcctcgtccgcctccagcacgcagttgatcagcttgctgatgcagaacagctccacctgctcccgcgcccagccgcccaccgtcccggactcgctcagcgcgcgcacgccgacggtgaccgcgccggtgccgtcgggggcgacggccgcgcgctcgcgcgcgcgccc

SEQ ID NO: 18116 - DNA, 116 bp, Chlorella protothecoides
ccaaaacaagctttgcaatatagcttatataaacttacaaaattattttttgattttacgcttgttagtttatctctttaaaaaaattaaattttttagagagttagtaaaaaata

SEQ ID NO: 18117 - DNA, 381 bp, Chlorella protothecoides
aatttgaaactacttgtgtaataaacccactctctcttgtttgtataatatgattaatatctgatacaactctcggctctaaactagttttaacaagggcaacttcgggttttaataaaggaactgcctgtcgttgcatatttgatcccataagagcacggtttgcatcatcgtgttctaaaaacggaataagactcgttgctaacgaaatcatttgtaagattgaaatagattgggttgtaatttgatctaatttggcataatcaaaatcccagttctttcgagcgggaaggctcatttttggcaaacgtccccattttgaaattagaacatctgaaggaactaaaacatgtgaagattctttttctgggtttaaaaaaa

SEQ ID NO: 18118 - DNA, 68 bp, Chlorella protothecoides
cccatccacaggaagcatggttttcacgaggccggatagattcgcaccgccaccatcgagttcacacg

SEQ ID NO: 18119 - DNA, 151 bp, Chlorella protothecoides
ctttttcaacaaaatcaaacctttttgttgttgcgttgagtccagaaagttgggaagaccgctatgcatcaagtgacgtagtagcgcctgctattgcaaaagatgccattaaagatatagaacagtttgaaaattatgagtatgaaaaaaa

SEQ ID NO: 18120 - DNA, 79 bp, Chlorella protothecoides
gggcacctcccaggcctggagcacatggagaaatcaggacccccccccttgcacctgtgctgcccacggctcgcaggag

SEQ ID NO: 18121 - DNA, 5254 bp, Chlorella protothecoides
  modified_base (650)..(659): a, c, t, g, unknown or other
  modified_base (1024)..(1033): a, c, t, g, unknown or other
  modified_base (1415)..(1424): a, c, t, g, unknown or other
  modified_base (1543)..(1552): a, c, t, g, unknown or other
  modified_base (1625)..(1634): a, c, t, g, unknown or other
  modified_base (2076)..(2085): a, c, t, g, unknown or other
  modified_base (2277)..(2286): a, c, t, g, unknown or other
  modified_base (3002)..(3011): a, c, t, g, unknown or other
  modified_base (3554)..(3563): a, c, t, g, unknown or other
  modified_base (4206)..(4215): a, c, t, g, unknown or other
  modified_base (4656)..(4665): a, c, t, g, unknown or other
  modified_base (4915)..(4960): a, c, t, g, unknown or other
tgcgcgtccccggggccaaggaggcgctggtggaggagctggcccggctgcgggagtttgagcgggaggaggaagggaacgagggcatgactgacgagcagcgggaggagcagaggggcgtcggcatcgagcagcaggaggagcaggtgggggacgccgtcggggagctgaccaatcaacgtgccagtcgcagcgcccatccagcctcttcaaagccagacgccagccaggcccctcccccgcccggccccaagtcgcgattccacagcaaggcgtcgcggcgcgcggccatgctgggcgtcgcagcgcagcgtgcacagcacgccgagccggggagcgatgggctctgtgtcgaggcccgtggggcgaccaagaaaccgggcatgcccgcgtggctgcgcgagacgctggcacgcctgctggccgcgccgcctgacactctcgaggccgccgccatggtgacggcctgcaggccagaggcgctggactcgctgaccgcctcgccccgcgaggcacgtggccgtgggttcggggagggtatggggggcccttcaagtcaccctcccgccaatgttgtggagagcagcaatcaaagcaggagccagcccctttcctgccgttccttcctccaactggccggccccactccnnnnnnnnnngtgtggagagcagcaatcgaagcaggagccagcccctgtcctgcccttccttcctccaactggccggccccactcctgtgctcggcaggctgtgcctgaggctgcaccccgttccccactcgtacaccgcaatgcaggcgctgatgcaggcgctgaccaggcctgagcgggtgcttggcctgccgggccccgtgggtttgaacgcgcaaactgaggacgcatgcctggcttggcagctcttcgaggcggtgaggccggcaaggggggaagaatggggccaaggacgaacgggggggggaggccgatcctagtctgcctgcggaaccaatgtgctcgactcacatgcccaagagacaccgccaccnnnnnnnnnngcggcaaggggggaagagtggggccagggacgaccggggggggggaggccgatcctaatctgcctgcagagccaatgtgcacgactcacatgcccaagagacaccgccaccctcccttgggtggccaactttctgctctccgcaggacgccaactgccagaatgtggccgactggttccagagctttgcagacgtgcgcgagtgtcatgggccgaggaagaaggggaggaagaccggctccaaggcggcagatgccaaggtgcgactgagcttccccagtactggccaaggctgggcaagaaggttttgggtcgggcttgcgcgtgagggagccgccgtccatcagcctagaaacacatgcctaggctcattccagtcatannnnnnnnnncctgagcttcccagaatactggccgaggctgggcaagacggttttgggtcgggcttgcatgtgagggagccgccgtccatcagcctacaaacacatgcctaggctcattccagtcatannnnnnnnnnaggccgggtgcgcccttgtcacagtgcatgcttgccatgccggccaccaggagatgtgtaactcatcggcagnnnnnnnnnnattcactccgtcgcaggccgatgcatgtgccgacggtggcgcgcgcatgcaggtcgcggcccgcttctcccaggcggtgtcagagctgcagttcgtggggctcatccgccacgccacgcggaggaagggggattatgtgcagcgctgcatgtacatgccagccatcatgtgagggtcgggtgtgcccttgtcacagtgcatgcttgccatgccagccaccaggagatgtgtaactcatcggcagaaggtcattcactcatttctggtctggcgattacgaatttgtaaggagaagtcaaggggtgtgcgtggagggttcgtcaggcagaggaccacacatttgtatgggagtttcgttattggaagtcggaaggttcgagcgtggctccgccagcatcgcgttccgtcgcgtgattggcgaaataaaagctcacgcagaacnnnnnnnnnngtttggaaatcggaaggttcgagcgtggctccgccatcatcgcgttccttcgcatgattggcgaaataaaagctcacgcagaacgaggagcattacacattcacattaattttcagtcaagtcattcacaagcagctgactgcctgaccacccgtactcagtgacaccatgtcgatggttgccatcccaaannnnnnnnnntattttcagtaagtcattcacaagcagcagactgcctgaccacccttattcattgacaccatgtcgatggttgccatcccaaacgcgatgaccacagtgaggccctctgccgcctcagcaagaccttcccgggcagcatcccgcctggtcgtggctcgagggtgtggacccgggtaccgaagccagggatcgccccgtaactggtcgtatgggcagcctggctcatacggggcgaggtgcgtgaagggatcgggttgtatctcagagaccccaccatgacccaatgtgtggatgcatggtgctgcccgatctcattgcaatatatcacagccaatcacatatcccatctcccacagctgctctccccgcttttggggcccaagcatgggaatgggaatcgggctcgagggagcgttccgtgatttcgagaagatgatgaacgccttcaaggagacggaggtccccaccgagcgcgccgccttcagactccccatcgacctccagcaggaagacaagcgcatcaccatctcggcagatctgcccgggctgaagaagagcgacgtgaaggtgagtgggattcactcgcgctggagaccataatattttcacgggacggcggatctcgcgagagtctctccacaaccccgaccgcccgctgaacatcagacaccgctcttctcaggtcgaggtgtctcccgagggtgtcctgaccatcnnnnnnnnnntttcactcgcgctagagaccataatgttctcacgggacggcggatctcgcgagagtctctccacaaccccgcccgcccgctgaacttcagacaccgttcttctcaggttgaggtgtctcccgagggtgtcctgaccatcaccgccgagaggaaggaggaggctggccagcggtcctcccggtctttcggcgagcggttccgcggccggttccggcggagcgtgcgcctgcccaagtcggcagcaccggagggtatcaccgccaagctggaggatggcgtgctcacgctggtggtgcccaagctggagactgagagccctgagaaccgcatcatcaacatcggtgatgactctgggcccgagtctatggagtttcccccctctcctgctgagtgaggacagggctggatgtattgatgcatgtatatgaaggtgtacatactgcccacattacatcaggatcttattgtttccagctccgcttgaggaagaagtgctgcagcacgaccttatgacctcacccttgctactaaacgaaaccgtcnnnnnnnnnntcatgtatacagaagtgtacatattgcccacattacatcaggatataaccatttccagccccccttgagcgagatgtgctgcagcacgaccatatcacctcacccttgctactaaacgaaaccgtctctactttacaaaacgtcattctaaaattctttgccaaatgcttctttcccaagcagtggctgtggtggttgtgctgtcacagtgtaaatagggtgccataggtagagaagcagagtcgaaggttggtaacgcaatcagggaagcctggcgatgatgagcaactgcagcgaccctaatgtggggctggatgaatgtgggtaagctgtgagttctaaatcctgctccggaggccatggagaatggcccggcctccgcgatgaaatggacggtgcagcagcgcggcattgcagcgtatgtgatgtgtgatctccctcctgctagtctgggcgcagcaccggacctgtcgggcgtgggcgtggagtgtgaggggtgagggggtgaatgcttgcgagcccctcatcacacctggcgagctccaaccctttccggacacaccagctgagacccttgcattcctgcccggcagttgcatgaaccattgttgatactgttccatactgttcaagcagacccttnnnnnnnnnncgcattcctgcccggcagttgcatgaataattgttattactgttccatactgttcaagcagacccttcccaccctcgcctgctccttccttccctccttgctctccagggcccccctcttgtccccgacacggtcccccccctcccacccccgcctcacccatggtggtgtggacttcctggacgggccgcgaccactccgggtgcgtctccatggacaacagcctgccccagcccacggcttcaccctggctctctggcgcccagcgccccacgtcgtgctccgagcgccgagtgatgtctatgaggttgcgcagcagctcctgctccgccgaggcctgcgcctcgcccagccccggccccgtcgccacgtgatcgcggggccctacctcggggtcgagcccctggtcacccagcagcgccagcggcggcatgcccagcnnnnnnnnnntgtcgccgggtgatcgcgggcccccccctcggggtcgagcccctggtcgcccagcagcgccagcggcggcatgcccagccgcccctcctcgcgcccatggtgggggtgctgctgggcgtggtgggggtgatgcccgccgccgtcccggtcgagcaggtgggaggcgtagtcgaagcgccccgccgctttgagcagctgctccagcgcctggctgctgggcttgtgggcggagggcgggggagaggggggnnnnnnnnnnnnnnnnnnnnnnnnnnnnnnnnnnnnnnnnnnnnnngccgggccgggccgggtaggggggcggggtcctggtcgtagggccggtatgcatcctgtgtggcagagggggttcaggggttgggttggggcttggtgcaaccgttcctgccatgatctggtggcgtgtggcaaagctaaacacgtagtccccaggcaccatccccagggctgaccctgagcatggcggcgtagtcgattgagggagaggggggtgccaggctctcaagccccaggggcggctgctcgatcatctggaagttggggccgcctgtggcaaggagtaagaagggaa

SEQ ID NO: 18122 - DNA, 86 bp, Chlorella protothecoides
cccaggcatcggcatcccatagtgacacttcctgccatccagccccaccgtttccgcttcccttgtatgtcttcatgcgaccttgg

SEQ ID NO: 18123 - DNA, 101 bp, Chlorella protothecoides
aaaaaaaggaaatatggcgaaaatgaaaaatttaaagaattaccgattgctcttcaacgacgttacatacatttcgtattagaaagttatattaaaaaaaa

SEQ ID NO: 18124 - DNA, 1318 bp, Chlorella protothecoides
cctccccccctctcccccgccaaatccgccatcaccgccaccgccctctcctccgcccccccctccccctagtctgactggctcgatctctttcaattacctgacgaccgccggagtgaatctgcacatcgatctggcccaatcggggtacgacggttacacagcaaatgtttacgtgtggacgagttatctcgcaaatccatttgcggggggtctcaccttcacaacaccaaccactgacctcatcagaatcaccctgggcactgcaatgaccgcctttgggtatagcagtatccttgtccaggactctaatcatgatattgtgctggtgcaacagctccctctgatctccaactcacccccaccgccctcctccatcggtgtgtgcggcgactccccggtcttggtgagcgactatgggatgtgccccatagcaacccccgtcgtcgtgatctgcacggcgtcgggggtgcccaccgccacgtgcgaggctgggactcagcctgagatacctacctgtgaaggcactccggcctacccaacatccggggtctgctcaggcagcacgcccaccctcattgtctgcagctcctatgccgtgcccagggcagcctgcctgccagccttccaaccacccccaccgccagcggtcccaccccccccaccatcaatttccagcgtctccggcactgccatcctatccggcacctcagtcactttcaccatcaccgcatcggggaacctgccaaacttttacaacgttggctacttcacttctaatgactggatggtgagatccgggcagaagtacctcaccacatcggacaacccgcaaacctggattgatagtctttactcaaccactttggtctcatacttcaagtatgttcaagtggtggcagggaccgatgctggtgactactctctgccttacacaattcagctctgatcatcccccatccttccatcccgccctgagtctatttgcaccctatgactattctcattgcaaaccatcctgtaatccacctacactgggaccttgctttgcaaggaagtgtcggcgagggaaggtggcagaaaagctagggaagaagagataggacgatagcatagaagggtatccaaaccttgattgtgctcactgtccgctgtaccagcactgcgtcccaaggtaggcgcatgtctcgcatgctgaccggtgccttgtggagcgcagggtcctcgattactgcgttgctgcggtgatgccggtcccgctgttcccattcgggcagtagatgccaatggcccagggcggtaggagtctggtccgtcc

SEQ ID NO: 18125 - DNA, 328 bp, Chlorella protothecoides
agtgcccagctcctgtcaagtcgtcccaggtggtgcaccgccgcacgctccatgtgcgaagccaaccatactattaaagtcaacagcaattcatcggtgcccaaagaatcaagccatgggcagcgagattggttgtgtccaaatttggcagcgcgactcgaactaggcgccaggggtattctcactgaagatagcaaggacttcgggaattacagatcaatcccggcaactccctgctcctcaagaccaggactggttctgagtgtattgcagaggatccctggtgtgctttgcaggcatcatcacttgttccagtctgcatcggctc

SEQ ID NO: 18126 - DNA, 96 bp, Chlorella protothecoides
ccgtgttggtgtggcagctggctatggtctgcgatgtacgtgggctcatgacgggtcagcactgtccatcccctgctcgcgaggttgctagtctgt

SEQ ID NO: 18127 - DNA, 389 bp, Chlorella protothecoides
ctcttaataattctttacactttcaattagggttagctttagcgagtcttggcacaattacatctttagtagcacaacatatgtattcgttaccaccgtatgcttacttagcgcaagattttactacacaagcatctttatatacacatcatcagtacattgctgggtttttattaacaggtgcatttgcacatggtgctatattttttgttcgtgattatgatccagaagcaaatcgtggcaacgtgttggcacgtattttagatcataaagaagctattatttcacatttaagttgggttagtttatttttaggttttcatacattaggattatatgtacataatgatgtaatgcaagcttttgggactccagaaaagcaaattcta

SEQ ID NO: 18128 - DNA, 119 bp, Chlorella protothecoides
ttttttgattttaaagatacaaaagatttaggtagattactccatgcttttgaaaggtgttgaaataatcctagatttttagcaagagatacacgagatgctcttggtatacaaaaaaa

SEQ ID NO: 18129 - DNA, 13761 bp, Chlorella protothecoides
tgaaaatttccggaaattcacataatcgaacatttcccattttcggttaccctgtcgccgcgaaactctggtgcccaggtactgcgtgcatgaggacgacaggcccatctgaagccggtttgcaatcttagttatgcagaggattcctaggcatgtgcaaataggtgtaccttacctcgatcgacctatgtcccccccgcagggtagtattcctgtcggaagcacaaagcctctaacctccgtgtatcgacctgcttgaggccatgcaactcgtactaatcgttttgctgatcggaacagcaggcctgcaggttggatcagggctcgggtcgatccggttaaagtcatggggccccgactatcggcaactaagggctcccagcaccctgcaaaacacaggacgcagcgggcgcaaatgatgggactcaagattggccctcacatacggatgctggttacatggccatatgcctctcggctgcaagtgaggacttgaagatttgaggccaaagacttccttttgctcgctcagtcaggctaccaattggaggatcacacatgatggacttcttcttggtgcatgtgtcatccctatttttgtgccttatcacagtcatcccctcccttccctgcagacgaacaccgtgatatcgttgattgggccacttaccatgaggcgcggggcatcgacaagatctacatcatcgacatgggcctggactccatgcagccagagctggagaaggccggcctcatccaggtgtggctgcagccaggcctgggagctgctgcagggtgttgaaaccccgctgccagtggctggccgtctccggcccgtgcctgccccacccgtctccaggccactgcaaccccctccccctgtgcccccttgatcgcatccacgatgagtgaatcctccgcaccgcccacccacacgccggtgcagtctggcgtggtggagcaccgccacgtcagcatggccgcggtccgtgaagacctcctgaagaacagcgggctgaaaatcccgccgaacttcaagcagctgcaggcctacgagttgtgcctgcgtgaccaccgccacaagcaccgctggatgggtgcggtgggtcatgggggtctatgccgctcgtgagcaagggggtttgggaggtgctctccagtgcctggcttgacgaatatgcagaagagaggcagcctggcttcctgggacctgcctggcttgtgcatgaagggtttgtagcggtgcatgccggcctactccctgcaccctccaagcggccgctcacatcctgtcgaacacgcatggtccctctgccctcctcgattggatgtccgcgctgtgcctgaattgcagcaatgtgcacctctatcagcccgtcgacccatccccgcagccttcatcgatgccgacgagtacctgacggtgctggagcccgccgcctccctccgctccatcctggcagactacgagcacctggggggtctgggggtgcactggcggatcttcggggcaggtgggggctggggtgcaggcctgggtaaaggggaggctctgaaagggggtggacggcactcaagattcaagggcacactgtaccccacgccgtcggacacatgtttgcagtgacagcttcttgggtcgcctgatcaccatgttctcagaggcagtcattcctgtgtgcgatccggagtgcccattgcactggagctcccggccacccttccatgctccccgtctcccacctcgcccccacttcctctccctgtctcagcggggcgcatcaggcgtcccagcggccgcatcgtggaggactaccacatgtgctgcgcggtacggtccggcgaggaccgccacgtcaagtccatccttaacacggagtttgcacagcatttccagtccgtgcaccacgccaactacacggggggcagggtgacgacaaacacctgcggcgaggccatcccgcgctacacggcggcggcgccctgcctggagagactggcactgcggcactacgtcaccaagagcctgtgggacttcacgcagaagctggcgcgcgggagcggcatgtcgcggcgcaaggactggacttacttttacagggtgcagaagatggcatggcaggactgtaggctcccagcggcctggcccctggggaggggccccgttgatgaggggggcctgggggcggtgacagcttcctgagcagctgcaggggccctcttgagcccagggcacacttttggagcccagtgggcggtgggcccctccaccgctctccatgccgacctctttgggctgtgccggtcccactcagcgtcacatggacgggtggccatgcccagatggtgcatggcaaggcagcagccattttgttagcatgcacagcacccccagcatgagaccgggatgccgaccggtcagtcaggtaacggcagcctgtaagatgctcgatcaggatgttcctaagttgagcctagcgagcaagtctgagatgttggactgtcgccttcaaaaccccatcgccttgctcgcgggccaagggagcatctgagagccggccaggccccctttccctcaacagacaacggtattcgaacctccaccgtttcgcctgcatccggcaacctcgatgcctgtattgcgcaacctatcatgagggcatctgttttgcgatcgggttctccgcggcagagggcctgggcctcccgcgtattcctggtggtcatagtgtcagctctggtggggtggaccctgatcccgctgggcagggtgatctggcgcccagcaacaagttattccggccttgaagccgcgaacatattgaagaatatatcaggcaagatcagcctgttggcagatgttctttgttggggtcgtggctgtgctttccccatggtgcttggcacagacatcgcgcgtggcttgctcgtccccagcccaccctctgcacataccttggagggcatgccctggtcatagatccatggggatgaaccctctgtattttcaggggggcacctgaccccaggcagctcccacccactcgcagccaaggacgggcatacatctggaggcagggccgcaaagtttgaagctctggctgccagggcagagtcccaggccccccttgtggcctgccccgcgccctgggattggaccctggggcaggtggatgcctccaagggtccggtgtgcgattccggcatggcccgcgctgcgtatcgcctgctcgacctggccaccggtgagggcaagctgatgggcctggaatggggtacgggcacgctgacccccctcttcctccagggcaagctggcgggcctcgtcagcatagagcacaacgccaccgtggcggagatcgcagcgcgcgtcaagcaggtgaggagtgattgggcggaggatctgcggcgcctgcatcgccgggcttgcatggtgacaccgacccacagactctggcacaggagaatgcaacacagctggaaagccgctgggcacagcgcaccgctcccctgccagatggttcagagccgggggaagccctgcaggcctacctcgacctcgtcaaagatgggaaaccccagtaccaggtcattggcatctctggccccgctgccatagctgcactggagaggtctgtggcgctcctagtgcccaaggtgggtgtcgagggccggggaggggggcgcctcgccctggctacgcactgatccaatgcggccggtgctgctcgtgctgaggcctgcacccgcagagctccactgctctgcatgcccatccatggtgacctgcatgggtctgggcacaggacccctcattgcaggctgccctccactccagccccttccaatgcaatgacttgtgcaggggggcatcatcatgatgctgggccagggggaggcggagctgcaggcggcaaccgccctggcgccagggcactggccgcggcatcacagcggcactgcgcggcgctggaccctgatctggcttttctgctctgcgcaggactgccacgagaagtgaccgccccgcaggactggctgcgcgacctccggtcggcctggggacgagcgaggctcatccctgctgatggtccggcgcacaaatggcgcagcgctgagcccgtggctgcaaatcgcaactctcctggccgcaactcgcagctcccctggcctgggcaggcctgcagtctcaaggtcatgtgcagcctctgctgggaagctacctatgcagccccatcacagtcttctccaagcagaaaggggtggctgggcgccatggtcaaaacctcactgccctccatgctccagctcacccgtgctgggctacctgcatgttgcaggagggaggctccactgcaggatgatggtggtgggaagatggacagcggatgatactcacttctccatgatgtgcccacttgcagctggtgagcatttctacaccgctaaatcatttcgcttgtagcaccaaaatgaacctctcaagcccgaagatgagggcgctaggcatggctgacccctttttgcgcaagttccttcccaccggctcaccctacaaagtgcaactactagacgcaagctagatatgcatgtttcattctactctaccactgcatcgcatgcccattcatgtccaggctgttacactctctgcccgcaacccgctgtaacattggcagagtgagctgaaggacgcatgcagatggtactcgtggcgagaggtaggtggaaggagaggcacagggctgccggaaatgctaggcatgcatcatgctgatctccttgatgatgacagccttctcctccttgaactgctcatcatctgcgtatttatgcatgggtggggtctacgcaggtcggatagcctggagaagcctgacccctggtcgtctaatgaccgtgatcgacccagtcgcagcaagaattgccatacgccaccacaagcgcctccctgcccacctctatcgttgtggaagtcctccaaatatgtcagcaacttattcttgttgttcacaaggatgtcggcgaccggcttggtcttgttgggattggcgacaaagaccttgggagggcgcgagggggggggatggacaagacttgagctgcaggctgaaagattacgtggacaagtatcacccagccaagtccctggcagcaagctcaagaataacttgcttactcccagcagtcactatgggcccctgccgacacatcaaacaccagtctagaggcagctgtcgccactcacacgatcggtccagtcacacaccatgtgctgagaagacaccacccggtcctcaccttgaaaacatggaaggcctcgaactggatggagcgtgaggagtccttgagcaggttcatcatcaggatgaggttgttgacgtccgagacatactgcatcatgatcttcacattgactctgtccagtaacagctcccccaggagctgagtcagtgggtggaggatgtgtgggatgagatgcctaacatgccgggaaccatgccgagaggtgtggtcccgggtgcaccggactcccaacctgcgcaatttacactgcggccacccatgcactccaagcagcagccaggtgcgtgcagcaagcatgtgcagggaggcacaggaggtaccttgagagattgtcgtcgggtgacatagttatcggatgtgagaagcttgtccagctgagagaaaaactgtgagtggaagggggggggccaagctttatctggtagatgcagtcaggatatacgggtgaaaggggaatgggggatgctatggggcagcaaaagccctccatgagatatgggcgacacttggcgttgaccagcgtcaagatccctccttgcaaatcagttttgttgccaagcacctcgcctcctcacatcttcatagttttcttgcaggaatgccgcaaccagctgcttgtttcgtgtgaggaggtccttgaacgtggcaaatgcatctgatgatcggggtgaccattgatggacaatcggcaacaagtacaggtgccgatgaccagttccgtttcagccgcgtcccaggtccctgcttctgcagccctacgcctcctcgtaggcatacaagatcacaaatccccaagggctgcatgcatcctcacactcacctgatgcaacttcaaagctctggacgttcagcttctcaaagagctcttcaaagaggttgcactccaatacaaatctggcgggcacaattgaggttttgaaagttggtggagggcgaggcaactctgaaattgaggagcacaacagcgctggacagttatgtcctgttatatttcctgttctgatagcattgccatcccagtggagctccactcaaagaccaaggccagccaggcggttgcattcaactcacttggcgatgtcttcatgtcgaatgcattctcggaacatctgaccacaattcagcgcgatctcagggtcctcatacctggcagcagacaggtcagatggagccatgggtgcggagatgggaaattgaagctatggatcttgggcacacatgaccaggactggcacccaccaagtcccacaagcagggggcaaatggtgcgagtgcagcccctcttgggatcaccttgggagatccaaacgccccctcttgcaaaccccctcacccgtagaacagggtggacagcacatctgggtgtgccaacacgtagtccctgcccggtcttcccccatcctccagggtgatgcggatgatggcgcagaagatctggaccacgtccttccgcgtctcaaagtccagcacggtcaggtaggtcaccaggtcgctcaccagaccgaccctgcaggcctcgctggcgatcccctgggcatgctccttgctgctggactgctcatcctcaccaaagatggcctcctgggagaggtgagtcggggtatcgggggtattgaaagggacgtccgcgaattcactaccgaggagacgccctccccggtcccgagacccatcaagggacccaatcttcatgcctcgacccaccttgatggacatgatggctttcgagatgtcctccaccacccgatcctgcttgctctcgtacggcaggcgctcgaaggactggtgggccttctgagccagctccgccacattcttcacgcgcatgcgctgcaggaagttcatcacgccgtcttctagaggctccactacgcgatcgtagacatgggggaagaggtggggcaagggtcggcggggcgctatcttgctcgagcccgcctgttcagggtggacggcaggcgccggagcggagcgtagtactgcttattctcactcaaaggcgaccgatcgtatcgacatcggtcctgcggtggggactgcggccctaggggtgggcccaggcgagggtgagtgccggggcacccctccgctcagggtacccgccccgggttcccaacatagagaatcctagcgatcttagaccgacccattgagatgcttcatagagcttcatgccaggaactggaggatacattcttcaatgacgaaatctcacaaaaatcagttcaggatgtggagtcccgaggcctgcgggcattcaagtcgcctggcgtgcggccagcaggaaaggtctgatgacctttcagggcgcaaacatggagcatggcccccgcgtgtcccgtcagggcgtgcaggcacgtggattggacgtgcgtgctggtgcagatgcgttccggatcggggcgcaggggccggctcatcgccgccctctgccccgagtgcggcggctgcctgcctacaccccgcccaggcgctccaattccctggagatgatgacccgcatgatctcgttggtcccctccaggatgctgtgcactctgaggtccctcatgtacctttccacagggtactccttgaggtacctgttgatgatggtctcggtgggggaggtgtcggtgggggaggtgggcggttgggtgggtggaggctcacgtgcggcagccagcttgtactggactggcagacggacagctagagtgtggaaggcacacatttgaaccaaaccccctcgctgaacaaactacaaaagagcaccgccccctctcacccccattctttgccgagcagaccagtccccctcccacaaacccacgctccttgcacagaaaaccgctctggccccaccgtactccattccaatccttacagtgcaacccccctcctccaccccctccaccacttgtttccttgcctcactggacaaacatcacccccctcgccctcaacaccactcacccatacccccccagcagctgcagcgcatcgttggtgaggtcatagcaggcgtcggtggccaggcgcttggccatggcgcaggccatggtggcctggggcgcgcccgcgtccagcgcgcgcgcggcgtggcgtaccgccaggcgtgaggcgtgcagcgcggtggccatgtcggccagccggaactgcgtggcctggaagtcggccagcgggcggccgaactggcggcgctctcgcgcatggcgcgccgccgcgtccaggcagaaggccgcgccgcccagggagcaggcgccaatgtttacgcgcccgccgtccagcgcggccatggcgatggcaaagccctggccctccacgcccacgcgcgcgcgcgccggtacccgcacgccgtccatgatcacggcggtcgtgggctgcgcgttccaccccagcttctcttcccgcttgccgaaggacagccccggtgcgccctgcggtggggaggtggggggagtggatgaggtgggaacggacagaaaagggaggcggaggggaatttggtggcgtggttggtggggaagcaagaattgggagggagggcgggaggtcgatgacaacaccggggcttccaacacatccaggcagagaaaggcccccctggctctccacccctggcggggaagcgcctccccatctccccacacacagagtcgcctcaccttctccacgaggaaggcagagatgcccttggggccgggcgcccctgttcgtgccatgaccaggtagaggtcggagacggagccgccggagataaaggccttggagccggtgaggacgtagtcgtcgccatcacgcttggccgtggtcttcagggaggctgcgtcgctgccagagccctgcgtggggaggagggagggtggggaccggctatctggccaggaatgcatgcctgacgccgcctcgtgggtcagtctggcctcacgcgacaggcgtgccagcggggccagagtttggggagtttgagcaccctactgtaccaaggagcatgcctgcatctggttgagggcgtgccatgccccgttcagatttcgcccccttccctaatccccaaacccctctggtcgctcacgggctcggtcaggcagtagctggccagcacctctgcggtcgccatacgcggcaggtacatctcccgctgctggggggtgccgtagcggtcgatcacgcctgccaccatgttgtggatggacaggtaggcggtgacggggacgtcgccataggacagcgcctcgaagacaaccgccgcgtccagcctgctcagcccactcccgcccacatcctccgggacgtacatggccccgaaccccaggcccgctgccgctcggatggtgtcgaggggaaagatgtggcccgcatcccaggctgccccattgggggccagctcctgcctggcaaaggcatccgccatgcgcttgaactccagggtatcgtccgacagactgaagtcctcgctgtgagacagatcatccggctgctggcatgcggggggggtcgtgtgcaggcaggccagtcggcaggcgtccctcacggggaggggactagccctttggcacacccgtcggagagcctgggacagcatgacgaggtggatcagacgccccgacgaatttctcggattggcatcggcgcctgtttcatcctgcaggaggcatgcaggcgtccccggtgtctgcagggacgcgtgctcaggccgcgccctgtcggtgattcccagttccggagatcgccgacaccggggctgagtaaagttcctcagggagatttctgcatggaggccggccccaacctaggcgcacacattcccttcgctcatcacatagcattcaagcatgatcaaacatgccaagcagcacctgcacggcggcgtcataaacagggggcctggcatgcaccctgtccttgttgcactcattgccgcaagccgccatcaaggcgtgaaggttcagcaggcgccaagggggctgctgggcaaactccgtcaggaggcggttgtaccgcagggaattcaactgcgcctctgcccaggtctcgtttgagtcggtccactggatccggtgaggacagttcagcacgactggatgcaccccctgggacagcagctcctgtgcaggggtgtgggccgatgggagtttgttggtagcacaatctggaccttgtatggcctcaaaaaggaaagagcatcccgtgtcaaaggataccacgccctacacatctcgtgctgtgccgagccagccttggctctgggctggcagattttgtcacacaggctctccgtgcacccactcccacacctttccagcgaggcgcagtgtctccaagaggtccttccactcctccaaatccctgatgaagccgagatgccatgagcagaaggatgtcacaactgcatccggctttgtggtgatggtcgtgaggttgtgcagtgcttcactgatattgagtgggaaggggcgccaccagaactcaagggcgccggccgttcccggcagggaatagttcaggtccgagtgagcatggggaactgtcactgcagcagggggagcatcatggatggcaggtgaacgctggttccacatgctttgcaggaccagtcagactcacaccccccgggctccagccctgggtggagttgcatgtggtgggctcccctttgggggaatggtccatcgccaaagtgccctgacatcgatatggtaagtgcctcaactcaattaacaaaccaactcttccaagctcggacatggtttcaatgtgccacccaccattgcgtcccatggctctgagcagagtctggagcaagtatcttgcaatggagtctcccatgaagaggatgtgcttgctgggcatggttgcgttgacaagctcgggcggctggtatatcagaccgcactgtgttgcgcgcgaatcgaatcgccattgcttgccgaagctcgggtcacaagtagcctcaccacggagagggggacagctgctcctgttacctggaacccatcgtccctgattcaggtcgttgtcggaacatgggaatatgtgggggggcgtcaccctgcgcgcaataggcgaaatgttttaggacaacagacatgagcactggatcgaagaatattttctcacatctgatcttgctcaccgttcaccaacactcatcggggcaggaaatcgtagccatgcccatgtcagtaggcagataccggtaacacccagccagattgtgaatgcctgcttcatgttacgttgcaagacatgttggatgcaccctcgaacgcgcaaataattggttgcaggcgtgtcgatagtctgttgattgctgaggcccgcgcctcttgcaagcgtacttcgatgtcgcgcaagggacagctggcccgcatcgggcgccaagcattctcatggataccctttgacacaacggaagaacaatgaagttgatcacggcaactgaattcaagctgcacgccagtgacatcttgcatctgtatttagtggattctgctttagtgccattgttatcagtgtaatatgacccagtaaggcacaggctttcaagtttgccctgcattgtcccatatgtctgccccccggaatggcaaggagtggtacattggaaagttatgaatatgcaagcatcatcaccatgtctgcacggatggtgccccagacatttcctgggctgggctcgtcaagctgggtgcttgagatgcgcatcgcaacctcgatgggacaggggtgtagacccttcccggccaccgtcggcaagccgtcaaaaattccaagtcagcaattgcacacgagcatgcaggcggcatcagaaacatgtgttgatcctgagcgggaagtcctggtgtcaggcttatcagcatgcactaatccaaggggccagccggggtcatcgttccccctcccccaagaggggccccgcgctcatccccagcaggacctgcaccgcggcatcatacacgggtctgaaggcgtgctcccggtccttgctacacgggtccccgcagttggtgctcatggtgttgaggtccagcaggcgccaggaccgcagcgtccggctcatcagcacctcgttgtaccgcaaccccaagggcttgatgaccgcccactcatccgtggtgaggcgatcctggacgctgtgggggcagctgaccacgatgggtcgaaggccgtcggccgcgaggatctgcagggagcacggtggggagggggtggggtggggttactcaccaggaggctcaccaatgatgactggtgtggggtggcatcgacgcggtacagcccccatgttcctcccacatgggaagcatcgtccacgggggggcttgccacagcccaacgaggagcttgagagggcatttgctgcgacatttcaaagttccagaatccagaggcaatcggccccaatcccatcccatgcaccgaccttgactcctgcatccacctcatcgagctgcctggaccagtcgctgatgttcatgacagagtggaggtgccaggcgcagaaggaagccaccaccaggtctggcctggcggtggtgttgaggatcctttgcattgagtctgtgatgttggacgggtagggactccaccagaagtccagggtggcattggaggctgccagcgggtaggtcatgtccatgtgccacctggggacggccgctgtacgacagggagggaggttgccggggaggggctcaggtggggccaccgcagggagaacctcagcactggcatgatcatggccactggcccgagtaccacagggctgcatgtggtggtcacctccctagatcctgggtaacaacacattcccgagcactccaccgccatgccccttctcgacccgatgcttcggacccttctcatcccacaccattcagattcccagagaaccactcccatgacccaccgctcctcccagtcgctctgagcagggcttcggccagataccgcgtgatggaatctcccatgaagaggacatgcttgccggccagcgtcgagttgagagtggcgggggagcgatatcgcatgccgcactggtgtgcacggcggctgaacagccactgcttgccgaagttgggagcacaggtgccaaactgcgctggtggagggcacgttgtggccccgctctcaatccaggctccccgattgaaggtggcgtcggtgcaagggccgaactgcaccactagcctgtgctcgaaaggaggtggcatgagaagacaccatgggtacttgcaaattcaatcacacgaaaaaagcaaatagcgtctggcggcagcacacctgttgacgaccaggccagggaaggggtgtcggacagcgcaccagaccaggaaccaaccaagagcgagaccaatgacaatcctgggctcctgcgccatgcctttgtgaaagagtgattattgtaacattcgtgcaagttgcgggatctgagttccgaaacagatccctaccgggcttgcgccggtt

SEQ ID NO: 18130 - DNA, 230 bp, Chlorella protothecoides
tgtgcgacaatcgcacttgctggtgccggcgctggtattggtattgtatttggatcattaattaattcagtagctcgtaacccaagcttaactaaacaactatttggttatgctattttaggtttcgcgttaactgaagcgattgcattattcgctttaatgatggcattcttaatccttttcgtattttaattattttcttgtttggagaaactataatcttatatgat

SEQ ID NO: 18131 - DNA, 5356 bp, Chlorella protothecoides
  modified_base (207)..(270): a, c, t, g, unknown or other
  modified_base (2608)..(2675): a, c, t, g, unknown or other
  modified_base (4182)..(4234): a, c, t, g, unknown or other
ggcccgcgccgccgccgcgcctgtcccgcctggacgccgcgcgcgccgaggcgctgcgcggcggggacggggaggccctggcgcgcgtggaggccgagctggtggaggccctgctctccgcccagtttgggccggcggccaccgacccggagacggtgaggggagatgtgtgtgggtgttgtgggggatagtggggggggggggtgnnnnnnnnnnnnnnnnnnnnnnnnnnnnnnnnnnnnnnnnnnnnnnnnnnnnnnnnnnnnnnnngatagatgggtggacactttgggctgggcgcgcgtgcgtcgcccgccgctcactgctgtgcactgggaggcagcatgcgccagctcgaggcaggctcccaggacaccccccctcccccatcctcccgacagggcctgacgttcctggaggtagacggcgcgcatgtgctggtggactgcaagtcgcgcggcgtgcggtgcgcagacgcggggctcaaggcgcgtgtggagcgggcgatcacgcggttggaggcggccatgcgcgcctgcccgctggaggggtgatggggagcgcggtgccgcaatccagaggtcaggtgggtgtggagcacggaccaggcggccgggcgaaatattcgggcgtgcaccaggagttcgattccctgctgcgagctcaggagggcgccggacctggcatgcagtcctgttgccaggctccagccttcaaatcatgtatccatcacctcacgcccatgtgcccgcgtctgccccctcttgaatctctcatactgcattggcatgcaatcgtatgtgtatgtacatgcagcaggagagagtcagacaagggcagcgacccagccgcacctaacgccaggctccctacatggggctgagtaactgcagcagggtggggcggggctcggtggtcaccagggcgacgccgatgatcagtggaataaagcctatgtgcagggcagtctgcggtgcgtggagggaaggaggggggggggcgcgctgctcagaggcgtgctgcataaggtagaacactcgcattcctacaccggtagctcgacaagcaccgcccgcagatctcagggaggccctcacaccacccattccagcccaccagagcatagggtgccacggtctcgtatgccttggaaagctttgccgtcaggtcctccgtctggcttggccttgtgtatgccgacgtgctcatccttgagccaagggacggtccgtgcgtgtcagcgagcaggttggggaagcgtggagagattattctcttgcgaacgagtgtgtattcgacgcttgggtgtggctgggaacctctaccgagagcacgaaaccgtcagtgcgcgccgtggatcctcccgccatcagtgccgagcccttcgtgcaggagcggtgacatcattccccactgactacctgaagtctctacttaggcacatcaattgaggttgtactcttgtcagcaacaggtccaggtgttgaccattgcgacgtacaagggaggaaaaatgccgccagtaaacatagttgttggaaaagtcagattgtcatcacgggaaaatcccgtcccaaataggtcgaggtccggtgttcgatccaccgtgggagcaaccccaaagctcctatagctcagtggtagtagcgcgactttagtacgattcttttgccactgcttgcatttttattgggctgaagatcaagcagctggcgttcgatgcctcttttagccttccctgctccattcatcgccgcttgtctttgagactggggaggctgccgtctgaatctcttgccaatttccctgttctaaccacggtgtaataccaaaattgtggaaccggtctgctcacctatgcctttatcctgacccgtcatctcatccagagaccaccaccatgccgttcaagggatcaagggcgtgtaaggagtagagcttccgactggagggtgaatatggaagtgacagttactgccatggagatgattcacaaggcaccccatttgctcccatccccttcccgcccagctcagatgtccaggttgggtgaggatgattggaattctggatggcgtttacagagcatgacatcacgaaagccccaacagatgggtggttgccatttatcgatcacggtgctggattctccatcagatgctattcaagggtgagaggcagtagcctccacatgaagacattttgctgcggcgctgtcggaatgcggccctgccgggtaccgcccgccaatgtcagcagggcaccaggattcctcgatgccagggtaactcacccctggccaccactgggaacgtcgctgcacccaccgcggtgcaggaccctggtgcagtgctcacacccaggcggccgtcactgcttggagggtaccagtgcctgctggaccaccggcccgtcgcccacctggtgggccatcaggaacccgtcgccagaaatttcagcggcggccatctcaccaagggccacgcctgccccgggggcccccggtgagatgtccagggtcatgacaaccaaggggggagtgcggctgagggacacggaggggcgcgggtttgtcaccaggatcaggtacgccttgccctttttcacnnnnnnnnnnnnnnnnnnnnnnnnnnnnnnnnnnnnnnnnnnnnnnnnnnnnnnnnnnnnnnnnnnnntgctctcgctcacactgcgcaggaatggtagattggggggaggggcttggcggggggatggcatgtgaggacgttcacacccatggtccattgcctgtgtgtatgaatgtgcctctggagagtccagggggtgatcacagttgacttgctggctgcagagggcccaccacccccgccaagccatgcatgcagccccggccagcacctgatctgctcgagggtctctccatccaggaaatacacaactgtgggggcagtggtgacgttgaagcaggtgctgatgtccacaagggtgctcaggggggaactgaagtagaacagctggcccaagggtgagggatgccagtgggctttgtaaggaatgctgttgatgctggggacctggccgctctcctcaaacgcagccatgacctgtgggcaccgggagagggaacatgggcgtaaataccggctgaggaggggtagtcagggatctcaaattctgctgatgttaggacacaggcacagcatgcagactggccagccatgggctcatactcccatgaaagcttgcaatggagtcgccgggcggcatcccaccttctcgatggagagggcgtccatgcccacggcaatgtcgccctcaaatttattggaagtgccgggcacggcaaatgtggtgacggggtacactacaatgtagtaggctgcgggcagggagtgtttgggcagggatctgtgccggttacattgagagctatcagggagcctgcaacggggcgaggggcccgctccaccatgcaggaacatggcagcattgccacggccaaggccttcccactcaccgagacaatcagggcaaagcaacaagccaccacccagtgacacatcttcatccccgacaccaactcactgtcgctcccaggcagtgcggccaccagctgagagcaaccctcccccagctctggcaggtgatgtacgaattgcctgcacgtagtacggttcagataacttacgaacagcatgctggggagcgattgttgtccagatcagaacctctggaacgacagtgcactgtgttaccagatggggatgcaacaggtgctctgaaaccctgttcagctgcacgagattcagcatgacaggaccggttaagaatctgacacctgctggcaccacattccgacccaaccctcgctcacgggatccgggcctcggaggtccagttagaattgtagacggtggcggtgagggagccatgggtcatggacgaggtgacggggcacatcgccatcgagaggccctgcgtgcaggagtatgttgaatggggtggacccgggaagaaatgggggcaagggagggatgggtgcagggcagtgcacctgggtcttgagacggcgcggcctgggaagaagggggtggctctggtgtgcgaacatggtcccgacatgcagggctgcagggcggcacccggagcacgccccacccaccgtggcagcggagggtgtgtaggagaagtagacgccgnnnnnnnnnnnnnnnnnnnnnnnnnnnnnnnnnnnnnnnnnnnnnnnnnnnnntccgttggcaaaggtgatgaagggcgcctgagggttgaagctctgatatgcgggaaaagggaggtgtggtcagaagtagttgcacaatgaatcagcatgggactgtgcctcgttgcaagcattgccaccggcccgcgcccaaacgcacaggtgcaccccatccatgcaatgtcctggtctccactccaggtcccctcaccgagatgctttcctcaaccgcaaacggaaggctgtccacaaccactggattgaagaagctcgtcccttgcacgtcgctccgcacaatacccctgtgtgtgaacatgcatgaaaaaggggtgtactcaaagtgcgaccaggcactagggcagctgcaaagagctgtgcaggctggggcatacaacccctaatcctgccggggagtctgtcgcccaggaagctggggcatgcctggcatccaggacgtcagcacaggggccatgtgcccatccaaacctctcacgtgatcgtcttggtccgcgatccatgcactccactggaagacaccgtgggccatgtgaggctcagctcaaaagactcggctgattccgtttcaggaatagtatccactgcgatatttggagaggagtgagacaccacatgtcagcatcacagacctgcttggatgcagatgcccgaaccaccccattccactacaccatggcttgacagtcgcttgctattacactctgtcacattgatgtacgttccccaggcccttctctcacaccaccaacacgctgccctcacctgcggtcaggtagacatactgcggcgtgctccagttgctggcagtgaaggtcacagatgagggcgagacgctgatcaaggtcttgtccttggatgcaattttcactgtggtcgtgtactgtggggcctgctgcagcctgtgggagaagggaaggacagtgaattgcactgagttgttgcttgggggtgggtggtcggcaggcctgctgcacagtctccacagacagcctcgaccacaagctgattggtccgtcaacaacgtgaagcccttgtatatctttccagcccttccctgcacgccatcccttactggatggagatggctgcgggccccagggtggggttcacctccgg

SEQ ID NO: 18132 - DNA, 122 bp, Chlorella protothecoides
aaaaaaacgtttatttaattttatataataaaaatttatgttaaacacacaaattaatatttaatcaacctaaaattattttatattgattgtcgaggcgtagatttatcaccaagtttttg

SEQ ID NO: 18133 - DNA, 92 bp, Chlorella protothecoides
ctttttatggtggtgaattagatggtgttactttttctgatcccgctactgttaaaaaatacgcacgtcgtgctcaattaggtgaagttttt

SEQ ID NO: 18134 - DNA, 176 bp, Chlorella protothecoides
ttatattaaattttcacaacgttgtagtgacttctgcgaaagaaataacatagattttacaagatatcaaaaaataaaaaaatgttttcaaggatatggtactgtttctgacaattctatagttgtgtctttacaacacaaacctgatattatttttttatttaatccttctgata

SEQ ID NO: 18135 - DNA, 67 bp, Chlorella protothecoides
gaagtttttgaatttgatagatcaactttacaatctgatggtgttttccgtacaagcccacgtggtt

SEQ ID NO: 18136 - DNA, 61 bp, Chlorella protothecoides
atggtgttttccgtacaagcccacgtggttggtttacttttgcacatttaatttttgcttt

SEQ ID NO: 18137 - DNA, 139 bp, Chlorella protothecoides
ggccggcctgctgggcgcgctgcgcgccaccgccgcacagctggtggccgaggcggtggggcccgggggggactctgccgaggagggcgccggcatgaggccgagggcgggaggcgcccgcgaggccctgaccctggac

SEQ ID NO: 18138 - DNA, 85 bp, Chlorella protothecoides
ttttttatcaagtaaagtctcaaattcattaagtccacgagctaattcttgatataaaaagtctccacaacctctaattttttta

SEQ ID NO: 18139 - DNA, 64 bp, Chlorella protothecoides
cctgtttcagtgctccttatacccccttcatcccagcatcgaagcacaggaattctggcagctg

SEQ ID NO: 18140 - DNA, 68 bp, Chlorella protothecoides
catttacaacaagtcatccccctgggtcacaccaggttaggagccaacaccaccgtcaggatggccga

SEQ ID NO: 18141 - DNA, 87 bp, Chlorella protothecoides
aataatcctggaatttggagttatgaaggtgtagcagcatctcatattatattatctggattattatttgcagcttcaatttggcat

SEQ ID NO: 18142 - DNA, 83 bp, Chlorella protothecoides
ttttttgtcttgttaatagtattaacgagagtattatagtaaaaaacgtcatatcaataatagataaagcgttacatatgtaa

SEQ ID NO: 18143 - DNA, 61 bp, Chlorella protothecoides
ttattcgttgatgggtttcaaaataaagagtataattcgttaaatagtgaaaatattttta

SEQ ID NO: 18144 - DNA, 61 bp, Chlorella protothecoides
gctctgtttcccattcggtggtgcggcaggtgtttgatatgaatgacacaccagcgtcaaa

SEQ ID NO: 18145 - DNA, 63 bp, Chlorella protothecoides
gtttgatatgaatgacacaccagcgtcaaaaggtcgcgcccatcgtccaacggcaccggctct

SEQ ID NO: 18146 - DNA, 248 bp, Chlorella protothecoides
atttgcatatacagtaataccatttgtttcattttctgatgcgccagaagcatggcaaattggttttcaagatccagcaactcctattatgcaaggtcttattgatttacatcatgacattcaatttttcttaattattatattagtatttgtattatggatgatatctagagcgttatatttatttcattatacacgtaatcccgttccagaaaaaatcattcatggtacagtgattgaaattgcat

SEQ ID NO: 18147 - DNA, 11899 bp, Chlorella protothecoides
tggcgcgctggctggccgacgcggaggcccggggcgcgcgcggcgcgggcgcgccggacgccgccatcgtgccggccgacgacctgtcggccgccgcactggccgtgcaggcgcaggacctggccacggaggacgcgctgtacgtgctggacggcctgctgaacaggggcggcattgcgccggaggcctacctgaagcaggtgagaggcgggcgcttgcgggggcgtgtgagggggtggtggagggcaaggtccctgccggtgttcaggacgtgggtttccaagcttggaccagtaactcaccccccatcccccctctccctcccctctccaccaggtgcggtcgctgtgccgccagcagttcatgctgcgcgcgctgggcaacaagatcgccgcggcgcaggagggagcgcgcggcgcgcgcgtctcgccgccgcgcgcgccgcccaacgcctccggctcggcacgcgacctggcggccgccgccagtgggtacctgtcggacgcggtggccatgcctctgggcgatggctgggccaacacgggcatcctcagcaacccgctggtgggcagccaggcgcagcagcgagggcggtgatggcccagggtgtggcatgtcggtgaatggtgaggctacgtgagactggacggcacaggtggagctggcgtgtgctcatgagatccttgcgtgcgtgtgttcttctggaggggcgcgtcgagtctggtgcaaccccagcttcagagtggcgtcgttcgtctgtaacgctgcagctcgaaccctggagaggaacatactgggatggaaggctggcgtgggtttgttcaggaccccctgccttctgtcaaactgatcagggggcacccccatgtgggcatggtctttgggacgagtgaatgtaatttctgcctgggccccagcggggctggggccacagaggaggacaaatggcacttcccgatcagtcaccagcacacctgttgtcagcgtcctgctcggcttgcagaaagagactctccttcagatgcatgcaggcgaggtcagttgtggcaagtctgggccagaactgttgaccgcgccaatctccgatgcacctttccatgcgcttacatggctcattgtacatgcacatgccccccattccattcctaggctgattcgggcggtgcaggccaatctgactgctcgggccattccaaatggcaagccctgcttctgttgcgatctgttctctgtgagcaaagagtatccaagaccatactcaagttctccataccgagcagtgatactggacccccttcaccggtgggcgtcctctgcatttcctttccccttgctcacctggcaaactcccttccacctctccctttcccaatccttatcctcccatgtctgctccctccccccgcccttgtgcactccctctcaacaccctagccggagtcagaaatgagattacatccagcggcaagatgcgaccacgggagcacgcataggcctccagatccggggcctcatgcctcggtgttggttgcccgggtgtagatctcctgggagtgggtcttggagaccacgcggatgactccctgggacagcagctccttgatggcggcacgcgccaggctgccgtttacctgcacagcaatcgtgcaagtgacacttgtgaagaatggcgaaagcataaggaggcacttgttcccaatctagcaccatcgacactccctgctcctcccctgcacccaccctcaggcggtcggacagcaccgaaggggtgatcagcttgtacttgggcacctcgttctgcagcttgtcgtaggtggcctgcgagtgatggggtgggcgtgcgagactgagctacaatctcggagggccgctggcatccagtatgcccaatagtcagccgagccatgcagggcccacacaaggggggcatccacggcgtcgtcgcaccttgtcgaagaggacctggttgttcaccttctccttcagctttcccttcgaccatttctgcgatgcatagggcgggaagataacgtgacgaacgggcctgtctgggcacccgagaacacacctccggtctccgtgcacgacgccgcaggctgttcggccgtgcccagtcacgctatcccagctgttaccttcttcttgcccttgccggccgacatggccgccatggccttggcctccttggacttctgctcctttggcgcctgtggggtggcatcgggtgcgtgccggagtgagcgcgggagacacacctctgcccgtgggtgccatccagtccgccccctccactcaccatggtgatcaaccctcctgacaaaagagggtcgggctatcgggaggacccggcttgtagctcggggctcggggcgagagccgccccgcgatattcgatctttctaaatagcaccttgacacaggcgacatagggcgcctcctcccctgcatccctcccttttcccgacttcccaacgtctctggagccgacggtgagcttggcatgcccctgcaccatactggacaggcggggctggtgccggcgctgtgcaccacctgcccgccgtagtgcttggctgggaccgggcccttcgttctccgctagcaccgccccgcgacttttcaagctcatcagaattcatcccactgcctgtgcaggctgagaaggagacagaacatccacacaatggcggttgtcaagaagtcgaagaagtcggtggagagcatcaactccaggctgtccctggtgatgaagtccggcaagtacacgctgggctacaagaccacgctgaagaccctgcgcaacggcaaggtgcgcgaggatgtcctgtgtcgcgtcgctccggggcctggaatctcctctgctctgtgtggggcgccgcccatcctccctcccgcccactcccgctgcaggccaagctggtgatcatctccaacaactgcccctccgtgcgcaagtccgagatcgagtactacgccatgctttccaagtccagcgtgcaccacttctcgggcaacaacgtggacctgggcaccgcctgcggaaagctgcaccgcgtgtctgtcctcaccatcaccgacgctggtgactcggacatcctgaagaccaccgagtgagcccggcaggcccagtcgctgtaaggtgctctcctcgacacgttgcaggaggcaggcagcagggaatctggggtcggcaagcaggggaaggggaggagggtttcctggcaggtcgagtcggctagcagccctgcggggcatcgccccaggacctgtcgttctctcacatcgatgcatgtgcagcagcggcatccatcaaggagccacaaggccagctcgctggcgagtcatcgatcaatcggtggccgtccaactgcccttgaagtactcgtcccacaccgcctcgccggcactggcgtaggccagtacccgcttccggaagcccctcagggccaccttgtctgctggcgtgtgcttgcactgcagacgggtgtgcgaggggaaaggtggtgtgactcgagggtgcctggtgcagtgtttcgccacctgagaatggggagtgcgcagggcgccagcacatgcgtgcaccccggcgcagcgccaggccgtgcactggggctcgcacaccgacccccccccaccaccacacgcctgggccagcttctgcgtgaggcaggtgtcggccaggtagtgcagccacaccgcgttcgtccccggcacgtatctctcccaggagtcgccggtgagcttgcgcatgcgccgatacgcctcggcctgcggcgggttgcaggggatcggcctgggcgtgccgctcctcccctgcgcatccctcactgccgcacgctcgccccagcctcccaccccccaaaactccatcctcccgccccacactcgcctgggcattggcgcgcggcccgaggaagagctccgggtcggcggccaggtcgcagaaggccagcgcgccgcccgcggtctgcagccgggacagcgtgaagtcgatgagggtgcagcgcgggcccccgccacacacctccagctccacaccgcgtagccggcagcgcagggcctcgcccggcgccgccggcttcaccaggaggttgccccagtgcaggtcacggtgctcgaactccgccgcctcctcggccacggccagtgccagcgtcgtctgcagggtggggtggagatgggaggggcctcgatcatgaagtttgggagtccctcggtgtctgtcgctcatcctgaggccgccacacgatggattgctttcatggacaccttcatcctaaacatccgaggcacctctgcccaatccaaagcactgacctgcaggaggatggactggatgtcagatgcggagtcgagggtggcatgctccaggtccttgcccccgtcctcaaagatgaacacctgggggtttggtgggagaggcatggagggtaaggatcgtggggggatgttccatggggtggacgagtgggccagctttgaggtgatccatacatgcatgctttctgagcatcagagccacctcccgcgtcccttccctgccccaccaccccacaaatgtgtaaaaaaagccggagaacctcaccgtgtacagctggtcctgcccaaacacatccacggggtcgttctcggaggcgtgctctgcgtcccagcggtgccactcgctgagcagagccggcgggtaggcgccccgccctacgcccacccccagcgcccgcacgaagccgggcgtggagttggcggctgcgggtaaagttggcgcggcaggggcaacggtgtggggttgatggggcatgcagcagtggaggcctgcactctcaaagccctctcccgagacagtccgccacctcaccagccgcgtcctcgtcggctagcgcactcagcgtcttggtgatggccacctcgcccagcatatcgtccgcccgcttctggagctcgccattcacctgtgcagaggaaaggagggaagaattggtgcgtgtggggaggtgtggcctcaggcaagtcacccccccaccaaaaaccttcagctctgcatgccccatcccaatgcctcaccctgatgtccccctccatgggcacaatcttgagaacctggccgctggccttgaaggcctcgccaaaggtcccctccccgatcttccgcacctgcgcagggtatcgtgagaggcgtgccaggcctgggaagtgagggaaggtaagacttgcaagccactccatgcagaacccttgccatggtgatgtccattgcatggcatgtccagagtagctgctctccagccccagcccctctgctcaccgtggagaggtccacgtgctgacccagcagctcctccatggagggcaccgtctgggggtcatgaggacaaagagtgcgaggttgcagtgaaggtccctgccaggcctgatgacgctctgtccaacaagcccccaggcagcaacactctcgtgccgtcagtcgtgtcaccgcacccaccgtctgaccgcaaaactccagcagcaggtccagccccgtcttggcggcctccccctccccagctgcgcggccctcggacgccagggtcaagcgccgcagggcctcccccagctccagagcgtcgcctggctccgatgtgtcgttcgctttcaatgcctcgctcagccctgaagcgcgcccagtcttggtcagcggcagcggtcccgatccccccacagcactggggccacctgccgcatgattgtcgccatccccgccagcaggctcctcgtctgtcgcgctgcctggactctcctggatggggctgggggcggccggcctcccagcggccagcgacgcccgcgccacaccccagggcgccggcgaggtggcggcctcgtggctgggctcctcatcccccgcctggctgggaggctggaccaccccgacccaccgcagtgcgctgctgaccccagatgccagctggctccccgccaggctgaggcggggtgccagcgaggtccgccaaaccttgcccgcgccccagcgggcgccgccgacgctggagcgcctgtgaggtggaaggcgtgcgggggccagtgggaaggggtgtgtgccgctgctggatggggagcctgccgcctggccaccaggcgtggcaccttctcccaccatgaagggtgtcacagcctccctcggttccccccaagccggccagccccagccctgaccccaggccccatcaccttccggcatccaggtcgggcaggggctgagccacgagggcacatgaaacgcggcgcgagaggccggaagccctggaagcgcggcgctgctgcgtgctggggggggggccctcaggcacatccagtgccggcgcggggctcccggcaggctccggcgaggcccgcaggtccggcagcctgccgccggactcgccggcgacctgccctcctccgcgcagagccggctcccggagggactcgctggctgtcagcgccgtggtaagcacgggcgaggccggcccgacggtctgagctcgcggccgcaacatcggcgagggcgtctctgcggccagctcaaaggcatccaccttgtgcagggatgcaaatgcaggtgcggagtatggagcaggggtgtgttgggggcgccaatcagcaactcaatgcacgtggcctggagtacatgcatgcccatgccctggtccaggaaccccctcccagcccaaggcatgccactcaggacggcaccattatccagcccctgcacctcacctcctggaagtactgacgcatctctgccatctgctgtttctgtatgagcacagcgttctccttgtcgggacctccccggcgccagcggccatcctgggctggcctcggtttcactggcaggggggtctgctcctcagcctggctgcatgcagcagtactgggctgctcattggaggtaggggcctcatctatgtcgacgaggacaggacgggactcctgaacgatgggagggggagggggaccgtgacctccgcaggctctgcctagggaaggccagatgcccatgcagccgactgggtcctcacctgcttgttacgacgactgtaggtttttacctccatcctgcgtcgtggagaaacaaggcccaccgatttgttgcagggcatgcagccctaatcatcggccgcgctcacccggcgaggcataacttccgcggtaggtagactgtcgcgatgctggattcaaacaccaccgtgaccgagacttgtgcgacgcatgctgtgcccctctaaaagagctgtcgcggggtgcagcgcagctaaaagggtcgtctgactgttcagagtgatgctaagcaggaaaattgacgctcaagaagtgttttgtcgacggcagggcctggtggcgacgttgctgtgtgccagtagtgccgatgacggattccgacacccctcaggcatgatgtgcatgtcgcatgctgttcaaggaggattatgtgtgtgtgacttcgcaggtcctgaaaacaagactcgacttccatttcacatcacaggagtctgctttgctgacactgcgcctcactcgggggcctgctgctggcacggaattggtcgtgcaggcacctgcacagatcctcggccgcacccgtgttccccgccagctccagatcaaagaccccaatgtatccgagaggcacgcccagatagcatgggacgggaagacctggacagtacgtgatcttgggagcagcaatggcaccacactcaatggtcgtgcgctggagcgtcaaggtgaggggaagccggtgctgggaagaccggcattgcaaggaaggcacactggacttgcatccgcagctttgaccttgcgcaatatgcacatcggcaggagatgcgtgcccgcttcacaatggcgacgtcattggctttggggatgagaccgaggcggcagcagaggtgagctggggtgaatcatgctcgtgagcatggcaaaggagaggcgcaagagactaggatcaaacctgcgaggaggtttttgcattcacttttgtcgaatgtggccataatgccccccaccatgctcatcaaattgtctcattgtccctcgcccaggtactaccagcgccagacgagtctcagacagtggagcactacattcaggccgaggcggctcgacttgctgaaaaattgagggtgaggtggggctgcgcagggaaggacgccctgtatcaggacattgcactgggtttgatgtgtgggaaaccttcaagtaaggagctgtccctttgttgttgagggtgggtccctcgagggtgccctggcctgctcgccaagccctccctgacccgctttctctcaggcccgtgcggagcaagcgacaaacaagctgcggcgggaatgggcaacccacgccaagggtgtctttacctagaaatgtccactgtcatctatttgtaggatactaacagtgcgacgttcagtcctctcaagggaggcggggccgttttcctccctcggcatcactggccagcggcgcagtggatcgcagatgaaggggggggctcacgacagggagtggatggcaaacaaggtgtgaaaacacgaggcggatgaaagaggcccagactggagtctgtgagcgcctctgctcctccttgccatcgacagtctcagcccgggtccaggactccccctcccggtgctgcccaaaggctgggctcactccaaggagatcttggcgccgacagcctccaacttcttctgcagctcctcagcctcctccttcttcagccccttcttcaccacgacgggtgctccctccacctgttggaggtagttcatagatcgtggaatgcagagggagaacaatggaatccggctcaaccttgcaggtattcgaatggcataccctgcccagcatctgcactttccatgaggtacattccacaccctagactcacgagctccttggcttccttgagtccaagctcagtgacggcacggatctccttgatgaccttgatcttggctgcagcgtcaaagccgtcaagcttgacatcgaacgccgtcttctctaccttgggggcttcaggttcggctgcaagaaggtttgttatggagtgaggaatatattgaggcatcattcatgagtcccacatatacctcgcagggtgagcttgcacagcaggaaaaccacaggtcataacgaactcagaccaccaccgaccattgatgcccagtcatcaccaggcacgcgccccacatcccacaccacgcacctgcgggtgctgcggccacggggccagctgcgtacatcggcctggcgtatgatgccgggaggttgaggcgctttcggaggagctcggtgaggtcgctcacctccagcaggttgagctgggtaatctggtccgccagttccagcaccctgggattggtgatttcccgggtctcagcctcggcatcgctggaaaaggatcgcgggccgggactgggcagcaggcgcagcgcagacgtcgcgacgcagggaggagcggggctgcagctcgccgctgcagagtaggacgcagcgcaggcacgctgaagacacagccgcagcattgcgagattatgtgctcctgactcgcgctcagagatgtatcgagggcacggtgcccggagtgggaggtaaagtgcaggctgcggggcaggaacttggggttgggtcgaggggaggagcgatgggcacaggcgaggttgtgagactaatgcactgtgcaagtgccaatgcggtgtggcagggaagagagttttcgaggccgatgcccccgtcttggaccgagttgcgtggggtgcagtgtgtcacggcatgcgcgggaaactttccagctggcaccccctgtccaccaagcttcaacgacgagggagcaaggttgctcggttcagggcatgtgacaaccaatgggagaagttgcgatgtcaaaacttgaagcggccgtcagtttcggagcgctcgtcactatctagtcgcgcatcggggtgtcgcgagtactgtaggaacaaggtggggcatgttcaaggggtgcccgccctttggtttgtcactcgcagtgctggccctcggccaggcgctgctgcggcccccacaccacgtgttgcccagtagaaggtctcgccaccgtttacgacgcccaatctcgctgcgcccgctgcacttgcgccgctgcccttgcttcgcagcggtgctctcggcgacgacatcccccggcgcaggaggggctgatgtcggcctcgctcccatccttcaccacaccttctccttccatcaaccatctcacaggccttgattgtaacctgatctgcttggaccggaggcacgcgccctggaggcccgaacgcccgggacggaggccggatccctagcccagggttccatgcccctccccgccccaactccggccatctccttcgatcaccgcatatccactgggaacagcgttggcctgctcagcgcggggcagctgtccaccttgtcggagtccagtgcagagagccttggggagggcctgcagggagtgttggagggtgaggcgctggtctcctctgcagatgtggacgctcgtaaagtagtggtcctcgggtaggttggggttgacaggcttggaccgcttccaagatctcatgatgtagagtggggcacatgcccttggttgctgcctcagtgctggcggggaacagggctcaccgtccatggcgtcatactatgcaagctgctggaggggggcgccacgcctgcctctccatggcgcccactggctgtcgaggagctggcagctcacttgccagcatgcaggcctctgccagtccccctcacacgcactcctccccttcccaccgcccagggtgccatggcagaccgaggactctgcgctgacgcgccacttctcccagtacggcgccgtggaggacgcccagatcatgcgcgagcggtactcgggcaagtcgcgcggctttggcttcgtgacctttgccagccccagcgatgcccggaccgccgtggcctcagagcacgtcatcgacggccgcaagtgcgaggccaagtttgcgctgccggagggcaaggtgcgggggcagcacgtagcgaggtgttgggatcttggaagggttgtgtgtgtgtgtgtttgtgtggtgaaccccatgttcaagggccgggcgacgggtcgccgggctggccctcctgcgtggacgcaccacgcaaaaggatgcgcgttagtccctttgctgagttgaaagcttcctgctgtgtcgaaagcttcctgcttgtgccggggcatccacctgcgtattcgtgttctggcgccctggcctgtgtttgcggcatggtgcagttcgatttcaaattgaccggaggttctgcctcgattgcgaccgcacagcggcctccctgagccatccgcccgccctgctgggcagccctgcgtgcaccccccactaggcctcattctcctctccttccgaccccctccccacccaaacaactccacccccccaggtcggctcggcgcgcaccacccgcatcttcgtcgcccgcatccccttctccgtctcggatacctccttccgtgcctactttgagcagtttggcgcagtgcaggacgcctacatgcccaaggaccccagcaaggcggggcaccgcggcatcggcttcgtcacctacgcgggggcagaggcagtggaccgtgtcatggcgcgctcccatgtcctgggcgggaacgaggtggccattgaccgcgccacgccaaaagaccgaggcgccggagcctcggcggcggcggccgccgcgatgctgcccggccgcctcagcatgagccagcccaacctgccgctgctgggcggcggcggcgccggcgcctccgcgcatggcagcacggccgtggcggagtacctgcgcgcgctggcggcgcaggggcccggcg

SEQ ID NO: 18148 - DNA, 160 bp, Chlorella protothecoides
accttcataactccaaattccaggattattcgctgtttctccactaatagtccaaccaccccatgattgagtaacacctaatcgtgtcataaagggtaatacaaacatcccttgacgccacatagggtttaatacaggatctgatggatcaaaaactgca

SEQ ID NO: 18149 - DNA, 100 bp, Chlorella protothecoides
agtagtattaaatgacccaggtcgtttaatttctgttcatttaatgcacacagcattagtttctggttgggcaggttcaatggccttttatgaacttgca

SEQ ID NO: 18150 - DNA, 103 bp, Chlorella protothecoides
aatgtgtgagtgtcagtctcagctgtgagtgtgagcgtttgtcctcagctgtgagtgtgagagtgtgtctcagcagtgagtgtgagcacgggtctgagcagtg

SEQ ID NO: 18151 - DNA, 65 bp, Chlorella protothecoides
gctgcaatgcaggagcccgacttgtgtgggcagccgggatgttgatgctttggagagcagggagg

SEQ ID NO: 18152 - DNA, 73 bp, Chlorella protothecoides
cggagccctcctgaagctccacctctacctccaccatggcaagcaccctgaccgcagccctgagcagctccgt

SEQ ID NO: 18153 - DNA, 6471 bp, Chlorella protothecoides
ccccaccccgccgcacccaccgcgcggagctggggccaggtgcgcaccgcccgcacggctcgcgcggcgtcacacagcgcgcgcagcacgccgcgccagtgcgccgccgccggcctggcgcccacccaggccagagcgcgcggcggggccagccccatgtgccggacgttgatgccggggacaaagcccaggctcctggggccacaggagccgtcggccgcggtatctgtagccgcgtcgctggacgccgctgccgagacggcctccaggcagcccagcgcgagctcgagctgcgcgaccccagcgtcgatgccatccgcgtttgcggccagcatccgctctaggccctgggggtggggaaaggggggattgagaggacggtgtgagggccagtttggagttagcacgcgcatttgctcggggtcaatagctgggcagagaccaacatgcgatgtgggccccggacaggctggcagccatggagactccaaggcactcgaacgccgtagccacccggcggcacctggaggcagtgcaggcggaaggagaggtgggctgccagcccgggagcatcactgcccaggtcctccacagccgagcgcagggcggcacaggcctgcgggagggcggtggtccctggggcccccaggattctcatgccaaaggtgtggatgctgatgtcctcatcctgcgcttgaggaggagcgggcggttcagggagggcagtgtcgagtttacatcccgaggccttccattgccaggaggcgacaggcaggcgtctgcagccggaaaagtggagccaggcaaggtgcccacctcgcagacatggccgttcagcaggaggtcatgcaccaggttgcagctctgctgcaccgagaggcacagcgcatgcaggacggggttgctcacgagcctgtgggaacaagagtgtgggcggcgaatgtccttcgactgtggcagcggcgatggggaggcggccgggagtgagtgaagcccttcccccaaccctcagaatcctgcctgcaccttgggatgtcgagcatgtagagggaggagaagacggtggtggggagcatggaccccaggtgccaggtggcttctgcctgcatcagctgcatgccaagctgctccagagtcgccagggagagggcgaggggtgcatgccccgacgccagttcctctgccaggctcgggccctgctctcgccgcaggccgatgtccatcttggtgtccccaatctgaatggcaagcatggcctcatacaggctgaagtcttcgccatgcaccagctcctcgggatggagggctccgcagccccgctctaggaaggccgtggcatccagccaggtggccatggcttccggcgcacgacggatgaatcagagttacggatactgatcacaacattgccgaaatgaaagtaagtgtggggtgactaaacagtgatagacgaaggctcaagacaccagtcccgtgcacgacacctgaccgatggccatctcaaacgataccgaccggcatgatacggatgaaattgatattaagcatatgtatgtttgcaatttgcatgcagtagattgccatgcttctccaggtggatccacggtgtgtttgatcgcgcatcggggagccctcgctgcgtcgcggtggcactcagcttcactctttctccaataggcagctcagcggccgcggagctgcataggcatagtcacccccttcagtgccaaccctgctcgacgttcactccccacggcaggcccattcttgcatccagatgagatcaataaatggcgttgggggattaataacgcatcgagacgccgagagggccgcaaggataccactacaagtcacagatgcaatggaggtttcaatggtgtggagatcacaatacaaaggaagggagacgtgcatgacacatacggagggtggggtaatagggtgaagggggctgtccccaatgcgagtttggctgcagtgattgtgcgggttgatggaaggccggtggagatgggacgcccgtgagagatgattgtagtggagatggtgagaaagggacacctgtcgatccatgcaacaacggttgcgcatgcggaagccactcgcacggtacgtccgagggctgcatacaatgttgcagccctttcttctcctcttgggtgcctcgcgtttgctctgttagctcccgtgcctgcacgcgccggcacatgggcaacctcgccgccgcgtccggcatgagcgcgtgggtccatggttccctcaccgcggctgcctgagtccataaaaggggaggaatatgggcttgagaagtatccaatcatacattccacaagccttgagctctctgaccatctcgacactcgatcattgccatcatgggtatccagaagacctccgcgctgctggtcatgatgctgctgtgctcggccatgaccgtgccagctcgcctactgggaaccaagggtgagaagcagtgcagcactgttcacaaactttttgagtgattgtcaaccattatgttggacagcatgtcacgtcgagtctgggtcctcgtcgaatgccgtaccggccatgtctccccccaccccggtacccccccgttcacatgtgatctcacgggactgaccgctcacagggaaatccgcgacggccaccgcgacggccagcgcgcaagccctggccagcggtaatggttcggccttcgcaagcgctgccgcccaagcgtccgcctcaggtacttggggacacccagtgccggttctcagagcggggcttgctcggcagcgcagaccagcatgaaacagctcagccactcagacccatgccgagggcatgaccgcttcgttgacacagcccccatcctcttcccactttgaatatcccaggtaacagcgccgcctccgcccaggcggtggcccaggccatcggcggcggtagcgcctccgccgcggccaacgccgcagcccaggcactgtctggctcccagtccaccgccaccacccaggcggtggcccaggcatggacccagggcctggcctcctgcatcggttccgcgcccaccgccaccgctaccgcccaggccatcgcctcctcccttctctgcgacagccccgcgctcgcatcggccaccgctcaggccctggcctccgtctccggcacgcccgccggctgtgccctcgccggccaggcgctggcgtccgccgcggcccaggcccaggcctccgggcagggcatggccttcgcccaggccctcgcccaggccaccgcctccgtcaccatgcccagctgcctcttcggcggggtcgcccatgtgagggtgctggtcaagtgtgtttgccagccggactggggttggatcccgggaggcccactgggtgccaatatccacaatggcatggtgtacaaaccgcatggaactcatggaggcctggcatggtcgtttgatttgctctgactgcatcccttgacccatatttcagcatgccaaactcaccacagttcccaatggcacttccaccccgcaggcctcagccacggcaatgtcctccgtgtttggaaatgggtcggcaacgtcaagcgcatcggccaccgccagcgcatccagcaacgcctctgcctccgccaatgcatccgcctcctccaacgcctccgcctcctcgagcgcctccgcctcctccaatgcctccgcctctgccaacgcctcctcatccgcatacggcaagaggtctgcgtcagcgagctcccaagcctcggcctccagcaccggtggcagggccagcgcgtccgccagcagcagcgccaccgtgtacgggcgctgagtgccacccccaagccagtgacctgactggtctgggctctggccgtgatcagaggcattctgcgaggcgaaccctccccattgttgaacttgttcctgcaaacttacaccctggctccgtccaccgtgcccccctgcacctccccatgatcccatcccaactgccctgtgacgatgtaataaatctgagcaatcaaaagcagaggatgttggcaactctctggttcaaccccagactgtcttgccaacatggtagcttaccagtatgcctacatggttttccccattcaggaagagaatttattggtactctgtcgaaatacattgatgatgccatcggcagggttctggtctaccaatccccattattaaagcttgctcaacttctccctgccacagcgtgcattctggtcgagcgcgcgcggaggacagtgctatatctcgcccaagacaggctgctcatacatcatccctgctgcgatcgaacgatccattcttcaaactcatgatcgcatcattgcattgatcgtcatggctacgtcctgaggtccggcacgctctgctcctcgtccacaagtatgagtctgcgtgaaaacattgcccgcctggtcggggaggggtacgaccagccacagggcgatcagtccactcctttgagcatcaattacgccaagatcaatgaatggatggtaagggccgagtctgtgtcctgggattgcgctccctgcgatctgagggaccctgctgtgacaagtcagcacacgggcaccacagcattccagactccctgatacccatccccgcccattctgtcccgctcctccagcttgacaggaagctgctctgcagggactggatgtcccagctgcgcgccctgcaggcgggcgtcgccgcggcgggcggcgacccggcctcctatgccactgctctggaaagggcggccgccacgggcgtggatgcagagcggtcgttgctgggggggctcaagggccaggccagggtgtgggacaggctggcgcgagcctacgaggcccgcaagtgccacgtggcggaggccgcccagcgcctcgcccgcgccgcagactatgaggcgccggcgctcaagcgcggcatggcccgagcgcagcagcagctggcggacctggagaaacgcaaggccgaggcacatcgcgccggagcgcgagcggagcaggcgtacgctgacgtgggtgtggggccaggggacgcttgatgttgtgggtgggcggtgcaagatcgatcgtgtggccaggcccttgtgtcctgaccttcaagcagaaggtggcatttggggcaaggcgggcggtgcagggcaggttcttgcatggcatgctggagaagtttggttcgccggccaggcccaccttggaacagccgaggcaatgctggcaccttgcctggtgacagcatgccgtctgggacaggtacacttctgcacaagtgaatgttggatgtcatgggtacctcaattcaccgcccacaacccccgcaggagtgcaagcgcctggacatctcgccaacgcaggacgcgaccgccgagctgcgtgccctggcttcccgccggcttcccgctgccctgcaggcctgcgtcgccgcgatggttacggaggaggtccacgcatcggtgcaatgttatgccgagtttatcgcggctgacgatagcgcagccgccgcggagcactcgctgccagtcctggtggaggtgctcgcgggcaccacagaggccccgctcttgccgagcatcccatccaccggagcccagggtgctgcggagggcgatgatacagccggaggagcgccggaggcggaggctgtgggagtcgatgaccttgatctgtcagccctcgcctctgctggcgccagcggcgccgcggaggacgccggaccaggcctcatcagctgggacatcggcacagaagcaggcggcgacgacgctccacaggatgccgctggcagcccgcggccggctggcggcgacggcggggaggtcgacccgggcatcgactggggcttggaggtggagggcggcgaggcggccggcgcggaggagggcgaggcagtcttgcaggacctcttgacctcggccaatgtgttcgagggatctgacccggtagttcaggtacggagatgaggtcggtgggccctgggggtggaaatgtttgtcctggtgaacttgtatgcttgctagagacccagctgccgttttggctttgggcctaggatgcaggcggaacccttgcaggctcagtgtccaaattagaatgtacacccagacctgacctcagaacccgcatctccccccaccacttgcagcggctgggtctggacggcgcgtaccgcgccgccctggccgacgacctgcacgagctccgcgctttcctcacggcgcggcgcggggagctgcgggccggaaacgtgggcgccacgctgggtgcggccaccgcgacgggcgaggaggcggccgcctggctggccaccgtggagcgcgcgctgggcgcgctgggcagccccgacctgcagcacctgctcctgctgcacggcaggccgcagtacctggcccgccaggcggccgccctggagggcaagcgggccgcggggggaaagctacacaggtggttgtaaaaggggggggg

SEQ ID NO: 18154 - DNA, 934 bp, Chlorella protothecoides
ccagcccgcccccttccccgcctccctccccacctcccagcccgccaccgcccttcccgcctccctctcctcccgttgtcctccccgtcctgaccggtgtggcaaaccaggatcgcaccaacaccttcaccgtgacagcctctggttatttcctcggcgacataaatgtctacaaggatacatacctgcagtacacctgggtccccgccacaaagacgatgacggtctacacaattacaccgccatcgacctatgcttcgggccacgtgtctgtttggtatgtggacgtgtatgatgccaacaatgtgcacatcggcaagtcgaactcggtgaccctcaccacgccctgagcacagcgttgcctggctcaagggacgtgggggcagcgtgctccctttgtgaagcccactgaattctcaatttcttacactcatcctcaggccagtagtctcccaccacctttgaactgaactgcatgcatgtttcttgctccctcccgctcgctgctctgcttttcaatcgcctgcacaccaggaataactcagtattcttctggagagagaggggatggcccggggaggtggtcacgtgtgcaagcgtagggtgtgacgaggcccgtcatctgcaatcacattttggaggtggcgtggcgcgtgatacttcacagtcctggcagctggcctcgccctgccgctctgggagggacgcgctgagacgcccgccgcctgcacccctccctggcccccgagtccgacctggtggcatggtggcaggggctgagcccctcacagctcgggtctgacgtggcccggcgccagccgtgcccacgtggccgccactcgctgcgtgaactcggcgtccgcaccggccgtcagttcgccggcccgggccaggtcgagggtcacccggtccagcagggtgagacggtacccga

SEQ ID NO: 18155 - DNA, 92 bp, Chlorella protothecoides
ccatgagcccctcccacacttgcgacacaggtatccagatatgtatcccacccagccagccatcagatacacactgggtcactcacagacat

SEQ ID NO: 18156 - DNA, 61 bp, Chlorella protothecoides
ttatcatgtgtctctgtgtacatatagatacgacacggtgtaggggagtgaggatgtgtgt

SEQ ID NO: 18157 - DNA, 64 bp, Chlorella protothecoides
cataaattaccgaaaaaaatgcattcgttataataacaagttgaaataaatttccgttatttta

SEQ ID NO: 18158 - DNA, 490 bp, Chlorella protothecoides
gtcgcaaaccaagcacaatctgccccaaagctgcattcgttgactcctgtgaataatctacatcacaagtggatgggatggcaagggaaaggcgaagctcgtaaaaatggatgggaatcagcataggtcaatccgcgggtcttggattgcaagggcgacacctgcatcactggttgttgtccgtcaggaatgccggtgcagagacattgttttcttcatcagtggcaacgcaaacgacactctcggcatctgcatatgtctcataagtgattggcacattgaaagtggcggttttagacgcagggaagaatgtggtgtatgtattgatcggattgttattgaggtcccgaatcgtacaggtgactgaggtggccgggaactcgatctccacagatgccacaaagctgtaggagtcccctccattgttgaccgtggcccatagaccagtaagtgctggtacttcagctggcgatggggatggcccggggct

SEQ ID NO: 18159 - DNA, 96 bp, Chlorella protothecoides
actgtggggattgcattaaacttagaggcaaaaaatgttggggctgttcttatgggagacggtacaaatgtacaagaaggtagttctgtacgtgcc

SEQ ID NO: 18160 - DNA, 3939 bp, Chlorella protothecoides
gggggggggggcagtgatcctggggctgggattttggccagccttcgcagggcttccgattgcgggggacctggatgattgtaggatgagggttcccggcaatgagatctcagaatttcggggtggaatccaggtctgggcaagagcattcactcgacctggatggcatgtggtctcaaggatcctgcagggtagtgcgcgcataacacattgatggctccttcactgccattgtgtacctggtgccagtgcccggtgaggcagtgacggacttggacggcgaggtcgtggaccgggaggtcggcgaggccgtggagggggaggtcgtgagttgacacttctccagctccgtcaatgcagaggcgagggcactggaggttgccgtggcctgcgagttgggcgacgaggtatgacgtctgcaaagcatacccgcttgttgcaggagcagtgtggtaggggcctaccccatggcgcattacctccacgggcatgggacagagggctttggagcttcatgtcactgtacagcgattcctgaaggagcccttccctccccaaccccctcttcaacgcaccgtggcattggcaacagcttcagcgttggcagtggccgtgcctccgccctccgcacaagccgatgcagtggccgcagcggtggcgacggatgtcttgatgctgaaagcggtggcttcagcaatggcctgggcgctggaggcacaacaagaagcaccggcgattgcggtggcgctggcctctgaaatggctgttgcctaagcggtggcagttgccgtggcatctccacacgcctttgctcccttaccagtcgtcttggcaaagacactggcataggccctggctgtggcctgtggtgagggattagagaagcgcagtggcatcatcaccatgtactcccatagggaacggggaatgctgtcgagggaatcaacattactactggaggagagactgacctgaaaacgcattggacctaggtttgggtcgagttttgtgcgctgtccctttgggaaccctctcatgcacagcatgtacacgcagtcagactggactcaccttggacactgcctccgcgattgccttggcctcagcagatgcactgccccctccgcacacatccgccaccgctgtggccagggcagaggcagtggatgttttgacctcactgaatgcgccggagttggcaacgactacagcctccacgaggccttcctggccatcgttcaaagcctgggaggtggcctcgactttggtgatggcgccagggtcgacggtggtgccagtgccctggctgatggcctggcacgggggggagacggagggttgagaggagggattccgacaagagctcctcacatgacagacagtacacaaaagagatcctggtcctggccagcaacggcccgcagcgctgaggcacaaagtgctcagctacatttctgcagcttggagcgacgtcttgaagccacaatgaatcttctgttcagtaaccacagctttggaagcatcctgaccttggcagtggcattggcggaggcaccccccgtggacacagcctgtgcagcggccttggcaagggcttctcccttcccgctggcggtggcgatggcactggcctgtggtgtgagggtttggagggacatatcattccacagatgtaaagggtgtaatattttcagttgacaattatttccgaaaacaccgattgagttcctatccagtacctgtgcgacagcattgctgttgccggtcgacagggcctgcggagggccgcatgtggaggtgtgatatcagcgcacacgtaaccagtattcgatgctaagatgcagttgctctcagcatattggagatgctggatacgctattacaatgttttctgttcgtgatcagcaatctcaccgaggctatggcttgagcagctgcttttgtattcccggaagccaccgccgacgaaattgccgtagctgtggcgcttgcagaagcttgcaaattccgaccatggaatcccgcagagtcgcgactgttcgcaaccacgcccagggccaaaataaccatgagacgccagatggatgtcttcatgacctctgtcggtagggtagagatggtaatgtaccagcactcgaacactgacaacgggcatgcgacatggcgacaggaattcccccatacctggcttgtaatgctagcttcaccgacccgcacggggttcagggagaacggtcacctgatgtacatgagaacagtatttaagttaagaaacagcacggatataggatgccttcatgtgatcacatcgcagctgctaccctcgctgcgaaggcatgtgaaggcagcgactggggattgagtcatcagcttctagctttacagaatcatatcatttccctgagttcggcttcgtgatgcgactgttgggaatgtaggtcgtatcctgtcgacctctgggaacgaggctggagccgccacagagatagggcgtagttgatgtcgctgagacctaaatcccagactcgcaaccagtgaaaggacctgtatcttccgggaattccatcggcaggccgggtagaccttccattgacggaattttcggcctgaacggtaacccgttacaaagctagcacttatacggttcttctggttatttagctcactacctctagtcgatagtggggtgcatagctcccgccagcatcatgatttgccgacatggaaggttgatggccctgatcggcatgaagtgtgtcatagctagcaaaaatgcacgaaagactcgcgcgccagttcatgtcggtgattgggttgactcgagaccgtgccgcatgccggcagcctaccgaatgtcgagccacgtaacatggatgcgtcgggttcaagaatcgatatttcaacgcgagtgggcaccatcgcaccctaccttgtccttccccggagggccgtggtcggctggaggggtagctcccggaatggcccgccgacctccggccctgcctctgacggtcctggaggagatcgatgaggagtcttccacctcatgggcggatgatggtcccagcccggccccagcaccctcccacgacgctcagaccgcccctgtccatgttcgcccccccggatctggggccgtcgcatccagctccgggcggggggccctgcgggacagggtgcgggctgcaatcggccgggcacccccatccgacccctcgatgccaccccacccggcccgggagctctcggggtgtgcatcacgtgcgccgcaccaggtccctggtgtggaggcagaggcccggcaccatgtgagcccgctggccgtccccctgccacccccaccgcccactcaccccccggccctccgcctggcagccttcctcccccgccagctggcgcaaggcacgccatccccacccccctgcaaccctttggaccgacactggctgggcgcagcgtgcgcagcgcagcccatgccccctcggctcggcgatgccctggcggcgctgggggtgaccaggccgggggcacccaggcccgacatcccgggcatcgccctgcccgagatcgcctgggacctcgcaggtgggtttgaagttgggtggggaggctggacctcgcccagagagcttttagtcgcgggcaacatgcttgcgtggcccaacctgggtcggtgccgtgtgtgtgtgtgtgaagcaggacaccgcagcttcgccacgacggggcaccatcccctttggacccccacaggtgacctccccgtacgtatggactcgccaccctacagcctggcggtcctcccctcctcccgccccgtggcgcgctgcgacgccgaggcggccgctgacctgctccggcgctgccggcgggacccagccaccgcggcgcgcgcggcgggcgcctggcgggaggaggtgctggcggcggcctgcgcgccgg

SEQ ID NO: 18161 - DNA, 209 bp, Chlorella protothecoides
cggtagatgccgatgttcagcgcctggcatgagggggcgggtgagggtggggtgctgtgagccgcctcaggaagggtttggcacgatgcacatcctcccgtacttgaaacagcaaaaaatactacacatgtcgtccctggccgcctaggaacctccccatggcaaatggcatgcccccagtacctggccggcagccagcaagaccaggg

SEQ ID NO: 18162 - DNA, 589 bp, Chlorella protothecoides
aaaccgatagtctatagtatagtatcagttgcgcttataaacctagtactaaaaagtttattattgttccagcaaatagtaacgtgtgtttttgtaaatttaatagtattctggaaaaaactaatttaaagatcactctttaaaatggccatccctgattgttaaccgaaaaaccagaataaatgttggtataagataggatctccacctcctgctggatcaaagaaactagtattaaaatttctgtctgttaacagcattgtaataccccctgcaagaacaggtaaagataataatagtaaccaagctgtaataaatacggcccatacaaataatggaagtctatgcatagataaaccaggtgcacgcatattaaatacagtacaaataaagttaatagcacctaaaatactactaacaccagctaaatgtaaactgaaaatagctaagtcaacactaccaccagagtggcttgctatacttgctaatggaggatatcaatgaatcatgtacaataaagtttttattgtactagaaatgtttttgttgacaatcaacacaatattatataataatattgctctcattg

SEQ ID NO: 18163 - DNA, 191 bp, Chlorella protothecoides
ggcacagaaggggtgcatagggcacattaatctgggatggaagatcctcgtgtcagcgctcacaacacttgaagggaccaatgcatgctcctgaccactcacgcatcgtccatctcggtgtcctcttccatcctatcagtcggtggtggcaagccaggcgaggccttgatcttgtcatcacccgcaggtga

SEQ ID NO: 18164 - DNA, 214 bp, Chlorella protothecoides
cctgagcgctcggcacgcaccctatcgtgcggacttcacgcttctcctcttgtgtgcccgcagtttccaaagatgcgaggtcataaggcagcaacatcttgaaaagttggccgctgcagatgcgctcaaaaatgctggcgctgctgcaaaaggcgaagactatgacgtgaggtttcaaacggcttgttcgggttgaaaagtgaggacaggccat

SEQ ID NO: 18165 - DNA, 61 bp, Chlorella protothecoides
gagttcccacacaaaacacaaagacaacgcgcgccgcctctcacccgtcattcccaatctt

SEQ ID NO: 18166 - DNA, 62 bp, Chlorella protothecoides
cctcacactcacacctgagactcgctgtcaaaatcatgctctcaggctcaaaggtccatgtc

SEQ ID NO: 18167 - DNA, 150 bp, Chlorella protothecoides
ctcttagacgtaataagattaattcgtttgtaggtgtatccgggtaaacataacctgacattttacgtggtgttattggtatagaaaaaccatgatcttcaaattcacaatttctaaataaatttttatcttcccgataaaaagtattaa

SEQ ID NO: 18168 - DNA, 64 bp, Chlorella protothecoides
tggccgccccctcgagggtgcgagaaagtactcgtgtcaaaccactgccaatgttcatacactc

SEQ ID NO: 18169 - DNA, 78 bp, Chlorella protothecoides
gcttggaaggacgggcaagcgtgcctcgcggaccgcagagaccatgcccctcgccctccagccgatgcgatgtgacag

SEQ ID NO: 18170 - DNA, 3640 bp, Chlorella protothecoides
gaaggtgaaggaggcggtggcggtggcggggcgccccgcctcgtcccagcgcggcgcatgcgcgctggtggtcagcggcagcagcgcccagcccgggtgcccctcgcgccaccaggcgctgaaggcctggggcagcaggcggcgcaccgcctcggggaaggcggcggcgtcctggggcagccagatgacgtccaccatctcctggttgggctgggccgggttctggcgccggcgcagcaggcccagcgggcggttgaggtccaccacgttgtgcgcggcgcagcggaaggccagccccacgtcggtgcggccgtcgggggggaagacgcgcaggcgctcgtcggtgtccacgcagcgccgcacgtggtcgcgcgccacgtcccagcccttggtcaggcgcagcacctgcttcagcgtctcgcgcagcggcttgttcccctccgccagctccaccagctcccggaactggcccacgcgcgtgacgcagttcacgggcacgcgcaggtccgccacccccgccgccgcgcccgccgcggcgatgtcctccagcttgcgctgcgtctgcacgcccacgcactcgatcttgctcacgtggtcgtccacgtgcgggatgtcggccttggccgcgcccttgacgcgcgcggtggccactacgaacggctccgacagcgcgtgcttgaccccggggcaggggtgccccagccggtccgccaggcgcaccagcaggcggaagggcggcgcgcgccccagcagcagcgcctcgcttgagtcggtgaccttcaggtcgggcagcatggcctggcccaggatgagggggaccatgatgcgcttctcatcggtgaaggtgccagagcggccgtgcgacagcagcggctggccctgcttgttcaccagcagcatgcacgattccagcgcctcctcccgctccccctcctgctcgaaccgacgcccgtccacgatgcagatctgggtgtgtgccggggggggggagggggggcatgtgcgtatgcgttgatgacaggggcctggaggaggcgaggagggcgaggggcaccggcggggaggcacggcgggtgcgacggtggcgggctgccggcctgccctgccctgcgccccaggccagaggtcacacccacgccaggcacgagtgcgtgcactcagcagggagcagcgtggcgtctggggactcgttgcgggtggagaagaaaggaggggcagcacagggctcccacaccccctccccatgcccggttcgccggaaacccgacccccggagcggccccacctggaggtgagggtcgtcgatgtcggggtgcaccagctggccggtcatcgcgtccacgaccacaacgtagatctgggcaccgcacttggcctccagcacgtcgcagggtgcgaggtacttggaggcgaagttctgctcgcacctccgacgctggcaagtcttgcacagcgggcagttgaggttggagcagcccaggttcctgcgggtaggaatgagtgggaagggtcccgggtcggcagcgggggagctcgcggagcccatacgccacctgccctcgttcccacccgcacccctgcccagcacactcggacgcatccctgccccgatgaggaacgtactggcagtcatgtcgaaactgaaggcacttcgccccagagctgaactgcatccctgcggggaggccacgcccgaaggacattccggactcccccaacatcgggccggcttcagggacttagagcagagcaaactccatgcacgagccgtgaggtatcgtgtcaagtcaatctcagcgtcagggaccgtctgctggggccctggaggggcctcgggctcgcacgtccaacacagcgccccgcacggaaggcagggatttctctgcttccgcactccgtgcgacggctgcaagcgcttccaaataaaaatcgtacagtaattcccgtgggggacatgtatatgcttggctgtcggagcgcccgtcgcccggcatccggcttgaaaagaggggtcctgcgccctcatcgcagcctgcctggtcatccttcccctctgcacaccccccccactcggacgccctccacgggccaccccgcgcacctccaggggcctctgggttctctctgcaatctctacaggtacacgcaccccagccaggacaagcagggcggccggtccacccagaccggaacctcctgctctacgggcatcaccaggcgctgggcgaagcgctccacgcaggcctcccgctttgcctggtggctgccccggtcccggctgatgcccacgccctggcccatcagcttgctgatgtccagccggcgccgcggcctgagcatggaggcagagacgttgccgcgcgccgcgttgacctccgccaccacaaagttcaccagcaggtcctcgcagttggtcacgctgttcacgtaggccctctctgcgagtgaggatggggaggagacatggtttgtactgcactccacgcgagcgcttgagaccacccggtttcaagggctggaagaaagattgggcgacgggtgcccgcaggggccatgtcaaaatgtgggggtagttttgggggggggagagtggagggggggcaaacctagcggtatgcaatgcaccggcagtctgcgggccggctaggagctgagatcatcttgattccccatgcccccggccagggtggaggacttggcggcatcatcatcgccagcacacactctgggcaggggagtgccgcccctttggcacagcaccagtttgcctcccgctgccccagaaaaccgaactccgccaccaacacctgcacaagccacgctcaccctctgcatactgggggctgttgaagagcgggaagatgcggtcggcatccagcaccatcccccccgtcagcaccatgttgtacctgccccgtcggtacacctcctgctcgccggcgtaggccgcgggcggccccgcgccggccaggcgcgggaacatccccgccagcaggcctgggtcgcggcgccaggccgcgaacagcgcctccacatcggcacaggtggagaggatgtcgtcgtccagcgtcagcaccgcgcgcgtgcgcaggagcgggtcgggcaggaagcggttggtcagctcgttgcggggcgacaggcgcagccggacgggcgcgccgccgggcgccgcccacccgctggtgtccgggggttttcccgagttccagatgatcaccacctcggccactgcaggaggggggaaggggggttgggaagcaggaaggacagcgccgacccaaaggtcgggtttctgtttgtgctggaggcagggcactgcccgatggcgggccccatccttgtgatgatgatcacattgccgggcccaccaccacattcccccccctggcaccccgccgaaccccctctaagagacagaggtaataccgcctcaacagccacccgcacccgaggggcactggctgacccagccgacggtgaccttcagggtgggcacgcgcgggccgtggctcagcagcatgacggtgtaggcgctggcctggccgccgacgcggggcgcgcgcgccgcgcccatgcgcgcgtgcagcgtggtgccgtagtaccagcccagcgcgcccagcgcggcggccgtcgccaagcc

SEQ ID NO: 18171 - DNA, 1029 bp, Chlorella protothecoides
  modified_base (445)..(454): a, c, t, g, unknown or other
ggtcccccgcccgccccacctgcacaggtgctgctgtcggaccaggccaagcggtcggcgcggcggcgcggccccgcgcccaacggctcgccggccgtgacaccgccccccggctcccccggctggtcccccggcgccggcgctcagtcctggcaggcgctgctgggcgcgctgaccaacgtggtggagacgctgcgcggcgagggggtgcccccccccgcggtccgtgcgctggccgccgcctgcctgcgcttcgtggacgcggagctgctcaatgccctgctcctgcgccgcgactgctgctcggtctccgcggcgcgagtgctcctggccggcctggccgagctgcgcggctgggcggcctacctggggccagaatggtgtccggggcgtgagaccgcggccgcggcgctcgagcgcgtcgcccaggcggcgcgctacctcnnnnnnnnnnctggtgcccgggtcctgagaccgcggccgcggcgctggagcgcgtcgcccaggcggcgcgctacctcgtccaggcacgggcgctgggtgttgaggttatggtttggggggggtccggggatcttggtaccagatggagggaggctgggtctgagcggtggcaccagattccacggtgcctcgcatggatttgatcctgagatctagacacagctgttgcttccccaccacgcatgcagccctgatcccccgaagcaccccctctctgaccctcataacacgcaaacagacacagaaactgccccccacacgacaccaccaagcagggcaaggatgactgcgtgcgcaaggcgcaccgcggcgtgcccatcctggccgacctgggccgcctctgccccagcctgaccctgcagcaggtgtaccgcctgacggagcaccagcacgacgactggatttcgggggcggggctgggctcgcaaaacatggtgctgctggagacgctgcagcgcctcatggcctcccagccctccatggcaggtgaggaagggggtgggtgggggtggggaaggggggaag

SEQ ID NO: 18172 - DNA, 80 bp, Chlorella protothecoides
gagggtgggggagtcatggcgtcggggcgctggtccagcgaggtccaggatggctgcgcagcgcagagccccggccacgc

SEQ ID NO: 18173 - DNA, 61 bp, Chlorella protothecoides
accagcatcagcgatctcaaagggcaggggacctgcccgtgccacacatcgaatggcagtg

SEQ ID NO: 18174 - DNA, 70 bp, Chlorella protothecoides
ccgccaaggcagtggccggcgtcaagtgacgagggggatatttatcatgccctgttcagaggtcgctgtg

SEQ ID NO: 18175 - DNA, 67 bp, Chlorella protothecoides
aagtcatcctcactctgcgctgggcgggcccagccccatgggcacctgccatgtcagcacgaaattt

SEQ ID NO: 18176 - DNA, 82 bp, Chlorella protothecoides
gaagtcgttgtaccatattaatttttttataaattttaattaaaagagaatataagaatactaaaatagcgaattaaataaa

SEQ ID NO: 18177 - DNA, 239 bp, Chlorella protothecoides
tttttttattttttggggtgtagccaagtggtaaggcattggactttgacttcaacatgcaaaggttcgaatcctttctccccagtttaaaataaatttcatttattcatttatttgtttatctagtaaataaaaactgcaatctctattattgactttaataaattcgatttattttatttggttttaatttcatacaacgaagtaagacttcgtacaacgaagtaacttcatacaac

SEQ ID NO: 18178 - DNA, 488 bp, Chlorella protothecoides
acagcctgtggcttgtggcctggacgcagtctccccgtgaatacagcgaggctgcggtccacagccgcatagcagcctcaggcccggagagcagccagccacgccgtttgtcgcagaacgtataaggacgaaaggcctcgaacgcaggagagctcgagacaggcgcttgaacaccctctaagaatgtttttatacgacccctgctgcaacgaacgcatgtcaggtttcagaagtccaattcacggccacgtcaaggcttgaggcggttgagatggtcggccgacgtacatcgactgtcgttcgacgtcaggtgaggtccccagtacacactcctgacagaccctgaggcccacgctgaggctgattacatagtttcagtgatgtccttggtcgcctggcgagttagaaccacccagaacgcggtaaatgtggggattacccatcccactgttccgcgactgtcgaccgacgctttccatattagtaga

SEQ ID NO: 18179 - DNA, 70 bp, Chlorella protothecoides
tcttcgggacgcagcgaaaactactcagcgtgcgctgtttacatctactaatatggaaagcgtcggtcga

SEQ ID NO: 18180 - DNA, 92 bp, Chlorella protothecoides
aaaattttatctaaacctatcaataaattacgttattcttctaaaaacaaaaaacctttaaaatacaaatttaatctttttaaatctaaaaa

SEQ ID NO: 18181 - DNA, 72 bp, Chlorella protothecoides
tgagggcttgatggacatccatactcacctttttctcttattggaagtacataagtgctggtgttgcagttt

SEQ ID NO: 18182 - DNA, 115 bp, Chlorella protothecoides
acaacttgctcttttcgttcttttaatacaacataaggtactgtattttcatgtggaagtattttaaattcctcttcagcaagtggccaacaagtaaacttgatgagttggtttg

SEQ ID NO: 18183 - DNA, 55224 bp, Chlorella protothecoides
  modified_base (302)..(311): a, c, t, g, unknown or other
  modified_base (1564)..(1573): a, c, t, g, unknown or other
  modified_base (2198)..(2207): a, c, t, g, unknown or other
  modified_base (2287)..(2296): a, c, t, g, unknown or other
  modified_base (2556)..(2782): a, c, t, g, unknown or other
  modified_base (2912)..(2921): a, c, t, g, unknown or other
  modified_base (4052)..(4061): a, c, t, g, unknown or other
  modified_base (5295)..(5304): a, c, t, g, unknown or other
  modified_base (5910)..(5919): a, c, t, g, unknown or other
  modified_base (6945)..(6954): a, c, t, g, unknown or other
  modified_base (7490)..(7499): a, c, t, g, unknown or other
  modified_base (9465)..(9474): a, c, t, g, unknown or other
  modified_base (9785)..(9794): a, c, t, g, unknown or other
  modified_base (10042)..(10303): a, c, t, g, unknown or other
  modified_base (10679)..(10688): a, c, t, g, unknown or other
  modified_base (11678)..(11687): a, c, t, g, unknown or other
  modified_base (15032)..(15041): a, c, t, g, unknown or other
  modified_base (15384)..(15629): a, c, t, g, unknown or other
  modified_base (15692)..(15701): a, c, t, g, unknown or other
  modified_base (16499)..(16508): a, c, t, g, unknown or other
  modified_base (17098)..(17107): a, c, t, g, unknown or other
  modified_base (17540)..(17549): a, c, t, g, unknown or other
  modified_base (17722)..(17731): a, c, t, g, unknown or other
  modified_base (18566)..(18575): a, c, t, g, unknown or other
  modified_base (19057)..(19174): a, c, t, g, unknown or other
  modified_base (19613)..(19622): a, c, t, g, unknown or other
  modified_base (20300)..(20309): a, c, t, g, unknown or other
  modified_base (20365)..(20483): a, c, t, g, unknown or other
  modified_base (21173)..(21182): a, c, t, g, unknown or other
  modified_base (21412)..(21421): a, c, t, g, unknown or other
  modified_base (22371)..(22380): a, c, t, g, unknown or other
  modified_base (23516)..(23525): a, c, t, g, unknown or other
  modified_base (25354)..(25363): a, c, t, g, unknown or other
  modified_base (25454)..(25621): a, c, t, g, unknown or other
  modified_base (25960)..(25992): a, c, t, g, unknown or other
  modified_base (26074)..(26083): a, c, t, g, unknown or other
  modified_base (27521)..(27530): a, c, t, g, unknown or other
  modified_base (28309)..(28318): a, c, t, g, unknown or other
  modified_base (29009)..(29018): a, c, t, g, unknown or other
  modified_base (29838)..(29847): a, c, t, g, unknown or other
  modified_base (30357)..(30366): a, c, t, g, unknown or other
  modified_base (30429)..(30438): a, c, t, g, unknown or other
  modified_base (30915)..(30977): a, c, t, g, unknown or other
  modified_base (31594)..(31603): a, c, t, g, unknown or other
  modified_base (32517)..(32526): a, c, t, g, unknown or other
  modified_base (33101)..(33110): a, c, t, g, unknown or other
  modified_base (33632)..(33641): a, c, t, g, unknown or other
  modified_base (35673)..(35682): a, c, t, g, unknown or other
  modified_base (37095)..(37104): a, c, t, g, unknown or other
  modified_base (37502)..(37511): a, c, t, g, unknown or other
  modified_base (38119)..(38128): a, c, t, g, unknown or other
  modified_base (38721)..(38730): a, c, t, g, unknown or other
  modified_base (39287)..(39296): a, c, t, g, unknown or other
  modified_base (40763)..(40772): a, c, t, g, unknown or other
  modified_base (43119)..(43128): a, c, t, g, unknown or other
  modified_base (45253)..(45262): a, c, t, g, unknown or other
  modified_base (47433)..(47442): a, c, t, g, unknown or other
  modified_base (47956)..(47965): a, c, t, g, unknown or other
  modified_base (48391)..(48400): a, c, t, g, unknown or other
  modified_base (49049)..(49058): a, c, t, g, unknown or other
  modified_base (49728)..(49737): a, c, t, g, unknown or other
  modified_base (50729)..(50738): a, c, t, g, unknown or other
  modified_base (51042)..(51051): a, c, t, g, unknown or other
  modified_base (52621)..(52630): a, c, t, g, unknown or other
  modified_base (52717)..(52726): a, c, t, g, unknown or other
  modified_base (54197)..(54206): a, c, t, g, unknown or other
  modified_base (54833)..(54842): a, c, t, g, unknown or other
aaccgaataacttagggactataatatgcaccttgcccgtgggtggtgctcacacctgtctgcatttcatgagcagtacttgtgatgccccgtagagagagtcaactgcaggtgtgctgcccagtacatagctcgctatgcatactcggcaacacactagcctgttgacatcatgcccccctgtacatggactctggaggatcggagcgttctgaatgacacccgcaccgtgcacatgaggatactctcattgcataggtgaagacagcacagctccagctcagtactatacgctataaaannnnnnnnnntcgtgcacaagagaatactcccattgcataggtgaagacagcaaagctccagctcagtactatacgctataaaattgctttaagcataaggccattgtgcaagagacaagataaaggacgaaatgcagtgcttcatcattcagaagcgacggcgctatcaagtatttctccaaccgaaagcttcatcaagaatgacaccgaggatctgatttggctgaaccaagtgcattcgtacatttaattgttcaacattaccgcactcgttggtcgatccgtgtgctcttcatcttcttacgcttctcatgttcaagttgtcacacgattgatcgaaggcatcgaggctgagcagtctgactgagaggtcagtcctgccgcgttcttgctttctccagtccccatgagcaagcggacgtattgctcggctccgcaccacgtgagctttgcgatacgatttgtaaacacacgtttagcccgcgttccagtgtgtcgcggggccattccagcttccccacccagctgccaccgtggttccatgggttgcagggcgcccatgtgcagctcagctgcagtacaaattcgtctggcccccttctcaacccagtttgagactagtttatccccatttaaccctttcggtggtccgggaaagcgtgggtgaggtgggtgtgactgggacccggagtccaccataccaggaacgtctacccagcggagctgccatcgctggcgctttgccagccactcaggcttcgcaatcgacggatagcacccaaacatgatcttgcacgtcgctgtaatgtgatttcggtggtcgtggtcatggcttatcctcccgtgagggagcaccgcctccaatcgaataggtcgcgccacattggggccgcctgctggactgtggttgccggggcacacaaaggaattatgctcacccgaaccctgatacaacaagattatgtagcacactcgagcatcagatagacggcacaaatgatttgtgcgattttgtcaacactctggctccatggtgctcaccattttcaggccctgatgaggacgacctcttatcatcaagcaatgcatgcatccacagcagaaggcagtgcaggtctacccaccacaccgcaggcaggtcaactttcagatatttcatattcattcagcatcctaacgggcataaatattacgctgcgtatgaggggcttgggataaggggtttctccccctggtcacggtggccatcttagttgttgttnnnnnnnnnncattacgcagcgtaagaggggcttgggacaaggggtttctccctctggtcacggtggccatcttagttgttgttcaacggcgagcgtgcatctgctgcagcaatggcatccagcaccagccgccagaatgcagcgacatccatggcctacatggtgtggtggatggatctcggcaaatttgcatagggaagtgggcccccctcaaccaggattggaattctggcatcgcatggctcccacgccgtgcatgggtgttgctcccaccccctggacaacctaccaggcagacggtggcgttgggggcccggccggtcgtgcgtcggaggtcagtgacggtctgaccagcgctgagcacgctgtgcgtctccacatccactctcaagtgcgacgcctgtcgaggtgagaggagagagctgtcgtgagggggaccaggtgcgttgcaaatgcgcccagctgtgaaggtttcccatgcaccctaccttgaagaggctgcgatcaatgacatacgccacagcacatgggtcgtgcagcggagggtgcacgaaatcgaaaacctccttgtactagggggcaggcgagtggagtttacggtacggatgtcaggtagaaagcaggagggcatagnnnnnnnnnntcttcagcctgggctggctcgcagcccctccccacaccacagcctcacaacctcagggcccgggccgccagagcctcacnnnnnnnnnntcttgtactggggggcgcaggcgagtggagtttacggtagggatgtcaggtagaaagcaggagggcatagcgcaggcaatggcacagaggcagggtggtcatcgagtggcccggcgcgccccatggactgcggcccagtcgccaatgtggcgccccagccccatctgagtcaagatgacaccttgagcctgggcaggcacgcaactcctccccacacaacagcctcacgacctcagggcccgggccgccagagcctcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgggtgaggggtgggacggcgtggggggttcttgccgggcgcccttgaggggaggggcggacacagtgccagggagacaggcatcgcacatctttcaacggcggcacagccggcgctgctgcctgcttnnnnnnnnnncgtcttggcaaagaagtgcagcaggtcgtgcatggcctggcggaagggggtggcgccgccgggggctgctcccagcaccgctgtcgccacctctgggccaaccagtgccgtatgcgtcacctccagagggaccatggtgatgcgggcgccgctgcgcataaccatggcggcggcctcggggtcgacctggatgttgaactccgtggaggggcctgagcggtgtcgtgtggagcgtagaggcgtgggtgaggggtgggacggcgtggggaggttcttgccgggcgcccttgagggggggggcggacacagtgccagggtgacgggcctcgcacatctcccagcggcggcacagccggcgctgctgcctgcttgcccggcattgtgagcgccagctctggaatgccacccgagacccctcctcacctgtattcccagttccgagggcgccccccatgaacacgatctcgattcggtccacgatttcggggaacagggtcagcaggagggccacgttggtcagcgccccagtggcgacgacatgcacgcgctgtgcacgctgcgccgctgctgcggcgatgcgctctgccatgacgacaacgccacgcggctgcagcggccctgcagcagctggagcactgatgtcggtgtcggtgcagcgggcgcccgtggggcctgtgctgtgggggccgatcccggccccttcaggcacaggaggaagcagtggcccgccactagggccgtccaggcccgagtcgccgtggatctcggcgcaggccacggggtcccgcatgacgggccggccctggccctggaccacctccacccctgccagcccggcagcgtacaggaccctcctggcattttccgtcactttctccacgctctggttccctgcaacggtgctaatacccaggaggtgcagctggggactgtaaccagcaagtaggatggcgatggcgtcatcgtgccccgggtcgcagtctagccacacgggggtcggggggtgcgtcgactgcggcatcgccgtgcctggccggctggattgacgggggaccgatctgtgaaacaatgctttgttcaaacactacgattgggtaaggttcacctggtgagttagtcgagatccggtgnnnnnnnnnncagccacaccggggtgagggggagcgtcgactgcggcatcgccgtgcctggccggctagattgacgggggaccgatctttgaaacaatgctttgtttgaacattacgattcggtaagattcacctggtgagttagtcgagatccggtgcaagagtggccgatctcattcggaaatccctgtgccggccggccgccggaacaggtgtgaagttgctgacctcctctggtacatgaagttgctcaccttcagcctataatccttagcgtggttgaatttcacatgtcaacatgggtgcagggtgatatcagggaccatcttcctctcggtattgcccaatggcaggcaggatcaggatcctcagggctgcccagccatggtggcagcgagcatgcacaggtcgcccccgatgtaagatgcaactcgatgcaaaagggtggtacaggcaaaagtcagggactggaggttgagtttcaggtacgtgcatcgctgacgccgcgctcgccactcagcagctgctgtgccgactcagtgagggcctccagggcggcccggagcttggccacctcctcttcggcgtgcaggatggagtccagcgtcctccggccctccgcctcagcgcactggctggcaaatgcccgaggcactgggacagtctcggggcgagggactgcctcctcctccgaggccaggagtgtgctgctgtggggtagggtgctgactcgccatgtgactcgagggccgaacgcctgtcggcaacagcacagaacagcagccagcatgctgagttggacgacacattgccgcagcccaccccactgccctgcagagtcccatcctttccgcccaccagcatacctgggcagaccctggtgctgcgatgcctcgctatggatcccgctctgcccgatgccggaagtggcctgcgagggggaggcaagcacagctgttccagggattgcccaaggcgatgccagttctattcccggccgctctcagccctttggtcgccatgcgcttggcgacccccccccccacacacctgtccggcagtagcctctgttgatgccttctgcgcggcctcctgcgcagcatccgcctcaatctccgctatcctctgcgagtgggatggagggaccgcagggccgatgactgcctgcgaccctcggcgagcaggcatgcgtcgggccggcacgctttctgccagggaaggcggccatctccgccccgtacttnnnnnnnnnnagcctcctgcgcagcatccgcctccatctccgctatcctctgcgagtggggtggagggaccgcagggccgatgagtgcctgcgaccctcggcgagcaggcatgcgccgggccggcacgctttctgcaagggaaggcggccatctccgccccgtacttgcctgcatggacttgacgatggacagggtggccgccacctggcgctggaaggtgcggcggatgaggatctcctcagcggccgcccagtcggcgctgctggacccgctcctcccacgctgctcccgcctgagttgttgtggcagagaatgcactcgggggatggatggtggggcgggggaccaggggagctctgcggcgccccgctcggcgccttggcggatgctggagtctcggatgggccagctccctttccagaatcccagcctgggccaccacgagactccttgccgtaccccttgccattggcgagctccctcacccaaggggcgcccccaatctctcgcaccccacaacctcaccagcatcgaacgctcagtggcccccagcgccataatgccgaccccatccttcccccatccctccactcacgtgttgaatatggcccgggnnnnnnnnnngacctcaccagcatcgaacgctcggtggcccccagcgccatgatgccgaccccatcattccccctttcctccactcacgtgttgaatatggcccgggccgcgtggcctacctcgtcaccccgtccctccaccaggcgccgacgcaccgtcctccagcagtcaacgtacgggtgggcctggggcctggcctcgcgcacggcgcgcagcgcctcctccagccccagcccctggacgaaggtgaggtagcccacggtggtcagcgtcgcgcgattgatcccggcggtgcagtgcacgtagacgcggtgccccatggccagcagcgtgtgcagcgcgcggaccgcctccggcagcatggccgcctggtcgtcgtggtcaaagtcgcggacggcgacgcgcgccgccagcaggccgcgagcgcatgcgcgggcgtgcagggcggagtagtcgatgcccagggcctccaggcaggcgtcggactggagggagaggatggccgtggcgcggccctcctccacgatgcggtcctggggaggaggggggggagtgggaaggggagcaggaagggtgtgggggggggtgggatccaggcggcgaacagcggagtgtcaaaccatgtacagcccgcccactcgccttggggccgcgccgaggacccagggcacaagcgcaggccattcagagtcccccccctttctcatactgtacaacccagcccacacacgatgtcggagggggagcgggggcaggagccgatgaggatggggtgcccaggcagggagtcccaattcagggtccaccgccactcgtcagagctgccctggcccccgccgctctcctgccagcgcgctttgttggcctcctcctcctccttactcacaggtggagctcctggggataggagcacggggctgaatgagacaaagggaaaagcacaatccccaccaaggtgtgtaccggagagttgtgtgggtgcgcctggggcagctctgccagggaccggtgttctcaggttcggatgtaccttgnnnnnnnnnnggtgcgagtgcgccttgagcagctttgccagtaaccggtgttctcaggttcggatgtaccttgcgaggcctgtgctgcaatgtgccactttttagggggcgcgtcgcggcttgaggaaaagtacgggcgggagctgtgtcgagctgtggcaaaccccaccttgcacacagatcgcacgggatggatgcagttcaactgctgcattgcgactacgatgagtttgaggatttacagagaggagcgcggggagggcgcttctgcgccggttatgatgcccaggcaggtaagatacctcagcccgaggcttggcgcctgctcgcctgcccagagatcagattcgcgagagcgcgctgaaagggtgtctcgtgccgaagtcaagcattctcttgacctctccacatgctcccaagggagaattcgtgaattgggagtctctaccgctcaagcctcgtcaacccgacggcggtgacggagtgtcttggaggtgaccagagattacggaacgggaggtcgctgttccgaaccgccccccggcnnnnnnnnnnacggtgacggagtgttttggaggtgaccagagattacggaggtcgctgttccgaaccgccccccggcagtgaccggagcgtcaagctcacctgctgctgatagagcattccacatgagtactgtgggaactcctcacaaaagggggcatgcccgctctcggtccagtgtggcgggcgaggagactcccattctccagggctggcttgcgaggtgcggaagggtgcaggaagttgggacgcgatccactttcagagagcggtcctgggattcccatggtgctgagagaaccttacaatccgatttacgctcctttgcagggagtcgggtgtggtcagcgcgctgctgaacaagcggtttggagccctgtacccaacggcgctggtgacctacaggaaggagactgacgaggcaagcagcgggggtatggttggttgtgtgttcgggtccagcagggtatgggtatgttgccggtgcaggatcacccgttgcgatccttgctgaccccaggcagggcatggccaggcgactcgctgcattgagcgaacccttcctccctcccacccttcctccctttcctgaacccagaccccgtccaaggtctggtccctgagccgggacgtctcgctcaccccagtggaccgccacacgttcaagctgcgccatgccaagaccagcacgttgtgggcggttaccgccaaggcctacgatgctaaggacatggtgagagggagtgggtgggtgggtacttgcccatacgtgcgtggtgtgggatgcgcccgcagcctgggctgacgagggggttgagggtggtaaggtcccttccccccctcagtagctcattcccactcgtactttgtaacctgttggcgctcaccttcctaattcctcattctccgtgccctccttcccacctgcaccgcagtggggcttctcggtcaagtggcccaactccggcatcatcgggcaggaccacctggtgctggcgtttgaggaggaaagagaggcggagctgtggcaccgggcgctcagtgacgtcattgcccgcctccccgcccgcaccgtctccggcatcggggacctgcactcccgccaggcctctttgacctccgaggctgatgcaggggaaggctccccgccccccagccccatgaagagcgggctgggagctgagctgggcgctgagcgtggcgcggtggcgacgggcgctgagggttccgccgccgccgccgccgccgccgccctccccgccacggcggtgccgatgcgtcacgtgcgtgcggcgtcggaggactccacggcgcgcccgcgcccgcgctcctgggcctcggtcatgcacatcaacggcgtggcgctgtttgtggaggactcggatgccgacgggtcggggggcgccatcatggtgtctgccgtggtgaaggcgcccccgcacgacgtcttcagagtgagtggggtgggtggagaagtgtgtgtgctcgagtagttcggaggtgtcctgggggtgtgacaagcgggggggttctgcttggccgtatgcttgcctccagctgggtcacaggaagtagggtacagcgggaggtggcccgacgctggtgcaagtggctagaggcatcaagtgctgcccacatcaacacgatcccttttttgccccccacccctgcagcacctggtgcacaaccgaaagacggagggcaaggacatcttctcgggtgtcagggttctggaggtcatcgacgccaccacccaggtcgtggcccagacctggaatgcgtcaggcatcgcgagcaggtcggcacatgctttctttggaaagagggaattggcagtggacaggctggcagccatacacgaggcagtgttgaggaatcaggtgtttccctgcacaatcaagtcggggcgctctgtggagtgcggtgcacgagtggcgttagaaacaaggagtgtcttgctcggacccgtggcccggcnnnnnnnnnntgcgagcaggtcggcacgtgctttctttgtaaagggggagttggcagtgggcaggctggcagccatacacgaggcagtgtcgaggaatcaggtgtttccctgcacaatcaagtcggggcgttctgtggagcgcggtgcacgagtggcgttggaaacacggagtgtcttgctcggacccgtggcccggcgctcatggttcgggcgacgatttccacccccttaaaccaagctccctccacggcccacctatctgccctccctctccctcctgccttccctgcagcttcctggctcccagggagattgtcctnnnnnnnnnntgtcttcagagtgagtgggatgggtggagaagtgtgcgtggttgagtggttcggaggtgttctaggggtgtgacaagcggggggtctctgcttggccgtatgcttgcctccagctgggtcgcaggaagtagggtacagcgaaaggtgggccgacgctggaccaagtggctcgaggcatcaagtaatgcccacatcaacatgatctcttttccccccacacccctgcagcacctggtgcacaaccgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcgacgatttccacccccttgaaccaagctcccaccatggcccacctatccgccctccctctccctcctgccttccctacagcttcctggctcccagggagattgtcctgctgcgaaccttccgtcgcgacgaggacggaacctacatcgtcctgtaccaggtgggacattccggtgactatgggagctctttacaggaggagagggagggagggagggttgtgatcctgttccggccacatcagatcccgccactggcatgtaatgagccagcaagctttggggcggcggtcaggatgcccgcgactcggaccctgtcatcatggcccgctcacagcatctgcgacagcacaggcacctcaccccctcgccccnnnnnnnnnnggccagcaagcattggggcgtcggtcaggatgcccgcgactcggaccccgtcatcatggcccgctcacagcatctgtgacagcacaggcacctcaccccctcgcccccttgctccctcaccacccctccccctcgccccctcgctccctcaccacccctcccccctcgccccccccttgccacagtccacgcggcaccgctccgtgcccgagtcgcggagctggggctggaacgcccccgtgcgcgtgggcgtgcaggccgcggggttcaccgtggcgccgctgctgcccaagtaccacactgagggcgagtcgcgcgagtgcctgctgaccatggtgctcaaggccgactttggcggcgtggtcagcgagcgctcccgcctcgcgcgcttgtttggtccgctggccggcgtcggcctgcgcggcctgctggagcccgtggtcagctccgtcatcgtcctgcgggacaaggtggagcaggacaggttcgtgctgcgcccgctctcctcgtcggaccccaccgccgcggtgggggctgctgagcccctggccctcggcccggcggaggaggcggcgcggcggcgcgccgcggtccagaagcgcagcgcctccacgctggcctaccgccgcgagccgctcctcctcgcccagcgcgccgtggcggcggagcaggtgggagagccgtgctgtgatgggcttgtcgttgggatggtggtggacgggggtgatgggaacttcaggagcaagggctggtttgcatgtgaccccggtacagcggcggtctctgttgtttttggtgagtgggctacgtcgagtgacgcggggtcgagtgagggaaggccaggggctggagcgctgtagcaatgcttaacctcccaaatggcccgagctgtggcgatgcttgagccggctcatccgccccctcccaccttgacgcgcaatatcaaccccttgcgacggttgtctacccctcttgcagctgtcaaggctnnnnnnnnnngaccttgacgcgcaaaatcaaaccccgtgtgacgcttgtctacccctcttgcagctgtcaaggctgtccatgctgccgcctggggctgtgccgggagcgctgggatcaggcccctcggtctccggcccaagcagcacgggcgcggcggcccctgctgcagacgctgcgccggcggccgaggcgggcgacgctgccgccgcagagagggtggaggaggacgcctgggccatcggcgggacctgcccccgccagttctggtcctgccccggcgatgcagggttcaaggtattgtgtgtgtgagggggggagaggggagagcatactgctcgttgtgagggactgtgagtgtgggccaacggtgggggaggggcagagggattcgcgcctgatgggcggaagaatgggcagtggtatgggctcaagtggagagaggatggagaaaggcagtcctgtgagcgtctcatattgttttgtatcagaagcgcagcgacccaaacaggatggctacctttgcgacctgagccaatgccttgccgaaatctcccactcaatgccagccatccagatgcccgcccgccccatccgtgtagttctcgccaacacacttcgctctctcaccctccaatactcacccaatgccccccttttttcccgtatcaacccttctaggtgcgtggcccgagttacctggccgacaagcgcaaggtccctgccggcccgcccgtcttcgagctggtggcggtggacctgctggagctggaggagcccatgctgcatgtcgcgcggcacctgccctcggtgcgcaacgcgcccgcgccgttcctcttctgcgtccagatgatggtgccctgcaagccccctgtggccctggtggccagctgggcggcgccggtggccgtgctggacgtggcagaggccgacctcgtcgcggcctacgaggcgcacagcggcaagctgacgccaggggacgcggccttcctcaaggccctcgccgcgtgagctgggcggtgtgtgtgtggggagggggtgaggtggggtgggtgctgaggtcgtgcggaagggggaaggtagggccgggacgaggggtgatgacggcggggcgcatagccgactgggaagttgttgctcagggtgccccttcacatgcccaaccagtgccaatcctgtgtcgagcgcattccaactcctcatccgagctgcgcagcttcatcaacggcgagggtcctgaggccgatcgggcacgcaacaagcagttcaagctcatcccccacatctccaagggcgcctggatcatgcagaagtctgtgggcacgacgcccgtgatcctgggacagaagctgactaccaagtacttcaagtgagctggggtttgaggagggccgctctgcggaggtttcttatgcaggaagccgcccagatgtatgctgtggccagcgcaatacccggatcttgcctggaccaccttcaattcccctccctcccaccaggggaagcaattactttgaggtggatgtagacattggcgcgagctccgtcgcggcgtccatcacaaacatggtggttggggcgacaaagtccttgaccctggacatgggcgtcttgctagagggacagaccccggccacactgccggagcagctcctggggaccatcaggtctgtgtctaggagtgggagacggtgttgtattctgcagcggcgatgtcacaagagtcatgactgtgctgagacaggcacgtgccacaacaaggcatgactccacagtggctcatctcaaccctcacatgccgaaaaaccacacatctcacccccctcagactcgcggcactggacatgaagaccgccgcctactttgatgagggggcggggcgcatcatccagcccgaacagctcaagtaggaaaggatgggcagcagggtgcgcgaaggcctccccttgccccatgcacagctgatgtgcatgacccagcaggcattaccttgtgtcagacgagtccttacccatgtagtcaatgcgatgatagcctcgctgacatgggcttggcatttggggggcaggtttcgcattccaggtttccaccacacgaccgtgcgcgacagctggtccgatggggggatgccactgcctccggcgtcgatgatcgggtagggtcgggagcacccaacacctgcaaataccccagtccgtccatgcgaatccctgatcggggcagaggaggacagggcgtcggtcggcaatcatggtgtcgaatccccgtcgccacctccagatcctggtcgtgagctgcgcgctgccctgcctcctggcctttgcgcgcattgaggacgacaggacctggtactccattgccctgagcgcagtggtcagctatgcggggctggtggccaccaaggccctcgtcccgatcgtcaaggccttcaacctgcgcgcggggctttcagggctggacatcaataagaagggaagcccagcgggagagaagaagataccagagtccctcggcctggcgtccggggtagtcttcctggtgaggctgcctcgtatggtatcatgggcagtggtctttgtgagattgtgcaggatttaggggctctgcagtactgcagcaccgatctctatcccagcacgccatcacaggtgtgcatcatattgtttcagcagctgcactactacgacgccgcctccttcgtgcggtggttgacgcatggcgggagctggtgggagctgaagagcgtggtggtggagcaggccagcgacgcatggtgggtgccactgcctgctgctggggatctgataccgacgcatacctcctggctggttgagacaggagcctgcagctatagggcctcgataccttagagagagccgagatgcctgtgtcagtactccctgcctctgtgtcaatgccagttcctcagatctccaatcctcgacatgaccctcacacactatctcccgacaaccccccaaaccctttctcaccccatattgtctccactcgccaggctggtggactacaacgcagccctcgccaccatctgcttcatgctcttcctgggctttgcggacgatgtgctggacattccctggcgagtgaagctggccctgccctgcgtcgccagcctgcccctcatcatcgcgtacgcagggggcaccggggtcgtggtcccgcgacccctgcgcgccctctgcttcggcctggggccccgcctggagctggggccgctctattacatctacatggtggccctggtcatcttctgtgccaactccatcaacatcctggccggggtcaatgggctggaggttgggcaaactgtggtcatcgcctcggcggtgctatccnnnnnnnnnnctacatctacatggtagccctggtcatcttctgcgccaactccatcaacatcctggctggggtcaatgggctggaggttgggcagactgtggtcatcgcctcggcggtgctatcccacaacctcatgcagctggcagggaacatcccagacgaaggtgggaatggcaaacggcacagagtgtggggagggagggaggggggggggttaatgcacaatggttggtttatggaggggaagggtatgggatatgccatggcctttgcttgatcggccagcccggcgacataagcaagcgctttctgagatgcagcggccagtcattattccggcagccctcccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtagcagcattttagatctcacccctctctcgaattgaaccgaccactttcaggtcttcgttnnnnnnnnnncacaatggtcggtttatggaggggaacggtattggatataccatggcctttgcttggtcggccagcccggcgacataagcgagcgcttgctgagatgcagtggccagtcattattccggcagccctcccaaatggcagcctcttctcctacctcacgttggagagtacgctcctgagctgccttcccctcctgcttgcagttcgcgacggacacctcttctctgcatacctcatgctccccctcatcacgacctcgatgggcctcctgctcttcaactggtatccctcccaggcaagaaaggcagcgatggattttgtctgtttgaaggtgtagtgttgtggtcaatgtgctgcaactgacccatagaatgggctgctgacattcccagctcctcatgcacagccaggactctttagcagcatttagatttcacccctctctcaaattgaaccgaccactttcaggtcttcgttggcgacacattcacgtacttctcgggcatgactctggcagtggcaggcatcctgggccacttctctgagacgctgctcatgttcttcatcccccagatcatcaactttgtgtacagcattccccagctcttcaagtgggtgccctgcccccgccaccgcctgcccaggtatggattgaggggtctgtgccaccgttgagtgatgccagggtgggctggttgctcgggtgtcctatccactgcaactcctgggatgacagcacaatgtttgataccggcgaggcacacactctgtgcccaggtacgacactgccacggggctacnnnnnnnnnncatccactgcaacttctgggatgacagcacaatgtttgatactggtgaggcacacactctctgcccaggtacgacactgccacggggctactccaccccacaccaaactggaatctggtgaacgccttcctttccatctttgggccctgcaccgagctagtgctgtgctcacggctgctggcattccagggcctctgctgtggggtggccttctgggcgcggcacgtcctcgccggggtgtacaaggagtgatggacgagacatccctggcaaaccgatgggatccgcctgacactcgacacgcacatccctgcacgccaccacaagcagcccacaactctgcacgtgtgcatgcgatgcatgcagcactctacccatagctgcacatgtcgcagaccttcttttgcaacgtcgggcccttgacccttgcttgccttgcttgctcttcaactttttgtgtacagtcccagaattgcagccagaatccgggggcatgcacaggaagacaagcacagcacaggcctaatcctccatccactcctctgctccgaggtcggagggcggcgggtacttctgcagcccctccagcnnnnnnnnnncctcctctgctccgaagtcggaaggcggcgggtacttctgcagcccctccagcaccttgtcgcacttggccatcatgagcttgaccgcatactcgaatatctcgtgcggcctccatgcccccgtcgactcgatggtgaagatgaagtggtccttgaccttgcgcagctgcagcacatcctgccacttgggctcgccactcatcgcccgaacctggcgattaggggggtgaacagtgaagagaagagaggcttcaccagtcctatgtgtcagatagtgtggcgaatgcaagggcggggctcctccaggcaacgattccgactgcacagaagtcatcgctttgatcgatcaccttttcgaggaggacgtcgtgctccaatggatcattaaccactgcagacccgtcggagtcaacagttatgagcccagggagcnnnnnnnnnntaggaggatgtcgtgctccaatggatcattgaccactgcagacccatcggagtcaacagttatgagcccagggagctcccctgcagaaggagggaggccgcgacgacattgagaggtcaggactgcgtcggcacaaggggatcatgtcgctcaagctcggtgccagggttggnnnnnnnnnntgacattgagaggtcaggggtgcgtcggcacaaggggaccatgtcgctcaagctcggtgccagggttggctcaccagcaccggggtatattcacctatatccctccagtacaccacggtcctcatcttcccccgcacctgcaagctctttggcgagctcgtccttcacaggctgcagcagtaccacctctggcatgaagcggtaccatgcagtcgccactggcgaccactttgcatgctcctccccaactcctgtacaggtcatggaggaggtacgagggggtcagcaggagaccttggcgggttgcatggttctgtcgcaacattcttcgagattggcaagcggcctgaaacttccctcagatccaccatttgccttcccctccacacccacggctgcgcaattccccatccttaaatggatggtaaacaatggcccagccagcacccacccttgacgcagtgtgcctccagctctatctgctggcccacccggagcttggccaagaggatgtcggcgttcacggggtcgacacttggcatgaactcgacttgcggccggacaaatttgcaccccgtctcgtctgggatctctgatccatgtggaagccacttcaaggccttggcatacacctgctcgcagcatgggaagggcggtctggctgggattgaggatgcctgtttgcgctgcagtcctcagaggctgtcctgaaaatagactgccacacccagtccatcccgggataccgccacaccccctggacgcaccttttcattcgtcacggtgccatctggctgatagtggcaggagagcttcatttttaggatcaccgtgnnnnnnnnnntgggataccgccacacccccctggacgcaccttttcattcttcagggtgccatctggctgatagtgacaggagagcttcatttttaggatcaccgtgttcaattcggtggcaggctctccatccagctgtagggtgggaaggagggcgtgggatgcgatgatgcaagtgagcaccggagagagggaggcgacgttgagcagcagcgagcacgggtgcacatgtcacgagacacaagccgcctgctccaccgtgagctggctgcagaagtgcattccctcacccggtacttgagatatctggggtgtagattcagcggcagcagaccgagccgatgggagagcatctcgtcgctgatgaggctggtattgttcaggatgaaaacgtgctcgatggcaactgttggagtctcggccaacataatcctccgcagcgagttggccacctgtgcatggaagtgtgcggcatcagcagcaagtgaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcagcacagcaaggcacacccacagcaagaatcctgcagagcggacccaccctaccaggatacccagcgcccactccttccctccccgccggctcaccgcacagctgatgcccttcatatggaaggtcatgtcgttgccctcgtactgcgtgatgtcaatgctgaagcccttcttgaagcgggccatgtcaaagatgttgggctcatcgctcgccatgaactcgacatcggtcatgctgctgttggtctgcttgaagggaggcgacagggcagtgggtgcagacacagagctggacctgtccaggtgtgaggagccccagtgttggcacctggccgggcctggccatgtagctttcctcaaatatataagttcgctcacttgacaataaggcatcaagcacacaactcttagcaaaggtcctgctccttgcaccactnnnnnnnnnnattcgctcacttgaaaataaaggcatcaagcacacaacacttagcaaaggtcctgctccttgcaccactcacgtatgagttcatgttcggcccgcacactatgcgtgtccgctgcagctccaaatggggaggcaggcccgaggtggaggggccatcatctgggcttgcgccatcctttgctgcccccttcttcttcttgctcttcgtggaagcgttcaccatgcttgttcgcgttgaatgaagcgaggactagagctccacgagtgccagcatgcagtgtcttacagggtattgcgacgcagtcttggagcacctcgattgacttcagtgtctcaatgagaagagtctggtccttttacgtgatttcgtcggctgaaggctgggtactaagagggaacaatgcccaacaagcccgcatcccgcctagttccctgcgcgcgcgcgctatgggaggcttcctccccatcattcgaaacatgctgtactcgggagaactctcgtggttggtattgtcaatcaggatgacaatgcattagatagtaacttttcgaaagggcgcaatgttagctgtcatgcgctgagcgatgaccagtcactggaaccagcggccacagtggctgacagcccgattgcccgtcaggcgcaagcggtcggccctagggggtgccaaggcttgtnnnnnnnnnngatgcatttgatagtaactttttgcaagggcgcaatgttagctgtcatgcgctgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattctaggagccctcccccttatgctcccaccccgtcacatcacaggcacctcttgggatggcaaaactccttgggtgtggctgtcctgaaggcgctgacgtcgctgatcgcaggcctgcttggcctctggggccttggcaccctcctctcccggtctggatcctcagagcagccagcactgactgcgtcgttgaccaacaggcagcgtgctctactgggactgccgttgcagccccagagtgcctcggagactgcaggggctgcacctgggagggggccccttcctgcccagatcccacatgcaagcctcacaccccctctggtgagtggaacgcaatggcagcatgcggcggggttggatgctgtcctcctgagcgctctagtgcacctgttgattcgctccgtcctccgtgccgcagcgccgcgctgtgaggcagccgggcggcagcctctactcggcgccctcccctgagcctcagcagcaccagcagggttccgggacacccccctcaacgcatggctggcgaggtgctgtccggaacccttccccctccgagtttgccggcatgttggtacgcgaccatatctgtgaaaggataggggtgcccagtggctctcataccctctggactcaaccaatctgccctgcagtgcaatggtaaacctacatgctgaagcctccccttcnnnnnnnnnngtatctgtgaagggataggggcgcccagtggctctcatgccctctggacccaaccaatctgccctgcagtgcaacggtaaacctacatgctgaagcctccccttcctctgtcaatgctgcacaggctgagtttgacgcccactcggtcgcacccggccagccggcctgtgcctcgccgtacgacatgcatgccatggggctgccaggcgtgggcctgaatgggggcccannnnnnnnnntcacttggtcgcacccggccagccggcctccgcctcgccctacgacatgcatgccatgggcctgccaggcgtgggcctgaatgggggcccatcccccacataccggccctccctcctccccaggggcaaggccgcccctgtgcaccggggcggtgagaggcagctggccccctcgcccctggagctgcgatcccgggtcctggagcgactgggactctcagaaaatgacctccaggtacacttctcgcacaggaagcctgcctgcccccttcagaaatctgggggctgtggattttcaggggggcctgatggtaggccaggctaggacgcatactgggcctgtgttgccagctgcggggctcaaatctgcagcataataatacaaggaaacgctcccccgatcatcccacatcatttccaaggcgagcaccgaggcgctgcgggagtggatggcccaagaggtgctccagccgctggtcgacgcaatggaaggcgcgcacagcagggtggaggagagcgcagcgcagctgggactccagggcatccggctcagcagcctggagagccccgcccccctgtccctcgcatccaagagtgaggccaggggtgatttgtttcctggaatcgatccgagcttggctggggccgcggcgctgcagacccttcagccaggccagtctcctcagtccaaactcgtcctactcaactatcctaccagacctggggcgcggggagggcatcgacgatgaggccctggtgttgcagctgcgagaccagatcgtggctcgcctgaggccctccggcacattctccctcacacccgacgtggccccgccgccagaagccctggcctgcctgcaggtcgggcagcaagggtgcaacggcggcacatatctctgcatccatcgtagagattgcctttgctctctactacaaagttttaggatcannnnnnnnnngcggcggcgcacatctatgcatctatcgtagagattgccttttgctctctactacaaagttttaggatcacactggggtaacaatggcagggtgcatggtgctggccatgccctgacaggcactactcaacgtcgctgaacccatcgcccctcttcactgattccttgcccgctacatgctccttccaggccatcgccacataccagcagctgtctgccgtgctcaagggcgaggccccgcccggaatcctcccggccacgcctcgcggctacgtggcaagccgcattcgcagactggctggtgggtggattcgttttggttggggaatgccggcctgctcctgatggcaggttgctgacatgatgcaacccccctggggcgctgtcatggcgctgccagcccctttcctggcaactttcacaccctccacctccatacagagggtccctgcgtgacggcctttgactggtcagcggggggcctctttggtggcaagtcctggacgctggaactaccaacagactccgtgctcctcctgtatatctttgccgccttcctggccgcccctcattggcacttcctacaggtgcgaatgcgcttggccgattgggctgtcagggcactcgcttagtttttcgggggggggggacaatgtgagggaatttgcaagaatctgcagggactgctttgtatgggcctgctggtgaactccccagcacctcgtgcggctcatgtccatgctcatgcgggtagcatgttgtgtactgccaacagccttccttacaagtgtgcctggcacggtgcaggaccctgccacaagcagcagccaggtggatggagggcagggcccgctctacctaggcaagctgccgagcagggtttcagggccctactttgcgatcctgcccctgcagccgcccgccaaccaccaggtgggcagcggaggcggggcatcggggcctcctggccgtctccacttctttggcgcatgccactcttgtgtctggccgcccaggggccacaattgtgtggcctgctgtcttcccgcagatctcgagacgtggagcgtttcctttttcatggctgacggtccgctgcttacaaatccaccatctcccacgatgcccatgccggnnnnnnnnnnaagacgtggagcgtttcccttttcatggctgacggcccgctgcttacagatccaccatctcccacgatgcccatgccgggctcacacacagacctctacacccacacaggcaaccggagtgattggcacccagctgggcaccgccgccccactcttcagcctggtgctgaatggcaatgtggtgctgaccagcggggggaggggggcactctgggacactctggccctcttcctgcgccactgcgcgcgggagtgccacggagcggtgagcagccgctccctcgccttcttgggagtagccgaggccgtcgcaccggagtatggtgcgcggaggatccccaagcgcctgctcccgttgctggggtggtgaatcggaggcatccatgtcgttgtagcgccagatgctgccttgggccagagaggctcaccccggggggtacgcgcgcgaattcaaccgtgcgagcgcctgttgtcacctgtcggagggtccggcacttacttgcgtatgcacggggaagagtttggtaggaacgagtttggaatttccagtttaaatcatttgaacgctgattagagaaaagttggcctgagcgaggaccctccggtgcacctgtgcgggctcgtcactcgccatggactgcgagctcgaggcgtccggaacacctgtagacgcggctggcgcttcgaccgcgtctaaagaagatgcattggccgctctgcccagctttgggcggccaggacggaggaagcccgacccgcggcggcagtccgtcgcactcttcaacgccttcagccagaccacgtcggggcggggcttcctgagcggtgatgagattgccctgggcgacgaggacgttcagatcccacttgacaaatcgggacgcctgctcgggggcgtgtccaaccacagccagctttgggtggagcctggcatggacgacctgctgagcagcgaactgcccagccctgagctgggcgtgctgtcgcaagcatccggcggggcggcaaatggagggcccttgccctccccgatgcgcgggttgcacggggccgagagtgagtctgagcatgctgccattgcgtgcggtaccagatggtcgcgatcttgcccccacacatccacctggccctgcctgacaacccacctatgccccgccccgcagctctgcacgccagtgagctcgacgtgatgagcagtgtctcggtcctgggcgggttcagccgaatgtgtctaagcactgctgagacgcttgagagcttgcccgaggatgatttcttgagcaaggtacagaagttcaaatgtatgcaacctgctggtatggtgcaaaccaggccctgcacccgtgcaagtgctgaggctccgccttccctcctatcgcaggatgtcgacgctgacaagttgggctgtctattccatatgtctccatcacgcaagaggggcgaggcaggggcggcaatggctgggacgagggcgagggcgccaagcagccacacccagtccggggaagggagcccctccgaggcactgccgcccctgcagaaactgggagcaacacccgtgcggcgggaggagcatgactggagcctaaaggcctgcaggccagacccccatgagccagggctccgtacaccttcgcagcccagccagcagtgagtgaagggccttgccttggtcagggcatcgcattcacaccatagtcatccatttcccaagtgcatgaatcgcatcggcagtatgctcgtccacaatgcatggcccatcctccgactccgaatccaggtctctaacgcagccgacatgtaccccttccggcgccctcccccccccnnnnnnnnnnggattcccatgagccagggctccaaacaccttggcagcccagccagcagtgagtgaaggcccttgccttggtcagggcatcgcattcacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcctgctcctccagcacacccagccgcttgccaaagacgccgagccgcctgccccggccgccccccctcgcccgcgatgccagccggggcgccacccgcctgccccaggccccaggccacggccgcgtgcccggcggcgctgcgccggcggccagcagggcacgcagcggggccccggctcccgctgcccagccagccaggaaggccgctcctgcgtcagctgcaccagccaggaccgctcgcctgccgtccaggacggtgaagaaagcgcagccggcccctgagccggccgcgcccagcgttccgacgcttgccagcggcgactgtgctgcgtcagnnnnnnnnnnnnnnnnnnnnnnnnnnnnnnnnnttgttgagaggaagggtgagcacccacacaggggttgttgatgtgtcttcaatttctcgctgaggttatacccccatccccnnnnnnnnnnatccggtacctggagcagcacccagagctggtctttgggtggactgcgccatcgcgcatgatgcagtcgcccgacccggcgacgcggcaggcacaggtgaatggcatgggagggtgtgcgcgccctgttgagagggagggtgagcacccacacagggcctgctgatgtgtcttcgatttctcgctgaggttatacccccatccccacccaatgggccccacatcctcggcccttgcgaaggcaagaaagctgactgcagaggagcggcacctcagggactggcaggatggctgatctcactcaccctacttttgtccctcacctggtgaacgtgactgcctgtgccaacattgtgaaatctccgttacaaaagggtttcggttctaggcatgagggtacatgccatgaggaatctgcccagaaccggcaattgggtaaacatctcgtaatggaaatgcgcgctaccaaacttgttgcaatgtcttgcaccttcgcatgaaccacctttgttgcagtatcagtcgctaacctcaagaggccgtcgaactagcatgtgggttccgcacggcccgtacagcgtcggcgtcaccgaccttgagtgggaggcgcatccagggcgtccattcaatgacctcgtccgggctgaggtgatcagctttacaatgcaaggcattgatcagggatgaacccttgggattcctgtgcatgaaattcgctccctcactctccatgcagcatttgtcggctcgcatcttctaccccaccgccaagcggtcgcctcggccatggagctggggggtatcatggctcccacactacaactatgccaaaggtagtccgctgttccctcttcgtctttaccagaaaatgtttgtaccgcctgcaaagggaacgtttcgacccatgctccgcccccacatcccacgccacaggcctcggcgcattcttcttcttccgccggcccctctccctgatcaatgtgctggcgcgggtggtcctgcaggccttcgtccttgtcctgggctggctgcagcgcctgtggatgatcccaggagcgccgctggcgcccgccctggacgtaggcggccgtccagccgtcatcttcagccatgggcttggcggcttccgcagcatgtacagcgtcccctgcgccgagctggccagccagggctacgtcgtcctggccgtggagcatgcagacgggtccagcagcgccgcccgtgtggccggtgccaaggtgggacgggtgctggggaagggggaggtcaggtcgagcttggaccccaagaggattgtgaccctcgtggggtccaggccgtcgatcccatgcagagcatctgctcgaatactctcgagcaactggacacatagccctggccgggcacacacccccgcccgacggcccctcattgacccgctgcaatccctcaggactggnnnnnnnnnngtcgaataatctcgagcaactggacacatagcccttgccgagcacacccccgcccgacagccccccattgacccgctgcaatccctcaggactggctgtactacgctgggctggggggcgatgcgggccaggtggacaagacacgcacgcgggtggctgagatgcagctggccctggatgtgctgacggccatggcccagggctcccgcctccccggccgcatgacgctgtcccacgggctgcaggccagcaggttccttcgcggcagcgtggacctgggttgcgtggcggcggcggggcacagctacgggggggccacggttgccatgctcgccgcggaggacgcccgcttcaaggccgccatcgcctttgacccctggtggtgagcgtctcggctgctgagtctgttgtgcggagcggggtgacagggggctgggcgagcgtgtctacatgagaccctgtcaagttgcattcgctccggcgaacccccctccttcgcatcacccatctaggtatgcgctgccccccgagagcgctgcgctggaggcctggaagacgacctgccccatcctgatcatgggatcctacagctggaacgttcccaaccgcgatggcatcaaggtctgcggcgagcggcagcaggagagggtgctgcaagccgccaggtgcaggggttgggtggggtgggatgcgcagtctgaacagcaggcaggctgcggtggacactcgcaggggcctttccttctccgtgctgacggcgtgctcctttgccacgaagnnnnnnnnnngagcagtcaggctgcggtggacactcgccggggcctttccttctctgtgctgacggcgtgctcctttgccacgaaggaaccagtatctcagcccgctccctgcccatccctgcaggcacggcggcggtgccctcctctttgtcgtgcgcggcacgtcgcacaacacatttgcaggtgagtccacccacttccagagcagacatggtgtgctctcaccgcagaacgccaggacattcatgcacttggccacagtctacagcccatccccctgccacccgatctccaccaccccactcgccccccctgctggacagaccccctgacgctcttcagcggccaggctggctggctgctgaacaggctggggctgagtgccgagctggacccggtccagggcatgggcctggtgaacaccgccgcactttgcttcctggcagaccacctgcccctgggtgcgggcacgcgcgccgcgcagacctggtcccgggccggggcgtggagcctgctggctgcgcacgcccagggcgaggccttgaagccttcaaagggcccgctttcctggtgaggcggcaagggggggggggggttatgccggggacaaacaaactctgacctgcgcggcacaggccacgacaccttttgcaagctgcctgcaactttctgtccctcaggttgttccctgggaaggggnnnnnnnnnncggggacaaataaactctgacctgcatggcacaggccacaacacctcttgcaagctgcctgcaacttcctgtccctcaggttgttccctgggaaggggctcttggtgaccctctctgacgagttcctgcgaagggcagtcaccagtcccaaggctgcgccaaaggcatcaggtgaggagggacccttggcctttggatatgcgcgcctcaagattctggcctagtctgatggcttgatgatcgggttgggagcatcttcaggatgcgcgccgggctatggatatcacctcacctcacgttcctctggttgcagaggccggaaaggatggcgatgtcttgactgggggtgaggcggcagcgactgtcctcccctcagagggtgctgaacaggggcctcccgctcctggcagcagggtgaatggtcaccatcatccggcagccgctgtctgcaaggtcacccctaccgtcacccagaaacaggctgatgcgctcaaggaactcctaggggaagaacatatctacctcgcagaagtatacacgtgatcaattgtcttctccctgcgccgatcgcactatttccacatgtgtctcggtgtaagccgtgctcgtcgagggcccacacatccaacctcttttcaaagccatgcggtgctgtgaccatagcaggcagcagagttgaattcctcgcgggagcgcgtgaacgcatgcaacccgtccggggccgtttcagtcgcacctccactgagcattacatccttgtagtgattggtgaagtcgtagacggaatccagtccggcctagtcgcacacggcgtgcccannnnnnnnnngccttgtagtgattggagaagtcgtagacggaattaagtccggcctagtcgcacacggcgtgcccatgtcttgtttatgaatcgccagtcctgtccagcgtgccagcgacaccggctcaatggcttcgtgagccgtccagcagctgccaccaggtccagcctgaggcttttgaggatagttccgagatgcgcgggacccgtgaaccaggggagggaagaggaagaggaggcccgcctcaggacagcagagcacctggagatgctcatgaaggcgaccaacgacgtgcgtgggagggcacggtgcctgggcgactggcaggtggatgctgatggatattcacaccctgtgccaccatgcaggactccgcgcccatgctctgtgagtgctgcgacggcaaaggcgagctggagtgctcctggtgtcatgggaccggtgagatgggtgggggggcaatgcacgactcccccactggacgcatatgggcgcagcctccgcctctcacaatgtcnnnnnnnnnntgtggggtttgagcatggtcgtgcaagtctgcggccgcatgagggcttcactcggaacgcgannnnnnnnnncaggtggggggggcatgcatgactcccccactggacgcacatgggcgcagcctccgcctctcacaatgtcaaacacgcccttgccaggtgtcatgaccctcggggataccttgtactgcagtgacggcggatgcagcctctgcatcatctgcaagggacaggtggggtcattacctgtggggtttgagtatggttgtgcaagtctggggccgcatgagggcttcactcggaacgcgagcatgctgtgtaggacgaggtgctgttggaggtgctcctgctcatgctggccctgcctgccatcgcaacagggggcgtgtacatgcaagcggtgccgagggacggggagaagggcagcctggcttccacccctgccaggctgtcccgtggagtagatgtagatgaatgaatcctgtatatttgtagcccaggcgcccggaacacgcggctcactttgagagatgaaggcatgtaccttgnnnnnnnnnnnnnnnnnnnnnnnnnnnnnnnnnnnnnnnnnnnnnnnnnnnnnnnnnnnnnnncctactgtgtacattacaatctgagagcagaatgcagagtccatggcacaattgatatcagacgcacgtagtctccaccatcctgccctctttaaacagggccatgggctgtgcgtcggccaggcgcgcctgctatgctgactcctgcccctgccatgccctgcgaagcggggccgtagaagtctggttcatcgacaaagctgactgccgcatggtcgcgttcagcggtgtcctccagctccaacaggacaatctcattgtcgccggcatggagcagtgggcccggaacatagagggtgacctgcggtccctgggaggcccagtgcctgtgaggggcgggatggggcacagggcattgcggcatggtgtgggccacaggcaggaggaccagatattctaacaccctccccaggctctggccccgacccgcaccagccaaggttgaatccattgatccaggcgatgcccttggaccagccgcggacagagaggtaggtgtcggccatttggcccgtctgcttgttgaaggcagggcctggcgcgtcaagggtccccctgtggcagtgtgtggtggttgtgttgggatccaacatcatgatttgcaccctgtaccttgnnnnnnnnnntagggtccccctgcggcagtgtgtggtggtagtgttgggtcccaacatcatgatttgcaccctgtaccttgcagtgtcagcttgaacagaaagtatcccgggaatgggtgccattcatcctcacttgtagaacatgggtccctgggaggagttgctgctcctaagatcgcttgaactctccagcaaccttcttgacactgccagcgacgaggtaatagggtagaaggcaaggcgagacagatctttgagctccaatggaaacacctgccaggtcagcaatggctcccctgtactcggggggcgggggggggggaggatcttcagatgatgtagcagtggctcgtgcacagaacatcagattttgtttccccaggccatcgccgtgcaatgcaaggtggaatggtgcgtcacggcgcgttccatgggatcggcatgggcagccgacggcctcctgtgcctttccgaggccggcgactggtgccgcacgccctgtcgcgaccggacaccgcggcggcggccattgcccagggcatagagctgtgtcgagagaaaaagtacgatgcggcacaaggattgtttgaagcagcgctcgaactgccgggaacaggcacaaaaagatttcggaacaagcctccccagatcagcaacagcgagcgcatcgctgccctgtacaacatcgcctgttgccagggccagctaggaaacatccaaaacggcatgatagccctggctggggctctagaaagcggtgagcggcgtggcatggagcagtgtagtggggagcaaaggatgatgcatggaaaggattgctgtggcggcatggtgatcgtgtgggggggaaaaggtccagtccgcacttgctggactcccagacaccttcagccagtgatccacaaccccaccccccaccaaannnnnnnnnnggactcccagacaccttcagtcagtgatccacaaccccaccccccaccaaacaggctacgctgagtttgatcagatgaggaatgaccccgaccttgccccgctgcgggagagcccaaagtttgagggactgctgcagcgctttggcggggcacagcccaaggggttcctcgagcgcttcaagagatgaagacggggccgtccccacccaggccctggtagaatgcacgtttgccaccagccctccccaccagtctccctgggtgcgtgcttggctcccgctgactcaccgttcaatgtcaccagagacgactgcagccccttgagatcccagccaccctcctcgcagccaaaattgcgccgtcccatggcttccaccaggatgtcgagcctcgctgtgtcagcatcattgtatggcccttcagggaaggtagagggcatgggtgggtgaaggtggccacacgcgctcgctatgtctagccaccgccctggcagtacacctcgctgcatgccgtcaagcggtagggccacaccacaggcatgacgcggtttccatgcagggaatccaggggcagtnnnnnnnnnngtcgctgcatgccgtcaagcggtggagccacaccacagacatgacacggtttccatgcagggaatccaggggcagtcaatctcaccccgcctggatgctccaagctggagtgtggtcggactgcccctgtgcatccgacccgatacctggccatccaggtatacctgcagagcgtgatggtgggtacagcaccaatgagacatccggtgtgagcaatgcctctttggtcggagctcgataagccgcctgaaaacgcccaacctcacaccgtggcataatcgtggggacttgcacccagatcaagctccgagctcttgctcagctgcttgcgggggatgatgtgccggtagaggatgaggccacttctgcacacatggaagggtgcgtggcaaggtgacaaagcgtacggccccaggttcatggaagaagatgtgtgcatgactggcactcagacatagggattgagtgagtgtcctggctgcaaaccccctacccttggatgccctcaccgctgggcatatnnnnnnnnnntgtggaaaggtggcaaagcatacagccccagattcatggaagaagatgtgtgcatgactggcacccaggcgtagggattgagcgagtgtcctggcggcaaaccccccacccttggatgccctcaccgctgggcatattcctccatgacatctgggcggaccgtatctacaggctcactgagctggggcaagacgtcaaagagtgcagccttccggtccagatgcacctcgccgtaggcgtggatgcgaggtcggggcggaatgggaggcggggtgatccccgtgtgctgcgcaatgacctctcggattgcctgcgaaagggaaggggcagcatgctcgccgtcccttgggctggcaacaggcgagccgtgggtgtaggctgagtgcaaaacgcacagtccccgcatggcaggctctcacgacggcactctcgtctgccaggggacatagaccttgtgcgcctgcctgcaggccccagcccactcacatggtacttgcactccccgccgatgccgggctggcagtagtcccctgcctcgctgatcggggcgtcgtagtcatacgatgtgatgtgcggctgatagtttgatccatccacgttggccccctggttaaatccaaagttggagcccccatgcaccatgtagaaggagagggaggtggtgttccgggcccagcgcaggaggacctgggtgtcagctgccaggacgctggagctggtgtttgccatgctttctccccagtgcgtcagccatccggagctgcacaggggtaggtacaggttgtgattgactgggagatcaaccattgagtagagctgctagggtcaaacacgagatgctggtattcaaccatggtgacgcagggttgactgtgcctttcctgagacatcgctcgcactcactagaactcagaattgaagggtggtgacaatccaggcgcgttgagggacttctgaacagcaaagtctgcctccgggttgaaccagcctgggccaaagtcgacggccctgaggacagggaaggggatgatgccgtgccggcttgtgatggtcacagcaggtgtgccttggagcatgcaagggtgtagaatggaaaaacacccactcatacgcccaacgcccccctcccgagttgaccatacgtgaatatctcgctcccgggcaaggttccatcggaggccacatggggtggatctggtagggaaagggagcgaggtggggactctcacgaactggaaacccctgcacgctctaaactcaggcaaatggatatccccaattagcaacagacctgtggtgaagaggactgcagtctcgccaagatgctgccgggccaggcccaccaggtgacggaggtactccttgtcgctcccacaaaagccatactcgttctcaatctgcggtgcggagcagcgcagaggtatggatgtggtctcggtgggtcttcattcgccgatagtgcagcgccatacaggctcatgggcgcaccctcccactgacctgggtcaggatgatggggccgcccgcctcatacatcagcggcttgatcatggtgaacagcaccccccaccagcgatcgacgtgcgccaggtaggcggggtcggacgagcgcagcttcatcctgcgcccgccagggacctgtgagcgggggatgtcagagcgtggaagtggaaaacattgggcggccaactgggcgtcctgaccaggagtttgagaccatgcccgccccggcgccttggtcccgcggcgtcagcgcgccacaagcaccctgaccttggaggagccgagccaccagggcaggcccccaaagtcccactccgcgcagatgtaggggccggggcgcaggacgacgagcaggccgcgatcgtgcgccagcgaaagaaagcgcaggaggtcggcgccaccctcccagtcgtactgccctggaaaggtctcgtgcacgttccaggcgacgtacacctatgggtggtggtgccggggagggtcagcatggcgccacaacgagaacacctgcagtatcctccacaccgcnnnnnnnnnngggtggtggcggggagggtcggcatggcgccacagcgagaacacctgcagtatcctccacaccgcactgccgtgcaagcaccgctgacaggccaggcacaagatgatgcgagcacttgccgtgatggcattcaggcccagggccttgaccctctccagccgatcgtgccagagcgcagggtggcatcggaaatagtggatgctgtaggggagtggggatcgacgtgtgaatctttggtccacaccgcacgatctcgatcatgcggcacgagaatgagccgtgcaatggtcaacacacctgccggatatgatttggaatgttttgccgtccttgaagaactggtcgtccctgatctcaaagctgcgagctggggcgaggctggccaaggcagattgcaacatcatgcatccgaggatggcaagggccacagcccccatgctgacaagtacaacgaccgatccgttcgctggggagcagagatatgggactggtgccctcagcagtgctagggatgtcgagtaccgtcggaagatgtcgtttgggggaagcatggactcacacgtcgatcttcatttcggaaggtctcgtctctcccgcgcgccggcgaagttcccctccgtaacggagatttggcgaggggatgtggcatggccccgtcgccgtcgtctgtacggaagacgcctctcacgccaaaagcaatacaaactaccaagttgtattgatattgctgtcccgtgaggctgtgcaggctatccccccctggagtgcgcgccccccgggataatgagagcagcgtcctgaaggtaccgatcggagcctctcctccacactcttagaatgggagcctacctgagtcagcccatcacagaaaaggtgcgttgacgaggctcctgacttctgaggccggaaggtagttctgcctggtatcgacaccctctgccccccgctgtccgcaggagactgcagagggggagaacgagctgttctgttatggagtcgcggccatgcagggctggagaatggacatggtaagcgtgtgagggctcgtgggcggtggcccccgcatgcgcgcgacggagcggaagaggtgcccagggcctgcctaccccattcactgccattccaaaaacgcccgtgttccgcaggaggatgcgcactccaccgtcctgagggtggagccgagcagcgatgctgggatctttgcggtgtttgatggacatggtggcaaggaagtcgcaaagtatgcggcagtgcacgtggtaggcgaagggttggtgattacgcatcgggaggcgcaacggattggaaaaggggtggaatggggtttcttcaagccgccgcagtgatctgcatgacacatacgccaatgggcattgggtgatggccatggccatcgctgctcgtgtgcgtctnnnnnnnnnnatcaagccgccgcactgatctgcatgacatatacgccaatgcgcattgggtgacggccatggccatcgctgctcgtgtgcgtctggcctccaggtgccggccgccgatgtggtctacctgcccatcacgcgcacctcatccccttcaacccctttctttcatgcagccccaactggtggtagagtcagaggggtacagagggggtcagactgccctcgcactctcccaagccttcctcgcggtggatgacctcctggtgctgccagagcacagggaggagctcaaggcactgcggggtggcgacaaggaggagaagcagaaaacgtgagctggggtgtggcagggccgggaggcaggccgcgtcgctccaaggggcccgtgctgcagcgaaattgaannnnnnnnnntggaaggcaggcagcctcgccccaaggggcccgtgctgcagcgaaattgaatgtctgtgagcgcctggggacccccggccaggggtacactccatgctggcgcgtgcggcagcatgctgcctgacgatgtctccaccctggcccccttcccatcctcctgccaggcgacgcggtgaggaggagcccatggtaatcaacggcggcagcctgcccgaccacatcctggaggcgctgggcctcacggccgagtccggggtgtccatccgcctggtgcggaatggggcccggggcctcatggtggaggggctgaccgaggacgaggaggatgaggaggctgcggcgggggagggggacagcgaggagagcacggcggccagcagtgaggaggaggcggtggcggccgtgcccggcttggcgggggtcgagggtgacggcggggagggtcccctgagcagccaggacgccgccaaggtcaaggcgaagcgaaagcgggtggaggccgccgccgcagcagccctgcggaggtcggggcccagcgcggcccaggatggtgaggatgggcgcgtgctgagtgcacggcgcggtggggccgatgagttgctggaagnnnnnnnnnntccaggatggtgaggatgggcgcgtggtgtatgcagggcgcggtggggccgatgagttgctggaaggcggctgtgcgggtggggcagtgcgtgcgccaagcacctcccatgtggcagcagatcctcgaccacggcgctcctccgtccgcaccccccctactgcagcggagacctcctcgggcgacaccggcgccgtggggtcgccctttgacgccgatgccgacgcgctgcccgtgctcgccccctctgccgcggaggaggagctgcgcgtcgcggcggtggtcgaggacggcgcctccccgcagcccgacacgccctccgagcaaggggagggcgagtacctgggccccaccgccggctgcaccgccgtttgcgccctggtaaaggccggcgtgctcacggtcgccaacgccggcgactcgcgctgcgtgctctcacgggggggggtggcgctggccatgacccaggaccacaagccggacgaccccgccgagtacgcccgcatcatcaatgtgaggcggcgtcggcggcgcagggggtggtgtagggggggccgcagactgctgggagggagtgtgggtgggtctgattgnnnnnnnnnncgtgaggcggcgccggcggcgcagggggtggtgtgggggggggccgcagacagctgggagggagtgtgggtgggtctgattgggagcacgtacttgggccaggatggtatgggagctgtggtaatctgtcgccgcagtgcatgctgatgcgaatctgttcattctctgtgagatgggggattgcggtgtgggctggctgctcccaaacttctgccgcccagcatcctcgaggacccgagctgcactccgatcccagcccctgatcatgccccctcactccaccatgcaggccggaggctttgtggccgacgggcgggtgaatgggtccctgaacctgtcccgcgccctgggcgacatggagtacaaacagagcaaggagatgggtccggaacaccaggtgagatggcggcccaggctgggcacaggcatgtggagagactcgctgcacgcgcttgcttcatgagagggagggtggggcggtgcttcgccatgatagcgtgtggagatggtgctcccgacatactcgaggctgggttgctggcatcccgtgggcacgnnnnnnnnnnagggcggtgctttgccatgacagcctgtggagatggtgctcccgacatactctaggctgggttgctggcatcccgtgggcacggtgcacgcttgcaagtggaaccttcaccctgccgataccaggcggtgactgcggtgccagaggtgaggacggagaccctgcaggctggggacgagttcctcatcctggcttgcgatggcatctgggacgtcctcaccgtgcaagaggtcggcaaggggtgggggcgcgcatggaagggagggagtgaggagtggataggggtcactgctgacaggttccccagggtgaagcgggcaggagagctctcgtgagaaacattctaccttcctggctgcatgttgactgcttggagcttggcaaaaccgtttgccggtcaatcacccctgtcatgttttcttctcctctcaggccgtcgacttcgcgcgagagcggctcttgagtgggaagacacccagggaggtgtgcgaggcgatgtgcgatcattgcctggcccccgacactgacaattgcggcaaggtaggcaggcaggaggcttggttgcatgcagctgggagctgcataccgcggcgggaggctcgcttgatgtgtcattatatgttaatggtagggaatggtgattgtgaaggtgccgaggaatccctggttgaagaaagtgctggtgtctgcaagccaagtatgactcttgttgactcccatttactttgctcagctcccaccccgctgtgccgcgacctcagggatgcgacaacatgagcgtgatagttgtggtcctgaaagactatggcttcccagagacactggccgcggcgagggccgccgctgccaccaatgcctgaaataccgttcataaaccccaatgtgtctgctgtaaaggagaattcctgatgcctcgcagagccagagagtcacccattcaacgataccgaggggctggacgataaaaggaggggcaggtagttaatggcagagaggcagagtgcccgtcctcctttcctgaaagcgcggactccagggctcgcacaggcccaggccctagaagccggcagggagacacgcaggcgaccatccacggtttcgaccgcatgagtctggagggttgaaatcccgaccaggagcctcgggactgcagggttcccatccagggctgccaacacggcgacaccttgccccgactccggtgcgctctgcgcgtcgagtgcccctcccccctactctgtgtgatctcgggagacgaaggaacggtgccatcggtggattagaaggcatcacgacacgccagcggcgggtattctgggccccttcatcgcatggggcagtacctgagcgctcccataacggagaaggtgagggcgtccgcaggcgatccgtcggcatcgatttctcgcggcagtagcatccttatccacgacgctaccccctgcaggaatcgggagagggacagacnnnnnnnnnnaagggcgtccgcaggccatccgtcggcatcgatttctcgcggcagcagcatccttatccacgacgttcccccctgcaggaatcgggagagggacagacagatagcatcgcctatggattcgcggggatgcagggttggagagtggcgatggtgagaggcatgatgatgaggactaggaggaatgtggaacaaggccgggggacccgggtctctaaggagcataccccacagtatccgccagctgactggcgttccctgatgtgcttgtgcaggaggatgcacacatcgtagacgtcgagtttgatacatccacgaagacggcgctcttctcggtgtttgacgggcatggcggccgagcggtcgcgcactttgccgccaaatatctggtgcgtctcgggccatgcagggagggagaggtcattgatctgcacctcggtgcgggggcgtttgatcagtctccgggggtttgccttgccgctatgacaaggagcaaggacggaagctgcactcagtttctctcttgtgctttaaccccccaccgtcacctcctccccatccccacatgcgcagcctgggagaatcatggccacaaaggcgtatgcggcaggcgacctgggcgccgcggttgcggaggcatatttggagctggaccagctgatggatgcccctgcgggtcaggaggagctcgaccagctagctgcaccagtacagaagtgagaggcttgcgagatgtgccctatgggggagggaagatggaaatagctgttacatactcggtgtctgggctccctgctgggaaggagggccagggcgccccttcctccaccccatgctcctcgccaccctcggcactgcgccagccctcctccaccctggcccgccacccccaggacgcccctgacgctcttctctgacgtggacacgagcgcgacgagcaacaccagcctcgactccggcagggtcagcgcgcccgaggaggaggcggaggaggcggccccctccgcccccggcgtcgaccgccggctgcgcaagatgaacagcagttcggaattcctggccagccacctgcagcgcgccagcatcgtgactccccgcgcctcgcccgagggcccctcgacggcgctggcggagcacggcagccttggccgcaccgatacgcggcgcgaggcctcggccctcgccggcgaggagggcgaggaggttgcggaggacccggcatccctcttcggcatcctggagggcgcctccgtccccgcgctggccgcggcggcgccggcggagagcacggagcagcggccgcgcgcagagggcgcgggctgcaccgcgctgaccgcgctggtccgcggcgggcgcctggtggtggccaacaccggcgactcgcgcgcggtgctgagccggcgcggcgtggcggtggcgctgacgctggaccacaagcccatcctgttcgaggaggcgcggcgcatcatccgcgccggcggcttcgtccgcgacaaccgcatcaacggctccctgaacgtcagccgcgcgctgggcgacctggacttcaagcgcaatgccgcgctggggccgcacgagcagatggtgggctgggattctgtgtgggggggtgaggtgggggggtgggaaagggggaatatgaggcgtgatgtgctgatgggtcaatcgccggagggcaggcagcccctcgtggccttggatcccaagccttctctccttcttccctccacacctctgttacaccctgcccctggaacacccacccacggcgccctcaccatgtttcgctccctcgccccgcgcaggtggtggtcacgcccgacatcgaggtggtgaacctgagcgagggcgacgagttcatgatcatggcctgcgacggcatctgggacgtgctgagcaaccaggaggcggtggactacgtgcggcgccgcatcaagaatgggacctcgctccaggccatctgcgagtccatgtgcgaccactgcctggcgccagacctgaccggcatgtgccgcggcgcggacaacatgagcgtcgtggtcgtgctgttcaagcgcaccgcgcgcctggacggcatctgggggcgcatgtggtctggcctctgggggtccatggccaagtaggcacgcgccggcgcagcgcacgaccccgctggtctggccccgcgcgctgcctccgtccacggacccatgagattttggagacttgcacgacctgctgtacagtagctgaaccctggggccagctggggtgcgcgcgcaggttgggaagggcccggcctgcgctgggccataggcttccccctgccaagcacgccttgaggcaaaagtggagggagtcaaagtctcannnnnnnnnnaagctggggtgcgcgcgcaggtggggaagggcccggcctgcgcagggccataggcttccccctgccgagcacgcctcgaggcaaaagtggagggagtcaaagtctcatgtgctaggccactgcaccatacgctcggattccggtggaaggagagagcgtacaggggttcgaaccctggtcttgagatgaatttaccctgggtcaacaccagaagcgaaaaacgtcatttttcatggtacatgtagggggcgggacgggagatgtccaatgcacggccaaatctgccatatgcctggacgtcacaccgattgagccttctttgagagtgactggagtgcatggtgccatgcagcgcgacgtaagcatcggtatggtggcagggcgccgcgggtgaagtacaggtgggagcgatgggaagcggcacccaaggcgaataggggaacagatcggagtctgatatcaacgtcgtgatgtaggaatgaccgtgggttttgcatcaacgtcgatggtgtacgagtgctttcgtggaggcagagtcgcaccggtgacattgcggcaggcacagcacacacaccgaggctggcctgcttcatcccccgcagccaagacgagcgagacttgtactccgatactattttggggtatactcggactcgtctagggacgcgcctatatctccatacatgtttggggctagaacatctgtgcgaacaactgcacttgcgtttcaaaacattgtgccccagtgtgccacctcgcgccgtcagagacccggcccccgaggtgcgcattcgctatcctgaggcgcagtgaacagacggtcgatgcgaaacctcggtgtgagtatgatcctaatcctgtgcccgctctgtgagcatcctaattgtgcaaacctaggcgctgctgcagggtggatgacgctggctgctgcaatgcctcccaccgtatacttcaccacgggaaacaaaaacaagctagcagaggtacatgtacacctcttggatcttctgatgccccgagcaattgagcggagggtcgaggcagcctgagtcttgctcaccctcaactctcgcttgccgcaggtgagggcaatccttggagagcaagggcagcttcccttcaacgttgaggccgtgtctgtggacatgccagaactgcaggtatgcgatgtgtcctggatctgcagccgcctgacattgcaaacagctgtgcagacagacctgccatggcctggttccctcatgaacagggtgaaccagaggagatcgcaaaggagaaatgtcgccttgcagcccttcaagtcaagggtccaggtgggttgagagggctgctacctcaccacttcatgcccgcgagctgtgcagcactgcctcctcaagctttgtgggtccctgcctgcagtttttgtcgaggacacatgcctttgcttcaatgcctacaaggggctacctggtccttatgtcaaatggtttctggagaagctggggcacgatggtttaaaccgaatgctgcacggctttgatgacaagacagggtatgccctgtgcacctttgcctacagcgacggtgagcctgcgagggtggaagccggcctggcacagagcggagcagagttgctgtctgcaatgccatccttcgcccctgagcatcccgatttgctctacacctgtgttctcgccctggcaaccgcatctggtccctctacccttgcaggacccgatgctgagccgcacgtcttcatggggaggacagacggtactatcgtcccagccaggggcccaaccacgtttgggtgggaccccatttttcaaccctccggctttgaccaggtgacaccagtgtgcagcatcaaattggcattcctttgtcccaccagagccactctccctggcctcacaccaggcttggcactccattcgatgcagacatatgcggaaatggagaaggctgcgaagaatgcaatctcacacaggcggcgggctctggacaaactcaggcatcacctcgtccagcgctacgccacctgagcggctgcagcccaatgcttgatgctaggagtctacgtgttctacaaagccatgcatgagcatgcaagctcacgccagtctgcaggcaaacgccatgnnnnnnnnnncgctaggggtctacgtgttctacgaagccatgcatgagcatgcaggctcacgccagtctgcaggcaaacgccatggctgcggtggctgcgcaggatatctggatgacattcatgacatcatttgtgagccagcccgttttggattgtatggtggcccctagcacactctccaggaggttggccagcactgcagccacgacaaccgccccggcgcctgtgcctgtgacctgtggagaaaggggttgcaggacctgactgaggctactcactgtcgaggtttgcaggccgtcattgttcctcgccgtcatccacattgggattcagtggcagggctgcaccgccctgcacttgcctgatgcgtaagcagagcgaattcagcaatcccaattacggctgccagccccgcgagggagccctctaagctcacagccccctcggtgccgcgtgggacccggcgaaaggtgctgacaaggtatgcctggctgccatacgctttgccaatctcgctggacactgtgtctgctgccttgctgcagaatgaggccacaaagcccacctgccgcactggatcgatcacgggtcttgggccgaatctcagctggtaaaggaagctctgtcatgccctggagtgcccatgccctcacctgccatgggagcgcctgcggtgcaagtaggtgcccgattgcgcacacaatgccagcaaagcctgagccacagacgctgcccagggatcgatgacctgaacgcttctcagctatgccttctgcctccttctgcttcatcctcactttggtgacctgcttgggtttgatgttaaattcaagagtcgaggatcagcagagttttctggactacgtgtccctagcgcagctggagctgcctgagcgctaagacaaggcagacgcaacgcttcatcccaacgcaccagggttccaaggatgaagtagaggcacacaatgaggtaacccttgtagccaaacgctgcataggacagtgtgcccaggacccacgaagaagagtatccgacccaggtgagtcccttgcgcaggattctgatgcccagcaggtagaccagactgttgaccaccaggccggcgaggaggcccgggctgggtctcaagagatctgcgcatgcaccgggccagcctgacccctgcgctgcaatgccagcccgacagcccatcgtggtggtctgggcagagtcattcccctgaaccgccgcccgcgcccgcatggacagctcttccgtgtgcagcacagtgcttatagtggtggatggaggccgggtcggagcctgtgcccggcatgaccctccatgctgatctcgccatcgctggggtgatgggctggctgggtgcccgtacgcccgccccggggcaacgcactgcacagcaagcccggcctgcaccgtcattacagtgtttttggcaaccgcactatctctgtatgtgtgagctcacagaccccgtcgacctcccgtcatctaactgaagatcatgcgccgggctgcccacgatctggcccgggattgctcaagtactgttcccagggccacggctgccctcccaacccaccacgccatctggctcgtcgtgaagcaatctgagcctttagaattacatgctgtcaacaatgacgatcagagaagtcttaccgagtcaacaaaattctgtgggcgacgctagggcctcagacccacgctcctcagaggtgctgcagcacgtcccgcgccgcggcgatggtcgcgtcgatgtcctcgtccgtgtgcgccagggaggtgaagccggcctcaaactgggagggggccaggtagacgccccgctccagcatgccccggtggaacttggcaaacttggcggtgtcggaggccttggcgtcctcgaaattgtgcacggggcccttggcgaagaagaagccaaacatgccgttgatgctgccgccgcacatgtcgtggcccgtgtcacgggcagccttcagcaggccctccaccaggcgcttggtgacgcggtccagctgctcatacacccctgtgttttgtgaagtattgtatttggcggggaggggggtgctggggtgcggtgtggcaggcaatggtgtgcatcactggggaccctttgtgccgccgagcaggcaaggcaggccagccgccatgcccgcgcctcccctcccgnnnnnnnnnncccgtcagtgccgtcgagcaggcaaggcagaccagccgccatgcccgcgcctcccctcccggtcctcacccggcctgtccagaatctccagggtcttgatgccagccaccatggccagcgggttcccgctcagtgtccccgcctggtacatggggccggatggggcgacgagctccatgatgtcccgcctcccgccataggctcccacaggcaggccacccccgatgatcttccccagggtggtcacgtcgggggtcaccccaaagtgtgcctgggcacagccgtgcgcaatgcggaatccggtcatgacctcgtcgaaacagagcagcgcgccctcctgtgcatggtgaggaggtgcgggaggtgagggccgtggagactcggcaaggacctcagcacagtctcctcaagccccccactccgccccccccggggagccacatgcaaccaggcaagcacacacccacctgcttggtgacctcccgcaggccctcgaggaactcctgggtgggcnnnnnnnnnnggagggacgtggggactcggcaaggacctcagcaaagtctcctcaagccccctactccgccccccccgggagccacatgcaaccaggcaagcacacccacctgcttggtgacctcacgcaggccctcgaggaactcctgggtgggctcgatgtacccggcgttacccaccaccggctccaggatgaccccagcgatctcgcccttgtttgcctcgaagatggccttcaccgcctccaagtcattgtatggtgctggtggtgtgcaggagggggagggggtggtcaggtgttggggttgagaatgcaaaattgatcttcccaacgggagcggcgggaccatggatcctggggaggccggcagacgacgtgacttgcgcgcgcacacacacagcccagcagacacctgtcagcgtggccgcggcagtnnnnnnnnnnaggaccagggatcctcgggaggccggcagacgacgtgcctcgcgcgtgcacacacacagcccggcagacacctgtcagcgtggccgcggcagtggaggccataacgcccggcgagtcggcgaggcccagggtaatcaccccagacccagcctggaccaggaactggtcggcgtggccgtggtagcaccccacaaacttcaggatcttctcgcgcttggtgtaagcgcgcatgaggcgcaccaccgacaggcacgcctcagtgccggagttgacgaagcggaccatctccacggacggcacccggtccacgaccatcctggccagcacgttctcgagctcgcatggtgcgccaaaggaggtgcccttgtccagctgcgcatgcagggcggcggtcacctcgtcgtgggcggccccgacaatggccgggccccagctgccgatgtagtcaatgtacttgttgccgtccacgtcccagcagtaggcaccctgtggcttgtgggtagggagggcgttacggtgcgtgatggtgggtggtgcacaggcaaatgggggcactcagaaaggtcattctggggtgccgtgacggtgtcgaatcaggcccccgcgacgctaaaaaaatgcgacccacctttactcgatcgaagacgannnnnnnnnntggcactcagaaaggccattctggggtgccgtgacggtgtcaaatcagggccccgcgacgctaaaaaattgcgacccacctttactcgatcgaagacgatgggatctccaccgacagacttgaaggcgcgcacaggggagttcacaccgcccgggatgatggttttcgcatccttgatgatctgtgagattccggggggaggcaatgcattacatttagcatggatgcaatgacgatcgcgataccctaaactacacgcacctcctgagatctcttggtgttcagggtggtcgatgggggtgcggcgactgccctcgtgattgcagctgtgcggcgccgggacggcaccgtggggcgtggggcacgaaggagctgctgtccagcgacagggatacacgtagtcattttactttgcggtgcgggtgacacaattgttttttgcatgcaaaaggcagcgggcctgggttttactcaggattgggagggtgcccatgctccacgtggggataatgcttcccgatcagaacacgcgcagcatgatcttcgtcgtttatggtggcgagggttccaaacagagcagtgctgaggaggacaaaggccggcccatctaatggaggtttgcatgcagggagacacagcatcttcaggaattgctctgcattgtggacannnnnnnnnntcaatgaaggtctgcatgcagggagacacagaatcttcaggaattgctctgcattgtggacagagcctgcgagaggtagtcattgaacctgtctgggacgtgggcgacgagctcatacagcccatcatcattgtcgtgcgcatactcccagcatacagcaaatgtcttgttgcgggcttcaggacagtgcagtgccctcagactgacatccgcaacatctgcgcagctgatcccctacgattgtgaaagggggtgtgatggtgcctgaagcaaaacaattgcgggtcaagttcaagcaacattctggcttcaatgcatctcttacctgagagatgcgtgtaccttggtcaaacaccaaagccttgtaccctcccgtctcctccaccagagcaccaggacggacaatggtgtaaccgagtccactggcccttagcgcacgctcgccgcggcgcttggcagctattacccgttcccgcgcggtctcgtccagacctggatggcaaagagcatcggagcggtgtccgatctttgcatccgagagacgcaaaactaggaggggggggtgtcaccaacatcctcagtccccagatcccacatcccacaaggcaccactcacccttggttgcaccagagcaggataccaggatgaagtctggctccaggccgccaggcatgcacttgatccagtcaatgctgcaagagaactctgaccgtccgctgctcctctctgtctggtctgaggcattgtacccaatggagatggacgtgatgtcagagacattgaggctctccagagctggcttgaagctggtgagggcgacgcggacagacttgtacgacggtggcggaacccactctgcagtgtactcttcgcccgcttctggggggggaacaaggagttggggcgcttcctgaaaaggtgtgcaggaatttgtgcacagcaggctgggtgtgcacccttgggagtgctcccacctgttgcgatggtgagnnnnnnnnnncaaggagtcggggcgcttcacgaagaggtgtgcagggatttgtgcacagcaggctgggtgtgcacccaagggagtgctcccacctgttgcgatggtgagcgtgtagatctggccgtcgccccgagctcgaatgatgaagccatccatgaggtgcaggccagtacggacgcttggggctgggcggcctgtcagtctgacaccattgtagagcgtatagacagcccctgcggcgattgacattaaatggggatgggtgagcgagcatgtccataccgtgtcaggctgtacggtcatttgatcacannnnnnnnnngtcgacataaaacggggatgggtgagcgagcatgtccacatcgtgtcaggctgtacggtcatttgatcacaacagccccacctgaaaatgtcatgactccctcctcgttgatctccatatcagccacatccttgggtccagccgtccgcatgacccggctcagaccagtgccacctgcacgtgctgggagaatgttagaatggacaccgctctctgtcactcctccccccattctgtacgcaccaagccctcagcctgccccttgatgcgccccagctcacctgcagaagttgacctctcgggagctgcttggaccttccagtcatctcctacgtagggcttcttgaagtgtacgagttctagcttggcaaatcgagatagcctgtgcttgagccgagccctctgattttgtgaatcctgttggagacgatggggcagacgcacatgtggggaggagcgcacaatgctcgggcaaccagaacatgctcactctccccaggttctcccctgccatgcccggacgatgttggacacaccctccacgtccaccctctccaagtcagagacgatgcttgtccgggcagttgcacagcatataactttgtccacgtccttcacagcctccctgcagtcctcataattaccaatgtctccagtgacaagcctcacgctcggcggcagcgtctggcgctcctcgccgccacgctgccggaccagtgccgtgacagtgtaccctcggaggagcagctttcgcagcaacacgcggcccaccctgcccgtgacccctgtcaccaggaccttggttcccttggcgcccggcgtctcaaactctggcctgtgacacaatggccgggtgagtgtgaggtgcagaggggcctctgcatcacgaacaaccccccttcatgcatgcgcacctgaggtaccggcccggcaggtcccctctcttggtgggggagctgatgcgctgaagctgggcccaaacatcgtcaaacacctcccttgactttcttccgatgctgatggggttgaggtcgtctatattgaacgactctgcgggccgcccttcattaccgtcgcccaccccctcacggggcgtttgggggccaccttccctgtgctgtgcgggaatgccgcagctcttcctagcaccaacattctttcttccgttgaaaggcacagcgggccgcctgtgagtcgcatggtacgacaggctggtggggatcatcagcgacatgggcgcacttcgctgcagcagggtcgaggcgggattcgaagtgcccagctagaacagtacgcgattgattagagagttcagcatgctaatcacgagttcaagggcattatcttagcctgaaaggccacaccgggctcatgtactggggtctacaccgggttagccactacttgtggctctcctcccccgcccttccggagcacgggtgcgctgcatgagcgctgcgtgcggacccgctgtcgtcaccccaacttcaggcgcccccgatcttccagaattcccatcgccgacattccgcgtgtgtatttcttcctcgccatgatgttcagatcacgnnnnnnnnnngtgcaagactccgaaccgccccccttgcggatctggtcactcgtgacgggtcgacacctgccgatctcgtcgccttgcagtcaatgnnnnnnnnnngtcctccgtgagtgtgacgtggttcctggaacatttttgttgtcgaaaacggtgtgtgtttgatttggagatcgccttcatgtctgatagggtgagagctgcagacctataccctgcgtgggattcctgaggccgtttctgcacccccccccttcctcaggaggggctgctgttctcgtcgcctcgcagttgatgatcgatgatggtgtcatcctgcttccgtaccctctccaaaattggccgcagcggaacattattgaacgggtgagtagaccgtgttggtgtggcagctggctacggtctgcgatgtacgttggctcatgacgggtcagaactgtccaccccctgctcgcgaggttgctagtctgttgccaaacccttccaacgcgcacctgcctactcccagtacaaactcagcgaggagcaacattgcacgagcaacatcggcggagcaactttgaatctaccaagaaaccgagtcgaagatgagtggggaggggttgattggtggaactcctacctgccgcgtgaccttacgatcgtgcctctgacccacacagtgtccttcccatcccgcagcggaggctggcgcgctttgccatgtttgggggttatctccgactgtggggaccagagggcgacaccctgccattcagcggcagtgacgtggtgagttgcccagcatactgcggggtgttgtttggcgtggagacagctggtggtctgtggtgtggttctggccaggggatgggcggtgtgtcatgcgggcgtgattatcaggtatgcaggactccattataagcttcacatcgcacgggtggtgcgtctatcccttggcagcagacttaataccttccctttttctatgatgcaggagatgtcccgccactcccaagctccacctgttgggtggattgtgcatatcagtgatccgtagatggctaacggccatggaagcactgatgcagccggtcccatcgccggcagttccctaggaactgctgtgcagtttgggttaaagactccggtggagggatcatagtggatcatggcagcacgtgccacccctccccccgatcttcccagacttcccccatcgccgacattccgcgtgtgtgtttcttcctcgccatgatgttcagatcacgtctagtgctatgcactgtgctcactctcctggctgcgtgcgtcaggggcaggggctcgagttgtcacgataaggatacccggaggtctacggccaaggtggtgaaagagatgccattccttgggctcttcgatgatcttagggagcagtcagtgtttgagggttccgacatcgtgagagtcagagggaagtattacgtcgtcttcgacaggcaagtcgtctcagggccaagatgggtataatacatgcacccgcaagagacccgtttgcatcgtccacatcctcatggtccccatgtgctgatcactgatgctagtccctacnnnnnnnnnnaggcccaagatgggtatggtacatgcacccgcttttacatcctcatggtacacatgtgctgatcactgatgctagtccctactcggccgcagttcctattccattgggtatctcgacgatcgcttccagttccgggaccctaacaaccagctgatcgggggcaaggggcagaatgactcgcagtttgagggaatcgcgtacgttcccgaggacgacaccttcctactcctgcacgaggtaagggtcctttatagtgtggaacctatgaaattcttcgatggtcctgcataagggcaaagccacaacttggcatgcagtcccaagagcatgagggcggctacaagccattcgtgacgactgcgcgcctcagcaaagatggaaaggagtacgagagactctccaagtgcgttgtggactttgagctgacgcatgaaaacaaggggtttgagggcatggcctacgtcaagaattccaaaggtgagatctgggccgccactgagcagcacaccgcggtacccatcagtggttgcagactagccttgctcgcagccaggtggtcatccatgcctcaagccagccatatttctgcaatgttgctcgaacatgttcttcctgttgcaggagcgnnnnnnnnnnttcaagccagccagatttctgcaatgttgctctcgaacatgttcttcctgttgcaggagcgttcctgttgggcctgtgtgaaggcaatttctgtgaaggtggccgtagagggcgcaagtctggaaacggtcgcatcattattctgcagctggacacagatgacaatggatgcaggtgtggagcgagaaaagagtttaatctgcatccctccgtccctaacttgtctagggcgatcatgtcgcatcgacttacacgtgcatcctcctgcagatgggtgaaaaaggatgtcctgaacattccgaaggaggcaaacttcatcgactactctgccatggccatcgattacaacctgggacgtatcgcgatcctcagccaagagaat

SEQ ID NO: 18184 - DNA, 108 bp, Chlorella protothecoides
gtgattgggcaacaagccacgaatgcccttctgaggttctcccatcaaaggcgcgcacaagcctacccaaaaggcagaattctcttggctgaggatcgcgatacgtcc

SEQ ID NO: 18185 - DNA, 208 bp, Chlorella protothecoides
ggctttattaactaaaaattatataattttaaaacaaaatttttaagaaatttttaatgggttacccgggatttgaacccggagcttgtcggttaaaagccgaatactctaccattgagttagtaaccctaattagtatatattttaacctttatatatttaaaaaatcaattaataaaaatcttaaacgttactaaataagtaacgt

SEQ ID NO: 18186 - DNA, 61 bp, Chlorella protothecoides
aaactcgcgccgcatctcgtgcgattgcataaacaagctctcgtcatatacaaaccacaga

SEQ ID NO: 18187 - DNA, 9666 bp, Chlorella protothecoides
  modified_base (2822)..(2862): a, c, t, g, unknown or other
ggcggcgccccagctcgcggcggcgttggccgcgccgggccaggcgggcgtgccgcagctggcgccgctgtcagtagaggagacggagtgggagcgtgcgatcatgtggccgacggaggccggggtgcaggcgtgctggcggacgcgcgccagcgcgcgccagggctcgtcctcgggctccagcgccgccgccggggtgcgcgcctcggcggcggtcccccgcgccacctcccgcagctcctccatggagtgggcaaagaagcagatggcacgcgcgcagcgcgcgccctccttgcacagctgcgtgcggtacatggtggggtgcagccagcactcgaacacgccgtgcgagaaggagcaggcgtcgccgcgcttgcacgagccctgcggtggagaaggaggagggcgggttcggtggagagggtggcaccagctgtcggcgcagccttgagggaagaaatgcgacccacatcccagccatacacaccttgcggaagtccgggcacggcacgccctggtagcagtagcggcgcgggtcgcgccgccgcgctttctcgtctgcgggtcggtgtggagggggaagggggcgatccaagcgggcacgaagcgggcaggcgtgatctgggttggcgagcagctccagtgcgcacgccatcgaggaaaaccttccctccttcgttcccccaatctcaggctactgtacctggatggccataggggcagtcggtccagtcgtgcacctcagctagccggggacacatgtcgatctggggagggaggggggggaaagggcatgggcgaccaggcccttgcaggtgaagggacgacctggggtgcctctaggccaccgcgaagggtccttcagtgcccaacactgatcccaggataccattccccacccaaaacaaatgcaatgcatccccgtccgtaccttgaattggtacattcggaactcgtcggtgcagtagcactcctttgaaagctggctgaccctccttccgtcggtttcctttggcgcaggattggcctgtcccggacattagggatgaatcggttgctggtggtaggacatggtgttgccgcatgactggcgcgcccgcggcgcccctgcaaagccggcaacccgtacctgaacctgcgtcaggaggtccccgggccgctgcccggcagcattaagggcctgcgtgtcggcccccgcggcaatgagggatgcgatgatacggtgtgtaccgggtcctgggctggcgcacgcatcgtgcaggggggtgcagaggtctgtgggggagggcaagcgggccgcttcccgtgccccgggcagcaccagcaaagccgcgaccaccctagcggccccgccctgcgcggcgagggcgagcagcgatctggcctggcactgctgttgtgagtcgaaccaggcatagaagggggtcccggcggtcgggaggctctccagcaggcagggattgtcgcactcaagcgcagcactcgcttcgggcggcaaagggtgcaggggccccatcctggcccgtgctggcctgcaccaatacgaaagttcgggtgctaatgcgaaggaagggattgaggccggaatacgagggcacagggtcttcctcaggcagcgtgcggcacacgtcactccggcccgtacaagatctggtggctcaaccctcgaaccacgaggcaagacaggcgggaagagtcgggtggccgcctggtgacaccaacgaagacttccttcgctcctcgatcatcaagtagattgaaatggatgttcaggcggggtgtcggggccccgcttgcgtcgaaatgttgcccttgatggggccgggacccgatcgatccggtgacatggattcggtcgaaagggccattgctagtattacacagaacgggatacgcatgctgatgaagcagtgctataatctaaggagtgagtcgacccctgcttacttttcagggatacagtctgtgagaagccatgatcgcgattaccgcaatacagtgcacagtttccggttggcatcatcaccagagacacttcgaagcgcaaacgctgggaccgaccgagccgacggaaggggcgaaaactcacagtacttcactgggagtcgtgggaagcgatgcattcaaaccggcatgcctcaattcaatgcaatggaggcggcccgcccactcgggattcctgtccactgaagccgcagatccgcttgcccagggcgcggggggttcaaacggattcgctcgccggcttcccccccgtccacgggtcgaacaccaccttcacccagccctcgagccgctgctcgaacgcttcgtacgcccgcacgccgtccagaaggggcagccggtgggtgatgattgctgtgctctcccctagctcccccttcgcaagggccgggaggagctcctcgagacaggacctgctgcggtgggtggggcagtgggacccagaatcaccgtgccgggtcgcaccctgctcgtttgcggcaacccaggccggcaataccgtaacctcaagagaatacggcctgccacacgaggactcacctcgcggggcaccttccggaagccagggtggcattcttgttgtacagatcagccggggtgaaagggaagccggggtctgcgtgcagcgccagggcggggccggcctgagtcagtctgtgcccatgcacgcctgtttgctacccgcagggcacctttgcttgcactctcgctccgccacgcgtctgcacagcggagggtgggagccggggcacaccggcagaggcgcaggtgtgccccgtccagcgcgcccctcaacccccccccccccaaaaaaaaannnnnnnnnnnnnnnnnnnnnnnnnnnnnnnnnnnnnnnnncccatcctcgcccttcctcgcctgtgtggcagccgacgctggaaacgatgcccccgggcttcaggaggtccagggccaggcccagggccggcccggcaccgacgacctccagcaccacatccgcgccctgcccccccgtggcctccctgcagtcggtggtgggaggtggggaggggaagggatgggtgagggcagcgcggaccgcaatgctgatcggtcgatttcgccgggcatgcgctgccgcccgtgctgcccccggcgcccctccacaacccccaccccacccttacctgaccgcgacgatgggatcgcactcggcgctgttcaccggggtcgcacccagcctgcccgccagggccagccggccgggcacgctgtcgatggccagcacggcgcgcacagcggggaagcgcccggcggcggtcgcggccagcaggccgactggcccgcagcctaccacggccaccaccacgcctgtgcatgggggagggatggtggtgaagaatggctgcaggcgtggaccacctaacgaaggatgccccgcccgcagtcggacgcatggcaggtcgtggtccccacagccttgcccagcttcagccacctggtgcggcacgggcgagcccggcgttgcgcgcgcaaaagtagcccgtgctgaggatgtccccggccagcagcgccgcctcgtcgccgacccccggagggatgcgcaccagggtcgacgccgcgagaggcaccctgggaaggattgcgatgcgcggtgtgggagcctctcgctccaaaggtctttggcaggctgggagacgacgcgctggggctgggcgggcatgcagtctcgcccgcaggccacacctgcgcccagaatggtaatctcacctgatgaattgcgcctgggcgccgtgcaggccctgcccattcagcctccagccgaagagctggccggcatcgcagcggcaggtcaggcccgaggcgcagggggcgcacacgccgcagctggtggtgaaggggctcatcaccctcgtccccggggtcagagtcgtgacggcggggcctgtgcggcaggggggaaagggatgagggatggaaggaatgaaggttcagggggctgggtatggtctgcattgcaacactggggcgtgcgtgctgcagtgcctgctccgtcgctgctggccgtactctcattggaccgtccatgtcaccagccactccgcccttcagatcggtcttcgtccctatgaggactccagttcccacaagtaacttaccgacctcgaccacagtgcccacgaattcatgtcccatgatggttcccccatcggtggcctccttgccacggaaggggtggaggtcactgccgcacaggcctgccagctccaccctcacgatggcatccgtgccggccgcgatgcggggcacagggcatctctgcacctctatatggtaaggagattgcaaaacaagcgcgtccatctgccccgaggcaggcggccaggcggtgtcgatggcggtacacatggtgggtggccgcggcacaggatgcggagcggtcccaccgcaagtcaacaataacaggcgacacagatatccagtgacacacgttctagcggaattgcatgcgtgctgatcctgctattgtcatgcctgccaatatcgagggcgtagatgcgatggcatgtcggagccacgatcaccgcgcgcgaagatcggcacaggccatgcctctcagtgatgtggtgatcgcagaccctcctgtgcgctgttggggcgtgtgttatccgtaaattataggtagattgcatttcaaggattctggtcgagtaacttcggtccgtggagctgcaaggggtccacctcccaaagggacccttcatcatgccccatcatgaactctctggctggtgcgggaagcatgccggccatggcattctggatgctgggtcttttgactcttgctatttgctaacagccgtggggccggcgctgctgctgctggcgacggtgacgctgggaatacagggcctcaggctccatcgcctccgcgccgtcactcgcacatggcgcccgcccggctcccacacccatgtgcaagccgttcttgctggcatcatggcaggactgcacctggcagcgttcttgatcttcgcaacgcaggcacgctgcggggttgcatgaatgaggggaggatgggagggcaatgcagtaggaggagagcggcgggagcggaaatgtctatctcttagcccgcaatagccaaagacttccctgagtctcatacgcccctgttgcacatctgcagtacgtcaaggtgccctacctcatcggctcttttgcggtgctcaccgtcgcttgggccgtcatcctggtgaggcagctgtgggccagggcacatgcaaagccatgcgcggcatcctttgtgcctcagccttgcacaggctgcatggcttgtgaaaatttcgcgccgtgccatgcatgtcgctcctgtttcaagagagcatgccccatgcctggtcctcttcaccagcttgcacagcatcgcacccccgcacacccaacagaccctcctgctgctgagcatgcgctggcgcgtccaggcacggctgaagcccctggctgccggggtcgcggccctgtacgccctgctggcctacagcgccgggcagtatgcgtggcatggccggggccggaccccatttgagtcacgctctgccctggcagtggcgctggggaccttcctgggggcagcctggtttgcctcggcggagacccgcaagtgggtttggtgggggcatcggggcgggctggggcgagattcgaggtccttggggaaggacggctcactgggcatggccacccactgcggggtcatgggctcctgatgtgatccggccacgtgaagcctccaatgtgccggcctggggcttttgagcgcacactgccctcaaggatccagccactgctcgtctgccagtgccatcaaagcctcgggtctctttgatcccggcgcctacactcaaaccccgccaggtttgtcgaccccgccgaggacgaggcgctgatggagtcattgctgggggacgtggaggcgcccgtgggggcctccacgcactggaccctggcgtccaagaaccgaaagcacagctgggtttcgctgctggcaatcgcggccaagtacatgtggcccgaggatgtctggctccaggtgggcgggatgtcctgcccagggccgggatgactcggtcaggttggtgggacatggaggggagtgcgtacccataccccgtgactggggcgactctgaaacatgggagcaaggccctccctggttgtgcaatgagctcacttgcccactgtctgggtgtgcatgcctcgcttcctccaccgaaagaaaccctctgaagaacctggcacccgcctccctgtccaccctcacaggtgcgcgcgtcggtctgcgtcctgctggtggtggccatccgcctcctcaacctggcagtgcccttcctttataaaaaggtgatgagggtggaaagaagggaggatcaagggtggggcaagagggctgtaaggtggcatgcctgtatggtgcgaccctcagtccccggcaagaagctaggaatgattgtgtgccctcacagccatacacgcctgcatcgcctgtatcgcccccgccctttcctccgccccctgcgtcaggtcgtggacgagtttgcggcgttctcggcccggacgcatgcgcagccgcccacccactacacgttctgggaggtgaggcaccgaggatggagtgctggggcttgattgtgccggttcagatgggtggggtcccaatcggtaagggctgggggattgtgtacgctcgcctttggcccggtgctcttgttccaaggggctttttatggctggcgctgcccggccatgtggctcttggtggaacccaccgtttccccaccgcaccccccctcgacctcccacacccactcgcaacagacattctatccgtacgtcgcggcttacatcgtcgtctactttttccagggcggggccggcggtgggtcggtgggcatcatcagcaacctgcgctccttcctctggatccccatctcccagaacagctacaggtctgaactggttctcgaacggaggcagcgtctttggcattgcagggtggtccatcatcacagttcaggccctagatggggcactggcgtcctcgtccaacatccctctgccgtgtctgggcctggccccacccctgtgcctggccccctcacgccacgcctccccaccgcgccgctccctccttcctcaggcgcgccaccctggacatcttcacgcacgtgctggacatggacctcactttccacctgcaccgcaagacgggggagctgctgcgcatcatggaccgcggtgagggccgaggggtagggggccctgctgaaggcgggaggatgcggaggccatgcgcgtgaagcccccaagatcgctcgacttgacctgcaaccggcaagctgcagaggaccagtgcgcgactcaggggagccccctgccatctttgaccactccaccgccacacctgtccgggctcccacacacctccccaaacaaacacaccccaccacccaggcacgaactcgatccagaccatgctgagcacggtggtgttctccatcggcccctccatcttcgacatcgcggccgccagcatctacatcgccctgtccctcaagttctggatcgccatcatcgtctttgtcaccctgggcggctacatccccgtcaccatctacctcaccatgtggcgcggcaagttccggcgcgagctcaaccgcctggacaacgcggtgcgggccaaggccgccgacgcgctgctcaactacgagacggtcaagtactttgggaacgaggggttcgagcgcgctacctttgcgcgcgccatcgacgacttccaggtggaggacttcaggctgcaggcctccctgaacctggtcaacgtcgcgcagtccttcatgatcttcgccggcctggcggcggggctcctggtctgcacccaggtgtggctggggctggtctgttgtttgaggggggaggtgagggtagggggctcgccggggggggaaacacccggagtgtgagagtgtgtgtgatcacaaagggaccactccgggatgcggggctgcacagctgtgggcaggactggaatggggggctcttcaaagaggcaacgggcttgacccccgatgtggctgcgtgtgagatttctgggtacccttgggagcgcacgtccaaaaagcgcccttcccccggcgctgcgctgccctgacccaccctggagcacctgcgctctgcacagggcattgccgatggcagcctgtctgtgggagacgccgtcctttttgtcacgtgaggaccagggtgtgtggcggggtggtcgtgccccggacttgtactcgcgcaaacccgcgatctgggcatgcaggcagaggggtttcattgcactgtgttcatccaaacagcatcctccggtgtctggtaagagcttccttctgcctggtccttgcgcgctgagccaaacaggaatttcctggtcaagtacctgaatgcatgtcatcgtaccccccccccccttttcgttcatcctcctcgccatgacaggctgatgcagcagctgtacgcgccgctcaacttctttgggacctactaccgagtgatccagcagtccatgatcgacatggtgagggcggcttggaggagaagagatggagcgctgggtggcttgagggttcagggctctccatagctgacacaggagcatccggccaatgcaggcctgccccctgccctcctgtcaggcctcgtactccacttcaaccctccaaacccacctgcccgcaccgcaggagaacatgtttgagctgctggccaagcagcccagcatcaatgactcgccaggcgccaccgacctggctgtgactcagcacgacgtcagcttcaaggacgtgtcctttgaggtgggtacggatggagcggcgagatgcgaggcggtctgtgggtgttgcgcagggcggagctgccctccgacgcagcctgggtagtctttctggcgctgcatcacccgcatcgacattatactccccgggcttctcctcacacccttcctccccccactcccaatcatacccctggccgcagtaccatgcggggacccgggtgctgagcaacgtcagctttgccatccccgccggtaagacggtggccctggtgggggccaccggctccggcaagtccaccattctgcgtctgctcttccgcttctacgacccctccgctggtgaggctggggagggtgtgggaccaggctctgtgcctgttgggtccagaacggtttggcccaagcaggggccgcctgcgcccttcctgaaccagtaagaatagagtcattcaaggccgagccactgtgttttacccacgtggccccatgtgtttgtcagaatgactagaggacgagatgacagacccagtcctggaaccccccccaatcccctccccccaggcggcatctatgtcgggggcaaggacatctcgcatgtgacccaggcgtcgttgcgtgccgtcatcggcgtggtgccacaggacaccgtgctcttcaacgatacagtgcgatacaacattgcgtacgcgcgccccgacgccagccaggaggacatcgaggccgccgcgtccgcggcctgcattgacgaggtgatcaagaccaagttccccatggtgcgtacggttaggaaatgggggttgttggatttgggggttgttgga

SEQ ID NO: 18188 - DNA, 62 bp, Chlorella protothecoides
atttattttactttaaggttttacaagaaaaattaaacaaatctaaatcatataatatttct

SEQ ID NO: 18189 - DNA, 80 bp, Chlorella protothecoides
aatcttgtattttttgaataacacctttcggaggtacatctaaatcaatgaaatattcttcttttcctattaaccttcga

SEQ ID NO: 18190 - DNA, 161 bp, Chlorella protothecoides
ccatttctttattttttacgcgatcatatgtcaactcaatataaagtatgtgtagatatcactgcagctgactatccttctcgagcatctcgttttgaatgtgtctacaacttgttaagtgtagaatataacagtagaatacgcattaaaacttgtgttga

SEQ ID NO: 18191 - DNA, 3692 bp, Chlorella protothecoides
ccgcacacccagccccccgtctcgccgcccccccccccgccgtccccgccgccgccgccgccctccccacccccgccttcgccaccgccctccccgccgtccccgcccttcccgccgccgcccgagggcgtggtgtcgggggtgtgccagcacctggatgactccaccatctcgtgcaaggtggagatcagtggacccttccagcccgaggtcggcatcttcaagctcacgtactactatgagcaccagaggaacagcgtgaatggcccaccctttgttccccagggctccctcaccaccgaggtggagacgctggccaatgcaccatacgccgtctcggtccaatacaccggagtggatgggaagaccaagttctacacggccttcagcctgtcctacaccaactcgccgccgcccgcatccccttgatacccctgcatagccagaacttgctcctttctctgccaatatcacccttcattttcatactcagcccctttcctacatcatttgatagatactccctgcctgtgacttgcagactgccccatccctatatcattgggaaactgtaaacaattgtatgcgacagaaaatgagcgtgagtgcgggttggcagctggcatacagcagcctttgacatgttgatcatccgtctttgactgcaactaggacctcgtggatcttccttcaggtgactccagtgcacaatggcgacatgcgggtcatgcacacaagtttgcgcctccacacgcctgatgatcgattgcaaggctatgcttgcgctgtgagaatatttcatacaacgcacgacccagccttgcgccgtatcctggtgcaaaccctcaagcaagccctacgatcctgggctgacttttgaagacctcacggctgcgattccctccccctgccgagccggatttgaaaacaaacaagtgattcccctggcttcagcgacggcgagcggtcctgcggttgatcctgatctccaggttcgtggatcgcgtgctctcgccgtgctgcgctcgatctcaggccacgaatttgaattctgcgcaatatacgcgcgctgcacaccccgggaaacgaccctccctccacagcatacaaaagcgtcgtcatcccacaccgcgatggcggggaagaggggtgccgctactcgtgccagagcaggcagagtcggagcaacagaagctgctcccagtggaaacggagggagtgagcaggacgcctcatcagcaggcaacgcagcagacgaaagggtgtcgaggagccaaaatggggaggcgaaccccagccctgcgaccaagcagcctacaccccggcccaaacctgtggctgaggagggctcctgtcacgcctcagaagcgaccgagttctacgtccctgccgacgtgctggaggaggaggagaggctcaggattgcgcgagaggaggcggagagcaaggtgcgcgcccgccagatagcaacggggtgcctgacggagtgtgcaggctgccagccagtgcagggtgggatggcttccaccaccctgccccaccagccgtgcacccccaccaacagacccctggctgctgtgaacctgcacctgacaccgtgcccagtgtcaaggcggcaggcggttggcacatggaatcacgcgccctctctttcctctccgtcgctgcagcccaaggccgctcccgtcgagctggtgctcggcaacgagtccttcaaggccctggagacgctgctgaacaagtcgcagctttacacccagttcctggcggagaacatggccagtgccgagacggagcagctcgagtcggaggccaaggccccaagcccgggagagggcgacggcccgttggggaagaagcgcaaggctgccgggcgcacaggcggcgccaagaagaaggcgggcaaggcggctgcggcgccctctgcggcccaggtgacatagcggggaggagaacatggcagaggcctgttgtggtatgcccagtggcatgttaaacccactgtggcactcttcctccactcaggctgttgtcacaaattcacacacgcacctagcccccaccacggggcactccctgcggacgccagcccctctcccaccaccctgcctttcctcctctcccaacaccctacgtccccccctcttccctccccctgccacaggagctgtgccccggcctggtcggcgagctgcgggactaccagctgcgcggcatccgctggctggcctccctttttgtcaacggcatcaacggcatcctggcggaccagatgggcctgggcaagacggtgcagaccatcggcatgctgtgccacctgcggggcaaggccatcctggggccctacctggtgctgggccccctctccaccctgcacaactgggtttccgagttccagcgctgggcgccagacttcccggcgctcctctaccacggctccaaggccgagcgcgcccagctctggtccacgcgcctcagcagtgaatgggccgggaggatgagcaggtggttgtcagtgaatgacgggccggagtgggaaggtgcgatacccacacctgttgtacagcgcgactgatggctcctcaggaatggctctcaatcgatgcgaggtctgtgtcggcagatagagcccacgggccctatctgcctggcgcgttgtcatcgtcccgggcacgaggccccggaccccgggattcccagtttgctgtcccccatccccactgcagagccagtggatgggagcttcccggtggtcgttacctcttatgaaatcctgctggccgacatccgcaacttccagaaggtgtcctggaagtacctggtggtggatgaggggcaccgcctgaagaaccacaactgccggctcatccgcgagctgcgcacgctgcgggtagacaacaagctgctcctgacgggtgcgaagggtatggttgggtgggcggcctaggagcacacaagggcaaggttgcactgtggggcttcaggggaggggcgtctatttgggagggcctcagatcgctgtccggttgcaagcatgccctttgtatggcaggcaggcttgccacggcctggtgcgaggacgtgcccatcaacaggcccacaggcacctgcccctggtggccgggaccggacgatccacttccgcccatttctcctacgcataggcacgccgcttcagaacaacctgacggagctctggtcgctgctcaacttcatcctccccgaggccttctcctccctgtcagactttgagtcgtggtttgagtccatggccgacgccggcgggcagcaggaggacgaggtccggcagcagacagcaaaggtgggctcaagtggtggtggtgcgctgggcacgctgcacgcgtgggcgaggcagccgtgtgccgcacagaccggggcgcgggtgggagtcagctgccctggggccatgagatcctgctcctgttggcactctcccatcctctctcccgcccaaactcgacaggtggtggagaagctgcatgccatcctgaagcccttcctcctgcgccgagtgaagagcgatgtggagaccagcctgcccggcaagctggaggtggtgctgtatgcacagcagtccgccaagcagcaggagcttaataagcaactgaaggacaagactctgcgggtggggctgggggcttatgaaggggggggggggggggggggggggg

SEQ ID NO: 18192 - DNA, 2286 bp, Chlorella protothecoides
  modified_base (376)..(385): a, c, t, g, unknown or other
  modified_base (612)..(621): a, c, t, g, unknown or other
  modified_base (1004)..(1013): a, c, t, g, unknown or other
  modified_base (1217)..(1226): a, c, t, g, unknown or other
  modified_base (1416)..(1425): a, c, t, g, unknown or other
ggcgggcgcggcccgccggcctccgtccgccccgctttcctgcgtgtgaacgtgacgcggcggcccgccgcgggcgcggccccggccccgggccagggcgcctggcccccctccctcaaggcctacgtggagcgcgccttcaccgccaccccggccaaggcccggccccggctccagctggccctgaagagcatcatcgcggaagcccaggcgcagggtgcggcgaggagacgggggagggggggggcgggggctgataggatatccatgtgagcgtgacgtgaagcggtggtgggctgtggatccgcgctcggccccggccggaccccagtttcctcagattccccacccttgcccccaacaggtgagctctggnnnnnnnnnncgggctgtggatctgcgctccgcccaggccggaccccagtttcctcagattctccacccttgcccccaacaggtgagctctggaggcgggactgggacaccctgcccctccccgacatgcagcacagcgccgaggatgccgcggtcctggtcagagagacggcggccttcgccccccagtctactgacggcgccttgagccacgctgcgcctgctgcggcagcgctnnnnnnnnnngccccagtctaatgatggcgcctcgagccacgctgcgcctgctgcggcagcgctgcgctcggcggccggggacagccgggttgcggggacttttgctgcgccctggctgccgcctgccaaccctcccggcgcgggccaggcggcgagcccggcggtgcaggggatgaagaggggcctgccctggcagaccggcgagcaggccagagcgggcgccccgccccccagcccggccgtgtttggcctcgcggccgggggcaggccgaaaaaggggcggaaagcggccgcgcggtcgccggccaagctgtgcacggagagcgaggagagcgaggcggagggcaggggcccgtggcgcaggaaggccgggcgccgcgccgcggtccccnnnnnnnnnngggcggagggcaggggcccgtggcgtaggaaggccgggcgccgcgccgcggtccccggcggtgaggaagaggtccgggcgcgcgcccgggccgggcggtttgggtcgggggcggccgacggcgtggccagtcggtgagttttttattttagagagtgggtcgacggtggggcgcgggtccgtactgcaatgcatgtgagggggnnnnnnnnnncaggattgggtcgacggtggggcacgggtccgtactgcaatgcatgtgagggggggtaccccacgccacagacctccctccgccaggccagtgtgcagcatggcgacgcctgcgctccacggcaccctgtgcgccttcctttcccgaacgcgcaggccaaacgtgggtcacgagcggcgccagcgtttcnnnnnnnnnnaccttagacctccctccgccgggccagtgtgcagcatggcgacgcctgcgatccacggcaccctgtgcgccttccttccccgaatgcgcaggccgaacgtgggtcacgagcggcgccagcgtttcctggcctccctggaccgcgccaacacccaggaggagctggactgggacgcctttgccgtcaaggtgcggggaggaagcagtgtgtgggttggatggcgaggaagggggcgctggatgcgctgcgcatcgcccatgccgcggccatggcacccagccccctcgtcgacactctctttcaacacacacacacgcacactccaacagggcacctgcacgcggctggagaagagctacttccggctcacctccgcgccggacccggccacggtgcgcccggagccggtgctccgtgcagcgctggaccagctggtcgcccgcatcgcgtcgggccaggccgcctacttctacgcgctggaccagttcaagggcctgcgccaggactgcaccgtgcagcacctgcgcaacggcctggcgcggcaggtgtacgaggcacacgcccgcgccgcgctggagtacggcgacgtggccgagtacaaccagtgccagggccagctggcgatgctggacgcggcggatgctgctgcggcgtcggggggggggcgaggagggggggcggcgagaccaaagggcacgggcgcggccgcgccggcgcgtgccgacgggaccgccaccccgatcccgacccccgcccaccgccccgagttcctggcctaccgcatcctgtaccaggcggtgcatgcgcggcacggcgaaggcctggccctgctgcgcacgctgggcacgctgcggcccgagg

SEQ ID NO: 18193 - DNA, 186 bp, Chlorella protothecoides
gcaaatagaattgtagcctctgttaaagaaaaagcacgcacacatccattacgattagctggtttaattggtaatagaacagccaaacgcgatttaattgataaatatgtagaagcttgcccaatgcctgtattagaagttttaccgctgattgaagatattagaatttcgcgtgttcaaggaaaa

SEQ ID NO: 18194 - DNA, 61 bp, Chlorella protothecoides
gttagacggagcaaaattaatcggagcaggttgtgcgacaatcgcacttgctggtgccggc

SEQ ID NO: 18195 - DNA, 76 bp, Chlorella protothecoides
gcattcggggtcttgtctgtaacattcctaaatacggtcatatgcagcggtgcaccgttgcgggggcttgtcagcc

SEQ ID NO: 18196 - DNA, 67 bp, Chlorella protothecoides
gtgagaaatgtattcggggcataggatcagctagttccgtaaagaagagtttagaatgagacgaaca

SEQ ID NO: 18197 - DNA, 71 bp, Chlorella protothecoides
cgtgactcggacaggtgttggggtggggttggttgttggtggggggggcgctgggtggtctctgtgacggg

SEQ ID NO: 18198 - DNA, 81 bp, Chlorella protothecoides
aaaaaaataaataagtattcctaaatattcgtacatttttgtttttttgtctttatttttttgattattgacatttttcga

SEQ ID NO: 18199 - DNA, 88 bp, Chlorella protothecoides
aacatttaggcaaaactgttgttgatatgcaagttaaagaaatacaacacattcaagaaaatgttaattgggtaaaatattgtgttaa

SEQ ID NO: 18200 - DNA, 70 bp, Chlorella protothecoides
ataaatatttcttaatatgaaatattagttcattaaaaagaaactaatatttcatattaagaaatattta

SEQ ID NO: 18201 - DNA, 294 bp, Chlorella protothecoides
aaatactgctgaactactatcgaattcgatccaaagtaggagagagattaaaaaagtcaataacgatgagtttaatgcaatatttcggatagtttgtgttttccaacttggaacaaataataatgctgttacgcctaataggggtacagctaaaaccatttcaatatatgacataaggcttagaaaaaatattgttttttaaattataaaataataaattttaaataatatacgttattttacttcgtacaacccgatattattttattgttgtacatatatttattatttttt

SEQ ID NO: 18202 - DNA, 143 bp, Chlorella protothecoides
catcaatgcatggggtcatggggctggctgcagagtcagaatcaacgagtggggggggaggcaatgaggtggtcggccactccatgtcggcactggtggtcgtcctgcatggcggcggcgggcatgatgaccatcgagggaag

SEQ ID NO: 18203 - DNA, 71 bp, Chlorella protothecoides
ctgggagatgcagaggtcctgcaggccaggggtggtagccccccatgacgaggtccctggcgggtcccaac

SEQ ID NO: 18204 - DNA, 101 bp, Chlorella protothecoides
acacgttctctatataatcgattatataaatcaacccattgagcatcaagctcgcctggaaggcgaaatgggacttttggtacaccgataggcattttttt

SEQ ID NO: 18205 - DNA, 61 bp, Chlorella protothecoides
tgtataaatatttgcattaatttttaatttgttaatatttatattaattaaaattatctgc

SEQ ID NO: 18206 - DNA, 63 bp, Chlorella protothecoides
aaaaaaaaattaaatttaaatgagtctaattctcgttatactattgattataaaaatacaaaa

SEQ ID NO: 18207 - DNA, 72 bp, Chlorella protothecoides
ttttttttctacaaaattattactttttacatttatagtatgtcatttttttaataaaaatcaaattttttt

SEQ ID NO: 18208 - DNA, 103 bp, Chlorella protothecoides
cgaaaaaaacttgtttagtcgatttaaacgatttagatggtaaactagtataatagtttttcatcaatattttagaaaaatttaagtttataatattcttaaa

SEQ ID NO: 18209 - DNA, 72 bp, Chlorella protothecoides
ccttttctctccacctccggacccccccccgcccttaccgcatttgtagtcaacacgctggggcgcaagtcc

SEQ ID NO: 18210 - DNA, 76 bp, Chlorella protothecoides
ttttaggatttggagcatctgggtattttactgggtacgttttaataaaaacaaaattaggagggagatcaactct

SEQ ID NO: 18211 - DNA, 393 bp, Chlorella protothecoides
taaaatctagtaatttatcaaaagattctttatcttgaagtgctatttgactgcaaatttttcgattaagaagaattttagaggttttaagctgattttgaaagttactataatttaatcctgataaacgaactgcagcatttatacgtgaaacccaaattttaacaaattcacgttttttaatttttctatctttataagaatttgttaatgcttttattgttctttgttgggcggttctatataatttagacgatgaaccacgaaaaccttttgttaaatctaatacttcttttcgtcttttatgggcaatattaccacgttttactcgagtcataaataaaattaaagtttttttatatactaatttgataattattcaaattaaaacga

SEQ ID NO: 18212 - DNA, 61 bp, Chlorella protothecoides
caaatttagagtgaaagcggatatggatggtcatggccaatacgagacaactacatggtaa

SEQ ID NO: 18213 - DNA, 77 bp, Chlorella protothecoides
caatggcataatgcgcagcatggattgcattcccaactcagatacgaagccatgcagcactgattcaacggcatcac

SEQ ID NO: 18214 - DNA, 79 bp, Chlorella protothecoides
gtgtgggctcgggctgagcccgcgtgtgctactgagcagcgtgaggcatcatgcagctactaagctgctagtggaccca

SEQ ID NO: 18215 - DNA, 76 bp, Chlorella protothecoides
gaccggcagaggaggtgaacatgtctccaggggggtttcatgtttggggttgatctggaaatctcaggatggaatg

SEQ ID NO: 18216 - DNA, 75 bp, Chlorella protothecoides
tgctgatacgggttgcatgcttcctggcaccccgcaggaaaaaactggaggtggggaagaattgtcaccgaccct

SEQ ID NO: 18217 - DNA, 480 bp, Chlorella protothecoides
cttttcgctcgccactactcgggaaatcgcgtttgctttattttccttcagttaataagatgtttcagttcactgagttgtctcttttttgcttatgaattcagcaaaaagtataaaaggttgccctattcgggaatcttcggatcaatgcttgtttccaactccccgaagtgtatcgtcggtaccacgcccttcttcgtctctagatgcctaggtatccgccctacgctttaattcatttgaccatgttctaaaatgtaaaaaaaattttttaacatttttggtggaaataagcggacttgaaccgctgacatctgccttgcaagggcagcgctctaccagctgagctatattcccaaatattataattttttttattggtgggctatgctggatttgaaccagcgacctcacccttatcaggggtgcgctctcaccaactgagctaatagcccgagtatataatacctacgttttttt

SEQ ID NO: 18218 - DNA, 254 bp, Chlorella protothecoides
ttatataacgtatttataattattataaattgaaaagaagttaataattatagtattataacttctttaaacaataactaatttttatgctgttatttatataataattaaataagttataaaaccaaatttttattttaattttttctccccaggtagggattgaacctacgaccaatcggttaacagccgatcgctctaccgctgagctactgaggatttaataataattttagtataaatataaatttttt

SEQ ID NO: 18219 - DNA, 5596 bp, Chlorella protothecoides
gggggggatgctgatggcatgcggtgcgggatccaagggtggggctcgtggaagggccgggccagccgctggcctggtgtcgtggcttgcatgctccggcggtgccatgcactggcggccggcggccatgccgtgagatggcatgaggggccggcttgcccgctctatgcagccaataccaagtatggccggcactccgcctctcccacaggccggcccccggacttcatgcaccgggagataagctcccagccggagcgacccgccgaggactctggcctgggccgcaccccttttgaggtccaggccaagatcgaggagatgatggcgcaggccggctgccaacagcccaacgaggtcctgcttgcggccaagcgcctgttgaaagagggtgtgcttgggtgtgtggagggagcgcgggtgtggcaacatcctgcactctccgcagggctgcctgctgtgcaggatagcaggctcgacgtggcccccaacccccaacccccaacccccgcctgcatctgtcccacccccatccacccaccatccacgcaggcctggccgagggcggccccatctccggcgaggacgtgatgcgggtgcggggctgcggcctgacggtgctggagcggctgcggcgcgacgccgcatcgggcgacgcgcacggcctctcctccctgctcagcgaagtggagagcggggcagggcagctgccgcggccgcgctggttcaccgagagcttcaaggcgctcaaccaggagacagccaccatcatggccaggtgaggagggaggaagggggggcggcgtggtggtgtgccaaagtggcgtctgggaatggtcctggaacagaggggagggggtgagggagtggcagtccgtgcatgctgcgacccgctgcgtggctgtcttgccggcggcaagggaatcgtgcgcctgtcctcccgcctttagccacgcgcgccgcgtgcctctcccctggagtccacgtgtcgccgccatctgaaggagtgctgtgccaagcaatgcgctcgggctatgtgtggcaactctcccccatcccgcatggaaaccctcctcatgtttttacccctcataccccctgcccctcttccccccccccaaaaaaaccaaaggcggttgtgggaggccgggcaatcctccgggggccagccggtggtggggctggtgtctgcctccacccttcccgacatccgcaagctctggcccgcggccgggtccccggccatccaggcccgagccgaagagtacctgcaggacccaggcatgcaggcccccggcgccggcgtggttggcttcgcggtccccgccctcagcctcgccatgatcggcatcatggcctaccgccgtccgcgcgtggccgcctacgtgtttggcggcctggccgccatctccgcaccctccatcctcctccagctggtggccatgaaccgcttcgccagcttcacagaccggcttgagcgggtggcacgcgacctcgacgctggcggccccggcggcgactccttcagcttcggcgaatggcagtgaggggggtgggccggagcgccagtggagtacctgctggagcgtcaagggctgcagcgtccatgagcagagccgtgcaagggagcacaatgctctgcagaaagtcccctgccaatcgccgtcactggcttgcctcctcatccaggatggcacaacccacagagcccgccgacatactcggaagttcccccatccgctgcagaccccccactcatgtgtgtgagcctggtcactgtgcaagtgttacaaggtaaggaaagcccttgaacagggaccttgtcgggcaggcaggaaagggggaaagctggctgtaaggaagtgggaatgggcagcgtggcaggtgacgagtgctgctaaagcagtggagttccttccatggagaagtaaacgctcagaggaaggcagctgagcaaatctgtgtagacccaggcctccacatggcctggcggttggaaaacgccacgagatatcaacctgggcacccaaggcccggccccgagcccgatcctgggcagcagggaggaccgcctggctcacgctccgcctgcgccccagcaaggcatcgcgcccatccactggctccctcctctgagcagccagcaggcctcctgctcagtctactgctgctgctgctgctgcagcagctgagcggcgggcgggaggaggctggctggtcggccgggtcgcgcgggccgcagctccccgggccggtccacaaactcgatgaaggccatctgcgctgcgtcgttgccgcgctgctgcgtgcgcaggacgcgggtgtacccgccgtcacgctggctgtaccgctgggctagcacggaaaagaccttgtgcacctccgcgtccccccgcaggatggccatggcctgccgcctcgcgtgctgggaggcctgacgacgatgagaaggggagggggggggggtgagagggtccacatgctggatggcagatagagtgttcgtggacccaagaccagaggcattgagcgggtccaggctgcactttcagatggaggctggggccagaggctcttgtgtgaacatgcaggaagggcaagcagggaatgccctgcatgcccggtcggaacaagaagcgatcctgtgggataccgactcccagcgtataacatccgctgtcaagacatgctctcaaaataccagcacacctccttgccgagggtgaccacttggtccgccacccgtcgaagctccttggccttgggaagggtggtctcgatccgctcatgctccaccaactgagacaccatggtcctgcatgccgaaacatcgacaaatgtaaaggttctgcacatctcaaacctccataagatgccatgcaaccaatgtccacatgtgtccctgcaagaactcaccgcagcatggcccatcggtgggctgagctccttcgaagctttcggaatgcccccctgtgcttcataatatatcaagccactctcgatacagtgcacgcagccttactcgggccagcttcagcctgtgtccgggcttctggtggggtccagcacttcctcgggcggcgacctccccgcgacaatatcaaaaggtggggccaggccgcgcctatgtatgcgatccggcagtgttttgtccagcgcaaagtaagtatggcctgcgagtctgatgccaaattctgctcagtagggatttcccgtctagtatctcgcgctttctcaagaaggctgcacaatctgctcgcctgcagggccgtgtggtgggacaaaagggcagctcatgctcgtgctcagcagtccttgccgactcctgcttcttattttggtagaagagactccacttgtagtatccactcgcctcgttccccctagagccaactcgcgaccgacatacttggcgtcctcgcttgcccgagcagctggtactctgcatgccgaactaggcgcctgaaaggcgagattctgcggggaagcgcgcagcagagggcaagggcgcgatgtctgagggccccagcacggaagtcgaggctcaggtggacttgacggtgcaccccagcggcatcgttccgcagcttcaggtgggatgaggggctgtataatttcggattgactcagtaaaaagtcgtgcccagtcttgtggtcacccctcccgaggccgcactgggcccacagcgagaatgtcctcctccctgcctccccagaatgttgttgccaccgtgaatctggagtgtaagctggacctcaaggacatagcgctgcgggcgaggaacgcagagtacaaccccaagcgctttgccgctgtgatcatgaggatccgcgagcccaagagtacagcgctcatctttgcatctggcaagatggtgcgtcaggtggcagggtggggcgccaaggctgatgccaggcccttcacggagtccctgtgacccaagccactctcatgtgctcatgcaggtctgcaccggagccaagagcgagcaggagtcgcgattggcggcacgaaaggtgtggaattggatgtccagactgagagaggcagggcggtggctgactggcgcagggccgaggctgtggccctgtgccatgagctcgtgacgcgttgtttgtgccatgacccctgaatggatctgagtgttttcggggagctgctcctgcgcacctcgctgcgcgtcgcaaggcatgcaagcccgagccagcatccacccatttccaatacccacccccacctccacatgcagtatgcccgcattctacaaaagctggagaaccccgtgatcttcaaggagttcaagatccaaaacatggtgggctcctgcgatgtccgctttcccatccggctggaaggcctggcgagctcccacagcgtcttctgctcagtgagtgggacagctagggtgggttgatcatgggtcatggacatcttgtcgcaataatcctgacagtggtctgaagatgcacaatcggattgttacctgtcaaagatccaaccctgcttggtggaattcgtcaaggtggaggccatgctaccgtcaactgctgatcgttgggccatgatcttgtggtcactgcaaaggtgccatgacttgcattcccatcctgctgctcacctaatagggatgccacctcacccccttcgccatcctcacttctaccccattcccccccaacacccctcgcagtacgagccagagctgttcccaggcctgatctaccggatggtggaccccaagatcgtcctgctcatctttgtttcgggcaaggttgtccttacgggggccaagcgaagggaggagatctaccaggcttttgagaacatctaccccgtgctcaaggagtttaagaagggaggcctgctggaaagcgtccccgcccccccggccctcccgcccccgcaaagcgcccccgctgacgaagcacagctcggggctcctgccccccagctctgatctcttgtgctgctgcggtaggtttatcgagggggtgtctgtgatgggcacagagaccctacagcccctcccctcctggggcgggtggctcgattaggagcatgcctccttccatcccaggcttgaggcatcccagtggacctgcaagcaatgcggcacccccaatgctcccactggagggcgtgtggattctggtcctggtccccaaatgcaaccagcacagcagcaggcagtgctcccctgccatggcccctctgtatcccccctcccatgctgcttctggtcccccaaaaggctacaacccactcggtgtctgaacctggctctccagtggggtatgcaaggacggcggaacagtctccctgggaacattctgggttatctggaaagcatgacatggccccggggcgggggagcggggagcgcggagcaaaagcagagggagtacacgggggtagaaggagcggcgtcaaaaggggacctcacgtcgctgtcagttgggaggggggatggcagcaatctaatcgtcaaaagtcatcttcttgttctggcccgtgcccgacgcgcccgcgtcgatggacatgcggggcttgaagtcgccccggcctccccggccgccgcggccgccgcgatcgccg

SEQ ID NO: 18220 - DNA, 78 bp, Chlorella protothecoides
tgatttggtgcggtccaccctgggccgccgatgttggcggtcacaaaatcccccatccatgaggcgctgcccaatgct

SEQ ID NO: 18221 - DNA, 88 bp, Chlorella protothecoides
tcaaattgctgatttagtttataattcgttcacattaggtatggaagatcatctattagaaatttttggtggtcatgatacaaaagaa

SEQ ID NO: 18222 - DNA, 122 bp, Chlorella protothecoides
aaattaaataataaattaaattttagttctattaaaaaaataagtttaaataataatattgaaaaaaatttattgtgtatttctattcaaaaattaaatcaaaataattttccttgcaattt

SEQ ID NO: 18223 - DNA, 64 bp, Chlorella protothecoides
atgaccatcctcaagtcctcacactcgtaaacgaacagattgaaaacccagagctgcagattat

SEQ ID NO: 18224 - DNA, 61 bp, Chlorella protothecoides
gaggaggcgggtcttcaccatggtgtccaggtcggaccacttggacaccagatactccagg

SEQ ID NO: 18225 - DNA, 6258 bp, Chlorella protothecoides
aagcccggtagcggcatatcttcggctcgctcgaagcatacgccgcatcccctggtcgtgtgacatcaatgacaccattcccagagcataaccaatctgcaaggtggaacactgccactgcaaatccggacagcccagagacagatctggggcatggaccgcccagcggccgaggggccccccgcctgcgcccctcgccaggtcctcatcagtgtctaccacggccgcgaccgcggcccctgccgccacgtccgcccctcccccgcccgccacgaccgccgccggcggccccctgcgccttggtctccgcccgctgccgcgcgaccttctccatgtactccctctcctcgtcgccggtgaggacccgcacaacggcctggtaccccgccaccatccgccgcccctcggcgtccacgtccttcacagcatgctgcgcctgttccggctcgccgaaccgggccacgccagaggtggcaccctgcggcggagcatgggtggagggggaaagcaggggttagggaacgcaaacatggggtgggcggcgggagaggtgctcttccaggcttgtgccccacaggatgagaaccctcaggccagtggcacggagcactgcagggtacgggccgctgttgcagccccggggccgcccctggcgcgccctgccagggtccgtccccctccgggtcaggctggtggcggggccctcgggagggggcgtggttttcctcccgttccgaactcactgcggcatagtcggcgtactttagccccgcgtccttgcccccaaagctgtccttcaccaggccaaagctgggctgctccacgaacccggggtcggggccgaagtcgaagcgcacgcagcagccgggggtgaagtcctcgacctccaccgcggcggcggcctcggcgggggctgccgccgcctcggcctcacgggggcgcttagtgccgctgggggcaggggccgccggctcggcagcggccgcaggggcctggtcggcggcctcggcgcgtgcgtcgcgctcctcctccctcctcgccacgtacctcagcttgggctccagctggagaggggcgccctggaagaccagcgactggcccgccacctgcgggagggcgagctcggtgcggggtggcggtgcgcgccagacacagaggtacggggaggggcatggcgcctgcgctgagaggtcagcctcggtcaattccctggcgcgcctcaggcccgtggcaaccctcaaccccgcatggatctagtctcccccgcggcacatctggacttccactccctgaccaccgcgcgaccttgcgccaacggcttgtggtaattttcaaagagctgcattcccccctcccctctcctcccttcctgcctcgcccgagcactgcccctgggtgtgctgctgcgtacccgagcggcctcctcggggctggagaactccaggaataccgagccgcggaagtccttgctggccaggaagcgccgcatgcggacgctcctgagctcgcccactctgctgaaaaactctgtatgatgacgggggcaagatggatggctgggaggagttggggggtggttgttgggcccaaccagggccgtcggacatctgcacgcccagagaatagccggtgatcatgcccagatatcttgttggggcattccatcggggcccctcgctcctgcctggtcctccacacggagaaccctgagccagcaggcaagcaccccacccgtgagctggtccagggtggtgtcgaaaggaaagggcgacgcatacagggactgctcgtcggtcttcttcgacagctcctcgacgggggggaggtcctgcgagccggaggggtgccaccgcatgggcatgcatgcacatgcggcagacggcgcgagacgatgcaccaccgagagccacgccagatgcagagttggcagtcgtgagccttgcccctgagcagccccggccctccaaccccagccgtcctccccagacgcccacctccacgcgcttgacggcagtggcatcctcgttcagcgccaggacgctggagcgcttgacgatgcccacgatgacgtccatgagggcgggcgggacctgcttgcaggccttgtccagcttgagcagggtcttcatgcgggagaacagggagatgacgcggagggggacgaagccctcggggtgggccttggactgttccagcatgaaagcatcgcggggcagattggagtcggagaaataaaactcgacctggggggttccattgagatgtggggtgggtgaagggagggtgggccagtccccgcgatggctctggcggtacccattcacacggcggtcattcctacctgctgcaaaatcttcgactcttcctctggagtgagggcaggggtcccagcctgattcgcctctgtggaggccatcctcgctggtggctgcggcgcgcagggggtggtcttggagggtcgatggacaaccccgttccttgtcgcggatatccactcaacagacttgaatgaggacgtttaagatgccaatcgaagcatgcagaacagcttcgtcactgttcgtggcggaacgtggcgaacttggtcatgctgggggtgctgcggcaaggacgttggcaccctgaactttgcatcttctctatgcctacacaagctctgcggcatactgcagtcataataataacactcgaccagctctcacagcaggacatctgatgttgcctttatagtgtccgtcatatgctctgtggcctcatgctggctcctagtacgcttcccagcgatatgagggagtgtgggtgtactgcagcacctcccgtgtcaaccaacaatgtgtaatcaatatgttaattccacgaaccgcgtatctcatgtacacctgggcggtgagactcgacaccctgacgggtgatgcagctcttacctcggagcataccctacatacacatccacgttgtaggttcttgtcccctgtacagataaaaacaacctgcttggagtgtaggtattaccaaaggcgacccaggtaccccctcgcgactctggtagaagtatatgcgtggaagtcgggagcagttgacgcatatctttctggcggtggctgcctccgagtccagaccgcgagtggtgggtcgcgtcgtacccaatacccccgaggtcccttccaccgcgctgcagccggatgagcgcgtcgtgagacgtgccagcccaggtgcgggcaagatacggggcgtcccgtgaggacgtttgcaactgacagagtttaaaagcaccacctccgtctcgaagtcaacgacgtacctcatccccaacggcagtacggcactgcgacggaacgccttctggtctcttggccactgcagatggcgccgtgtacacgcgccaggggttgagtgcgagcgcattccctgcgtcccactgccttggtgggctgccgcggccctcggcagccagaccccatgaacgacaccctgggcccgccgccccccgcacctggctacaaggtgggtcatgctgtcctaccgttacgcgtatctgctttcacgcacgccgagccgcgggggagcccatcagggttgtccgggaggtgcatgaccaccgatgttaacattcgccagccccccttcctcggccctccccagatcactctgggcacggacccggacaccaatgcctgccagaacagcaccagccccatctgcttcaacacagcagtcagtgggcagaacatcatcacgggactctggttcaatgccatcattggcatcgtcatgctgggcctgtttatcgcctggcgcgggaccttctccttctaccaggcccggctggtgagtgccctgctggtttggatttttgtgaatcggactggggagagctacccgcgtggcgccctcgctgggaatgggaggcccgggcgcctgcctgtggggcgggcggcccttgctgctttgttggggtgtttctgtgcggcacactcggaccccacacggcgccagagtttccacacccacagccgcacgcacgcgcactcctcttcacgccctcccacccccacgcatcaggactcgccccacgtcacgcgcaagccgccgcgcatgaagctgacagggcaccaccgcatctggtcctggctggtcccggtcttcaccatctcggacgaggagctcgtgcgcagcgctggcctggacgcgctggtgggtccctgggtggagggaacatgtggtgaggtgctgggggttggcgcagggggggcagggctggaattgcgagctgcatggtgcagccaggcgtggcaggaggcacacaatgcaggggaccctttggcccagtttctccctccaccctccccctccaacctcatcgcatgcaggtcgcgacgcgcatcatcggctttggcgtgacgctctttgcgcccatgaccgtcctggccgtggctgtcctgctgcccatcaactacggaggtgggctgtgtggccagactgaatgcaggcccgcaggactggtgggggggttgcgacggatgatggcccgtctcacgggcacccgcaatcgtgcaagggtgggggttccgaggagcctgcccgccccagcaacccctcactccaaagcctgccctgccttgcaccccccctcccatctccaaccctgccactatttccacctgcagagcgatactatgcgtcgcaggccaaggccgacgccgtcagcgacaccttcacctcggtcttcatccagctgaccatcagcaacgttcaccccaggagttccctgatgtggtaagcaatgggacgtagggaagttcaggacagggaaaaggtgggagggaaggtacctcgctaaagccacctctgctgccgttgctgcccctcgccctgccagtcaccacctccagtgtgccgtgagacgtatcccacccccctccgtatgcgcttccccgctccacagggtccacttcacccttgtctacgtgttctgcgcctggacctgctggctgacggtggagtactacaaggagtatatcgccatccgccaggcatacatggtccaggtgtggtcgggcgggtctcctgctgggtggtcgggctgccctctgggccgggcaggaggggggagcggcggacgtccgctggcctcgcgctcgggaaagatgtggcatccgcccagcgcctcttgcccaccccttccgctcccccagacccacacgaacacgcacgatcgcaggcgactgagatgcacgaggacgagccaggggcgtccgcttgccggaacgagagcgaggggacggagatatccctcacgccggcggcctggcccggcgcgaagcgcggggcgagcccagatccggagcccgtggcccgaggcttctccctgggctcggcgctgaccaaccgcctgcagctgccgaggtgagctggtggtgtgcatgcaaggccccgtgtgtttcagggggggcggaaagatggacccctgcatctgtgcaccgcgcacgatctcaggcagcttctgcgccgtcccgcctcgccacctccaaccaggcgcaccgccacgggcagccaactgagcagggcggccatgcccgcgccctcgcgttcgcgcctgggcctggccgacggcgcgtctgcctgccccgcccaggagctggagctggtggagggggccggccagcgcgcgggcggcgcgctggccgggatcaagagcccccgcgccctggcggacgccctgctggcggggtcggggcgcgtgcggcgagcgctggccccgccggcgcgcgcctggggcgaggacgaggaccgcgtgctgctgcacggcttccgcggcgccaccagctccgcgcagtcggagcccggtggagttggtgccgctgttggactgtctggcgttgaaggggcccgtggcgccgtggagggcgccggcgaagacggcggcgggggcatgggcccaggtccgcacgacggcgaaggggagctgtccctgcgccagcgcttcggcagcccccgagcgggtggcgcggggccgcgcgacggccaggcaatcgatggcgaccgcggggaggaggcgcacgccgatctcctcgcgattgatggcgggggcgctgcgctctccctcatcccagcgcgcatgccccgctccggctcggtcctgagcctgggcagcggctcggggcccggcacgccgctctgctcctcgcagcacacgtcgcggcgccctcgccatgcgcgctccggctcgcacgcggcggcggtggccgccgcgctggg

SEQ ID NO: 18226 - DNA, 103 bp, Chlorella protothecoides
aatgtattagatcctacaagttttacttggagtaataatattgtagcaattggtgggaaagtagcaatgatgccaattccattaggtacagctgattttttag

SEQ ID NO: 18227 - DNA, 67 bp, Chlorella protothecoides
gcagggtctccaaatttggcacatgtcaggacacagcacagaaaacccaccccatgcaccctctctt

SEQ ID NO: 18228 - DNA, 112 bp, Chlorella protothecoides
ttgggggaaccccggttttcgttttcgggctctttttcctccctcttgcccacgctcgtgacctgcatcagaagcatgatggatataaagacgaaccaagcttgttagaggc

SEQ ID NO: 18229 - DNA, 110 bp, Chlorella protothecoides
gtgtagggccgcatccgccggcgccggcgtggccgccgcgcccgtccgccctgggctccgcgagggagcctcgggtagccaggcacggccagcacgccggcctccggcag

SEQ ID NO: 18230 - DNA, 61 bp, Chlorella protothecoides
tgccagcttggactcaaagcatgtcagacaaatggcgaatgcctgcagggatattgattct

SEQ ID NO: 18231 - DNA, 73 bp, Chlorella protothecoides
ttatcgagacacctcataatgaccctgtggttgaaatacactacgataaaaacccatatgttgttattacgga

SEQ ID NO: 18232 - DNA, 79 bp, Chlorella protothecoides
cattccattggtctgtcgccacgcggcgataactgcaaaacaccaatgccttccacaagaccccttctctcacctccac

SEQ ID NO: 18233 - DNA, 69 bp, Chlorella protothecoides
gctgcagccacgcatggcgcccaccttgcggagcagggaatcgcagaaggatgccatggcttcggcgac

SEQ ID NO: 18234 - DNA, 65 bp, Chlorella protothecoides
gcccactgctcgagaggaacatgcaggcagtgggcagcatggaacaggcggccaagaatcaatgt

SEQ ID NO: 18235 - DNA, 61 bp, Chlorella protothecoides
cgtctcgcccggcaaggggcctgaggcgcacgaaggccagcgagtcgtcgtccactttgat

SEQ ID NO: 18236 - DNA, 6209 bp, Chlorella protothecoides
cgccgcgtgccgcgctgggcggcggcggctttcgggccgggcgcggcacgctgtgtgcgctgggccgcgccgacgccaccgtgcacgtgcacgtgctggaggcgggcggggcgacgaagcaggcgcgtggcgtaggggagccggcgtgcatgctgcggggccacgcggcggcggtggcggcggccgcctgggcctttgacgagtcgtgcctggcctcggccgacgtgggcggggacgtgctcgtctggcacgtgcaggcctgagcacagcaacgtttgggggcgactggaggaagaaggggagacctgctgtaccatttgcagaggggaggccgtgcactgcagaggatcgcatgtgcatgtttctgccggcccctggtcttgagaaagcagcggttagcctgctgagtgtgctgctgacctgatattgtgtcgatgtaacctggatgttgtctgccacagggagctgcatgcgtaaagctcagcgcgaggcgatcagcacgcgcagggcgctgcatgcccgtgtcacaggtctgcgccggctttcgcatcaggcacccgcccgccccgtgccgtgccgccggccgcccgcggcgccctcgtccgcccgcctcgcccgcttctgccgcccgggcttcggcgactgcgcgccggggtccagcacccgcagcaggcccgcggccacgagggcctgcagcacctgcagcacctcccctccctcggtgtgccccttgcacatggcttggatctcggccacgctgtgtgcctccgggtctttgcgcagcagcgccttggccagcacgccggcctgccgcagctcaaagtccagggcggtgccggcggtgccggcgccctcctgggcggcctcgccccgcgcatgcgtggcgcggtcgttgaacaggccgtgcacgaccctgatgaccccgggttcggggcgggtgaagcgcagggcccctggctgggcgacgggggacagcctggagccagggtgcagctttgtgtgaggcaccgaccctgtgcgtgtgttcgtgtgcgttgggggggtgggggtggatgggggagtattatggagagcgttcgccgacgctgcgcacggctcgcgaaacaaggattccccgccccgagggccgggagggtgggcgtgcggcactcggttgggtgcggtgctgttgccagggtgcggagcatggcccctgcaacaccgccgccactccttgcacagtcggcaacaggggcaacaggcctccctcctcgacgcagcagcgcaggaggatggcagcatgctccggcctgcccaaagcacggcctgtccgaaccccggcccagccaccacgaaccgggtctggggagtggcgggtactgcgggagccgctccgccatgaacccctcccactgctcctcggccgcaatgtggatgtgggcccacaccgcgtcggtgaagtgcttgaacatcctgcgcaggcggcgctccaggaggccgggcagctcccactcccctgcaaccggcagggacaagggggggcggcgcgcacgccgtgaggtggggctgcagtcctgcctgtcgaccccgccacggggggttccgggtcggggacgacagacagatggagtgcgggggggggggcaggacagagggcagggcccagtccacgcgggtggtcgagctggcacggcgccccggcacgccacccaccctggccccgcaccctggatgtgggatgcggcgcggtgggagtacgaggcggaggcataccattccaaggcggtgtggcagccgaggcggcggaagtccggacccatgggtcggcgcagggcgagggtgcgctgcgccgcctcctgcagcgcgcccggcagcgccgcctgcagcagggccgcccagctgcagccctggttggcgctgagggtgatgtgcagggagtgggtgtcgggcaggctgcgcccctcgtggatggtgccccggggcaggatgagcaggtcgccggggcccaggaccacctccatgcagggggcggggaggctggccctgtcaaagtcggcgcggttgtgcctgttgggcggggcaaagtgcacatgggggtggggctaggggagggtggtggggcaaatggggtctgcggcatcgcactaggcccccctcgagatcccccggcgcccctgcctctcgaaatgcagactcacggtacccatgcaggccccgcccgtctcacagtggcagcagattgttggggtcgacatagagggaccaccgtttccggccctccagctggagaatgaaggcgtcgatgtcgtcgtagtggggcgcaaagccctgagacccaggaggggtcaggtaggcattgctgcgtagagggaaggggtcccaaggggtggggggttgatgttccacgattgtgttgctgctcccctgatggacttctgtgctcgatgtgacacagcacatgcatccggaagatccccttcccgctcctcatctaaatacaacaaactccatctgccctcaccagcccacacagcagccaaaggcggtctccagccgggacatgagggcccagagtttatcgcagtgctgctgggggtgcaggatccgcaccgagcacccctccttctcaaaccgcttccacactcgacccagcttggccggcgtgcccggcgcggaccccggtcgggggccagggtcgttcatgttgtagctcatgcgcttgctgccgtcgtagcggaccacgtccacgttgtaggagtactggcattggccagaggccaggtaggcacgaatgtctggaaaggaggaaggagggcagagtcaagtccggggaggagtgcgaggagctcttgagcgccatggccagcatggcgccccctgggcagtcgcggggcagcctgccaagcatggctgtgcaagcctggggcagcaggctcccaaggtccctggggctcattgccgcatccctctccatccccacatgaccctccagctccctacctttgctgctgtacagatcagagtagtagtcaggcaaatttggccgttgaatgtgcaccgggtaaggcttactgagggcacgatgcacgtcatcctcgtcaaaggggtgcgccagccacttcacgcagtctttggggtctgtggcgctgcgccagtccccctgtgacaggcatgggcacagggagggattcaggcgggccaggcggacccccctgtcacagggtgcacacatgtggagggcaggtgctcatggtcggcgccgaaaggaggctcgtcgcccgacgtaataaccaccaaagccagagcgcacctcgaaggacgacctggcatctgcgcgcgctaatggctgggtcacgttgtggggcgggggcgggggacgccagactttcctgttcttgttgtgctgcactctttcataaaaagtacgatcgtggtcgtctgagaaatcagagcaatctccttctgtggactcctcaacaaaatcagcaccagaatcagaagaatgggcagcactcgctcccagaggggctggcagcatcgagtctgagcaggaggtcgagtacggagtctcctcagtgtcggagtctcctgagctacttggccaggcatctgatacgtcctgcaaaacgtagcggtggtcagaactacgttttaagattgcatacgcacgtagggtgacctctccaccacgagagccgcctctccaaattggctgtggccctttcctctcccacccacctgaggtatggcctgactggcccaagtaatagctcccgtcggttgtcgcaggctacctccaagttcactcgccactctgcctagtatgtccaggggcgagctgtcttcagacatcccgtacttgtctcggaggcaggcaaaggccttgcgcaaggcaggactcgtatccaggacggggtcctccatggcagccgttcaggctcgatccggttgagcgtgggtttcacggcatttatatcaggattggaaatgccatcgatgtcagcgctcgccattgattgcctcgtattcctgcgaaagcccgttgcatggcttacggagggcgcgagcgccccaggctcagatcgatgttgaaacatgcacgatatcccctcctggacgacagcagcacgttggcatatgtaaattcttgtctcaagaaactacttgcgcgatgctggaggttgcatgacatccctccacctcgtctgtgtgacctgcggaaggggtgtatcacccagcctctcccgtgtgacaccctcccgccctgccatcaggaggagcttcacccagaacaggcccagcagagctgcgccacgcgctgcagggagcgctgcaccccaccgcttcgacgcccctcgctaccgcaagcccccccccctcctcccctaccagctccagcaggccctgctccatggagatgcagcaggcacgctgaccctgctttccccctgcccgggccacgcctgggacgaggctgccgcctgggcgggggaccggggctccctccccgccctgcgctgcctcctcgaggcccgtgcccggtcggggctcgaccccggcgaccccaagtgggtcacccgtgtcgtcacatcgctgaggagggcgggcgcccccctggccgaggcctgggctgtcttctgcaccactcccaccccgacactgtacacctgcaacgccatcatcgccgcctgcgcccgagccagggactggccgagggcacatgaggtgaggatgccacgcttttgggatggttgtgggttgtttttggccattctcacccttttgaagagggtttggtaaggagtatcctggtgttccatgcacaattccacccgggagtcaccctgcaccgctcgatagttcactgggtccctgcggtgctgtccaaggctaccttttcatccaccctcttccaatatccccgctgacacgacgcccaactcacccagcccaccagccagcggcctactgctcacttatttccctccgccacaaacacactacaggtgctgcagggcatgcgcgtctggcacgtcgcacctgacgtcgtcaccttcaacagcctgctgcaggcggccggggccgggggctcactggcgggggtacgcgccacgctgggtgcgctgcgctccgccagcctggcgccgacgccgaccacctacgccgtgctgttcaccgcccttgccgcggccggtctgcgcgacgccgacgagctctgggccctgctgcgggcggcgggggagggcggactgcgccccacgccccacatggtctccgccttcctggcagcgctgcggcgcacggcgccgcgcgacgaccaggtggccgatgcggtggcgctggtggacgcgctgccatggcctggcgagaatgaggtcaccgcgctgctgagcctgctgcgtcaccgccccggcgctgcgccacggcacgtgccggccctctggcgcgccatccaggcggtgggtgtgctgggatgtgtgtgcatgccagagggagcagaggcgggggattgagtgaaagagggggaacgcgggtgcgtgcgctgcttcctggggacagcaatggcacctaccccgccgattaaaaagagtgcgggcagctggcgtgtggattgatgggcgcctgggagcttgggcaagattcaaccaacctgagaatccacccttgccctccaaacaacccctcagtcgccggagctacaaacgccccacgtcttctccagcctcttcgccgcctgtgcgcacgccggcgccggctccgggctggatgcgctggcgcaagaggcctacgagttgatgcgcggcctgtacctccgccgggcgcccacctcgggcaaggccagggaggccgcgctgctggccttcaacgccgccgcacacgcgctgtccatgggcggccgggcggaggccgcgcgggcggtggagggggacatgcttgccgtcggtgggtcacgtgaggggatgtggaagggtaggtcgtatggcatgcctgcgtctgatccccctcgtaagtcccctcccacatatcatcacccaccatcaggcgtgacccccgacgcggcgacgctgagcatcctggtgagctcgcacggcgcggcgggcgacggcgccggcgcagcggcggccttcgaccgccttgtcgctgctcatgccatcccgccgggcgccgccgcctttggttccctgctggcggcccaggcgcgcgccggcgacctggcccgcgcctcggcc

SEQ ID NO: 18237 - DNA, 61 bp, Chlorella protothecoides
taggggttggcgtcctgcgcattgaggctggcagatcctcggtggcggcggcatacgcact

SEQ ID NO: 18238 - DNA, 61 bp, Chlorella protothecoides
accctgcctttctgtacagcctcctggaggacctttcgatgacttcagctacactgatggc

SEQ ID NO: 18239 - DNA, 72 bp, Chlorella protothecoides
ccaagttatacttgcaaaattaatgataatatttcggttttaaaaaattctcaacaattagtaaaaaattat

SEQ ID NO: 18240 - DNA, 263 bp, Chlorella protothecoides
ttttttatttgtcaataatattgctaaattaaatattttttgcgattacccggacttgaaccgggatgggtgtttacccacaaacccctcaagcttgcatgtctaccaatttcatcataatcgcaaaaagacggaaagagagggattcgaaccctcggtgatataaaagcatcacatagatgttccagatctataccttcaaccactcagacatctttccgcatttaatgatcttatatctttatgcttagcaccttaagcat

SEQ ID NO: 18241 - DNA, 735 bp, Chlorella protothecoides
cagaacggaaaacatccttcatagaaatttcacgcggcggcaagttgccatacaaaacagggtcgccagcaatatcggtataagtcaaagcacctttagcgttaaggtactgaatctctttagtcgcagtaggcggaaaacgaacaagcgcaagagtaaacatagtgccatgctcaggaacaaagaaacgcggcacagaatgtttataggtctgttgaacacgaccagaaaactggcctaacgacgtttggtcagttccatcaacatcatagccagatgcccagagattagagcgcatgacaagtaaaggacggttgtcagcgtcataagaggttttacctccaaatgaagaaataacatcatggtaacgctgcatgaagtaatcacgttcttggtcagtatgcaaattagcataagcagcttgcagacccataatgtcaatagatgtggtagaagtcgtcatttggcgagaaagctcagtctcaggaggaagcggagcagtccaaatgtttttgagatggcagcaacggaaaccataacgagcatcatcttgattaagctcattagggttagcctcggtacggtcaggcatccacggcgctttaaaatagttgttatagatattcaaataaccctgaaacaaatgcttagggattttattggtatcagggttaatcgtgccaagaaaagcggcatggtcaatataaccagtagtgttaacagtcgggagaggag

SEQ ID NO: 18242 - DNA, 62 bp, Chlorella protothecoides
taggacgacttggagaagctgaagagctccctcggtaacgcgatcctggaggagaaacccaa

SEQ ID NO: 18243 - DNA, 131 bp, Chlorella protothecoides
tttgacgagtgaaaaggtctccagggagggtgataccatatcgttgaggtgcttgcagccccgagacctactgccaagaatgtatgtgatcaattgcatacatcaccgttgccccacaccattgccaactc

SEQ ID NO: 18244 - DNA, 124 bp, Chlorella protothecoides
aataaaacttacggatgccctatttatttaccaatattactcaaatctaatagtcaatctaaagctatttttgaatggatctatttagggtttttaccgtttatgacaaaacctgggcattttt

SEQ ID NO: 18245 - DNA, 69 bp, Chlorella protothecoides
gtaaaatttccgaatgaccgatagtattaaaaatagtatgaatatcaatacctaaagcttgtaaaaata

SEQ ID NO: 18246 - DNA, 78 bp, Chlorella protothecoides
aaagtcgagtgaaggtcttgcagccagcctaatcgttaagctttgaggggctcagcaagatgaaagccttctgttggg

SEQ ID NO: 18247 - DNA, 69 bp, Chlorella protothecoides
atttgggaataataaattatatggtgtgtacttatttattattcaataatacggcaaatacacaccata

SEQ ID NO: 18248 - DNA, 65 bp, Chlorella protothecoides
acaaaaattaattggtagtttaaatagataaatggaatacttcataaaattgattctatctgttt

SEQ ID NO: 18249 - DNA, 71 bp, Chlorella protothecoides
cagggctttaaccttctatggcgtgttatttcaaattacttggatttgctacaacaatatagattacatgt

SEQ ID NO: 18250 - DNA, 77 bp, Chlorella protothecoides
cgctgagaaacttcacttgcctcacgggtgaggctggagcggtgatattgtctttgtggggctggaggatgggcagg

SEQ ID NO: 18251 - DNA, 94 bp, Chlorella protothecoides
tttttttgtttgtctaaattgtataaaataaattacaataaatttgatttattttactttgtacacaaagcacttgttcaaaaaaataaaagta

SEQ ID NO: 18252 - DNA, 120 bp, Chlorella protothecoides
aaggttgccctcgagagggtgcgtggtggtcagcatgcagggcgcgaccctgcacgcatcatggggttcctggcgcgctgcttgcggtgcagaactgggtgaaggcgataaactctgtct

SEQ ID NO: 18253 - DNA, 79 bp, Chlorella protothecoides
agaactgggtgaaggcgataaactctgtctcctggcatccttgcccatggcagagcatccagtggctgcggcatggctg

SEQ ID NO: 18254 - DNA, 8312 bp, Chlorella protothecoides
ggggggggcatgggaggtgggcgagcaacggcttggtgtgcttcgtgccgcaacagccaccccagccgctttacacacacacacctccccaccaaatacacttgatcagcatcccaacccacctcccgggccactcgcagtgccgcgctggcggccgccgccatgggcaccggcatggcggtggagaagacctggccccgggccttggccaccagcagggccttccaggcgcgggagcaggccaggaagccgccggagcagcccacggccttggacagggtgcccaggtggaggtccacgctgccctccacgcccgccgcctccgccgcgccggcccccctgtgcgtacaggaaagggagagggggttggctgggctttgggtggatgagacggagagaagggggggtagcgttcagggggcaggttagcaccgcccggcgggatctaccacgggcgctggagtcacgactccagcgcccgccccacacgagacgcacatgacaaccccgacaccccgccccccatctgcgcacctgtcgccgcagaccagggtggcgtgcgcctcgtccaccgccaacaggaagccgtgggcccgcctcagctcggcgaggcgggccaggggcgcgtagtcgccgtccatggagaacaaggtgtccgtcaccaccaggcggcgggacgctgcaaaaggaggggttgcttagtctcggttgggctggttgttggcagggcatcggctgaccacctccctcctgcaacacggctcagggcccggcgcaggaacccgtgggacgtccctccacaccccctgagcaacccggtaccagcaggcacgccctgccccccacccccgccacggacccctgcgcactgggcttggcggggctggcctgcagcaggctctccaggtgcgccatgtcattgtggcggtagacctgcacccgcgcgccggcggccttggcgaggcgtaggccgtccaccagcgaggcgtggttgagctcgtcggagaagacctccacctcggggctgcccgccacggccgccatcaccgagcagttggccgcgaagccggaggggaagagcaggcactcctccgtgcctggagggggaagggggttggggggaccagctgttttgttcgcgactcccacacgagggtcgtcgccgaggcactactgttcccctgcctctccctgacctgccagcgtcgccaggtcagactcgagctcgcggtggtgcgtcgtgtaaccccccaccagcgccgaggagcggggcccgctgcccacggccagggctgcggaggccgcggcggcgcacacctgggggtgggtcgaaagccccaggtagtcgttcaggctgaacagccgcaccgtgcgaccgggaccggtgcccaccgtctgggcctgcgcaggaggaggggggaaaggctcgtatgtggtttcagtggccgacctcagtggccaagggcacggcggcaattgggccctgggtgctgaccatgctcaaggtcaagcacaccgcccaccccacactgcggcaaccggccggcacagcacagtgcacctgcgcggcatggttcccggcaactgtcgcgcgaagctccctcgaaagtctcgtgactcgcaggctctcgagcgtttggtccaggtaggcctcccagcggctggtcatgtcggagggcacgccaaagtgcccccaccgggcaggattccttcccgcgtgacgcgcccctcgaagctaggtatacctactcagactttcaacataatcagcatatgcaatgtgctgagtaatgcaccgccgactgcatccgacatgcaggatgctggcaagcggcagggcgcgacaagggtttagacgggatcttgatgggttttgtcgggaagaagttgtgcgacacgcaaggccaaagctgatatgcgcttgaaagtttcgcagtgccctggccagtaaactgacaccgtgtgatcgtccactcgactgtggtgtctacctgagcaaggtgccccaaagtaggacaatggagctcagttcagtgagaatgttgctcagttcttctctccacttgagaagcttcatactgctcacacaaaacattgcagcgcatttgccacaatcagcatcttgtaatggaacgtcgggagctcaggacccctttcgcggtggtcatactgcgctgttggcaatcgcccttcacaccttgtacaacagctgatcggaagtcttcagtgtttcatgagaaaggacaagtgcacgccttcgcagatgaaggcttgcatggccagccagcccgtgattttctgtccggatcctgctgatcccggcgcgtcaaatgttcaccggctccataagctctacctgcatgtgaccgccatgcgtcacagttcggaatctgagttcaacattcttgtccacactcatccctacctgatgcccagcatcaactgctgaggctgcgaccgtcgacctatgccctgcaaccgttgcgtcaaggggtgcgtggggcagtgtgcggggcttgtgggatcgagcatacctcttgccaccaggtgctacgcgtgcatacgtgggtgtcacacgacattataccgactttctcgagcttgtttcccctcttgccgccccccttggcaggtgctggatccttggcgccctcactctggcatgccgcctcagcggcgccggtgctgagcacattcctctgccccccgatccctccctgggaaaggtggacaagaactcccttccaatatccctggaatggtttggcaataattgctcccgcccctacctggtcatcggggtggttggggacgactcccagcaccctcacacgtgagcagggggaccgagggggcagcggttcaggtcacacagatgtgcccctgagagtgtctggttgggatgcatacacctcaggggatgtcatgccttcctgtctgcccagactggagtgatcaattgggcttctgatcgataccagctcgccactccatctcctttgctgaggctcaacttatcgattgagtgcagactcaaccgccccccacatcacacacctccacagatggctggacaacgccccgcaccgctcctttgacctgctgctcatgtactatggccaggacccggacttccagtgcgagcactgtgtggccgtgtaccgccgctccggcgccaagtggcagctgctcaggaagctgagcgagtccccggtgtggccccgtgtgcggcaggcctacaagttcgtcatgatccccgacgacgacgtcctgatgtccacccatggtgcggggtccctgcgccgtcctgtggtccagctatgctgggtaaaggggggttgcgtctgcgttaagccaagccatgcagtgtcgaagctgttggctgtcgcctcgggcagcacgaccccgtctgcaacagccaacagatcctcgcctcctcaccggccatcatccccctcttccccccaccatctgaactggtctatcgtatgcagtgatcaatgtggcattccatgtggcacaccgcttctcgctgtccatggcccagccatctgtctgccggcacaaggactcctacagctactggcacaacgtctaccagaacacttccaacgccctacgctacacggcctttgtggaaaacatggcccccatgttctccatggacaccctggagcggcatgtgctgccaactctagagaatgccagcatcggctggggtgcgcccgcattggggctgtgatggggggccatgggtggggtttatgcggaaacggcagcgaccccagggtcacggccagaggagggggcggtggggatattggttgccatgtagatggtctgcacaatcaccagctggcagccgcaacgtgccttacacatctatcctcctccctactactacaggcatcgacttcctctggcccctgctcctagagtccccccgccgcggcatcggtatcgtggacgcggtgtgcatgtcgcaccctgccaaccagtcgtccagcgggctgtacaatgtcacacacgagaagggctggtgaggcgcatgagggttcttgtggtgtcgcaggacatggatgttgcgtccggccagggggcagaccccaacacatctgtgtttaaaaccctgcgagccctcctgacgacgtcgcctgcaatgcccctcccctccctgcaggactgctggggaggagtactccttctttcgagacaactggaacatcaatcagacgacatgggattcctttggtgtgtgccaggtttccccgcacaatgctcctgagttttcaagcgcacaggatgctgggctggcacacaggcccaaacatcctgcgtttaggatttggagtagcgctatgtcctttgagagtcaggatctgtgccgtctgtcactggtgctctgtgctccccacacatccaccctccctgctgcacaccacgtccctgcaggtctcaaggagtaccctaccagcatcgtgtttcatgcggaaccgctgccagaagggggctatgagctgaagctgccggcgttctgtcccaagaccttctccctacctgctgtcatcccctgtcggacggtgttccggatctggagcctggttccgtggaccatgttgggggcgctcttgctctacgtggtagtcttgaggatgaagagctggaaggcacggcgctggccgctgactgcgacgcctaggaggaagctttcgggacaccggagcctgccgaccaaggaggtatacctgcagctgtccccctaagcatacctatgtaaactacctgtcgtatgtcacaccgaataaatccgtccctctcactctgcccgtatgaggttggttttctccagagaaccatatatgtaggatatcgaatctcggcgcctcctggtaaagctgtcagactaggggtttcgccacgttctcggcagctacccttccgatcaaccgattgctgacgacggacaacgcaagcagggaccagcttcttcgagcgccccaatcgcaacgcacatgcaggggcgacgctaaatcctggagacttgcgtgcgctgaatactgccagcatggatggacatgggattcagaggtagctctccagtaccggacgcgccgtgcgcaatatgtggccggctaggtgcctgccggctcgacgctccttcctcagcacctcctgagccgccctggactccacatctagtaccgtggttctgattgttctaatcctccaaccgttgccaccctgcgactcacggtagagaaggccttaatgaaggccttgggtcttgccctggtggtgttcttcatgggcaaccacccctgccagggtagagtcctacatccttccccacctcctgaggccaacaacagctggaatgtagcacctagtccgccatctcaaggtctggaatacatcggcagcccatgctttcgaccgtatctgctcatcgcagcggtgggggacaactcggccctcggttctcctgcgtgagtctcttggtgggcctagtggggaacagcgccagcttgcaagcgtgtgagcggatgtggagtatcaaaaacctgtaaagtggagttgcatgaagcatggaatcggtgcatcttgcgttcctccgtcaagtgtcccttgtgttaattcatgtgacctggctctcatgcttcacctgtctgcctcctttccagatggttggacgacagtccaggccgatcgtttgacatgctggccatgtactacggcaatgacacggcgttctcctgcccctcatgtgtcggcacgtttcggcaccctggtgccaagtggaagctgctgcacctcctggcctcacggccagaatgggatcgagtcatgcagccctaccaagcattcatggtcacagacgacgatctgctgatggcaccccatggtgcggaggcaaaggctgggtgaggtgtttggggcagaggtgctcgtggtggattttagctttgtgattgatggccaaggactgctcacatacaatgatggtcccccgcgtcgatgcctacagtggccatctcttatctgcctgaagggtgcagcgctgaatgcctgccatcctgtacaagtttcctctcttgtctacaatcttctccttcatccccatgcccagacttggacatcgggtttgacgttttctcccggcactccctggatctgggccagctgtcagtttgtccctctccagattcctacacctggtgggagttgatgtaccaaaactcctccaacaccctgcgctacacggccttcgtggagaacatggcccccatgttctccaagagcatgctcacgaagcatgtgctccctcacctggaggacgccagcatcggctggggtgagctgcttggtgacaggctggaaaagagggagggatgatgggcaaaggtgtttgccaaaggagaatggcatgggacgcagaggaaccacggtgctgagctccacctggatgtgttcctgccgtgtttgattttctcgttggccagagcattgactgtgaaagtaaggagccatgggtatactggcgccctctagttgccggccaggtggccaatgcagtggtgctctgtagtctgttgccatgcctcttaccctgccccaaattgccctgtgtctcccacttcaggcctggacttcttgtggccctttctgctgcgctatgcccgcgagtctgtgggggtcgtggacgccgtgtgcatgacacacccgtccacaaagccagagtctgggagcagcatttacgccaccacacacgaaaagggttggtgagcgccaggggcggtcgtgcaaatggatgatgcccaaggcaatggatgctgggagtgcaggcacttgaaagactgctcaaccccagctccatgatgtcctgcatgcccctgaaagggcctgcccagccgcccaccctggctttctgacgctgctctgcctctttgcccacaggacgccgcgccaagagagagacaagctgatgaagcattggaagatcaacaccgcagcctatcgccgtcacggtgagtgcatactaagagacgtgcggagggaggtgccttgttgtgtacaggtatcactgggggtggcaggggaaccaggctgaaaggcattcctctgcctttgccagttcccttgtggcacccatcctgacacccctcccctcttctcccacccccatcaatttatacctcaggactgaagctggcgccaatgcagacgcaatttgccgcggtacccttgccgccggcaggttacgtgctgccaccttcttcgtactgcccaaccccaatcgccccctggcgtcctgaggcgggggtggagtcgctggcaagcgcgcgatgggtgaggaacgggattcgagtggtcttcctctgctctgtggcaagttgttccgccgcatggtattgcaggaggtgctgcagaaccaagcgagcctccatcgcccctccttgacttccatgcgattggaaaaacccaatctcatccaaactgtttgcattgatggcaagcgcatgctgtacaaataataaactcgtgttgatcatctgggtcttcttgggtgacagcacaaagcgcgcgccactcaagatcgatgtgaatgccctgatgctgcggtatattcaggtgtctcgcggagggtcgcgtggaacccatcaacattactatctttggtggcggaatggtcgggtgtcggtggatgagggacccattcctttgccccgaggcctgagtcctctacccgaaccggaggtctccctcgacgagcttgccacatcgatgccatgcgcagcctctccatccccttgacccgatgctcccgtcttttcacacgccgcttcctttcctcggagagggatgacggccacatctccttgggcttccccacgctgtgcatctggggtgcaaacacgggcgtggggaagacactcgtcagcgccgggctggccgcggcggtgacgcgcgcagaggtccgtttgggtaggcgcggggcgtttcgcatgtttgtagctcgccgcagcagggaaccaggcgccaatttgcactgggaaaggcatatgctgcaggggtgtcagtgcctggcactggacacccgcctcgtggcctcccacacccaggcccacgccctcgaccggcccaccattcccacccggtcaatacccacccacccaaccctaccacagggaagcctgctgtacctcaagcccctgcagaccggcttccccaccgactccgatgcgcgcacggtggccgcggcgtgcggaggcgcgacggcggtgggcccccacgccgcgcgcctgctccccccc

SEQ ID NO: 18255 - DNA, 276 bp, Chlorella protothecoides
caaaattcatatttttttagttataatttaatttttatttattataaattatttaaaataaaaaagcaagacctaataatatattaaatattaattaataatattttaaataattatatactaaaacatgtaatcaactattaatattgtttgttaaaataaaattgatctgtattattatttacaaatttacttttaaggatattataattatgaaattagctgtttatggtaaaggtggtattggaaaatcaacaactagctgtaatatttcaa

SEQ ID NO: 18256 - DNA, 100 bp, Chlorella protothecoides
cccaccacgggtccagcacccaacccccagatgatctcccggaggagagggcatctttccgttttcagtgctacgagtgcgagaggtgaacgacggaggg

SEQ ID NO: 18257 - DNA, 81 bp, Chlorella protothecoides
aaatttatttaaaattattaaatcacgctttgtaggacttgaacccacggcatcaggttttggaaacctgcgttctaccaa

SEQ ID NO: 18258 - DNA, 63 bp, Chlorella protothecoides
gggaagcggaagcaatgggagcgtccttttttggtctgatgccccgccacaagccaggaactg

SEQ ID NO: 18259 - DNA, 90 bp, Chlorella protothecoides
cagctactgctaattcaccagcaacattacaatatttagctccttatactggcgcagctttagctgagttctttatgtataatggacagc

SEQ ID NO: 18260 - DNA, 83 bp, Chlorella protothecoides
aatagtctattttattgaacgacgagtttctttttcaagaatcaaaaatagaatattaagacaagcaagtatgcaaccattta

SEQ ID NO: 18261 - DNA, 67 bp, Chlorella protothecoides
gctggtctcctgcctgtgcgaggtggtgcaaggggttcccgcggcggccaaccacctgtggggcctg

SEQ ID NO: 18262 - DNA, 195 bp, Chlorella protothecoides
aaaacccttctcgttgctacagcagctatggatctaaccccagagcaactaaaagcgtataaagaacgtcaaaaagaacgccaaaaagagcaacaaaagggtggtgatcaggatgatcttagtttaattaatcaattagacactaaattttatgtagatcttgatccggaggatcctgaaccagaagttcaacct

SEQ ID NO: 18263 - DNA, 148 bp, Chlorella protothecoides
taaataataatttaaagaaacattaagtattggggctgaaccgtctgttttggatataaatggctttgtatcatcaattttagatataacacgtatatcattattttcatttacaagtatagcaggacctctataatcatcttctaaa

SEQ ID NO: 18264 - DNA, 75 bp, Chlorella protothecoides
atttttaaatgatttcattttttatatttagaataaatagttataatttaaattttgataaattactagatttta

SEQ ID NO: 18265 - DNA, 347 bp, Chlorella protothecoides
ggagggctgggcttgagggcttggtgaggacatgccgcttctttggagatttcatacatctgtgtgctaccatgcccgatacgtaccttgctgagcaagttcatccctttgcaggcacatgacgggacgttgattcttcacccgcgtccaaaaggggaactctctgcgtctgattccgatgatgagggttttttaccccagtcagacagcttgacaaagtgaaagtcgatcccgagatggaagccaggtgcgtgactgagagcatgcgttggcaaagtacaccgctctaaacgctgaccatgggcggtgatcattgccagagcaggtgccaaataccttcctactat

SEQ ID NO: 18266 - DNA, 15593 bp, Chlorella protothecoides
  modified_base (205)..(214): a, c, t, g, unknown or other
  modified_base (651)..(660): a, c, t, g, unknown or other
  modified_base (1157)..(1166): a, c, t, g, unknown or other
  modified_base (1569)..(1578): a, c, t, g, unknown or other
  modified_base (1670)..(1679): a, c, t, g, unknown or other
  modified_base (1817)..(1826): a, c, t, g, unknown or other
  modified_base (2746)..(2755): a, c, t, g, unknown or other
  modified_base (3046)..(3055): a, c, t, g, unknown or other
  modified_base (3386)..(3395): a, c, t, g, unknown or other
  modified_base (3505)..(3514): a, c, t, g, unknown or other
  modified_base (3598)..(3607): a, c, t, g, unknown or other
  modified_base (4244)..(4253): a, c, t, g, unknown or other
  modified_base (4433)..(4442): a, c, t, g, unknown or other
  modified_base (4615)..(4624): a, c, t, g, unknown or other
  modified_base (4766)..(4775): a, c, t, g, unknown or other
  modified_base (5754)..(5763): a, c, t, g, unknown or other
  modified_base (6313)..(6322): a, c, t, g, unknown or other
  modified_base (7583)..(7592): a, c, t, g, unknown or other
  modified_base (8629)..(8857): a, c, t, g, unknown or other
  modified_base (8933)..(8942): a, c, t, g, unknown or other
  modified_base (9320)..(9561): a, c, t, g, unknown or other
  modified_base (10084)..(10093): a, c, t, g, unknown or other
  modified_base (12155)..(12164): a, c, t, g, unknown or other
  modified_base (12404)..(12459): a, c, t, g, unknown or other
  modified_base (13146)..(13155): a, c, t, g, unknown or other
  modified_base (13218)..(13227): a, c, t, g, unknown or other
  modified_base (13355)..(13364): a, c, t, g, unknown or other
  modified_base (13806)..(13815): a, c, t, g, unknown or other
  modified_base (14080)..(14089): a, c, t, g, unknown or other
  modified_base (14725)..(14734): a, c, t, g, unknown or other
  modified_base (15322)..(15331): a, c, t, g, unknown or other
  modified_base (15386)..(15518): a, c, t, g, unknown or other
ggcggtgatggtaaaggagggctgggggccaggctggggaacggtggggacgctggtgacgttgccaacttcggtgacggcgaggaaagggtgggaagcggcactggtggcatggctgacgcttcaggatcaaggtgtggaccggataccggtgacggcagcaagatcgatggcaatggtgcacttgcaccctgatggggagatnnnnnnnnnncgacggcgaggaaagggtgggaaacggtagtggtggcatggctgacgcttcaggatcaagatgtggactggataccggtgacggcagtaagatcgatgggaatggtgcacttgcaccctgatggggagatgctggtgtgggtccaagcgcaagtcccgggcttgccagtggggcacgtgggtgcagcggtgatacgtggggtgccagggaaggtgtcggtactgggcctgcagctgatggtccgtctgcgccttcaagctggcctgaagaccccggtgcagggccgggagtcgagaggggcggagcaaggttggcggggaggggtccacgccccggcggccggtgtgctggcacgggatgcgccttgggactgggcgccgacggggtcagcactggcgagcctcgtatgggcatggggctgggctggggtgtgggannnnnnnnnnaccgacggggcctgcactggcgagcctcgcatgggcatggggctgggctggggtgtgggatgccggggcaaagggttccttggtgagtgtagagggcggggtggaggagcagctgggccaccggggtcggtggggtcggccggctgcggggagggcggttgggcgcctgccggtgcaagggagggccccgacccgcaccctgcggcgtcggccagacagggcgccggacctctgaccccggttgggcctcctgctgcggcgggccctgagccggggttcggggcccgaggactctgagcaggcgattcccgcacggagactggctctggggccggggcgggggagccagccgggctgggctgcggcgatgcgtgggggctccctggccgaggccccggactggaggggggtggacgaggaagagcgcctgcagggattgagaggaaaggcttgctgggagatgttcgggcgtgcatgggcgccgccaggaccttggnnnnnnnnnntggctgcggcgattcgtggggcctcgctggccgaggccccggactggaagggggtgggcgaggaagagcgcctgcagggattgtggggagaggcttgctgggagatgtttgggcgtgcatgggcgccgccaggaccttggacgtctggaaaaaggtatcatcactgccaggcgcctcaccagaaggggttgggccagatcctggcaagggcctgcccggggaccctggcttgagggggcgcggggacgtcgcctgcgctggcgagggcgcacgcaaagggctggctggaggtcggccgcgacccggcggcgaaggagcaggggaacgccagaaggcggggccggcagcccccgccggtgactgggcaggggccgtgcgggctggttgcgcgggcgcaggagcnnnnnnnnnngaggagcaggggaacgcctgaaggcggggccggcggcctgcgccggtgactgggcaggggacgtgcgggctggttgcgcgggcgcaggagcnnnnnnnnnnttgagctcgtgggctgtcctggccggcggattgcaggcggaattggaggctgggccaccttccggctgcgctccgaattgagcgctggccccggggccggctggactttgcgtgatgggccgggctgcttcccggcgnnnnnnnnnnctgagctcatgggctgtcctggccggcggatcgcaagcgggatcggggactgggccacctcccggctgcgctccggatcgggcgctggccccggggccggctggacgttgcgtgatgggccgggctgcttcccggcggtgggactggggccctgtgcgccaagcggcggctcagcaaggacaagcggggcatgcgactgccagcctggcgtgccggactggcaccccggccacgccacatgctggatctggaaagggtgctcggcgcggacaccctttgtgccatcgacagaggatgctgcgcccagactggccgccaggcaggccgtccagcgctgcaaagagggagtggtccctccccagcctgccagcactgcatgcaccgcaccgtcctcctcctctgccagcagtcgggtagtgaccaggtgagggggtgcagggcagccggtcctccggatgacctcctctgcccaggcagcagggtcggggccggagtcctcccacccttccactcccgtgccattgccactgggcgcgtgcagggtcaggaaggaggtggcacacccccaggccgacgcggggatggggaatgtggaggccaggaggtcggcgtgggcgccggtgggaaggatgtcgacggtgctgacttggaggatggtccagagatcgttcacgcgaccgctggcgccggtagctgcgatctcgacgcgcgaaccggagccgggcgtcgccttgatgtggatccgaagacctgcgaagcataatggtgtggaagtgatatggcgcttgtggtcttacatcccgtcaaatctcatacgcggtcgtgatagcggaatgctcgaaggcgccgacgtctcctcatctctgaaggcttcatccgggtacctggaactccatctcgaatggcctccgcaatgtccnnnnnnnnnnggccgacgtctcctcatctctgaaaggttcacccgggtacctggcactccatctcgaatggcctccgcaatgtccttggcattatgtcttgtcggatcaagactgagcgtgaaagtcaaagctgactcctgcccggagctgcagcgtgatggggaagttggctgtttggcagagactcgatcttggtgcgagggggaaacatgcacgtgggcgacggccagccggaggtgcttgatctcggtgagtaaaggtccaccgacagattgcttgcgtacctgtctgcaagctgannnnnnnnnnttcaaagctgactcctgcccagagctgtagcatgatggggaagttggctgtttggcaaggactcgatcttggtgcaagggggaaacatgcacgtgggtgacggccagccggaggtgctcgaactcgtttagtaaaggtccacctatagattgcttgcgtacctgtctgcaagctgatggccatccgactatcattggaatggtagatagaagggagcaggctgtgagtgctctgcaagtagtccggaacaaatgcgatcaacgacatatccaataactccgacttaccgctgccgatccatgcgctttcgactgaagaaggaggacggtgnnnnnnnnnncgtgagtgctctgcaagtagttcggaacatatgcgatcaacggcatatccgataactccgacttaccgctgccaatccgtgcgctttcgactgaagaaggaggacggtgnnnnnnnnnngcgcgggccagcaatacctaaacctcgtatcgatacggcaaaatcttgcgaatagcaagcaatatcctacttgaaactatgtannnnnnnnnngagataattataaagtaggtaggtgctccacgtcgtacctttaccacagggtctccttgcctcagggtcagagttgacttctgatgcaccatgcaataccgatccaaggcgtccgcgggccagcaatagctaaaactcgtatcgatacggcaaaatcaggcgaacagcaagcaatatcctacttgaaactatgtagaatatcggtttaacgatctttcagtgccagatcgtgatgattgagaatgtcgagtgtggacccggaaagttatgaggattcatgaggacgggagatcggatacgcgaccctgtaatactggatgcgcgaggtttagtcacgatgcatttatctttatgaaagcaatgagattcagtggacactgaaggataggaaagtattcgcaaggagtcgagatgcgctccggtttacgatcggtcaattcatctgaacgttatgccgaacgtgcctcaactggggggggtaccctgccaagaaataacggtgacaggctcgaaatcggcaacctgcttatgcgcttgcccatgagcctgatctataaaacgtcacgatcgtaccagtgacagatgatgaagggttctactgaactcaaatatagcaatgcagaggtggccacaagcnnnnnnnnnnatctgatctatagaatgtcacgatcgtaccagtgacagataatgaagggttttactgaactaaaatatagcaatgcagaggtggccacaagcagttgctcacaaagccaaagcactgtcacaaggaaaccagatgcaccgacgcagaggcaaggcagcccagggggagggtgttggagtnnnnnnnnnngtgtcacacggaaattagatgcaccaacacagagccaaggcagcccagggggagggtgttggagtgcggcatgatccatatctccttgcacagtgacgatgggtcctatcctgcagcacccccccgcagtctgacccaggtctcccccagtgcctccagatcgatgcatgccnnnnnnnnnnagaatttcattactttcataaagatgaatgcatcgtgactaaacctcgcgcatccagtatcacagggtcgcgtatccgatctcccgttcccatgaatcctcattgctttctgggtccacactcgacattctcaatcatcacnnnnnnnnnnctccatatttcctcgcacagtgacgatgggtgctatcctgcagcactcccccgcagtctgatccaggtgtcccccagtgcctccagatcgatgcatgcctcacgcctctggaagtatatggcgcaggcaccgttctcgcagagaaagggctgcgtcagcgtggcagagtcgcaggcccgacatatgctgcctgcccgggcccggagggcctctgcctccgcctgcctggcagtggtctccaggaccactcttgcagcgatacctggatccctgcgacggccaaggtagggggcagctgtgaggcgcacttgctgcggtggaaggcaagcaatgatccaagaatgtgttttggggaagggagagcctgaatttttcattgcaggccagtgcagggcagatgccgcaaatactactctgcatcgctgcaggcccctgcatgcatggacatgcggatgagttgcccccgcttgcctcgaacagatctcgcacagtgcaggcgccgtcccagaggtctggggcagcgtccgcttgcagcccatgcacttggctgtcgcggcgtagaaggcggtcatgcccacctggcggccacctgagaacgaggaaggggtgagcgttaatcagacagactccagggcgcaggaaggagtgtccgcatgacgctaccccccactccctcatactcaccccttgcacccgctgccgcaccctgcctccggcccttggcccggggcgacggggttgggggggacagcgatgcgccacccggcttggctactctggagcccacctcctccaccctcacccgggtgtgagcgccctgcatcagcgcctgcaaaaggcgagggttagggaggcggtgggtgggtcggagcctcggtggaggcccccttgggctccgccacacatgcacacacgtgcagacagccccgcaccccagcaatccatgcgactccgctgccatgtggatcctggcactccnnnnnnnnnnagaggtggtgggtgggtcggagcctcggtggacccccccttgggcttcaccacacatgcacacacgtgcagtaagccccgcaccccagcaatccatgcaactccgctgccatgtggatcctggcactcccaggccttgctgccccccgctgccccacccatcgcgtcaaacccctcaccccaaacccttcaccccaaccccacaaacacacctggactcgcgccggcggcatgcaatgccccagcatctcgctcagcggacgcaccagcttgttgttccagtagagcaggtagtctgcgcgcgcgccagaccgcgcggccatcaccggatcctccgccgcgtcgtcctgcttcggggcccccgccagcagcacgtagggcaggcgctcgcccagcacaaaggcgcgcccgggatcacgctggaccagcctcaccgccagcgaggcatggggcccacgcacctcggcggcggcagcggggtcccccgctgcggcgccgctcacttgctccccggtgatctgattgagagagagggtggggggggggggggnnnnnnnnnntccacgcacctcggcggcggccgcggggtcccccgctgcggcgctgctcacttgctccccggtgatctggttgagagggggggggtggtttggtgatgggccaagggggccttgactcccgaccagggccgttttccccagcgtgtcctgccaaattctgatggcagccggcatgacccctggcaggcagacccaagccagaaataacaccctggctgggtgcagaccagacatcccgtgcaggcccacgggcagcgatcctagagggtccagatcccacctccacctcacccgccacaggccctgcgtcatgatgagttcgtgcagggagacccgtccagagagcaggcggcggacctcctcctccacaaacgcgatcgccgacctggcacggaggggtggggcacagattgagtaccaagagccagcgccctgccaccactccagtgttgacacctgctcgcgctcactccacgtcgccacgcatgatgatccgctccaggacgccatgcagggtcgtgcggacgatgggagccgcctggcgccacatgctgacgaggccctgggggagagaaagaggagggggcatcggctctgctgcatggccaggtccaatggtcccttgtccggccccgccatgcagcaggcctgctggattgcatccaaccgccacaccactgctccctgagactcgccttgaccatgagcgccggatggctgtcgggtcgctcccacgtcttgccagcgtacctaacatggtgtggaggcaagtggagcaggctcagggggcagtgcagatcagctgcacggggggccttgggagaccaaggaagcaagagagcctcctgaagtgcctgcccggagaagtgtggcccaacctgttgacatggatgagcaggagcgggttgcagacgcgctcaaacttgagctccatgggatcggggaaggcagccgacacgattgcagcagtgcgctttccgacctgtcaagggggcaggatggcgaggctgaagagaagaaagcctgaaggaatgccacccagctgtacaccagcggcagggtcgccgagatcaggtgggcaaagcgatccctggtcctcacctctatggcctctgcaggggtcgaggcggccgggaagacagcaaacctgcggcaggaaatggacgcacaggtttagagcttggggtgcagtgtagcggggactgggacctcacccaacccaggcctcacgcccagcaggcctgctcagaccgatcaaagnnnnnnnnnnacaggaaatggaggcacaggtttagagcttggggtggagcgtgacggggactgggacctcacccagcccaggcctcatgcccagcaggcctgctcagaccgatcaaagcagccgcagccttcagcctgcacccacaccaatgcaaagccagcgggacgggccccaccctccctcgcacaggctgtcggtgtggccgtagatgacgcgtgcgccgcgtccgatggggcccagctctccagacctgctcgcgctttccagggcatccagcgcgcggcggcaggcctgtgcgccgtaagccaggcatgagtctgccagcgggatgcactgcagcggcgaggtctgtgcgcctgcgggagcgtgtgcgagtgtgtgtatctatgcaagcgggagggatggcatggttgagctgggtctgaagcctgggtggcggagcagtggaagagcggtgacatgggctgaggtgaaggcccagccgtctgcaacaggtatgaaggtggcaagccgtccaccgcgccgcaggcgtcgccctgctcacccgtgaagccgtacagcgcgtttgccgtgaccttgagggccttctgccggccgtccagcaccgcccgctgcgcctcgctgcgccatgggatagaaggggggtggcgaagggctcggcacgcaccacccacggcagagatgcccggcagccgcgctgcgctgcccgcaccccagctcacgctgcgggcagtggcgtgccgtcgtgaccaggcctccccagcgcgcccctcccgccccccacctggtcgtggccttgagctggtcgcgcgtggcggcccgggcgacggtgagggccgccaggatggctggcagcaggcccttgcgcacggcgggcttcacaaacacgtcgcccgtgggcgtgaccgtggtctggtcctccgcgaagtgaccctgtgcagtggcgcggtcggtgagaggcgagacagcggcctccctccagtccccgatgcaggtgcagctggccccaaccctgctggtcctggaggcgcaggctgcgtggtgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggtacgtgcttctgtgaaaaaagtgggagggggcgatggaagccgccggggcacggcgtaagccggcgaggctnnnnnnnnnnaggagtgtgtgcgagtgtgtgtatctatgcgagtgggagggatggcatggttgagctgggtctgcagcctgggtggcagagcagtgggtgagcagtaacatgggctgaggcgaaggcccagccgtctgcaacaggaatgaaggtggcaagccatccaccgcgctgcaggcgccgccccgcgcgctgcaggcgccgtctcgctcacccgtgaagccgtacagcgcgtttgccgtgaccttgagggccttctgccggccgtccagcaccgcccgctgtgcctcgctgcgccatgggatagaaggggcgtggcgaagggctcggcacgcaccacacacggcagggatgctcggcagccgcgctgcgctgcccgcaccccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatagcggcctccctccaatccccgatgcaagtgcagctggccccaaccctcctggtcctggaggcgcaggctgcgtggtgcactccatgcccgacacgggtcatgcactcctcaccctccccacaaggtgcttccgcaaccccccctccccgccaccctcaccctgtcctccgggtgcaccagcgtggtgtagcacaggttgtgcgcgcggtagatggaggggtacaggctggcaaagtcgaggatggccaccgggttcgtgtacagccccgccgttcctgatggcagggtggagaaggtacgtgcatccgtggaaaaagcagggggggggggcgatggaaggcgccggggcacggcgtaagccggcgaggctgtgccatcagcctggccccggcccactccttgccgccctgggcgcctcacagccctggcgcccctcaggttcaagcacgcaggcgtgccgcatccctgcgagacccccctcctctcaaaatccgacatcacacggacaccccctcactnnnnnnnnnngggttcaggcacgcaggcgtgccgcatcccggcgagaccccccccctctcgaatccgacatcacacggacaccccctcactgttctccacggggtgcaggatgaaggtgtgctcctggagctggcccgcctccagccgcgccggcagcacgtacccgcgccgcccggcggtgcgcaggagcaggctgtgcgtgcgcaccatctgcgcctggtacgccacctggcccagggtcaggccggtcacgcgcgccatctccaccatgtccggcaccgtggccaggtggaggaggagcgcgcgcaccgcgcgcgcgcgcgtcgccatgtaccgcgccaggcgcagcagcccagcgctgtcgccggccgccagcgcggcgacctcccgcggcgccagggtctccagcgtgccgcccagcaggctctgtacgcagtcggtcagcgtgaaggtggacaggttctgcgaggtcagcacctggcgctgcacgtccacgaccacccgcccgtccacctcagcgcgcagcgtctcctggttgctggtgctgctcatgcgcgactgcgaccgcacccaggccgcgctgtaggtggtgatgcgcttgaggcgcagcgggcgcgagcggctcgaccccggcggggcgcgccccagcgccgcggcgcctccgtccacgcgcagcgcggcgcagcgcgcgcccagcgcgcccagcgtgcgcccggcgtcgaacaccgccagcaggtcggggtcggcggcccgcagccaggccaggaaggcgcgcagcatcgccgcctcgctgcggaacaccagcgtgcgcgcgccggaggcggggtctggcatcgtcgcggccgtggcggcctcggagtgggtgaataccagtgacccgggcggcgccgcccccgggggggcgggtggcaggcccacgcgccggggcccggcagccagctcggcctccgtcagcagcgcggcgggacccgtgccagcttcgctttcttcgccgttctgcgcggcctccgcgccatcgtcggactgggatggtgaaggtggaggttcaacgccttctgtcttggccacgccagcctccgccccctcggtctcagactcgtgcacctttgcctgcaccgcgccgccgtccagcggcgttagcaggcagcagatggccaccagggggtcgcccttctctggtagggccacgcggtctgccccatcagcgggggcgcagagcgtgctcagcgtgcacacccgcagcggcggcaggtcgccccgcaccgccgccgccgcggcggcgcgggcggcggcagaccccgcggcagcgctgccggggggaaagggcgaccagcctgcgtccgcgagctgtgtggcgtcgggggtgaggcaggtcagggcctgccagggcgccgtcgcatcgatgtcgaagccggccgcccgccgatcctcctgggccagagtgtaaccgggcgccggtgcgccagccttggggctcgcggccggcgggacgtacagccaggccccgcctgcacaggaatcaaggaggcgagtggggagtcaggtggcagggggcaagccatgagccgacttgattgcctgctcctcagaggtctgtggagtgtacaaagcgaggcggccactgcagcatcctcaggcacgtccagaccaggcctcttcgcccactaaactacagctggcctgggctccggcccccagggcaccaactagacctcgctcggcacccgggcccacctacaagctcccctccctcaccggagacgggcatgtctgcgaggaagcgctgcagcaggccgatctcactctcgaacatcgtccccgccccaaagttcccccccgcctccagcaggccgggggaggccaggcagcgcgcgagggcgggggctgctcggcgcaggctggtgccgggatcgaattcgagtcgcagcatgggcgaggcggccggcccgaggtctgcggggcgacagtactgcaggggccgcctgtcgcatgccagcacggcagccaccctgaggtcggggggaatagccctgttgaccacggcgcgaaacgactccctgagccctcggtnnnnnnnnnncgccagcacggcagccaccctgaggtctgggggaatggccctgttgaccgcggcgcgaaacgactccctgagccctcggtcctcaaaccagtccagggccggggcggagcctggcatggccgccggcgccacgacgtagaggtaggggcggaagccctggacctgcaagagcacgctggcacccgaggcgctcgccccccagatggtgaactgcccatgatcgtcctccagaatgtccannnnnnnnnnnnnnnnnnnnnnnnnnnnnnnnnnnnnnnnnnnnnnnnnnnnnnnntgggggttggcaggtggagatgacgggccagacatgcccacgcacagcaggattccaaccctccacatggccatgaggggtccagccctagagcacctcgtgtggctccaatctgtgcggacggcgcctgtctgtgaagagctccatgtcggggctgtggtgtgtggacgaccacggactgtcagatgtgcaggaccgctatcagcatagatgagcatcggctgtcgcctggcttacccggcatgtggagcctcatatgccgggttcaatgccgacctgcgctcccgcttgcccggcatgggcctgggaggagctttcaagtattgcttagcttagattacagagcttaggaactcacatcgcatctccaaaatagcctggctgagagggtctgcccagccttgcacccgtgtcggagggacgagcacgaggtccaccaccggttaagcaggaagcctgcaggcgcacatggatccgggcaacgagcacgcacgataatcctgatgcttggcttatgtttcagaattattccgcgagagatctgagaagcggactgcttcggtggtcgacagtggggctggcatgaagcccgacatgacgagctcgaaacctccaccccgagggggggcctcttcctgagctttcaatctgtcagcaaaaatccaggggcatgtccagacgccattnnnnnnnnnntaacgagcacgcacgattatcctgctgcttgacttatgtttcagaattattccgcgagagatnnnnnnnnnnaacttggtcttggggtcccaggtctgcataaattaagccccaagaaattccactttaaccgcggcgtggtgttgcgctacgattggcacatatacacaggccagagcccagacatgaaccagcctgtnnnnnnnnnngacttggtcttgtggccccagatctgcataaattgagccccaagaaattccacttttaccgcggcgtggttttgcgttacgactggcacttataaaaaggccagagcccagacatgaaccagcctgtgggagccactctgcctccactacaaggcgatacagcatcgcaagattccatttggctgggcgaatcactcggagttccgtcagtatatctgagaggtactctccggtctttcatcgtactgcctgtcagatggttcgggcagcagtggtcccgacatgcccgctagcaaggctccgttgaagtcagacttcacatgccacagtacattaagctgtcatacagaggatgtaacccccgcggtagcgttcggactgatgcgtagattcttgagggtctggaccgtgccgaacctaccggcagctggcggtcacacgnnnnnnnnnngctgatgcgtaggttctcgagggtctggaccgtcccgaacctaccggcagctggcggtcacacggagagcagcgctgtccggtgggcacatggtcgggggcgaccatccgatgctcgcccgatcgcgcgttccgcaagctcaatctcgtctgctccagggatccatgactccagaagaggctcagctcttcgttcgacgccacgtgaccccaccatctgttcgacgtatccactggcgcatgggccgtgaagccagcatggagannnnnnnnnngagctcaatctcgtctgctccagggattcatgactccagaagaggctcagctcttctttcgacgccacgtgaccccaccatctcttcgacgtaaccaccggcgcatgggccgtgaagccagcatggagatcgagcggcgcggagcttcattcgagggcctggcgcccctcaagtccgcgctcgtcacattgaaggcctaccagtacgttcctggcgcatcagtttagaggcacagggtggtgcatgtgccgtaccgggagatgcgcacctgcttggccccagggacagtgctggagccgatccaaacggcctgggcaaccgacaaacaatccctccccactccttctctcccgcagcaaaggcagccaccatgactcatcctcccaggcatacaaggctctgtataaacaacagtacctcctcatcctgactgctggcagcttccgggtgaggaaggcctgggaaggtagtgggacgcccggcctcttgagtgggctcagcacttgtaccaccatgtgagtgctcctgacccatattcgagcccttccccttcaatgtgatgcagctctacagcacacgggaggtggaggagggcgcggtgacggcaccaactccggatgataattccgatctcgnnnnnnnnnnactcagcacttgtaccaccatgagagtgctcctgacccatattcaagcccttccccttcaacgtgatacagctctacagcacgcgggaggtggaggagggcgcggtgacgccaccaactccggatgataattccgatctcgggcaggagctggagaccctgaggtcgacgctcctcccctccgctggcaaggtgtgcaagcgtctctaggtggtggcgtctgatggatgtgctcctttgttcccagtgagtcgtgtattctccagtccactccctgccacgatctcactcccaaacccacacttccccagggtgagctcagagcgacgtccgtaacatcctccccgcagcgtccgtgcccccccgcctccccgccctccgaccagatgctgtgcgtgagcatcgcactgtccagcctgctgcaggcggaggtgcagcccggaggcctgctcaccctcagcttcgagccggtgtggtcgcagcgcgccccctcccccgccgccgccgccttccgcggcctgctgcgcccgctggtgcgcccgcctcccggccccacctcccggcaggcccgggagcccgccgcccccgnnnnnnnnnngacgtccttcccgcagcgtccgtccccccccgcctccccgccctccgaccagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccgcccagcgcacacacactgcgcctggtgtgcgccgacgaggccgaggcgcgcgcgctggcgcaggccgcgcg

SEQ ID NO: 18267 - DNA, 345 bp, Chlorella protothecoides
ttcaataaaatttaaactcaatatttaatttgtaaattcacataaaaatatagaaagtaaattaaatacaatttttatttaaaattatggcaactggaactacatctggcagaaaagcttcaaatacacaaaatattcaacctggcaaaataacttctttgggaacactactaaaacctttaaattctgaatatggtaaagtagccccaggatggggtactactgcaataatggggatttttatgggattatttgcagtttttcttgtaattattcttgaaatctacaatagttctgttcttttagaagacattactgtgagttggaaataaaaaataaaaaaaa

SEQ ID NO: 18268 - DNA, 196 bp, Chlorella protothecoides
attcgttttcagttgtttcacgaattaaagaagaagttactaatgaaccatgcattgcagaaaataatgaaccaccaaatacaccagcaacaccaagcatatggaatgggtgcattaaaatgttatgttctgcttggaatacgatcataaaattgaaagtaccagaaatacctaatggcataccatcagagaatga

SEQ ID NO: 18269 - DNA, 67 bp, Chlorella protothecoides
aaatccgaccagacaggtgcataggggaagaggggggaattggcaggaggtcgaggtgattgtggcg

SEQ ID NO: 18270 - DNA, 67 bp, Chlorella protothecoides
cagcgcagcgtcctctcccgcttctggaagtcgacggaggggagcggggaggaggaggaggaggagg

SEQ ID NO: 18271 - DNA, 67 bp, Chlorella protothecoides
gtacagtcaggggtatccccctcagaactatgaagctggctacccaccccagggctacccacctcag

SEQ ID NO: 18272 - DNA, 387 bp, Chlorella protothecoides
ttttttattgaagaaaccaattgtcgcatatgttgttgtgttacattatatttttggtaatttcgagaaactgctaataatgctaaattcttccatcgcttttctcgtacaagtgcttggtctaatcgacaacgcccttcaataatatccatagctgtaaaagtaatacgattttctaaacctaataataaatctaaatttcgtaatcctatgtccgcatcaattaaagcaacacgataaccaaatctagctatagacattcctaaattagcagtagttgttgtttttcctacacctcctttcccagaagttattactataacccgaggttctggttcatcaatatcttttttagttgagttttcttcggaggttgattctggaatc

SEQ ID NO: 18273 - DNA, 108 bp, Chlorella protothecoides
cactggcatgctggaccttgcggcctttggcatgggtggctctgatgctgcacccgcaaatgccccaggcatgccgtccacagtggagcccactggcatgctggacct

SEQ ID NO: 18274 - DNA, 65 bp, Chlorella protothecoides
ctgtgaagattgagaatagaagagtgggtactctcacatcaagaacattcatcatcaaggaggat

SEQ ID NO: 18275 - DNA, 61 bp, Chlorella protothecoides
ataggccggtcaggagtgaatcggtggtggttttattgctgacgactccacaggcgttggc

SEQ ID NO: 18276 - DNA, 417 bp, Chlorella protothecoides
tgggtggcggcgggggagacgccttcttggaggtcggtggggacgcctgcttgggaggggaaggcggcggctggttatacttcctgagcacagtcttgcgaagttccttcacgttgcagaagttgagaatcgtcgtccgttttccaactgcgttgttgcaccggaggtttgtacccttattgttgagaccccagttgaggtttcccgtgttggagttccctgcgcattatagaactgggatgttatagctgagcatggtcatggtcatgtatggcacatctctccacccagcttgtgcaacactcgggaccccagtgccaccccatcgctttcccgagcctgctcaccgatgttgatgttgccctcattgttgtggccaaagttgtgcttccccttgttcccggtaccgatgttgcc

SEQ ID NO: 18277 - DNA, 67 bp, Chlorella protothecoides
acaaggcaccttgttgtccttggccgactgcggtatgatctcccccccaaagtcgttgcggctgggg

SEQ ID NO: 18278 - DNA, 61 bp, Chlorella protothecoides
atctcccccccaaagtcgttgcggctgggggcgtccttgagcagcttgatcatgacatcct

SEQ ID NO: 18279 - DNA, 89 bp, Chlorella protothecoides
tattggtaaatattacttttcttttacaaattcatctctatatttatttttagctattggtacagctggtttattatttcattttgtaa

SEQ ID NO: 18280 - DNA, 76 bp, Chlorella protothecoides
cccctgccaagccgccattccctatccccctttcctcccacctcaggacccacctgcaggatgtggacttcgcggc

SEQ ID NO: 18281 - DNA, 61 bp, Chlorella protothecoides
aagaaagtaggtggtggggaaagggagaatattctccaagccatgatgttgcactggccag

SEQ ID NO: 18282 - DNA, 183 bp, Chlorella protothecoides
gtttttgtgcacacaaaaaccgtaaatcttggtctaaattacaatcattagctaaagctttatataaaattcttttagactcatacttcatatataattttcgtctttttaaatcgcgtttgattgagttaaacataatataaaatattttaattttttgaaatgaattgttatcaaataaac

SEQ ID NO: 18283 - DNA, 144 bp, Chlorella protothecoides
ctaggacctcgggcgcaagttgcgttcaaagattcgatggttcacggaattctgcaattcacactacgtatcgcatttcgctgcgttcttcgtcgatacgggagccaagatatccgttgttgagagttgtctctggttggcgag

SEQ ID NO: 18284 - DNA, 75 bp, Chlorella protothecoides
cggaaggatcattgatgcacattgatactagtagagcttgattcagaacaccaccacgttgttgcaacgtgtgac

SEQ ID NO: 18285 - DNA, 9442 bp, Chlorella protothecoides
ccccccccccacatcccgcgtgcagtccccctcgccgtcatcatgtcgttcaagaagatgaggcggtatggaaaagacccagccgtcgtggccgccgctctgaggtccagcgagctgctggaggtcagtctgagcggcaaggcggtgcggcgcagggagccgctgaaggcggtggaccactccgagctgcgttccaggacgctgctcatcaccggcctgcccgacaagtcctccatcggtgcgctgggtggaaagcgcggcggctgccacgggcctcgtgtgctgcctgcccaccgggtccctgggctgccgatgcactgagcagagtcccatgctcgcgccttttcccatcctcgcaccctttcccacccacccacccaccctggtagaggagctggagggacggtgcaggccctacggcaccctgggctttgtgaagatccggaagccggaggtgctggaccccctcatcgccttcaacccccgcttcatgacctgggtggggcaccgctggtacgggctcgtggagtactcgagctcggaggaagcccacagggccagggctgcgctggactccaccgactcctggtgaggaccgggactttggcactggccgggcggtgaccggcaagggcacgggcaggaggggtgactgaggtttgtcggcgtcgatgcaccgcccgaggctgtgcctgtgaatcccgaccgcgccgtctctcgttccctggcacgccagaggcagacgctcttccccacctcagctccacgccctgatctcgcacaggcgcgggggccagagggcagccatcctcaacgtcctgccccaaggcaaggcggcccggccccccaagcaggcgggcccagacaggcagggagctggggcttcagggattggcggggcggccgcagggccgtccgtgggagccacagacgacgcggtgcaggagtgtgaggcccaggctcccgacggcggcagggaggggcagccgcccggcggccccaaggccaaggccaagcccgcccgccgcgactactccgcctgggccagcgcatcgcatgcctcccccggagcggggggtggggcaagggaggggccccgtcaaccccgcatggcggtgccgggggagaagggatttggcatgggcaggggcaagccgctgccagtgccggcgtgaggcgtgcacaccctagagtcgcctgtcatggctggcgtgggaatcgagtcgagtgatccccctcccacccctgtccctggcctggttgtctgacaattccagacgcattgcgcattgttgcaaaactgaaatcgcccggtaacatggcaggtctcaggtcagctcgtcgatccgccgccgcaccatccattgcgaaacccggcatggccgtgggtgcagaaatcacccccgccgcggcgagcgacctcgccccactggagacctgctgcggccgcgtctcctccccgcgtccctttgcctcggtggggatctgctgcggctgtgccgcctcggccagggccctgcccgctcgccacgtccctgcgctggcggcgagcgggaccgtgccctcctgggcaatggcgaggccgacctccggaccggtcgccgcagcggtgatggagacctgctgctcgactccggcgaccggctgcgaatccgagacttgtgcttcttgtgcttggaggccttctccgccctcctcgcctccttgcgagcctgcaccagggcgtggtgacaggagatcatgcagcggggcgaggcatatggcctgggagccaggtgagcctgcagcgctgcagatggcccctcctcccagtggcaatgtgtatcagcgcaggtcgcagcccagggacctagctctgcaccttcttctcctccctcctatcctgcttccggatgtctgccctgggcggcgcagactcctcggcctgggcaacccctggcccaccccgcgttgacgccggctgctggcgcgttcccgcgacagactgggaggtccccacgcctgcgaggcgctccaccatctccccatcctgaactgcgccgctgcggaggtttaggaggattggggtaaggcatacttgagtaggttgcccgctggggtcaaatgcaaattagagagtcaatcgtgggcctgggccggcggctgggctggttgtggaggcttgccacgcatccctcttgctgcactgtgagcgtagtacatgggatgcatggagcgccccctccaccgactcacgtgaggcgggaggcattgaagcccagccccttcacccgatcctctgcgcccgggtcctcctcctcggcagcgtcgccggccccatgcagtatcttctgcatgtccgcaccatccagcttgggctgtgtcaccggctttggcggccgcggcttcatgcccagcgcctggagagggggcagggcatagtgagtggcttcttagcagtagtagatttcgatcagattcatttaaatgttcaggcaactctgcactctgcatcagccgatcaggggtcgatgagcctgcagagcagccgtgctcgacgattcagttgccaaggactatgccagaatccctcaaaccccaaagcctgtcccgcacctccatcatgaggtcctcctcccgctgcttcaccatggccagctccttttcgcgtgccgcctgggcatccccctccttctcgcgggtgtaccagtatacatccttgcccttctgccacctgtggcgggggggagacgcatgttgtgatacactctccagccaccacctgcactccgcaatccacacattcgaaaccaccacgcacaatctacctgccggtcagggccttcacgctgtgcccgaggtaatattccctgtcctggtccgctctcacactctcccagttgaactggtccttgccccccctggtgccaccacgtgcgggcccattatatatgcccgccattcggctcagaggagtagttgcagatgaaaaacacgaggtgttgtctttcttaacgactcataaggctggagaatggcattgccaaccgaccatcgcgcccgcgcgcggtgacctgccttgggtcgacggatcgcttctaagctttccagccgtggggtgttgttacagcgactgaagtgccgactcaagcaatttagaccccgaacctgtcacaccagccggctacagcaagtgcgttgcaatgtgggctgctgcagcggctgccagggtaggacccgcagcacccgtcacggaggacgctgcgccgctgtctggccgtcccccgctcagcggctgagcggcatctaggtagtcgaaaatgttggccacatcctcggcatcgaaattgtatatgataccctgtcggatcgatgggaggcatgtagtggttgcaggaggtggtcaagttgctccttcacactgcacctttggctgcaaaacgacatgaaattcactgcaccacactatcaatgctgacgtgacagctaccgattgaacagccactccgtaacttacatgaccagcctctggaacctccacgaggaggtagtctggagattggagggccgaatacgtctgtgtgactgccgggataaccttgtccgccgatcccctggtgtgagatggtgggggagagaggagatcgacctccctgtgcagtagctgtacccatcatgtcgaagtgtacaacgcctccagcctcgtgcacggcctgcaagctctgtgaggctcctgaactctgtttccccctggcgagcaagtatgagcccccaccacacacgcacacacacccgtggaaggcgatgggcaccggccctttgcccagtgcctgactggctgctgtcgaccgagggcacagggcctccagctgcgccggccagcccgccgcgcagaagccctcgtagtaggcaaggactgccgcggcctgcgcctccagagccgccctcgttttcagcaggaccagggggttcttgacgacggtgccgagtgcatagcccgccccaggcatctgcagcgcacccacagcatactgcagggaggccaccgcattccagaggctgcagtaggctgcatgggaggggcaatgtgggtggtgggtgggggttggtggggccagagatatgtcaccaaggaggcgagagcagggccttggctggctgaaggatacaataaggagctggtatgacactgtgctgcccataaatctggcatgtggacatttgggactctaggcagatgcacagacgtcagacactgcccaagcgcatgcatgcccacgagaacacagcccagagctggagtgaaccccccagtccaaacctggatccagggcccccagggggaagaagagggtcaggtcggcctggctggagcctagctgggcatccaccagcctggccagcgtggcagccaggcccccctccggctgaggggccaggggaccgccaaaggaacccgccactgcaagcagggcgggatggaggagaggtgatgcagtgcatgggggttcagcaaacattggcctgagatgtgtatgtgggtgatcctctgccagagaaggcaaagccatgctgctcctgtgtgcgctcacgcacatctatacagtaccacccctcccgggcctcgcaccggagaccacggcgtgcaccgaggaagggaaggaagctgccagggactgcgcgaccatggctcccatggagtagcccagcacgtcatactcaggcagtagggtatctgggtgcgccgctgacagggcggccatgaatgccgcggtgttctcggtcagcagagggatggagggcgccgtggcggcgaggaaagtggaccctccgatcccagcatgatccagggtcacaacgggtcgggacccctgcgacagccaggccaggaaggaggggggccactcgtactgggtggcccccatgccattcagcagcagcaagggtcggacgggttcggtgatgttcagggtgttgaacatgtggtagctgttattcacgccgcctgacagggggccaggaatgtggggaggctgggtgatcgtacctgagggctgactccctaaacccgaagatcagtgcccatcgagtgcaccaatcatggctctttgtacctgccacaagaaattgttccggcccgagaatgctcaagtctcccggggtgagtacggtggtggggtcacactgggacgggtacatggtctgggccagggcaacacctgccacggcggccacacataggagactcaatgcccatgaccgcgccatgtagagaatttaaggcgtctataatgatgaagatatcttgatacgcctgccgaagcggcgatcgggcggtgtcttattccacactgtggtcgcccggtactcatcgaaacggcgtccccccgagcaacgacgcgcgcgctgaggcacgtggtacggtgtggaaatttaagcaggagcgtgcgtcgtgctaggagcttccagctccaaaagtgtggaattaggctctttgcccgaagcataaacagagcgcgaggcatgcctgcatgcgcacaaaattcgtgatagtggcaggtgccactatctttctgctttgccaggtatcgtcgaatatcttgcgattgacatggggttagccgacgatgcttcttgatcgacgaagcacacccagatgtagcttgacttatcacatcacgtgcagggtgtcctgctctacagcgtccgtttagatggtgccccgtccaagggtgtgaaggtgagggcatgaagtattcggcttctacccaccctggacattagtgccgcctggatcgcaccctcatcaccaccgcaacctattttatcgtgcacaggtcggcgcaggcacccaaggccgcctggtgcagctggtgaccagggaggagggcacagccgcccgccaggggccgaagcctcgatgggccaggaggcaggacccccctccgccggccgaggtggcagcgggggcgcggcgccttcgccaggcccaagaggctgccctccggaggtggacccgcccagacgccacctccaccacagttttcccgccagggcatgaagacggcgcctgtgtgggctccggcccgccccgcatcggcgcctttgccgcggtggtgatggtcacctttgaccgcgccgagtacctggcacgggcgctggagagcatgctccacgtccacgccctggaccccgacaaccagtgcgtggggagtggggagagggctggctgtgccgggaatggggagctgtgcgtgggcgtgcggtggggagtggagggggcgacccaaggcatcaaggaaactgcactgtcaccctccccttgcatggctggaaggcctggcttccgcaaagttccctccacgacgggtagatgtgacgctgtcgctcgcctgctgacccgggtgcaggttgcgctttcccctgtacatcagccaggactcggatgctcctggcgtccaggaggtcatcgagcagcatctggacaagctgcgatacctgcaggtgggcaagagggtgtggatcggtgctgaagcagtgggcaaggaaccgcaagaatgtctggcagtccctaccgcacccctgggctgcctctagagcatgacatgcaaccttgcctcgtctgtgcagcaccgagaggtggctcctcccatcccctcaaacaagcgggagatactggcgtactacagaattgccaaccattacaagtgagctagaagtctgtacatggaagaggggtgggcgcagccagcatacccttctctccatggcgtcattgctggctgcaaccctgaaagtcgggccaatcccccttgtgggctcctcaccatgcgtttccttctccaagacttcagcgctgcacaggcagcctactgtccccccacaccccttccacccaatgcacaggttcatcttccagaccttcttcgactgctttggatttgcgcgactcatcattctggaggacgacatgctcctcgcccctgattttttcccctactttcttggtctcggccgcttcatggacgcagaccctagcctgtactgtgtcagctcctggaacgaccacggacaggtgccagcactggaatggaagacgggggatcagaggacagcgtgactgaatggccgctgcgcttagattgccgcccatggctgcagaccggccctctcaattccccccgacctcccatctcctcactatgcagtcaaagtttgtgagggaccagcacactctgcaccgcaccgacttcttcccgggcctgggatggatgactaatgccggagtctggaccagcatcagggaggcctggtgagggcgggggctgctgagcagagggatcctgggaggagaagagccggagggggcatgcacatggcatgtatgcttgaaacatggaccagaccaaatggggtgccacaagcagaagcattgcccaatctgcacagggacctcccaagattgcgacgatggcctgcctcttgaagggtttatgcctgggtcagacagttcttttttcacacatgttgcttgcctcctctactttcttctcacacccgccaatgtctgcccacgcaggcccccagcatactgggacgactggatgaggctcaactccacgagacagggccggcagtgcatcaggtgtgtgtgtgagctgccaggcatgtgctgcaggctagagaccgtcacccaccctggtctgagagcggcggatgattggcaaccccctcctgtggccccacaacgctacctaaccgctggcacccaggcccgaggtcagccgcacctacaattttggcgagcacggctcgagcaagggccagtacttccgcaccttcctcaagcccgtgactctggccagcgaggccatcgactgggcgagcgaggacctgagccacctcctgccggacgagtgagggagagggttgggaagggggggcgggggatcgccggcaatgtcaatcgcatccttgcaacattgagatgcggctttactttattaagatcaggcctaagagccagtttcattcgccacaaggcaggcggcagtcagcctcaccaaacattcctcactcacccagaaaccccccgccttccaccacaggtatgccacgcgcttcgaggcaatgctggcctccgcgcccacgctggccgccgacgcggcatggacctccgctgccggtcccgtccgcgtggagtacgccagcctgcaacagtaccggctgatcacggggaggtaccgcatgctgcgcgagtggaaggacggcgtgccgcgcgccgcttaccgcggcgtcgtgcgcgtgagaaacccgaacggcgtggaggtgctcatcgcgccggtgccggggtttgaccccggtgcggcggcggcctccggggagggccgggcgcaggagccggggggcgccatgggcaggtgactcgtagattgggaggggaggggatggtgatcgtgtgcccgcaggctgggataccactccatgctcaagcggggcagggtggcagctggtccgtatgggttgctgtgacctgagggagctgcagatgagggacagaaggggaaggaggcacgatgtccctgcgcctgactgcctccacttctccaccccccctcttgactctggcaggaggggcaagcttgtcactcgatccatcacagactgagatctggttctgaacccttgcgctggtcgcagcaccttcgagcaccctcgcctatggagcggccccacgcactgaactcaacagttgaaatgaaatgaaagggctgatctcacactgcaaaagcccagctgtttaagcgagggcacgccacgctcgcagtgggattgcctcaggctaggtgccagtacagaacgatatgactgtcagtagcctgtggacaggggacagtgcaacctcagacgggtggaaaatctgagcaactcccgtcaacactcgtgccagagtgggtcgccggcagtcgtgcgctcacccctcctccgcccacggcgcctgtggggggaccaggccccggccccggctcctcctggccacccccagcgcggccgccagcggggccgacccatacttttgcagcgcgtagacgaggtcgcgccgccccccggccagcagctcagcctggctggggagcacgcgggcggcgtcgcccccccgccccgccatgaaggcccggaactccgccaccgccgcgcccaggccgtgccactggcccctgccctgcctgcggggcctgagacccagcctggcggccgtggcggaaaacccgccgccacgcatgacggcctgcgcggtcgggcgggggtgcctggagtgtgccttcggggcgtgggcacggggaggcccgccggcctgcctctggatccccaagccccgtgcatgcactgacagctgccaacatccatgcctcacgtgacaaggggtcccctccctccctccctccctctctcctcctccccc

SEQ ID NO: 18286 - DNA, 187 bp, Chlorella protothecoides
acatatcaatgcatttttatataattaattatatgagaggcctacttagctcagctggttagagcatccgtctcatacgcggaatgtcactggttcaaatccagtagtaggcacacttataaaagttaattataaatgatgttagtttacaaaaaaatatgtattatttatgaaatcaagtacttga

SEQ ID NO: 18287 - DNA, 77 bp, Chlorella protothecoides
cttgacatagatgtggtgggtaaaggaacataatttccaggtctccattccatgttgctctgtgcctctgctgggct

SEQ ID NO: 18288 - DNA, 73 bp, Chlorella protothecoides
aaaaatttaatgcattaggaaataataaattatttgcaataaaaattgtattatattttatatttactttttt

SEQ ID NO: 18289 - DNA, 183 bp, Chlorella protothecoides
aaacgctcaatacgctcgatgctgttcatttgtaaatggtaattacatccaaaacaaactcgcttattttgttgtaaatgtttaatatataaaatgaccccacagttttcacaccgaatccataagcttaaatctcccgggcggtggccggatttaggtgcgttaagtaactttaaatttttt

SEQ ID NO: 18290 - DNA, 76 bp, Chlorella protothecoides
tgaacatgcaaacgtcgaaaactcactgcaaccctacaatgctcaacagcactgccaaaggtctgaggcagggaca

SEQ ID NO: 18291 - DNA, 62 bp, Chlorella protothecoides
acagcatcaggatcgagccccttctgtcctcaccctccaataaaaacagaaccatgacgcga

SEQ ID NO: 18292 - DNA, 64 bp, Chlorella protothecoides
atagtccatgcaaacccacttaaaatttttactaaagtatgtccagccatcatattagcaaaaa

SEQ ID NO: 18293 - DNA, 7548 bp, Chlorella protothecoides
ccccctccaaccccaccccccaccccacccccaaatccatgcagtggcatcggcgccaccatctgctgccccggccccgttgccacagggctggatgggaatgcacggctggtctatggcccgctgggcctgatcgagacagtgacgaccgtgccctcgcccgacggcgaggggtcgcagctggtggcggcgcactcctcctcggggcgcaccgccgtgccgcgcgcagtggagctcatcgtgcgcgccgcacaccgcaagatggacgaggtctggatcgcgcggcaccccgtgctgctcgtcggctacctcacccagtacacgcccttcctggcgtggtggatcctgaagaaaatcgggccggggcgcgcgcgcaagctgaagagcggcggcgacggctactccgtcacgggcatgtttgtgtgggggacgcccaagaagacggagtgagggactggagtgtgtgtaacggggggagaggttgaggccgtggcccactccagcaccccactgtgctgccaccttcatccagcatgagcaatagtgagtcatcgcttcaggaccatccgtccgaggcagccaaatgcatgtgtggagcagcactcccttgtccatttcaagctgaccaggcggccatccatccgtcatctgcctcctcctggaaagaggaagtccactcaatcctgcccccttgcctggcagcgcggcactgccaggcccaagggatgctccatcacacttgaattttgtcacgctcttcatccctcccacgccctcactcttcatccctgctcaatggaagtttttccgccggcccttggaggcatcgcctggtgcgtgcagaacatctcgcacgattgtccagggggcaaatggtgctgacactgaagcttggtgctgccaaacattttgtgaactgaacgattcagggaatggatctcccagaagaacacaagtgatcgggtgatgcaaagtgaggatgcagagcccactgagctttcttttgttggcatccctcccaacacggatgccccccactatgcgagggagaaaacaaaaatacattgaggcgtcaaacataaaaatcggaacatcaacagcggcccatgctgctttctacaggccatacaactctgagtacttggacttcaggtgctccaggaggatgctggggtccagagggctccctgtcaccttctccagcagctcgtcggccgaggggtacaggcttccgacctgcaggggggggttaaggtggccttgctcacaatgccgtgctcgagaagattcacacctcgacgccaaacccgcgcaagctcacatggccagtctgtgcctcaacgacaagtcatggtgagcatctaggcgaagcctgcaggcatgcatgcgtgctttgctcccacctctacctggtgaatgttcttgttcagccaggccttgagtttggagaagttcccggcggcggcctccgcctcaaagtcgggcaggtctttgcgtgccgcctcgaagatctgggctgccatcatggcccccagcgagtaggtggggaagtacctgggtccaaagagggaggaagggatgtgggatgggggtcatgcagggaatgcctgacgatgagcctaagatgttgcacaaccaccatgagcaaatcacgacagcaagtctgctcaaatttgtgcattgattgggctcctaagcacgttctgcccaggctgcagggatgattggtggcctcttccacatgatcagcattacaggcctccccaaccagcagcctcacccaaagagtccgtaggaccagtggacgtcctgcagcactccctgcgcgtcgctctcaggctcaacccccaggtactccttcattttctgcaggtcggccaaaggcaccccagtggcatggtggtatgaactgcataatagagcaagcatccacgcatcctggagaccacttccgggctcagtctcctcatgcctccatgatcatgctgtgcgtgtgtggccccgccagaccccgagacagacaccatcgtgctttccacccagcccatctgcccctggccagggccaggaggccagtcgatctacgaactcccaacccagccggggcatcacgagcctgtgcccaccaaacatcaggatcccatcctcaccttgttccacagctctgggagctggtcgacggagatgtcgccccgcacgagctcgctctccagctcgtacctcaggatgatgtgcagtgggtaggtgacctcgtctgcctccacgcgaatcagggagcggggcaggacctcgttcacggcgcggtacaggtcctctgcagtcctgtcttgcggcagctgcacagagggtcaagggtgacggagagggggagttggggagggatgatgaccatcacacatgcccagactctgttctctgcaagacaggggcgccgcaggtggtgattgatccagtgcgctgacaggccagcaagaagccccctcgtcgacaccaggctcacctgagggaaggccgccttgatcttggggaggaggtaggcggcaaagggccgccccagccccaccatgcgctcccacagcaggctctgagactcgtgtacccccatccccgcagcctgtggggtggagaggtgggtggagtgtgtgtgggggggagttattctgtacagcgaggcgatgagggttgcggccagtgcgtcctgcaggtccacgcaggcccctgggccagggaagggcgcaggtgccgatccccctccgacgccccacagatcaccccaaaggtatcccccccgctcgcccagctctccgaattcatccaaccaggccgcccacctcgttgacaggcaggccgtcgtactccaggttgcgcccctgctcatacagcgcatgccctgtttcgtgcaccgtccccgtcagcccctccagcaggctgtccttcttgaagcgcgtggtcatgcgcacgtccgtcgggtgcgcgcctgtgttgcagaggtgggacagggtgtttggagggttgggggaggggtgtccatgagatggacgggcatggaggaaagcagccccagagggttgcattgcagcggctctttccggccacgcctggtcccaacagctcctgccggcagctcatctgccaactcagataacaagatcaacgcacagcatcaggcccctacctctccaacccaccaccggtgaaggggtgcaccgacacatccaggcgccccttctccaggtcgaagcccagggtcaaagcgatctcacgacacagcgcggcctgagcgtcggtgtcgaactcgcccttgagccaggcggtgtccgggggggtgccgcgggcacgcaggtccgccagcagcggcaccaggccggccttgacctgaggttgggggggaggtgagcgggatattgtacgcagggcacatgccaggacaagaggggtccagagatgctgcaatggccggctttggtgcactggcatgacgtggccctgtgccacaggtgctgcgcgcagggggccactagtgcacgcaggcgggggctgccatgcacctttggtttcccccctccaactccctccaacatcccacaacatgaggccctcctccgcacgtcacatcacctcccccatccaccccatcacacacgcacacacctgatcaaagatggagtccaggcgcgcggacgtcagccccggctggtagtcgtccagtaggacgtcgtagaccggcttgccggggtcaatcagggcggcgcgctctctgcgcagggccacccacttctccagggcgggggcgaagagggagaagttggaggcctgcctcgcctttacccaggtctgggggaggggggggggtggagggacaggggatggtgagtctgtggacccccagccttagtttccatggttcctgacagcagcacctctcgtttgtcactatgaagccaagccagacgctccttgctgtagcaggacggtaaatagaaacggtgcactttctgcttgaccatactgttcaacctaaaccccgccccaggctcccaaacacgcacgcacctggtaggcttcggtctcgtgctccgcctcgcgcttggcgaggtccttggtgacggcggtgaccttcctgtactcccgcgcggcctcgcgcacagcggcggcccggaatgcgtcggccccctggccctcctcccgctgcagctgctccagcagctccccaatggccgggtcagacttcctctcgtgcagcagcccggccagggccgacttctgggccccgcgcgaccccgcggcaccggcgggcatcatcaccatctcgtcccagcccagcaggccggagatgccggagaaggcctggatctccttcagcttctccgacagggcggtgaaggcctgcgggaccgggtggcgaccgaatatggacgggggggggggggtgggggaggcatgcctggtggtgctgttgaatgaattatcaaccaagcactctgcccctgtaccccaccttggaggagggagcaatggcaacctcgccaggggtaacagcagtggccatccttatccgcgcaagcttcttagggctaggaaccgcctgtcgccaggcaacaaagggagatgctaggcttgtaccgattcgtgtctcgagacggtacttgaacatgcaagctcgcccggagagtgtgtgggcagctttgcacgcacacgcaagtgatctcacacccagcgggtcagggaagggcgacttgtcagagcgacagcgaatccagagaatcaagtagatgcactcggcttttctcagctcaaagactccatcacttcgcgggcagccgcgaggtgggatccccgcgtcgcatgctcaatccacaattcagagcgcgcgaggttgtgtcatgtcggagggagcagcatgctcgagacggacaaggctcgcgatgctttcatgcagcttgatgcgagccgatagcatgaacgtgccatgatatggcgctgacatgaggtgccggcatggagggggccccatacgcctccaaagtgatcgggtgggtggtggtggtgggatgatcaggcccatggcaagctgatctacagattgaacatgcgtatattgtgttcacatcgtatacttaatgcaccaggaggaagcaaatcctagaagaggcccgatccgggagggagcagcgccaggttgcacgccggcatgagcaggcggccaggaccctgcagcgttattggcgaggccgcactgacagagcgacgctgcgacgccacctcgcggagcagtggctgcagctctatgcccctgttgtagcagacacgggcagggtgctggacaaagatgatcttcttgggaacgtccttccccccatactggcggccagcctcctccccttccgtggcttccaagctggtttgacggccggtgcgccgatccatgtcgacgccagcgtccgccctgccctgcgaggctccctggcgcttgtgttgcgctccctggcgagcgccgttccggccgagaacctgctctccacggctcctgggtgaggtgacgacggatgctgggagtgccatgctcagaggctgcaggttgagacacctgcaaactcctagtctgcgatggccagtcgaaagaacatggttcaaggggcccagagtggacggcaagaccatatgcacccccaacgagtcagggaagcggcatctgtgttgcccatgtccaactctgtatcaatcactcctctgcatgcccttggctatcagggagacttcaccgctacaatcgcacattacgcactcatccctgcccctcttctctcctgcgccggcacctcacagcacgcctagcgcacaccgcctgtgccacctgctgctgctctgctgcagcctggcggggtgcccgggcgccgatggcctgacgcaggcggctgcgacgcgctgcgcgcggctcctgcttgccgccccgacctcctgggccttggacgttgcgaaggatcatgctgcgaatgctgcccaggccctgcacgccgagctggtccgtcgctcgctgcgtgcggtgcccgccggcgtagcgcgcctggcggcgccagggaatgctgccgaccggggtgcttccagatctgtggagctgctccgcgcctggctttctagcctgaccagcgcaggcctagcccacgagcaagcagactgcgccatggatgaggtgtgcctggcggtgctggcgaagcctggtacgggcgatgaaggttcagagtccgaaacggcggcgctgttcgtgcccgcggcgactcaggcggccgtgtatgcggcggccgcgcgtgtcgcaccgctgctggcaccgcccaacgcgctctacctggcgctggtcctggggcgggcggcgcgggcagcgagcagatccttgcgagcaggtccattcctggcggccacgagcgtgcttttccgccacgcatgcgggccgggccgggatggagcttcggcccgtgccctcctgggcggcagcgggtgcccctactcccgcggagacctgtttgggatcgtcctggcccgactggaaacccaggatgtggaggcgctgggcacgctgtgccatgccgtgctgaccctggaggcggaaggagcgcggactgttgggccctcaggcgatacgggtcacaaccagacctcgcacacgccgctgctcaaccacctggccttcaacccgggccaccagacgctgctgagcacgctgtggcgccacctggcgcacagcgtgccactcctcctggaggcgcacagggcttcgagccggggctgggacgtgccgtcgctggcacggggggcgcgcgcgtccctgacctggggacaggcgagatgctggggcgtgctgtgccgcctcctgcgccacctgctgggcgccctggacgacgcggagtttgcggcgggcgcggacggcttgtccccggaggggcggcgcgccctgactgccgcgctcaacacgatggtggtgcgcacgctgctgccggcgccgggcggcgccgcgcgtcaagggacggttgaggctgcggcggggggtaacgtggacccttatgcaatgctgctggagcaggggccctggctgcacaggtgccaatgggtgtctgtgtgtgtcggcgtggggggctgggcctgggaaacctgctcgcgctgcgccgccgtcagtcctgaggggtttcctcgatggcacacctgcctcagccgatggcactccgtccctgcgggctgctgcctccgacttgcccggatggtgtagggtcgccagggctcatgttgttcacacacacgcactcttcgagacctgcgctcctttacccgcctcccttcctacaacccaacccagggagctgtacgagcgcgacgcccgctgcgccttctgccccgcctgcctctggctggagccgttccagagcagccggggcgcgggcgaggccctggcctcgccgtccacgctgcgtgcgctgtgggcgctgcaggaggacgcgcgcggcccgcgcgcggcgggcctggcgcctgcggggacgcgcgcggcgggcccggcccgcc

SEQ ID NO: 18294 - DNA, 61 bp, Chlorella protothecoides
ccaggaccaccccagtcaccccgctgcctcacggcactcactcctccctccctccctccct

SEQ ID NO: 18295 - DNA, 142 bp, Chlorella protothecoides
aataaaatttaactaatatttcgggtagatttctaatcgtaaaataaaataataatttattaaaaatggctccacaaacagaaacaaaaaccagttcaggttttaaagcaggtgttaaagattatcgtttaacttattatac

SEQ ID NO: 18296 - DNA, 261 bp, Chlorella protothecoides
aaaacgttacctacaattgatgtaaataagtttgttacagagccttcttcaaaaagatcaattggatatgcaacatatgcaatatattgattttcttcgcctgctactggttcaagatcatagcaacgtcctttataacggtctaaactagttaaaccatcagtccaaacagtcgtccaagtacctgttgaagattctgctgcaacagctgcaccacattcttctggtggaacgcctggttgaggagtcatacggaaagct

SEQ ID NO: 18297 - DNA, 161 bp, Chlorella protothecoides
taagcataaagatataatgattataattttctagaataatactcaataactaataattcattaacttggagtttaattaaatcgcgtggtacgatgttattaacactagcttctaatgtttctttatttagatttaaataagaagaaacagtagcaatacc

SEQ ID NO: 18298 - DNA, 298 bp, Chlorella protothecoides
aaaaaaattaaaagaatcacaatacggtattcgtcttaaagaaaaacaaaaattaagatataattatggaattaatgagcgccaacttataaattatgtacgggaagctcgtcgacggaaaggatctactggagaagtattattacaacttttagaaatgcgattagataatatcatttatcgtttaggatttgcgcccactattcctgcagcacgtcaacttataagccacggtcatattagtataaacaagaaaaacattaatattccaagttatacttgcaaaattaatgataat

SEQ ID NO: 18299 - DNA, 83 bp, Chlorella protothecoides
tcgtaaagattttcctttaagtggttatgttgaagttcgttatgacgattcagaaaaacgagtatgtattgaatctatagaat

SEQ ID NO: 18300 - DNA, 85 bp, Chlorella protothecoides
aaaaacgagtatgtattgaatctatagaatgtactcaagaatttaggtatttcgattttgatagtccttgggaacaagtggaaaa

SEQ ID NO: 18301 - DNA, 1033 bp, Chlorella protothecoides
cccccctcccccccctcccccaccatcgccgccgccgccgccgaagcagacttgtgatcctcgaaccagcttctttggtctgcccaccatcaagtaggtcctgcacatgggtatgcccaaaatgccgcacctcccggtgctttcctggcacacccacagcagacctggtctgggctgtgttccacatccatcgcatgctgcaccgccttgcaggtaccagaacacgacctacctgacaagctcaagcaacgtcgacacctactgccggtgagcagtgtgcgtgagcaggggatcatcgagctgatgtagggctgcagaatcaggcagcgtatgaaattgaaaggactggtgtttgcctttttgcacacgctccaactcgccgctgacagtctcctccctcaatgtcgccgtattcaggctccagggcttcgcaggagtgggcgcggtaagggaggaacgcatcttcaaatcgacgccctttccccaattcactattgaggcgctcgatccacacactcgggagacgtgcacgcctgcgaatgacgccccgtgccgtgtcatagcggtcgtcgagtgcttgcccgagggaatccccaggtgccagccggacgacaacggcaacatcggcaacaggaatatcggaatgaacaacttggggcacaacaaccacggcgacaataacagcggtgagccgcggttgaccttggcctgcaggatacaatgcgagcggccttctcagctccacctccctcctccaccacaggcaacctgaaccacgggtcgcacgtcacaggctcagaaaactgggggaactatctgatatgcaatgggatccagacaggatcccagaacgaatgtaccattgactccttggtgacatcagagaccctcatcctggatgagtagggcaactcttagccaccaggcgcagggtttgaagagagtggagtggatagcatggcgtagcgaaaaagttggactgggtcggtgcaacgaccttggacggccctgccctggtcatgctgggatgtaa

SEQ ID NO: 18302 - DNA, 328 bp, Chlorella protothecoides
ccctgacacttgccttggtcgtgtttggttggccatatgatgtggagcgatactttgcttgcttgcctgtagtaatgatcttctgttgcactgctgtaacagtggagcaaaattcgagccactgacagcaagattttgcttaattgcactcttcccaatacgaccaaaatgattaggcatggggttcaggattgcagaatacatctatttcccacgatctcaactcgtatcaaccgatgtcattatcctctccacctgcctgactggcgccaagtgtgtagagatgattgtcttacaaggacaaacgagggaccaaaagaggcggggg

SEQ ID NO: 18303 - DNA, 91 bp, Chlorella protothecoides
aaaaaaaccagtattatcaatgtaatgactgttgtcaatagcggtaaatcgagctatgccaaaagttttcacgttagatatgttaggatta

SEQ ID NO: 18304 - DNA, 85 bp, Chlorella protothecoides
ccgtatacatataccaattttctacgagaagtttaactaatgattgcccaatagaccaatcttgtgccccaatattcgaattatc

SEQ ID NO: 18305 - DNA, 1050 bp, Chlorella protothecoides
cggagatggcggaggtggcaatggaggggggcttgggggcgagggcggcggtggagatggaggggggctggggggagatggcggaggcggcgatggaggagggctgggttgagacggtgatggagggaggcttggtggaggagggaggctcagtgaaagagggggcgtaggtagtggagagggggtgggtggaggagaactcgggttcgaatgtgggggtggagacttcttggcgagtggaggtgggaatgtcttggcaggtgggggtggagacttctttgtgggagggggtggagattccttggcagatggaggtggagacttcttagtgggtggggccggcgacatcttggcgggtggcagtggagacttcttggagggcggcgggggtgattgcttggcagccggcgggggtgccttcttgggtggtggggatgacttcctgacagtaggcggcgggaaggcaagaacccatgcctgcttccggaattcaagcagactgcagtcattggagaccttgcgatctcctgtcttgttgaagcagcgattgcccgtgccgtcattgttattcccccaattggcggtgccgatgttgaagttgcctgcaaggacagcatcattgtgacatatgagtctgttccacccaatgattgcagaggctttgcatgtatggcatggcgttcattccacattctctgctcaccaatattagaattgccaatgttgttggtaccaaagttgttcttgcccctgttgccggagccgatgttgccatcgctgtctgccgagcacgccttctgtcctggcttcaggcactccacggcggtcaggatctccgtggagcgatccgacaggatcgcaaagttgctcacgcgaatagttgacatggagagccccatgatgtggaggattgaggtgcggagtgaccccaccttgctgaagcccgcatgcctgctcacagggggtaaggagggggcggaggggtgcatccacagggttttgtacagtttggtgcacttgagaggctatgcctgcctcaggatggctttt

SEQ ID NO: 18306 - DNA, 70 bp, Chlorella protothecoides
caaattataattggtcaatttgtttttttgtttttagataaatttcaaattaaatctaccccaaaaaaac

SEQ ID NO: 18307 - DNA, 99 bp, Chlorella protothecoides
aaaacggtaaattgtggaaactagttgtttcttgtttattcataaaaattcgctcatttttatttttttctaaataaactgcattaaaatcattattag

SEQ ID NO: 18308 - DNA, 77 bp, Chlorella protothecoides
cgccaccgatctcgccggtggcgccgccccggccgccacgacccccccaccgaggcaacgatgctgggattgcgaaa

SEQ ID NO: 18309 - DNA, 68 bp, Chlorella protothecoides
ccagcagagtgccatccgagcttgcatccccatgcccaacggtcattccgatcctacccacccacacc

SEQ ID NO: 18310 - DNA, 80 bp, Chlorella protothecoides
ggagtatcaggaggtgggtggtgtggatagaagctcgtgcggaggaggtgggggaaacctgttggtggctgcaggggatg

SEQ ID NO: 18311 - DNA, 2413 bp, Chlorella protothecoides
agctcggccgccgccgccgccgccgagccgcgtcgcagcggcagcagcgccatgcccagcacgcaggcaaagtgcgcgtcggtggtgcccgcccgcgccagccccgacgaggccaccaggccggtggtgaggggcgcgaggcagcggcagccggcctccaaggcgtcaccatcctcgccggcggcgctggcggccgctcgggccagctgccgcgccgccaagccgggcagtgcctccagcaggggcgccgctgactcgtcgggcacgaggcgccttccgccgggcaagctcccggcggccagtcttgctgcggcgcccgccaggcggcacagcgtgaggtgctcgtcggggttggtcgtcggcttgtcacccactgcatgctgccacggcagcaattcaatgatgtggaccacgaggtctgtgctgacctggcagagggcttcggtcctgcgctcccgggggggtcctattgctgggcgggggagcaagtaggcgtccgaaccaggcagcgagaggtctgccagcaggtcgcagcaggcctccagggcgccgagctggagggggagggaggtggcctgcacagcaccacttgcaagcagacaatgaatgccatccccctgtccagaggtcatgtcggcgcgcacgcaggcggcggcgagcgccacgacctgatcggtgcatgcgcggccggcaagcgcggcggccagcggtggtagccagccccgccactccagggtgcagggcaggccggggtcacaggcgcagcaggcctgcagcgtgttgagcacgctgggcaccaagtctgaagcctcctgaacacaagagggtgtgagtgagggtggggcaggtgcagagtgagggagccagaggctgcttcagctggcaaggggtttggggtgcgagggctgagcaaccccacgactgtggatcacagacctctgaggcagcagaccctgcctgcagcgcctcgcctcccggcactgtggcaagcaggcaggccagcacgctgacgaggaccgctgccacgtcagcagcgtgagattccgggatggcccgcagcaagcccaaaatgcgcagcatgccccgcagctctgccatgtgcacggcgggggccccctcgccggagtcggcgaggagactcgccaccgcctgggcccagcgcggcgagtccaggccctccctttcctcaatcttcgccagctgaccgcgcagggggccccagcatgagggtgtggtgcttgctctcgacctcttcttcgacgaccggcccccactgactcgctcttcctccctgctggcaggtgaacgagaggggcagtcagaatgtaaccctgaattgattgagagcccagagatccctccttcggtccatgcaccaccttccatggcccttgccgtgcagcttgcatcacctcctggctgatcagccacctctcagcccacctcacccgcctgctggcagcgctcgcagcagctgagccgccagggcgggcgccaacccagcccccagcgcccctgacagccccgcatccggcccttggaggagggctaaagcggcgtcgtgacagggcgagcgaggctccgccgcagcgcacagaatgcaggcgaccaggcgcgccgcgcagtctggagtggcgtgcgcctccagcggggctggcgcctcgagcgcgacggccgccagcgccggcgagcgcgcggcggcggccaccagcgcggagcaggcgccggtcagcgcggcgccggcctgctcacggacgcctggtggcgcggaaggcgtggtggcctggaaaaggagccagtcatggaggagggccatccacgcggccagcgcctcgccacttgccaggctcagctggctggccggattcaccgaggccgcggcctccagcaggcgcaggggcccggcgggcagagtgggattgtcgcccggcagcgccgcgaagaaagcgggcagcgagtccgcccgcacgtcctgcccgggcagcgccgccacctgccgcgcatgggtaaacgagggggtgggggggatgagatggcaaccggggcagtacatgccagcctcagaaccagggtcctacgctcaattccaagccattgctcttgtgtgctggcacgcccagcacccgcacacgtactcatccgcaacaccctcaagcccattcctccccttccagccgacctccgggtgctgggcggcgcaggaggcatgcaccgccagcagcgcggagtagaggcgcagcatggccgccaggcctatggcgcccgccgggccggggcgggccacgcccagcagcggcgtcaggttgcgagcgaggggctccaggcaggcctcgcaggcgcgcgccacgggcacggcggcggccagccccgggcgcacgcagcgcaggcaggctagggccacggcagcggcgcc

SEQ ID NO: 18312 - DNA, 102 bp, Chlorella protothecoides
aaaaaccagtagctccacttgacaatattcttacacgagtggtcatttctcgaacaacaatttcaacatgtttttcagacactgaaaccccttggtttaaat

SEQ ID NO: 18313 - DNA, 67 bp, Chlorella protothecoides
ttgtaaggagaggaggagtagtgatttgcgggcgcacaggttgctgctgcgacggtcggctgatcag

SEQ ID NO: 18314 - DNA, 61 bp, Chlorella protothecoides
ggcccagtgtctctcatccaaagggttggtactgagacgacccactgtcttgaggtcaaga

SEQ ID NO: 18315 - DNA, 108 bp, Chlorella protothecoides
aaatggtttttctacgttacgttttggagttggtatataagaatcaaccgtatccattaatttataaattttatcaacccatttgttctcaccaggtttaatatttgg

SEQ ID NO: 18316 - DNA, 123 bp, Chlorella protothecoides
aaaggtatttgtcgaatatggttccctttggttatgagcatgaaaaacccaaaaactaccaacttctaataaagaatgtgtcatcggaacaacacctttaattggaattagtgttttacttga

SEQ ID NO: 18317 - DNA, 67 bp, Chlorella protothecoides
tttggagtatttgtataaactcgagtgcatacacctcttctttgtggacaagcttgtaacgccggcg

SEQ ID NO: 18318 - DNA, 160 bp, Chlorella protothecoides
tatttatttccaaaccaaactcaatcaaatttgctattaaaataaacataatttattataatatgctgtacttgttttgtacaggtttggaaataattataacataataataaataaaatttattttatataagtgaaatctataattttagtagtatgt

SEQ ID NO: 18319 - DNA, 5393 bp, Chlorella protothecoides
ccccccccaaaccatgcgacccacctccaggaaagacgatggtccctcctgtagccagggtcgcaaggtttccgagcacggccccgaagcagtggaacagggggacgggaatgcagacgcggtcggcggggcccagtctgcagccccgccctatcatgtagccgttgttcagcacgctgtgctgcgacaggagggcgggcttgggccgccccgttgtaccgctggtgtattggatgttgtaagggctgtgcaggtccatgccagcagcccgcgcccgtgccgcctcccgggcgcccgccatgccagaccgctccaggaactcgtgccagctgagcaggcctgggccagggttcaggtggggccatggtagggggagccagctgaaggtattgatggacacagcccaccggtgccccgactaaacagcaagagagccctggcaatccaggtcacaggcacttggcatcgatggccgacccatcaatgccccttcaggccctctgcttgcctggtgcactctcgccacttcccagcaggaccacatgccgcagggtgggcacctctgccctgatgctctgtgcaggagtggcttgcggggctgactggcgctgcgtgccgcacggtctgcctgcaagaccctgtgcgccctcttgtctcggtcctgggcccggctctcggacaccctgcaaggcaatcctctcaacccagctcgtgcgctcccaggctgcaattcacctggagcatgccgacgtagtctgaggctctccagccaggtgacataatgaggtgagtcatgccacagcgcgccacagcatactccagctcagcggtctggtacgctgggttcatgctcaccagcacagctccaacctgatgggttgggagggcgactcggtgaggccacagatccacacagctggctgggatgcggcagcctccaggccgcatcagaggaacaacggcaatgtgctgctcctgcttgcccacccagcgattcaccccttccacttccctaatgtgcacccccagggcagcaggcatgcctgccgtggacttccctcaccttggcggtggcaaactgcatgatcacccattcctggcagctggttgcccagaccccaaccctgtctccttgctccaccccaagagacaccagggctgcggctgccgtgcacgcttcttgctgcagcccggcatatgacaggcggctgccctggtgcaggctgacgacagcctccacatccggctgacgccgtgcgaggtcgtcgaggaggccccccagactggtctggaggagggcgggactcgtacagcccttgacgtggctctgggtcaaggtcaaagtggttgcacctgttgcatttggattcacaccagggttgctcagactcgtagacaacgagccgatgagatgactctggcaaagaagaggaatggaaatgatacctcggaagatgtactagctcgtggaacagaaacaagtaccttgcttaggtgtcgcctgggccgcgcttgacgcagctcgcctggagttcgtacagacaatcgtcaaggcctccctccgtcgaaccagagcccacgcagccctcatcctgacgcatgagcacctaaggagactactcaatcatcggaagttgggtggagaccttggctcgcagtgccacccttcaagagcactcggtgtgtcggaaagacttccgagataggctgacgtggctttctactgcatggacatctgcaatcggttcccctccaggagggtcaacatctgaccacaaacgtgcctccagtgatatccagggcggttctgacgctgggtctgttgcagagtataccgcacggggacacatgctcaaaagccaggggttgtgtcaacagactcatgtactggcatgcaacccaggtcaccgatgatgagtgctgagacctgcgtccctgccaccagcacgcctttcctctgcatgaaaaggggaagatgtaccgagttcgtgggtcttgcagaaaggcaagcatgccaagttcaacgccctatgctgtgggcttgccgccaagccctagcggcacctctgtccttcaggggcatcatgcactgagctcattgtacccccggactatgactcaccctggggatctccaggagcaggttggcggcccggagactgagcaggcggctgctgatctgtcctcccgtggattgtgccacgagttcccacttatcgccccccgccatccttctccaagacccgatggcgcggtggtactctggcctggcggggtcctgcttgatgtcaaaggagagcctggcatgcactcgccgcaggcctgggtcctgcagggaggggcgtcgaggctgttggcacggacacatgggacagtgtgggtgcagaagggaatgcttcctaatgagtgccaacacctgcgacccagaaagcacaccattgtcttggagggctttgtccagggcttgggcagcgtctagcacactccaagtgtgagcagcttagaagtcagcaacccctttgctccaacatcagccaccctctcccaagactacacgtaccccccagccctgcagccgtttcaggcagggaagcaccaccaggttgaaagtgaccaggccgctaactgggttcccaggcaggccgaagacaagtaggggggccctgggaagcatacaggatgatgctcaggagcgatgtccatcctgaggatgtcgtcttccatgccataggccaacgcccccaagacagacctcgggggcggcggccagcattgcaggcactgcggcaaaccacaccatcttgcccaggcaccagcgagcctggccccaccccaccagacccatctccccatacctgccctcccgcggcacctccgcaaaggtgagtggcttgccgggcttcatgcacaccttgccaaagtgcactgtgccctgcgcttccaagaggggcttgatgtagtcacgctggcccatggacaccccacctgagaggagcgcgggaatgtgggtgcatgagaggcccatgctgtgaggagctgaagcacacagtgggccccgctccacatgccatcagctgggctgcctgcaccactcacatctcaaccttgcttgataccctcttgccacgccagtatgaccctcagccccatggcacctcccatgcctcccttcccggggtctgtaaacacccacccacaccagtcccccatcgtgtaccaacccgtttgcctccagctcccatggtctcaaggtgcaacccacccgtgatcagcatgacgtcagcgcccccatccagcgccctacggaatgccgccgtgctttcttcctcggtgtctcctgcgatgcccagatcctgcgccagcgcccccgcctcgctgaccgcggccatgagcatggccctgttggcgtccctgacctggcccggcccgagtgcgacggccgccggatccttgacttcgtcaccagtggaaagcacggccacgcgtggccggggataggcctgtggtcgagagtgctaggtagtggcttcatttttgctcccctggcagcgcgggggcagagcctgccaggcggctgtgcacctcaatggacaggcagcttccagcatgcctgcatgcagcaatgaggccccagtcccaccttcacggtgacggccccggagccggctaggatcccgatctccgcgggcagcaggtgatgccctgccggcaggatgacctcgccctgagcgacatcactcccgatctggtggtggtaaggggtggcggcaccacatctactcaataagacaaacatgtggcgggcatggcatgcgcgcatgccatgccctgactatccgcccctggagcccctgtactaccaaggaccaatgcctgcctacctgcctcacatcataccccggaccaggcacctccatgaggatcttgaccagtcgctggccacgatcgtccgctccctgatccagggtatcctcgatttggaccacggcatccgccccctcgggcagcggcccgcccgtaccgatgtaggccacggtgccgggggggagggtctccggctcagcccctgcaaacgcctcaaaagccacggggtaaatgccaggtccatcgacagccctgacagcataaccgtcctgcgatgaagaagtgtgatggacatttggaacaccaaaccccaggccacagacatcggcaggggcgggagcgggctccagaccggtcccccccaagcaccttaatgctggccctgtacgcggggattggatccctggccagcacatcttccgccagggtcagtcctagtgcatcgatgtagctgaactcctggggagggagcggcctcgtcgcgcccagcaccgtctcgacggcctccgccaccgacaccatggaatagtttgcggcaggtgttcgcaccggctccatggtgggcagagcaagctgaagtgcgtgagattctcgatccgattcgggtggacagctatggagtgcaccatcgcttagcatgatggtgctggaggagtcccggggagtgatctggcgcgcgcgcaaccgcgcacgtgcgtgttcggcaccccacaccccctctctctctgggggcatggccttccggtacagggcaggtccatgcccgcttcagatagcaactttgcggcacacaggcgggtctggcaggcccgggactcaccgcccccgcgccaaggccggcggcggcgtgttgaggaggtcgtgcaggggggtgcggggggcgcgccgccgcccctcctcgtccttccccggcccggtgaggggcgtccccgccctctgccccgtgccgggcgtcccgccctccgccctgccctggctgggcgtcgcgcgtgcgctcggggtggaggcccccagctcgacgcgcgccgcgcgcgcggcaaaggccagggatgacagcgactccggggcggaggcggggtccgggtccaggcagcacaccaggagcaccttgctagagccgcagagcgagtcctgcagcacctgggtcaggcgcgagttgcggaagggcacgtgcggcgcgcgtgtcgccagcgccgccatcacgtcccccagcgccgatagcgacttgttgatggcctgcgcctcccgcagctgctggcccgtcacctcggagcgcgcgacgcgctcggaacctgcaaggcgtttatgtttgtgtgtgtgtgcgtcggggtggggtgaatgcaggaagagggggaggcttcgaggaccggcggcgatgcacctgcagcttgctggccagcgcgccgatccaggcaccccgaatgggggcccaccccagggggcccttgtcaagcgacgcaaccctctcgttcaccttgtccaagtccacatccccgcccacccccgcccctcccttcctccttcccccc

SEQ ID NO: 18320 - DNA, 73 bp, Chlorella protothecoides
ataaaataacccttgttgctagtttttggcaaagtaatagaactattttatcaaaatatgttacaagagcttg

SEQ ID NO: 18321 - DNA, 10816 bp, Chlorella protothecoides
gcgccgcgcgcccgcgtggcccccgaccgccgcgccggagccctgctgggcatgctgcgccgccttgggccccgcggccttggtcaccgtgcaccagccagggctgcgcgagcgaggcgagcgaggcgagcgagggcaagcgagaatcggcggcgcgggctcgcatgtcacgaggggttcccccgccggcgcccccgcctgctctcctgctgtgcctgcgtcccccgccgcgccgctgtcccctgcagcgccggtctccgccgggccctcccgtgccgcgcaggcctccaccaccgcctcctctgcctcttcggcatcgccgtccaccgcgggcccagcggcggcagcctttgcccccgggacccctcccttgcccttcttcttggctttcttcttggccttctttcccgcgccaggcgccgccgcctggacacctcccgcccgcacgccctcgcccagcacctcggccagcagcgcctcctgcagcgcggccgacttggtctccagctcccgcaggcgttcctcaagcgccgcgcgcacgggcgtgcccgcgccggcgtagtccaacacgttgcgcccgcgccggtcgcggacagagaggctggcgccggcggccagcagcgcgcccagcgcgccacgcgcgccgttgcccgccgcgaacatgagcgcggtgcggcccagcgcgtcctgcagctccatggtggcgccgtgggccaggaggagctcgaccccggggcgggagtcggcggaggcgacgagcatgagggcggaggagccggagggggcccaggtgtcgcagaccgcgccgcgcgccagcagcgcccgcatggaggccagcgccgcctccgaccccgacccggagcaggccaggagcatggcgttcaggacctcgccgcgagaactggccaccgccaggtccacgggcgtccggcccgacgcgtcgggggccaagcatgcggccggaaacttggagcacacctggtagctgggcatgggcagaccggcctgggggtgcagaggaggaaagggaggggtgggggggtgggggcgcgaggggctgacatctgatgtggggtggtcagggtggagaggggtgtgccctgcgggcctctgagcgcactggtttggtagaaagcctgacgacggagacccgcgccccagcagcagggcacgagttccccccctgagcccaacaccgcatcgcaccccacctgggcggcgaggtgcaggggggtgtccccggcctcgtcctggatgctgccatccgctccacgctccagcaggagctccacgcagtcctcgtagccgcaggaggcggcgtggtgtagggcggtgcgacctggaccgggagggagggagcggtgggtttgggtggggggggtggggtcgcgagggcgagcgggttctcggttccctcctgaagccgcgagtcccgtcctcgaataacaatgatggggtgaacggctgacgacgctccgaccgcggcactcggaccaccgcgagccgggaggggccccctgcacagcatgcccacctgtctcatctttggcgttcaccacatcgcaggaggcctgatcgagggctagctttagtttatcagtcaagccgaggcgcgcggcagccaaaagcccttcggctggctcgtttcctctggccatcgggcttgccccagcatgacaagagagggggaagggcacgcggtctttccctatcgtctcataaaaaatggaaatataactactatgagctctgggtgagccctgtcagctaacgtagagccaaacgccggctgtccgcctgccgagtccactcacgtctctcgcgacagcgtgctgggcgggcacggaagggagtgtcaaccagactgggcactggaaaccaacatcgctcggcagggcatggcgggacttgcggggtggcaatgatcaagttcattcgtcccatcatcaattcagtatctgctcaagatgttgcgctggattgcggatttcgtgcgttgacgtgggctttcacgggttggcttgttttgtgttgtccggaaataagaacattgcacgagtgtatgcagcgtgtggcaccggaaaacaactcaagcaaggtcataaatgcaccagatttgatctgggagggagagggtgagggacgagctagtccatgagtctccagtgctcagggggatgcgcgttgtgaagctgcatcctcagaccctaacttgtctgaatcttaagagggaactgcagcacgcttagcacctttgcttactgctgttgataaagcattacaccgggggtgctggctgacagccttcaagctccgccctagaaatttacattaccctatagggtgggaccagggggagtcaggtcccatccaaacgggccttcacatctcgcttcacgagcagggccgtgttgagcgcggacattgcagcggcctcgagactgcctgccacactttccagcgcattattataccacaggccccgagccagcaggaagggactgaagtcctccggcggatcgctcctgcacagggcggcggtggaggacggcttgcgccggttccatggcatggaatcatgtgtggcggtccatcggaacacccgcagcaggtgcaatcccctccatcccgtatgcccccggtgcgccccacctggggtaggctgcccaggtcgtggcatcggccacttgccacccagcctcaaacacgatgctgagccaggcgtgggagagggttttcgggctcgtcagccgccacaggctgggctggcctggggccagctggaccttggccagggacgaaaaggggacgggggagtctgccgtcaccagcacacggcctgccgagttggaatgggcggcatgagacccagggatctcgggggcggccagctcgtgcttgccactcaaaaggtgtcgagtgcgagcgcctagaggcttggatctcagtgcaccatgcctcgggcgcagtggaaaggcccccatgctcatcccatcattttccagggtgtgtcccagagcctctgcaccccccgagcgcgcaccgtactgcagctgcgcggctaccggctgtccaaagtaggacgcacgcaccctccccctgaccagggtggttacggtggggacaaaggagcgaggaaagcgcggcgcgaggtcgggcacgcccgccaggtccagctggctgccctccaggggggcagccaggatgatgccatcgaagtcgccgctctgggcggcgatggcagcgcccccgccggccgccgcgtccgcccaggcgagctgcagccggtccgagccggggctccgtgcgatgctccgcacctcggcgcccagatgcaggctggcattggcggagtccagcagcgccgacgccaggccggggaagccgccctcgatgctgaaacccccgggatctgcagggggggtggggagggggtgggcagggggagacggcagaccggcatgggagtgactcggctggtatgagccatctccctgcctgggtaggcaggtgacgccgcaacaagaggccagcaagcacgtgccgcgggaaccccactgcacccagttgtgtgatcacgtcgcccgcagccctcacctgtgactgccaggagcgccgcagcaccagacagcgcgttcaactgcaggctggtttggccgtaggcggcgcgcgtgatggctcccaccacttccgtcttgaagagatcggtgccccacccgccctcccccagggcagcctgcgggttcaggccgtgcgcgttgagaaggcgcatggtagggcatgccatccatgcaggcaggcaggcatgggtccagtcgtggcgtcctcggctgttcactgtgtcctatatacttggcaactcctgggtgaaatgtaggagatcttccccaatacatctcccaatcctcacctctaccgcctcgaagagcgtgacctgggagtcatcatacactccagcggccctgaggaggtcctcaggtgagtcgtacgcctggccctgcgtctggagctcatacacagcgctgaaccgatcccagaactgggcggaatacctggtgggacgagagggaaaattggactggaaggtttgtgctcgagggaaatatctgaggggtagtctcactccccagcgctgctccgtggtaaccgcacaggccaaggttcccttcccttgcccctcccggcagacctctggagcagccaagggttgaggccccagcgccagacagccttaacgaggttgacgagccaccagggcgactccgcccagacgaggcttcgtccatcaaagatggcgggggggggaccccaatgtggccgatgaccgtcaggccctggctatcagccagttccctgatgtactgactgagggagggaggggttgagggaggcctgaggctagccgacatccaagtggagccccagggtaagcccttccacattccaatgcagaatttcgcagagcgacacgccggcttgcctgtggtgtgcgacctgatcgaatgcggtgtccaccgacgcattcccgatcggtgtggtggaagtccgccctcccacgctggtgctcctctcaaacctgcactcagtcaaacctgtgactgtcatgcagcgccaggtgaggggcaatcacacccttgaacatatgacatctccccaacctatgagtatcatgcatctcagacaaggcagtattccacatggatctggacacaccgcgcaggaggccaggactcacacagtgatctgaacttgatcgcccagcaggctcctaatccagtgcgctgatgctgcccctccgatccctgcgcccacgacaccgatgtgtggtccagatgacgcacataccatgcactgcaggccgatgaggagtgcgaggaggccgagatgctgcgtggcaccagcgggacccatgtcgaaggggtttcactaggtcatgcgggccctcggatagatgtgctaaagtcaacccagtatcgatttacacattcagcttgccgatgaatgaggattcgagcaagttgccctccatgcaggttgcccgtataatgtgttattcgtgtcgtgcagatcatgcagccagacacatgctcaaaccttttctatttcgtcggcaaattagatctcaggggaccactgcccaggctgtgtacatcttgtgacctaccctagcgtaatccccagctgtcgtcaatcaaggcacttggcagcataggacgcactccgggtcccttgcatgggaaacccagtggtggagcacagccccccgccaccaccccagctcaccgccgaggagtatcgggagtggaggcagacgagggacgctgagagggcagcgcgtgtggcacagcatgcggtggatcgggaggccggcatcctgtctgggagcatcccccccgaacagctcacggggagggagttggccaggcactacccagagctctttgacggctactgactctcgagcttgtatccttccaggctctggcgtgattgcgcatgtgccatgatgttaatctgcttggggtgaggcaatgcagagtgcatgcgtgatcccccccatgggagggggcgatgaaggggccgacgccatgcatcgaaaaaagaggactctcgagacacatgggctctcagctctcgtagttgcacacagacagaacacacccgccgccctggaggaggggcgaggtgtgtgggtgggggttccccagggggtggggcagggggcccagcatgcgtgctgggcccggctgggcggccgcggcatcccaggcacggtccaaaggcggcgcacgccgccgtcctccaggcctcccaacctcggaccgtgcacacgccggtgtggcggccgcgctttctccccctccccccccatcacttggaggagttggagttgctgcgcagccgggccagcagcccgcctgtcagctgcgacttctggcgtggcaccgccggctggccggcgcccgggcgctgcgagggcgccactgcccccgcgccggtggaggcgttggacgcggcgctggagccggcccgcggagtggccgcgggcgaggggccggcgctgggtggcgcgggcgcggcaacgccaaccagcgcctcggggcggtcctggttccggtacgtgttgtacagctcctccatgcgcgccttgagttgctcgaaggtgggccgcgcggcggggtcgcgcacccagcaggcgcgcatggtctccgccagcgcgggggggcagttgagcggcagcggcgggcgcaggcccttctgcaccacccccaccgcggcctggagcggggtcatgtcggcgtagggcacgcgccccgtcagcagttcccagagcacgatgccaaaggagaagacatcggcctccacgccgtagggctggtgctcgatcacctccggcgccatccagcggtacgtccccgtctccgcggtcatgacgcccgtgtggtccagcacgcgggccacgccaaagtccgcgatcttcaccacccccgtctcgtccagcagcaggttggcggccttcaggtcgcggtgcacgatgcgccgcttgtgcaggtagtccatgccgcggcacacctccagcgcaaacttgagcacctgggatacgcgcagcgggcccgtctgcacggagttgggtggtgtgtgtgtgtgtgtgtttgggggggggggggggatcagtttgatttttgggggtttaggcaggggaggaggatgagggggtgatgcgcccaagcccgagcccgcagcggtgatgaggcaggggaccctggtgctggcatccgacctttgagaccacatgcacgctgcgatactcgccctggatgcaccagccccaaagcgccaccccctccccctcctcccctcacttccccacaatccacccccccacacacgcaccttgcggatgtattcgtagaccgagccgcgctgcatgtactcgaatacaatgcacaggttgggcttcttggtgcaggcgccgatgaactggaccacgttcttgtggcgcaccttgcgcatgatggcgatctcctgcaggaattcggagaactgggccgcagtgccctgcaccgcgcgcaggatcttgatcgccacgtcctgcccgcagtacgacccgcggtacaggtcgccaaacgcgccggacgcgatcttctcatggaacatgacgtcgctggggtccagctcccagtcgctgtccagggaggagcccgcggccgcgccagatgcctcctgtgcgtgtcgattggtgagtgagtgtataaagggtatctcacacgcatacgatgcgtgtgtttcaagaggggtgtacagtgcgcatgcggccctcctcaaccccccggcgacgtgcgcgccaccacccgagtgccacacaaggatctcgccgaacacccttccacccctccacctccgaaccctcacccgctgcaggcccaggaggtcctcggggttcacccgctgctccgacagcgggctcagcggcttgctgtgctcctgcgcgccgcgctgcgctggggcatcccgcgcgcctgcggcgccgccgcgggcgccagccaccagcgggggcggcagctcctgcaggcgctgactcagagtctcctcaaactcctcgctgccgccgccgaaccagccgttcaccacgaagacgtccagggagtagtggtcgcgcgtgttgaaggcgtgcgcctcgcatatgttcagcccgatgtcgcccaggcactcgctgagccggctgagcagtttgggctggtcgatggaggcgatggtcacctcgtagaagacggcggcggccgacaggctggcgtgcacgttgctggaggcctgcgcctccatccgctcctccgcctccagcaccagggcctggaggttgggtgaggagccgaaggcggggcgcgggagcgggcgcgggaggtggcgcagcggggacagcgggggcggcgtcagcgacgccgactggtgcgtctgcgggagggtggggggtggggtggggaggtgaaacgtgggaagggagcctggggcagagtacacaacgcgggtggaaggtgctggcagcatttccagacacaagggcgtgggacatgccaggggcgggcttggtcgccttcataccacatggtagccgggcggcgcgaccaccgcccatccagcacccacaggctcatgcagagcgggatggggagccagccatggttttccgaaagaaccgctcatcccctagaaccacacctcggccgcagcgcacctctaaggagccctcggtcaggaagctgttggacggcactcggcctgcgatgccggttcccgttatcacgtcgacgggccggacctggaagctcaccgcgctgggttcagcgcgtgcactgtccagcagccgcttgtggttgagcacatccagggactcgatgttgacgtcgaaggcatacctgtggcaaccgtggggatggtggactcgcaaacgccccgcggactcgtagccgcctccaccgacatcatttagaccccatcttacctcgacggcaggctgtcgaagtgctccaggaccccctggatgaaccccggggcgtccacatcgaaaccttcccgcttccggagctgttctatgaaggactcggccacctcgcgtttaccccgcctcctgaacgactcgccctgcgcccatttgggcgtgtcgttggtatcagggctcattcctcggcatgctgcaggatgaacaagacttccgaagctggagggactgcttgagtggcctatggtcacaagggtggccattcacagggagctatcaggggcataggagtggcccactccggccgaaagagagcagtgatgtatgattccggggatgggcgagagttcgtgggggaaaggcttcacattgtgcccacccgcccatgcccccgcccatgatgatagtccgagtcacgtgtgtgttttggcccctgcccggtatctccgtgctggtgagccaccgggtgagtatgaggagacgcctctgcgcatcacatgccctccgcccctttgaggagttacacaaattgtgccaattgtatcgtggacgaagcctcgtgcaatgtactggcctacgtcaaatgctttaaagagaggggaggatttccgcaagattcgctttgttcaggcattcgtcatggtctgaggcacgatgctcgggtgcactgtggcgaaaatcgaagctatccattgtattcagcaagcttctgagtggtcgctgaagtgtgcgctggcggtggccagtggcggtggggttcacggagtccgtacgaaaatggatgcgtggctcgtagggtcagctaaccttgtcattcaatgcggggcaaggtcctcgcctcctcctgttctttcaggctggggttgcaccaggccggagtgatccatgcttctcgtgcagaatgcttgcagaaactaccacagagcacagagtaaccggcctggtaccgttaaagcatggccaaacctcaatacacaaacttggtcagcatgacaggctggggatgtgcgttgccttctaaagcaaggggcttgaagtccttgttggacattgccggatccgagtataacaatggttgtagagctctctcctcattggcaaataagtcattacctcagcatggcccacagaattgcactgcttggcacccgcttgccttgccttatgcatatgatgtcgattaggaattttcccgaggacacatgtgcccagcaggctgttacttgcccattagacatgcaagaccatgttgggttcttttcaatacttcatgaaccccacctccaatgccggagttgggaatttcacagagcaagctgtccctttcagatgttgcccggtgtgtgaaatgattcgtgtgagccctattatccttggatgtcctcccccatctggacaggtggcggtgtgacagtaagctttgctcccagctgccacgttggaggagcagcagacttttggtaagccgtgcgatgatcttgtcaagaggggtgctgtgcatcaaatttctgattgcgaagtccgtggctgatacacacctccccgcactagcgtcctctcctctccgcggcatgcgttgcatgactatgcacacattccatccatcgcgacgatgatgtgaaaggctgttaagccgtggcctgctgggtgggtcgagcgcggatcgcttcaccacgggcccccggggagtgcggcatcatggcctgcactctcgacaaggtgcgcgcaagcatgagtatatgtggggttgccgtgcttgtttgtattggcgttgcactcgtcgcaaaatcgatcgatggtctgccctcgtcccctccgacaccatgcccagatgctgatcaagggcatcaggtccttcagccccgacaatcaggccgtcatcgagttctacaggccactcaccctcattgtgggtcacaatggagcgggaaagacggtgcgtgggtttctgtgaccggtgcagaccggggcccatgccgctgcatgctggtgcagtggcagccggcccacccatcggtcattaagggagcaagggtgtgcaccagccacagcatgcgcatgaaaccattcccttctgcctccacctcgacagaccgtcattgaatgcctcaagatggcttgcacgggggagctcccgcccaacactcgttcggggcagagctttgtccacgaccctaaggtactattccgcacatgcgggggtgggatggggtatgtctgcatcagacgccgttcctgcactcatcccccacgcatctcccaatcatgccattaacgtggatctccacaccaacgcgcacgctcccccccccctacccc

SEQ ID NO: 18322 - DNA, 259 bp, Chlorella protothecoides
caggcggaaggtggagtagggcaggatgcgtacgcggtggccctggcgagttgtgtgtgtgtgtgtgcgtgttgggggaggggggagatgcaggctttggagatgggaaggagactagcgtcatgcgatgcatcacgacagcctgggtctgagcacggctcgacagcgggcactgagtgcccgccatacaaagtgacatccctggggagggccgcacggcagtgcaaccccagtgtccccctgggacccagcgacgctg

SEQ ID NO: 18323 - DNA, 74 bp, Chlorella protothecoides
acttttttatggcacgcacaaaatttgaacgtaaaaaaccacacgttaatattggtactattggtcatgtggat

SEQ ID NO: 18324 - DNA, 136 bp, Chlorella protothecoides
gttgataattttcttttgggaaaattggagccaacagtgagagaccactctggaaaagctagaattctaatggcgttccttgaagcaggacgcttgacagtttcaggtgggcagtttgactggggcggtcatctct

SEQ ID NO: 18325 - DNA, 76 bp, Chlorella protothecoides
gtattgtggggcttttcgcgctttttttaatccatatttacgtcgttctttaatacgagcatcccgagttaaaaaa

SEQ ID NO: 18326 - DNA, 131 bp, Chlorella protothecoides
aaacctcgactaaatataatgcttatatttctgtcaatgggggtggtttaagtgcacaagctcaagctattagattaacattatgtaaagcgtttatcgaacttattccagaattaagagcttcttttaaa

SEQ ID NO: 18327 - DNA, 152 bp, Chlorella protothecoides
tgatatttattacaataaatatcatttattccgttaagatttattaccaccaacgataacgaatatttgcacgattggtgatagctgcagtatgcaactcatcgcgtttttgtctagcttttccttgtttggaataggcttgatatatttca

SEQ ID NO: 18328 - DNA, 206 bp, Chlorella protothecoides
ctgggtctccattgcctgccactgtctcaatgctagcgctcccatacggaaggttgcggtgctcaatgacaatggaatcacctggatcactgggcaagctgatgagaccagacctggacgatggtaagtggtcgtccgcaggcccatgtggagtcccgccgcgcttcactgtttgacatcagtacctacagagtgctcatgtctgg

SEQ ID NO: 18329 - DNA, 160 bp, Chlorella protothecoides
cctccggcagacccccgctcccagccctcagagccaatccttttcccgaagttacggatccattttgccgacttcccttatctacattattctatcgactagaggctgttcaccttggagacctgatgcggttatgggtacgacctggcaagatcggagg

SEQ ID NO: 18330 - DNA, 284 bp, Chlorella protothecoides
cgatcctaagagatggggtagtcctgtgtcaagggtgcaatcgcgcaccgcccatcgaaagggaaaagggtcaagattcccttacctggacaaggcggctgacggcaacgtgagcgagcccggagacgccggcgttggccctgggaagagttctcttttcttcttgacagctcgaaggccctggaatcgagtcattcggagatagggctcagaagctggcacagcaccgcagctttcgcggtgtccggcgcgccaacgacggcccttgaaaatccgggggagca

SEQ ID NO: 18331 - DNA, 97 bp, Chlorella protothecoides
gtactcggtccggcccagcaaccaacgggtatgctcttggaccgggtagaaggactacccggcctatggtgagtcgggtgaggcggcattgggagag

SEQ ID NO: 18332 - DNA, 140 bp, Chlorella protothecoides
acaccagccaccctggggcaacacccacgcacttggtcgctgcaacacccccccaccctaaccaagcatacccacccaggcccccaaccccaacaaagaggatataataataaaagaacaaatcgtgacgacgacggctg

SEQ ID NO: 18333 - DNA, 15181 bp, Chlorella protothecoides
gccccctcccaagaagagccccccgcccccatctaagaagagcccgccaccctcaagcaggaagagtcccccctcaacctcccaaaagtccccaccaccaccatccaagaagaagtccccgccgacacccacaaagaagtcgcctcctccacccaacaagaaatcgccttctcccaccaagaagaggcccccacctccaacaaagtagagttcccagtcagctacaaagagtccaccgatctctcggacaatatgatcaccttccacacacccacattcaccccactacccccggcccctcatcattatttacaaccagaaccatcaccacttttccatacacaagggtgcgatcaggaatgattcacgccatgaggccctgcccttcctcaacactttcccatcgaaccttgtgctcaagacgagggtgtagtttaccattgattaaaccccaccaaacattgatcattgtattaaaaccactgtcaaaccgctataccctcctagagttgacacccatccacctgactcaccctttggcaccacaaactgcagtgataacattgataactgcgcaaatctccagacccgtcttcaacagagggttggtccccctcaactttccccctgcattgtcctgacagagtgcactgatgttacagtgaccgcaatctcagagaatcatacacagctttggtgcacggaaggtctgtacactggcgaagatgcattggcaagacaaagtatcacagcctgtcctggctgcaagttcacacaaccaggcttccagcgacatcgatgacaaacctgccaagagggtgtggagtgcacaacaatcatgcgacattccagcaatacttatctgaagggcaagccacatctgttcaggatgcaggcctgacaccgtggaatctcccacatgcataaaaggtcccgtcccctggtcaacccactcacctgtacttgacatcgttcttttccagacgctccatggcctcattgatgtaattgatgtcgatcagctcgatcttgcacgtgatctgcttctcagcgcagaagtcaatcatttcctgcacgagggggcgtggcatccgttggaaccaggcgcaaggctttggccaccatccccctccactgcatgttcgaatcagattccatggcaggaagcagcgtccatgatcccatccctcccccccccccgccccctgcacatcccacctgggtctccttgatggagccgatggcgctgccccccagggtcctgcgcttgaagatcaggctgccggcggcgatgggcaggggcatgttgggcaggcccaccatgaccagcgcgccgttgagcttgagcaggctcaggtactggttcaggtcgtgcttggccgacacggtgtcgatgatgccgtccagcgtggtggcgtgcctcttcatgtcctcctcgctgctgctcaccacaaagtggtcggcgccaaactcctccagcgcctccttctccttggcgggagaggtggagatgacggtgacctccgcgccaaaggccttgccaaacttgactgccatgtggcccaggccgcccaggcccaccacacccagcttggtgccgggcttgtccaggccccagtggcgcaggggggagtaggtggtgatcccagcgcagagcaggggcgcccctgcggccaggtccagggtgtctgggaacttgacgatgaacttctcgtccgtcacagtgtgggtggagtagccgccctgggtggcgcgcccatccttgcccgtggagttgtaagtccaggtgacgttgtcgcagaactgctccaggtcctgctggcaggcgtcgcaggagcggcaggagtccaccatgcagcccactgccgcgcggtcgccgaccttgaccttggtcacctcggcacccacctcagtcacgatgcccaccagttcgtggccggggaccatggggaaggtggacccgccccagtcgttcttgatctggtgcaggtcggagtggcagacgccgcagtgggtgattgcgaaggccacgtccttggggcccaccgcccggcgctcgaagcgcatgggcgccagatggccagacttgtccttggcggcgaagcctaggcagtctccagagccctcggcgtcggggtgggtgggggccttggacaccgccttggtgaactcgtcaaaggaggagggacctgggataaaggagggattggaaggatgtgcgcgtgagaagccgtgatcgctggactggggtgagcctgatcacgatcttgatcacatgcccagccgtgccagccggcaaccggacaccccccgaccgcttcggaaaactcactcttggacttctccccgccgtacttgctgatcagctcaacaacatcctgcatgattccagagcaaagccataggtaattgatccaggcatcgaaagtgaaggagcaccctcacaccttcccgacaacatcccttcccacccgacgacccttacatcatcccacgaccaacaacgagcacccacatcggaggtgaggttcttggcagtggcctcggtcctgtagatggcaaatgcacgcgagtgctgcttggcctcagccggactgatggtgaaacccatacttgctcttgtggatgtctcgcacttcgagcggaaactgactgcaaaggaggttctccaggaactcgatgatttttgtaagaaacaatagagatatgcaaggtttgtgtggatgatgtgaggttttatattccttcgaggggggggtgagtgatgctgcgaatgtacaatttcctatggtaattcgttgggtaatcggtttccgcgcgcggcccagcgaccacaagtagcgatgacgaagctcccaaccttgctcctccacagcaagggtcagcgggtactatgcaccacaaaacaactcagggtccccatacaaacgttcgatttccgtctcactccgcaagaagaatctcagtgggggcagcgggagctgggttagccatacagggctcgcctggcgtgcagagacctggccgggaaccttctcccacacaggttccactgggtgcggtccttgtgacggcagtgctcttatggatggcacatcctcactgccgctccagtgttctttatcagcccaggcatgcctggagaggtggccgtcaggaagcctccagggaggcgtcatcattggtccaggggctgatgcgtccctctgcctggcccgatgccccaccacctcctcgccccaccatgccaccatgagggtgatgcgtggctcgacatgcgaggaccctctccctgcgtgcatgagcagaatcgttcctgtggctgtcaggcaccaaatctggggcatcgtatcctttctgcacaccggcacgctgatcccgtgtagagtggcagggagagacaagcggtcgatgttcgagcccacaggccacacccctgtcccctctgcatgccagccacctgaccgacctggttttgggaggacgccgtgcagcagcctgccctcaaagaggagtagggagcctggaaagggaggcaccagccacgctcgcgtcgctgctgcgggtttccccagccactcctccagcaccagcgtcgcaccggccccctcccccgccaggaacaggacgctgctcagcagcggatgctgcacgcgatactcgctcttgccgtgccccagccaccgctcatctgcgggcgggcagggatggggagggtggtgcgggtctacagcggccgccttgtgacaaggccacgccccgagatctggtcacaggcgcatgcacatgattctccattcctgacacagcacaacccccatgagcggtcacacgcctggatctcaccgacatcataatggagctggtgagcctcgtcgctcgccctgcagtgggcccaaacctctgcatgcgtggcctgctgcagtgcccccgccaacgggtgaggggatgaggctatgcaccgggccagggccgagacagtctcctccagcggatggccatacatcgcggcctcatcgggaccgtgccgtgggatcgggaagaggtgggaggaaaaaggcatacccctgcctccatgcgcagcccagtaggggctcgcaggcgacaagcccttgcacagagaggctgccaggggagggggaagcagcgcagggaggcataccagcctgggggactggcagccaggcggtgcctccatggcaggttgcgaggatgaggcctgaagcatggaacgggagaggcgaaggcggcaacccagagcagtcaggatgcagtcagctggcccgacgacacctccctggagaagggcgagggcctgtgatggacgaggttgagcccggtgtgtgtgtctggtattatataggacacgagggaaggtcagcctgggtactactgcttcatccactactcaccgagaggtacagtgcctctcccagcactgtctgcgctgatgcgctgcatggacacgttgcatggctattacagaaaatcaggaatgcagcgctcagatcggctgctagctgcagctcggcctgtgaatgccatgcccattggatgagggttctttggggtctaaaagatatcttgggagatactcgggtactcaccgagctcgggcgcacccggtactggcggatgcgtccagccaagccacccaccttgtcgaggcaagcgcccatgctcttgctgaaggaaagaattgccttatccagaggctgacgccggtgggtctccatgtcgaccatgtactttgagcagaatcacgtggccttgctgcggcagcgatgtgaccatgaattttcgcgtgcggcgctggctgccgagtcccgagttcgcaacattataagagtaacttttggcgaatgggtaaggtgcctactggaccctatgagcagtcgcgcaggctgtcgcacctcccacaggacgaacgaggaaagctggaatgggacacacagcgcgcgagcagggtttggcactcctgtgtggtggcatggcaaccacggtccaggccccgagcagggccggatcgactcgacaccccatcatccgcccctgcaggcaagacacttggggattggccggcggcaattgggcatcgtagtctgcgaaatgccagcccaagccaccacggtgtcagcgacgggtcgcacctaggcaggggagtgctcgccaaatggctctggggtcaggggctatgactgcagcgctgcaacgacccatctggacgctcccgaggaccctttggtccccccggcccaggcgggtcgacgccaggcagagcacccgaccaagcccccggggtgtcatcatcgaggcctatgccgtgccagggcccttgtacatcacggcatccttcgacagggatcgcctatctgggttaactcccccccgattgctgcccaaccaatcattcctgcagtttccatccaggtcaaaggatttgaggtggtgctctcggtccctgctgccccccaatggccccctgattgcattgcagcttgccctggtcccatctgagaagttcgaatgcctcaggagcacgcgcggaccggcttcctggcgtcacactgcacccctccacccctccactcgcagggaggaggaggtggagccccgccgggcggagcctcccctcgtccgggtccggctgcacgtccactaccgcgtccactcccgccagatgctgtgcgtggcaggctccgccatcccctttggctggtccttcctctccatcgccaaggtgcccatgtcctgggcgccggacgacctgtggggcgtggaggtggagcttccgccggggacgaagctcgactacaagtatgtcatcctggaggaacaggactggacgcagcaggtgggaggatctcttgggtttcgaggaaggtgccctgcatcggcgggagctccggcatggatcgcgcactcggggtcagccctggtctcccaggaacctccgctgcttgaggtgccggctgctgcccggccagcccggggggcggtagccccatgcaccagcccatgcctgccctcgcacatatcaaaaagtctgaagggtactgcatgcctcccaccccgccgtcttgcaggtgaacgaggccgcagaggggcgggtgcagtactcgtaccgtatggagccggagacctcccccccggacgtccagcacatcaccaagcagatggccattgttgcctggcagcccggccccaaccgccagctcagcgtgcccacggaggaggagctggcggccctgaagcccggggtcaggctggaccgggcccctcccccccacagtgccgccgccagcggccccaccgccggcggctcgcccatcggcggggggcagagggggtacggcgcgcaagctctgggtcggaccaggtcggcccagccgccgcccttcacggggagcggtgccgccgccagcatgccgccgcgccaggaggagctgacggggatgtgggaggtgctgacgctggatgccgacggccgccctgcgctggagagaagggatgtgtgggggagggaggagcccccgccccgctctgtaggacgaagcacctggtcagatgggctgtaggcaggtggcggagggcccggtctccaggcctgcccaggtccaggtgagggcagtgggtggtgtagggggcgagtgctgaggccgtggaaatggcacgccttgcgctcatcctgctgctagttctctaaacgttgcgtcctctgtccccttgccgccacgtgcagatgtttccctacacgccagcgccggcttccgagtcctggaagtgtccagcgaccctgtacgcttggcgtcgctcctctacagtgcttgtgacttcttcctacctccctccgtgctcctctgccttcccgctgggtgtgtctgctgctatgttcatgcccctcccccgcccgactgagccgatagagtccccctgccagggggcggcaactgtacaaccagcctcaaatgctgccatggtggtggggcgggtctgcctgcagactggatgcggggattacatgatgactgctggggatgggcgatacttggggaaggggggaaccctggactcgcgggcaggcaaccgtcgttacggggccttgccaaccacaagtccaggtcaagctgctgcacgaggggtgccgctcatcggtgggcgctgcagtgccggggagggtgcccatacccgggcctgagttggcacagtggagccctctccccgcaagccgaggggggatattatctcgccatgccgtctcggccccaggcaggtgggcggcccttctcctgtgcccgacgctgcaaggccgaggctgctgggcattccatctgggagatcttccccgattctgggttgccacccccaattcgcacgggcagtggtttccggtgctgaggccaggccctcactgcatgtccatgtccagcccgtcggcgtgcagctggtccagggtcaggtctgagagcgagaagttccgcggcggcatggacaagtcagcgccacctccgcccgcgtggccggtgtggccgaggatggacagagggttctgaatcaacagagggggtaaaggtaggagagggggcaactgggcgctgagcggacgcacagagtccagacctcccttccaaggggcaaacaaagcacgcaactgcagaatccttccctccatatcaaaggcacctgcactgaaatactgtcccacacccgcagcagattccccctgccatccctacctgcgccagggccgacaccaggtctggttccgaggggcacaagcgcatgcccgggaagagtgggacttgggcctgtgccccagactccagcaaggagggtcccaggtttgggtacaggaagccattggctgtggaatgggggcaacggggcgagggctgtgtgtgtttgtgtggggggtaataaattgcggtaccccgggcgagcattacaggttcatggggccgggctttggtcaatgactgaccacccggtcctctcgcagcagcccacggcatgaaacgcacatcccttcccaaggaacatggcacccccgatatccctgcccgcacctgatctcgtgtcggtgtcgcccagcccagatgccagcccacccccctcccttcccgggccccctgagtgcaggggccccgactggaagagggggatgccggaggcggtggcggatgtggtgggcccgctgcctccgctccccagcctgcctgctccaaactgctgggcctgctgcgtcggcacccacccatgctgcatgcgctgcggggggaaacatggagggtctgagggttgcagactgagcatggccacctgctccttcccagctatgatggcctccgagacagccccatcccacagcatcagacagccacaaggcgccaaccgcctgcctttgcctgcacatatgcaccgcacaggggtcccccgctgtcctcttgcagtcgatctgtcctaatctgcagcaccccccacatacccacctgcaccacttggacctgctgctccagcaggtggttgaacatgatgatctggcctttgagcttcaggcgcaggttgtaggcggcgaagaagtcggggttctgttcctccagcttctgccacaccagctgcgtaaagcccggctctatggtggcctgcgccgacaggatcttcaccacctcgccctgcgccaggtagacctgcaggcagcgttcgatcaggttctggaccagctggatgtcggcggtggacacgggggaggacacccctggcgcgcagggcgactcgctgctggacagggggccccgccccaggcccaggctgctcccgcccccgctcagggagttggaggtgctcgtagcggcgctgcaggtggaggggccgggggggtgccgcgccttgcgctgcaggggcagggggtgcacctggagcgcggcacggggcaatgcggggggcaggccgttcgggaaggcatcctgggggagcagggttttccccggcggggcgcgcaggacggggacgtccacagggccgggagagggagaggtggcccctgtctccctccctgcctgatctcgatcgaggctggaagtcgggagagacatctgtagcgtggcagacgttgccattctaccacatcgaagggaggcggggaggcgacgtgggggtgatgcacatcgcgaatcgtggccttgcgatgggggtccgtgcgagaagccccgattcgcacaatctcgccacaccaagcgtgcgataaaccgaacaatgtgccccaagataactagggtgtggattggagaaggctccgcgcctctcactgtgcgcgaagttgcccagactgggtgttacttccggccatgactgacgtgtcgtcaagtcgataagctgggagtcggggacaaactccgcggagtgccccccatgtcgatactcagcccgcccgccccatacaatgtggagcaggaggcaccatgtccttgtatacatgttctattaccctagattttgtctctgcatgcgagattcggcggcataggtgcagtgggcgctgcaaaggctgtagtccttcagaggtttattggcctaatatcgaccattcagcacagcgatacatctccgggtggtttattactcaaattcaaaggaaggttgcctggttcatgtgtaatggcggacccatgggtgccgtacttcgtagaaatggagaagcagacaggatgggctgagtacggtacggctcctggaggtcgagatttgtatgcagacgtggacgaacaggcaagggatagaagaccgtcacggtgctatgtccccatgagcctgcagtcgagcggtcgagatttgagccttctggacagtgcggccctatgctgagctgcaagatgtctgtgttaaggggtgactgctctcacttagggggaggtgcatgcttcagagaggagaatgtcagccattccgtgcagcaacactcccattgaccagggtagagctcccttgagcaaggtgtgtactgcaagtcaaactatggcaagtaagacttcccggtgtgtgtgatcaagactccccataacgacctttcgcaccccttgaaagattcaagaacacattccaatctcttgaggcaggagttgggcggctctggttgccaggacaaatcgatggttgtcgctaccactgatgggaggactcaataatgtgcgatcttctgaaggcaaacgccagtcacggagccatgagtgatatcgcaacagctacattctatctctgtggattggaacaatgagacaggggtccagacactcatctttcttcaaacataaaccagcacggcgagacggtctcgccgtctgaacggcgtgcgcagactagctccatcgatctgatccgctgcattgtcactggatggaacaagcactgaagtacacgagcattggacgggcgggagctataagacgagaaatgcaaggtattgaggtgacctggcgacgcacatcggcgtcagatcggatgccagcgtggcgcccccggcgacgtcggattgtgagcccttctgacaccagcgcgcagtgcatcatgcgcaggccgtgggtgccctagctatttccatagcaagagtgtcccactcactggtgagggttgggttgccctgctgaccagcgcatcgccatggcgcctgggtcggtggatatcaacgtgctgcccggcaaggaggccggcctgttccgccagctggtgaagcagtacgaggtggggccggtggatggttgatgaataatatgcctaaattgtttgatctgcatatcagcccgggagggatgaggctccacaccgagcaggcgcctgacggcgatgacgccgctgccccgaggtactcgatgatggaacgcacagcggcacctcgctggcaaaatccgacgtacatcaagaggtccttgcgccgagaccaagcatctcttggcctgatttcaatcaccccctccgtcgtctctgcagaccaagcagtacaagaaggggctgaagacggcagacgccatcctcaagcgcttttccgagcatggggagacgctggccatgaaagggctgctccagaattgcctgggacacaaggaggttgccatggacctcgtcaaacggggcgtgaagaacaacctgaggagccacgtgtgctggcatgtctttgggtgagtacgctgtgggcttgatatgtgcgacgcatgtgaggcggcgtggaagaaggtcccacacatcgtttccctgcatgcaggggatctggggctccacggcttcccctgcctgcaggaccactcccagcacctgaacaagcacatccctcccctccccacacccagcctcatccagcaatcggatgagaactttgacgaggccatgaagtgctacaagaacgccctgcgcatcgaccgcgagaatctgaccatcctcagggacctggcggtgctgcaggtgcccagagagttggcggggggggctggggtgctgtggggcaggctctgcaggttgcagcaacggtcagcggtgcggcctgggtgtggctgcagcacctcatctgtccctatgacgctcaaccggcgattgggacgtccagtttgcactctcgttctgctcctcttcgtgatgggcatgcctcccaaaggcgctcaaccgctccataccccatcccctcccaaacatgatcgccccttcgcagatccagatgcgcgacctacccggcttcctggagacgcgccagacgctgctggagctcaaggccaccaaccgacagaattggctggcctttgccgtggcgcaccacctgaacggcaaccacgatgtggcagtcaaggtgctggacagctatggggccaccatggacgaggaagccgcggcgcatgaaccctacgagactagtgaggtgctcctgtacaaggcgcagatcctggaggaaggtgggtgggagtttctcctttctggggggttggggttggggtggggggtattgggtatgtgtcagggagggagaaggtcacaaaaagaagctaggcgtatgtcccgtcagaagacttgcggacttcttgtggtgatgtggggtgtggggtggtctttcccctctctgcatgccaaggaggtggggcctgtgcatggaccgacttgctgggcaaagtggagcacaggcctggtcatttcagcagcctcgttttctgtcgcacaggcggccaggcagaggaggcactggcggccatcgatgcggcggtcggcaagcgcctgctcaaggacaggctgggggtgctgaccggccgggcacgcctactcaccaagctggggcggactgaggaggccgagggcgtgtactggtgagcagtgcctgagagcacagccgtggctcacaggatgggggtgctcatccgaggcaagctcctgcctgacctaccccaaccctcacctgtgcggtccccacctcgtgccagggagctgctgggaatcaacccggagaaccaccagtaccatgctgggttgcggacggcgctgggtctcgacacccctgatgtccagctcaccgcggagcagcggcagaggctgtctgacatctacgcccgcctgcagcgcaagttcccaaagagcactgcagccaagcgcatccccctcgacttcctggtgggtgccatggactggctgttccgttgtgctcttgggcaagggccgtatgtcgtttcccttttaggggagttggttgtgtttgaatagttcctggcaagctcacacactggccatgccgccacactaaccagaccggggaggactttaagacggcaatcggcgcctatgtgcggccatacctcgtgcgcggcgtcccatctctcttctctggtgaggtggtagaggacttggaagaatgcggggattacatctgctatcagcagaccgcacacatactgttccaagcaagtcagtgcttgcattgacacgaaatggaaactccacccatcattttcgcaccacccccttcccccatcccttcactcacagacctgcggccgctgcttgccgaccctgcaaagtctgcagccctggatgcgctgtttgaggggctggaggcatcgctggtcgaagggcggggcctcccgccgctggagactgcatccccagcctctgccacggctccctccaccaccggacccccctcccccgaggacaaccccctggtgtgggtgcgcctattccgggcacaggtggcgaacttggcggggcgcagccgcgaggcgctggcggcggtggacgcctgcctggccgactgcccgggcctgccagacgcgctgaccgtgcgggcgggggttctggggcgcgccggcgacctggcgggcgcggccgaggccgccgacgcagcgcgtcgcgccgacctggctgaccgctttgtcaactgcgcggcggtggccgccatgtttgccgcggggcgctgcgccgacgcggaggagaccgcggcgctgttcacgcgggagggcgagcacaccaacaacctgtacgacatgcaggcgacgtggtacgaggtggcggcgggccgggcctacctggcccgcggtgaccacggcaaggtgagacggggagggatgctgatgagggtgaagtgctgagtctttttatttggggggggggaggggggggaagagcacctgggaggcagaggcgggattgatgcagggcgctgtcattgtcaatagcaatcgtcccctgcagtccacaagcaatgtgccgcagcttccggcgtcagctccctcagtacatcaatgcttgccggtgcaggccctgaagcggttcctgaaggtggtgtcccacttcaaggagttccgggacgaccagtttgacttccacaactactgcctgcgcaagcacgtacgtgtgggccttgggaacgggggggccggcatgctctgggagcgagcctgtgtgccatctggaagcatgccaggggtgtgaacaaaggtcaccggccacaaccctcgtggcttggaccagctgattgctggcaaacggccctcagccgaacatgcccgcctctcacacccagtcgttccctccaaattatccactgctgcagacgctgcgggcatatatggatctcctccgatttgaggacgagctgtactctcacccagcctacgccgaggtggggatggctggatgcagggccgggaggggtgatgtctgcaggagacccagtgtttcaaggcatgttcgaggatgagctatgaagcacaagtggtgcttaccacaccgctcagcccctgtacgcccccaccatccctcattcagggcgcctacggcgcaatagaaacctacatccaactccatgaggctgcaacgaaggcggccgcagcaaaggcggaggcagccaatggcgcttcggcagaggatgccaagaagtgaggatgcagattggtgggcttgggggagggtcagttccccggagatgcctgtgctccccgctccccgcccagcactgattagtattgcatctcactgacgtgctgcgtgaacatccaccctgcaccaccatgatgtgccgacccaaccaatccccttatgacgaccatctagggcgcgacagaaggccaggaaagaggagcagcggcgagccaaggaggcggccgctgccgctgcagcggaacaggaggctgccaagaaggatggcaagcccgccgccaagggcaagaagtgagtgggtgtgcagtggccttggatgtcgggacggtggcgtggcacctcagatggtcgtgaggccctcgagcgcctgcaggaagatacacccgtgccgccacgcctcaccccgcgcgctcaactccaccccccttccctgcctcacagggaccccgacccggacggcgtgcagctggccgccgcggcagaccccctgggggaggccgcggccttggtgcagcgcctaacgcagtgcgcgggcgaccggctgcagacgcaggcgctggcagcggaggtgcagcttctgcgcggccgcctgctcctggcgctgcaggccgtgcagcgtgctgagcgtctggccgggcccggcgacgcgagcgtgcacctgctggtgctgcgcctggcgctggcgcaggaggcgcaggcggcggcagggccggcggcgggggagggcgccgaggcgcacgtggcggagctgctgcgggagggcgtggcggcactgcggggc

SEQ ID NO: 18334 - DNA, 76 bp, Chlorella protothecoides
aaataattataataaaaccttcaaattttttcaagtctaaaaacgttgttttgcaaacgctttattggcttctgcc

SEQ ID NO: 18335 - DNA, 113 bp, Chlorella protothecoides
tcgatgtcggctcatcgcaacctggggcggtagtacgtcccaagggttgggctgttcgcccatgaaagcggtacgtgagctgggttcagaacgtcgtgagacagttcggtcca

SEQ ID NO: 18336 - DNA, 71 bp, Chlorella protothecoides
tgtggttgaatcataataatttatttattggtttttttaaaatattttttaagaaaacagtaatttttttt

SEQ ID NO: 18337 - DNA, 233 bp, Chlorella protothecoides
caacagggattgtttggtgtacatgctaacgatgccgttctactgaagggactttttgagcctatccgttgccagagcgcagaaaagtatgccttacagcttggctaccttgggccacaaagatggtcttgatttgaactatctggaggatcatagccgtcgtgacattgtgtgctcgatgccatcctgcttgcaattcataaagactgtgttggtgaggcttgatggtccaa

SEQ ID NO: 18338 - DNA, 69 bp, Chlorella protothecoides
cagggcagctcagggatctccctgtgcatggttgttttggggggggagggaggtaatcagtgcgaggca

SEQ ID NO: 18339 - DNA, 126 bp, Chlorella protothecoides
accgggcgatgactgtggcaagtgggtacctcctgccaagcatttgcattctgcctggtcatgctgcacaccagggcagtggacggatgtatctccttctcaccctcctgcaatgggctgcaaggt

SEQ ID NO: 18340 - DNA, 225 bp, Chlorella protothecoides
ctaaattattaaaagtgtctttagaaatttctgaattagcttcttaatataaaattttgatttaataataaaaaaatacaacaattttttgttaaaatattataaaatctattaaaaaaagatgagatatgaagctgtagaacgaattggattaataccaagatccattattcgtactttagataaattaaaaaaacaattattgcctggtgtagaagtattagc

SEQ ID NO: 18341 - DNA, 14881 bp, Chlorella protothecoides
  modified_base (7367)..(7520): a, c, t, g, unknown or other
cggggggggggcccccccccccccccccccatgctctcagccccagtccctgatgtttccccccttgcctgccccatctacccccccactccctgccagcgacacaccctcccacaccacactcaacacccaccaacggggttgttgtgcgcatcatggtagacctgcaccacccgcccgccggagcgcacgatgcgcgccatctcgcgtgggtcctccggcttgtggtcctgggtgagggcctggatgcggtgcacgccccgcacgctttgcaggcccagcactgcgcgggagtcgcccagccaggcggccgtcacgctgcgtgtgaaaggggggggatcaggtgggtaaggggttgggaagaaggaggccatggtggccagagctctgggtccctttggattgatggtctcgagcaacaaagtccctgctctcggctcccctgcgcacacgcttgtgggggcatgggctgacctccaatccccatcccctcacccacccacaacaaacctgccaggctcggccatgcagacgacggcggtgctgccgctgcgtgagtagtcccgccccctggcgttgagctcggtggcggccagctgcaggccctgcaccagggcgccggcggcggggtcccccgcgcccactgcgctgggatctggcccaccctcgcccccggtggccgaggccagcatgctcttggcgaaggagtcgcgcgcgccgcgcgaaacctcgccgccgcggggaccgtggccgtcgaagacgcccacgaccaccgccccgcggctggccagcgccgcgtcgtgcacagcggggatggcttgcagcatgaaggagtcctggttctcaggcttccagcgcgagtgcacgcgcccgccggaggtcacgcagcagacgtctggggagaagggaggcggaggggtggtggtggaggcctccacaggagtgtcgtcgtggggatatgcatccatgtaaaggccatgcacaggcagggacgggactggccaagctggaggggctagctggatgccagcggtcgtacatcaccgtgaggtcagcaatcctcgtgccaaacagccatcccttttccttccatgttttaacctcagataagcacttcctcggcaaccccctcgactcccccgcacgcaccgatgccggagggcagctgcacccctcgctggcagtcatacccgcggggtttcaggtactccttgccgcgccaggagtccacctccacgcgtgcggaaccaaggagcgagcggtagtgcgtggattccaggctgtcgacggggacccccagctgcacatcggtgcggggccggtgggactgcggcttggatgaggagggtggggcagggtgtggcgcaggcgctgctgaaggagccaggctcgaggcccggggcgtgcgtcgctcgctgctgggcgagacgccatggctgcaaggaggggcggagcaggctgagcgaacgtgtgggctgagcgtccggcccacttacggcagactctgaatgcaatgccttgtctggtacagtggaagccctccatttccctcgtggatgaggtggggatccagcaaagcagctcgcaccttgactgaggtcgaaaggtcccgaaaggacggtggtgcactctgagcacgaccatcccgcgcaagctcgggcgcagcgacggtcctggtgctcacccacccctcaggagagaagatcgttggatctggcgctacggagagctagactgatgccactctcagaattaaagcaattttgtttcgcaatgtagatttgcacatcgcgaagagcctatcgcgataatttcacggacacgtctctcggtgccacttctcgcacgtgccagtgtcaaccagaacatctctgcccaaaggattgacaaggttccaacatgttttttgtaaggttgtagcttagatttacatctttccagcttagttctgacaattgtgctgctgcgccgcgaactctcagtgcatggctctatgggtccaccagacaagagaagttcctcgtcaagaagccaaaggacgtcctgaatatggatggaaagcttccaagtaagcatcccatggttgtgctctgtagtgatctttacatgcgtgcaccatcttctgtgcaatgcatcgcagcaaatatccactcaaggtatgccaatcagggatctcaaatgagccaggcgagggcccccgctttctctgcactcagatcacgcacagaaacgcatacctggcagtatgctcaatgtgtaattggtaataatattcatgatctaacccacgaagaggttttctcgtgcgctgggagtctgtgtgaggcagcccgtgttcgaaatgcatcggtactcccagagcaactccacctggggttagagcacgcatgtaaacaagtttagtgccttccaatggcggccgacatggtcaagctcgatgatgggaaaggccttcaggtcacggaggtacactcgtctcccatggacactgttttcacaaacttcaaggctggtatggagggcgtggacaaggagaaagtgaaggccatcgtgcacgacatgtccaaggtaggttgtgaggattggatgttattgcggataggaccgggtgcacacatgtacgaattctggtgtggcgaaccctccaagccaccagctgtatacaagcacttgcaatcgcatgcctgggaacactatcctatttgttggggcagttggctcaacacgctgtcaccttgccacctgtcagggatcggaccacttcaagaacgagcagcgcaaggcggcggcgacggatgtgaggatccatcgtatgaaacaggcggccgcacgcctcaccgcagaccagctcgccggctttgagaggtgtttgatgtttgtgttgttccttaatctcgatgttaaggaatttgcagggcttgtcgggacaggtcggcatagggattgatctataggagatgggcactgttgtgcatgcccgtcagcggctcttaccccaccctagagtccttgtgttgtgctgagaagtccaaacataaactaacgactgcagggcagtggatgctcaggtgtgcgagctgaatgcaaccagggatctgagccgaacctggctgcacgttgacatggatgctttcttcgcggccgtagaggaaagggaccggcctgacctggtgggtgttggtgtgtatgagagggcagagtgagttggggccacctcaagacaaaaggagagtggggattgggcgcatcttttcgatatttcagttggaacatgctagctggccagcggtagggatgtctactacgagtgcagccctccagacattgagctgcttcctacagatcctgtgtacttcaagttgctcagcacctggccctctctctccgaatactggtgcagaaagccaagccgtttgctgtgggcgggatcggcatgatcagcacggccaactatgtcgcccgtcgctatggtgtgcgatctgccatgccaggtacgaaagtgatgggttttggtgcattgtgtagcgctgacaggaatcgttatgatgtgcagccacggaagggttcaacattctcggcagtacacctgaagctaggctgagcatatccgtctcctgccctgcctctcgtcatgagcaaaccccaaggccttcacaggtttcattgcactgaagctgtgcccacagctcatatttgtcaagtccaactttgataaatattcaaaggccagcgcgcaaaccaggtgcagcggggaacatgtgttgtccggaggagggcgatgcgttgcccatggcagctcccgtacagaggcccgaggagctggtcaatggagtgctggttcgtgcccgccccttgacccagcctcagcacagctgccgctgaagggagctgcaccagggcaagggctactgtctctagctacccgaagctcccaccctatcttgcagggcggtgttcagggactacgacccggagtttgaggccggcagcatggacgaggcctacttggacgtcacagagtacgtacggctccatgggacgacaggtgtgctgattagggctgagtttctgctggcccactggcccccaggctgcctcataccaccagacatacgccttggccatggcatcgtcaccattcggcatgcttgagcaatggcccctcaggtgattctgccgtggactgcaagtggctgaggtatgcgtccaccctacctgcccagggcctgaggtggctgccctcattcgacagcgggtgcagcaggaaactggactgacgtgcaggtggtccggtgattgtccatggtgtggggcgcacttttgcagctagcttgttgaaccttggccaagccatctgccaagccacctcctctgatgtctctgctggccctgcaggttctgcaatgaccagtggggaattcacagtattgcctgctgcatctcgctttcccatctcgtaaattgaatgcagtggttcaactcactcacggtccatccatacagcgtcggcattgctcccaatcgcatgctggccaaggtctgctccgatcgcaacaagccaaacggacaggtagcagtgatactataccgcgagggtgggtgcaccggtcacgaggcatacctcactaccgccctgggtgaatactacgacagtgccttttgccagatgagaggacacacctactgcccccttataaagcaatggaatccagagcccaactacctaccatgcccctccgctcccttgcagtatgagctgccctccactctggcggctgttcgtcagtttgttgctgcgctggaaattcgcaaggttccgggtgttggcaaggtaagcttctgcatctgggtaggtttaatctgataccctgcacgtagggattaacaggagggagcctggtcacagtgtcggagtaccctctcagatccacggtgtcccatgcgccgacgctgctcactcaacgcctgttccatgtccatctgcctgcaaccaggtcacagagcgaattctcagtgcgtttggggtccatgttgctgcagacctgcacacgcatcggtgaggggtcttattatgggtgggaggtagacacttatgaggggtgcacacgtcgcgccaaggatcgcatgtcggcatggcttcgtgccctgtgtcagcacagggcagcatgtcaatgctgtctatcatcgtccttacggtcatgctgattcctctccgcaccccagagccctcctggcggccctgttcagccccgtctcgctcgacttcttcatgcgcatagccctgggcctgggctccacgcgacactcggacccgggccccgacggcagtgtggggaggaagggcatgagctgcgagaggacgttcaggtgagtgctgtgcgttggagggatgcctgacgatgccaaaacgtctcgggtggccggcagtgactttcagcctcgcctctccactgccatatgggaagggccatgccaaagcccattgtgccagagccccaggtggccctgccctccccgccaggaacatgagcgaacctcgggatctggaagcgaagctcggtgagctggcggagcacctcgccgcagacatggccagcgaggatttgaaggggcgcaccctcaccctgaagctgaagtgctccaactttgaggtgggtgggcggggaacgatttgctggctggtagaagcatcataccttgccatccatgccagcgtgagcgggagccgggaagggtgccagagccgcctgctgcaccggctctgcggcctcctcacccctttttgctgctgaccggccacgactcgcagctgcggacccgcgccatgacgctgcccaagtacattcacaccgccagcgacatcctggcagccgcactgaagctgctgcaggccgagcttcccatcgaggtccggctcatggggctgcgcatgagcagcttcctcgagcaggcgaggccccacgcatagcggagggggtctttgggggagaggtgacgcatgtgctgggaggaggcgttgaaggcagtccacgagctgtctgccgcatggcggcgcccagtcacctgcttcctaaccatctgtgttcctgccacaggtcagggacccaggccagctgagcctggctgagatgctggcgggccggaggtcgccggcagcgggtgccgaggccgggccgagcagcgcgggtgccaaggccgggccgagcagcgcgggtgctggggactatgagggggaagccgccggatcctccctgggcgagggggagctgctggagctctccctgcaggactggggcaggcgtcggggccccaggcctcctgcagaggacacctgtcccggcagggacggatccaggtcccctgatgggcgggaagccaagcctgcggccatgggggagtgggcctgcggcgcctgcacgctgctgaacccagggcttgcgggcaggtgcgaggcctgcgggcagcgccgcaggccgcacgcgacgatggcagtccgtcggggccagaagaagaagcccaaggtggagggtgtgacgctggaccgattcctggctggcaagtcgcgggcggcaagccgtggcatcgacagcccggcatcaggaggctcggccgacatcgcagagtgcagcctgtgcaggtcggtctcggcgaggcgggatgggtggggcgagcagtgcgtgcatgacttgccatgctcaggcggaggggcgcgaaaaatccatcggtgcagttttttggcagtgcagaaacttcagggaatgtggtggcgcgatgcattcctgccgaggccgagtgatcccggtgactggagcttcatgttgcgcacatctagcatgcgacccatgctgacccgcagggaatggcttccagagacccagttggcccagcacatgcgagggcatcgattgtcacatcgatgacatggcgctgtctcagggctgttgttgaggccacggtagggcgtgtggggccctggggggcggccatgtgctgccataatccactttgttcccctccaccggagtcttaacccatactgcacagcagttcctagggaactgccggcgatgggaccagctgcatcagtgcttccatggccgccagccctctgtggatcactgatatgcactattcaccccaccagtggggctaggaagtggcgggagattccctgcatcatagagaaagggaaggttttaagtctgctgctgagacaccagcgcatctgtgcgatgggaagcttatgaaggagtcctgcatacccgataaccccggcctacatgacacaccgcccatcctctggctagaatcacaccagggaccaccagctgtctcgtcgccaaacaacaccccgcagtatgctgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtggtggcaagagacggcggactgcttcagcaggcagaagagggccaaattaaccttgcacctgggatgagatccatgtctgtaagcgaccagcttagcaatccggcagggagggcgtgtgcggggcggcagtgcctccggacgggcaagggagaggaggggcccgctctcccctcccacctcctcccttgaccacctgaggcctcgacgggcgtagttcccgggcatgacaatcaggtgcaggcagtgcttcatcgccgttgcactggatactctaccactccaatgatattttaacacgacaatgtgcctcgcggggcgcgttcgcaccccgacgggacatggcaaagctctacaaagttcaaaaaactgtcgaccgaatgagggggtctcgcaccgcaaaccagcaactaaagctcttgaaaatgcgtattcaacaatgttcgaggagctgatgtctgtaaaagtggaaatctcgacttgtcccagggcggagataatgtggcaaaagaacggtactcggacgttgtgcatctgccggcgacccccgtccggaagctgtgccgatgtgggggttcattctccgcataggtcggtagggagtcccaaggcgaatgtctgcattgacacttggaaaatccatcattttccaaaataccaaggcatagtaataccacgcctggcataggatggcgtcgtcagtgagtcggccaccggtcaccgtggagaaggtcgacaatttccaaccccctgcagcatcgaagaccaatggcgatgtgcatgggaaccctagctcgacggcaggcaacgccggcagctcaggacctgactctactcaggtgccgcaccatgccgcgcggtgtgcgcatgcttggaattacagtgcgattccggggtgctgattggcaatcttcaccatgggtcaagccatgtcacagattgccccgtctccatccaaggcccagcaggaccccaacaagtggcttgcggatctaattgcccacctgtggccctacgcctcgaatgccatagaggccttggccaatgacatgatcccagatatcctggccgctagccgcccatcttttgtgcatgacctcaagctcaagaaattcgagctggggaaggcacggccgaagctcaccaacctcaggcaggcagcagtaggggaaatctcgcggcaagcttgagccttgagatgtaaggccatggctgacctgagttttgggacaaactgcgacactcactgcttcactcaattcccgcttgcctaacagagtcacgggagacacacgcatgactggcgatgtcaacatcgaattcgactttgactggaagtctgagggtcaggtgtgatatttgataccagtgggctgcttctcgaagggccacatatcaccctgcctaaccactccacccactgctgcccatgtcccagaccgcatggccccctgcgcagcacggttggacccccttcatcgccccgtcccacccccctcctcccatctctgcacccccgcccaggccttggagctgtacatctccgtgcccaagctccccctgctcgtttctgaagtggtcccggatccgttggaggacaccctagccctgctcatgtcccttacggtcatgtgcaccgacctctggctcaagggcaccgccagggtgactctgcgtcccctgctggaggagatgccggtggtgggcggcgtgcgcatctccctcatcaatcccccggactttggctatgacctgaagctcgggtatgattcgcggtgtgagggcggagtggtggggcaaagcgagtgggtggtaggggctgggtgcccggcattggtgtcgggaagcttttgcctggctttggaaaccagaacgtaaccttccatggagtttggctgcagggtgggggtgactactctgccgccaccactgcgcatggctgcacaaaaggaaagagagtccatccaaccccatgccactccccacatgtctttgcctgggccccccaagcccgacctcctcccctcttccccagtgacaggtttgtgctggagacgatggagcccctcatcaagtcctgggtggacggcgtcgtcaaggagtctgtactccagccgtgagtgtggatgtcatcttgtgatggcatgcctgatgatgacccccatccaccgccgtgtgtctgttgtcgtggccagccccctgacctgaaaacgcatccatccacccatgcccaggtatgtgctgccggagcacctctggatccccatcacagacgacgcagaggacgtggacaagccagagggcgtgctgcacgtcaagatcctgaacgccacgggggtgcgacagagaggggggttgattgggaggaatgggggttccggatggtgctgagtcctgggatacgctttcgtgccctgcctcaccaaaggctgtctatgttcgcaggtgcctcgcatggacctcctgggcggctgcgacccatacctggagtgagtggagggggagggcggcggttcctttccggcgagaccccacatggccagcttatgattgcgggaaacaaaacatctgtgagcaggggtaatcagcggaggcctggcagagacaaacctcagtgtgtctcacacaacatcatcagccctctgatgcccctccctcctgccatatccaccgtggacagaatctatgtccgcgacagccagcgcaggctgacagacgtcaggaagaagacccgcgagcccacatggaacgagtcctttgtctttgccattgccgcaccgcagtaccaggagctggtgagtgggcggggcggtttcaagctgtgaacttgggatgggacagggcatgtgctgatgcgcagctgcctgcagcaagcctctcacccgcgattcttctgcttccctgcttgcacctaaggatgcatcaggaatctaacaatggggcggtcttcaggctcccacctgcctccaagtacatcgcagaggatgatcatgtgggacgaggatgagtggtcaccccctgatgagattggaaggtgggtgtcgggcgggggtggggcgtcgccttcgtgcctgtgctcctcgtggctgcctccccagactgagcacctcagcttcaatcccatgcgcgcagggccctgctgcccatcaaggagctggagcatggcaagcagacgagcaagaccctggactttaaggccagaggtgatttgggtcgaggagcggctaaggccttgagggttctgaagatgtttccttgacctagtcgagcgcagactatggcgcaggtacacccagccgaaatgtatcgtctgagcatgcccccacacccacccacccacgccaaaaaccctgtcgcagtggaggaggtgcacgaagaggagaaggccaaggcgaccaggatgcagcactttgccatggccctgggccgacccttcatcaaaaagggcggcaccatgtgccacctgaacgtcgaggtggggcaaggttgttggtacatagtcgagagtgcgttggtgacttgcatcctgaagggctattgaagccgccacgccaaaaccaagggtgttgtaggcatgaaaacataggttcgtgtgcctgggatcgacctgcacgggctgtgccctgacgatggccctgtcctcccaccgcaggtcacctacacccctctgagccgcaaggaggtggagctggtggagaacgccatgcgccacggcgcagagcatgcgctccggcagcgctcggttcagcagggcatctcgccggcggttcgggagctcatccgcaccggggtcgtgcagctgaccctgcacaatgtccacagcaagaccctcgtctccaagctgcgcacgccccacgtgtgagtggcccaggggtggtccatggagggatccagcaagccattacatatggtgctggagggcaggagccgcagccatcgtgctaaacctcaactcgtgagattctgcattctgcctccacagaaaggcgagcatgcgggtcaaggagtctgagaagtcctcaccgctcacgctggcgaaccgaagggggcaggcagccttccccgcgcccctgtcggtgcacgtgggactggatgcagtggaggacgagagcaccatgggtgaggtggctgggagggtgctccagtgcattcgagcggtgtgtgagtgaggggcgagcactccacggcaaattgcatctgcctcagtagcacgaggcatctgccttcccgtcattacagtggagatcatcatccaagaaaagggctgggtagggacttccaccgtcggcaagctggagtttcccctggccacggtcatcaagcgcatgaagaccaagggcgagttccacctccaagaaggctcgggcactgccaagctggacctccgctggacgcgctacctgtgatgccctagtgcattgccagtggcgagtggcataccctccagaggggtctctacaggccgccctcccagccaccagatcaatttgtatctccaagcgccagtgcgctcaacctcttcttgccctgggttttcatggtttgtagtcctttcattccaccttgtgtttggcaaccctcaacggctgtggagggtgctgtcatctgctcctgctgccgcgttacacaactgggatcgaatattaagcgatggggggtggtagtaaaaccaggaatggcagggaagggtatccacatgtcgctcgaagggccttcagtatttgagaatgatgtagagcgcatggatcgcgcctgtggatggaattgggaagaaaataggcattggggggtgggcttcccagaggactgtgatcaggttcacaataaatggaaggtgcccaggaagctgctgaaccctgcaacaaaatggccatcctccccacgctgcacccctgagcaacaatatacctggaatccagcccaggagcgtgagcagcaggttcaaaaggacatccttgtcgcacgcatccttttggatgaagacctgttggggggcgggtcaccgggtggattatgccgacgcatcaaggacagacggaccaagcacgaacgatcaatgtctcaacacgtcgcatgctgtaatgtttcctagtccaggcagggcccaacttacagcaagaggtggcaagaagatcgccactgcgaagaaagggtggcgtgtgtgggggagcagcttgaccgagtactcgaacgatcacgtcgggccatttgtgaatgcagacgcgcttcaccagcagaaacacaatgttgagaaacgatccttcagaacaaagcgatgatagcgtagttcagcgcccccgtgctcaccaatgatgaggccgatatcccgggctgtgaacggcattctgcgttgtcgggtggagaaacgtctacctgggtcccggaggctcgcgctggagatttggctgcgctcatttgccttgaccgtgtttgttgtcaggcgcctgagagggcagaatatgtcaccttctaagcagctaccaaggtaccttcgacacatgcaagggggtaccaccgaggcaccccgagccaaggtgccacgttgtgaccggtttccgtacccatcatcggcccccattgtcgtaaacccttcagtggcaacggtatgtcgtaacatggcggaagttacgatgtgcgacgttggtaaggctgtccacctccgcagtacgaatgaactggagcgcgggctacggacggagttgcatgtcccctggtccacccaagatttcgaatgggactctggagcgctgcgcgcctcgtccaaggcctccagccgcgtgcatgaagcagagacggagcgcgggcaggagttgggcactcgctcgcggaaccagtgccgagtggcgggatgcaataccagcctatcgttgcagaaattttactatcaggcaaggcccctggcgggtcttccgtggaatccggagggtgtacgagggaatgggggctcacgcacccccccagctgtacagccctcccacctcgtcccgcatgtgcacacctgccccgcagaggtacatgatatgtccgtaccacgctgccgtcgccagcatcaccatcggaggggtcgccagcaggttctgtcagcaggtgaggtgctggctgggcggtgcctgctgccgatgaaggcccaggccagccactgaatgtctcacgctaccggtaccgccgctcgccgtgactcgacatcaagccacactgaacctcacgctggccctcaaccccgccggtcatgcagtgtggcaagttccagcccctggccgactttgacgatgagaagcggacgtgccgccacagggtgagtgtgtagcaacgttgaccccgtgcagccacctgtgtgcgtgtcgatcaaccgctgtgcagctgctggggctgtgtgcagtttggtagaggcggcaggatctggcccgctggatgccgcacgggagtgcatcggccgcatggcgccgggcctctatttccaatccggctcagtggcctgcgcgtcaccccccgccggcccggctcccgttcgtctctcgactgccaccccctcttccacccgtacgcagctggagatgcacaatgcgcggcgaagaaagaagccggcgcgccgcgccaaggcccccgccgagcgcgccgcaaggcgcgcggcggccgcggcggccggccccccgcccgcctcggtctccgtgcacagcaacagcacgccggaggacagcgcctatctcacgctggatacggcggggacggacggcatgacggacagcggcatgctctcccacaacagctcctccaagggggatagcgccggcaccacgccgctcgccaagctgtacatggactcctgggtgaggaaataggaagggacttctgggagaggggggagagggaggaccctgtgctagagaccgctcgtgaccctgaggagcgtggctggtacccggctcaggttgcctgcggaccaccagacacccagctttcactcaccctgcccccctgagcctgccctctgcccccctccccaccactcgaaacgcaggactccgcccagcccatggacgatgggctcctgtccttcctggatcccatccccgcgctgtcctgcccgctgatgagcgatcccccctcctccaccctgggcctgtccaccgaggacttggacggcatcctggacgacctgtttggcgggctggctgccgagacgggcctgggcgtggacgtgggggcgggggcccgaatgtccgcctgcgcatggccgtcctccaccgccgccaccgccgccagcggcgcatgggacggcagcgaggccagtgccggcaccgccgtgcgcggccccgatgcctcgcccgcgcctggcggcccccgcaccgccgccgccggc

SEQ ID NO: 18342 - DNA, 74 bp, Chlorella protothecoides
gctccccctcttctgcaccgacgccccgcgtgatcaccatcgtagtgtcctgcctcgcctaccatccacctcca

SEQ ID NO: 18343 - DNA, 61 bp, Chlorella protothecoides
aggccaggctgggggccatgctggggggggtggtgggcatcatcatgtagggggatgtgcc

SEQ ID NO: 18344 - DNA, 103 bp, Chlorella protothecoides
aatgcctgattctgttcatttccctctgtctgggcagaggatggaaataccaaagggccttgtgacccaaaaatgacttcagcagcccaacctcctgccccgg

SEQ ID NO: 18345 - DNA, 65 bp, Chlorella protothecoides
tcttattttagatacaagggcaattatgaaaaattagacaaaattagagattttatgagaaaatt

SEQ ID NO: 18346 - DNA, 78 bp, Chlorella protothecoides
aacccgagcacatggactgatacagtgagtcacgacatggcagccttgatgtcctatgtccaagtagtgtccatccag

SEQ ID NO: 18347 - DNA, 61 bp, Chlorella protothecoides
acccacattttggaagagggagaggaggccagggatggatgtggcgggggtgggacggggg

SEQ ID NO: 18348 - DNA, 207 bp, Chlorella protothecoides
tcggtccccaataattaattcacgttgtcctcgaccaataggaatcattgaatcaatagataaaattccagtttgtaatggttcatgtactgatcgtcgagaaataataccaggagcagaggattcaattaatctgtttgtattactttgaatttcacctttcccatcaatagggcgagctaaagggttcactacgcggcctaaaaa

SEQ ID NO: 18349 - DNA, 347 bp, Chlorella protothecoides
ggtgccgtttccccgagaccagggaagccactgagcatgtgaagcacaccctccgttgccaagaggtctgcaaggacgatggtggcgcctcctaccgccacattccctggggtgggcagggccatggggcttgccacattgcaacaggtggaccagcctgagcgcatgcagctggacagaaccaccccggtccaacagttgcccctggtgtcaaacctggcccggacgatgtgacgggcagcaagcccccgctcaaggtgtcgacggagggcgctgcctccaagtctgccagcttcagctggcctggtaccagggtgttctcgagcaggggcttgaggaagacgggg

SEQ ID NO: 18350 - DNA, 61 bp, Chlorella protothecoides
atgcaccctgtatgttgctgtgcaaataccctgctgttgctgatccattgtggccaggaac

SEQ ID NO: 18351 - DNA, 80 bp, Chlorella protothecoides
agagatgctcttcgactcggttggtgcacacgacacaccccggcagcactgtcctccaggacaagcaccgacacatgacg

SEQ ID NO: 18352 - DNA, 66 bp, Chlorella protothecoides
cagggtggcctctggcttctgggcgtgtcgaatccggggcgggatgctcgattggttgaccgaggg

SEQ ID NO: 18353 - DNA, 61 bp, Chlorella protothecoides
gggcgggatgctcgattggttgaccgagggaggggcgactggggggtggagccagttgcct

SEQ ID NO: 18354 - DNA, 82 bp, Chlorella protothecoides
acaactctctccacagcaggcgcagcatgcaaaagtacctctccatgcagattccatctccgattcgacgtcaagggtgacg

SEQ ID NO: 18355 - DNA, 62 bp, Chlorella protothecoides
tatggaagcctggggccccctgcaggtgcctgaaaaggccatggcaattggaggggcacagc

SEQ ID NO: 18356 - DNA, 78 bp, Chlorella protothecoides
ggaatcctgcacccatgacagcatggtaaatgtgctttcccagccccaagagcaggcccacccagtaacttgaagcaa

SEQ ID NO: 18357 - DNA, 61 bp, Chlorella protothecoides
gtcagagaaggggagaacgggagtggggggtgtgggtctcgccgcgggaaaatgatagtca

SEQ ID NO: 18358 - DNA, 138 bp, Chlorella protothecoides
atgcctcgacgtgatcctcaacccctgggggcagtgcgcggtgctggtcgcgtgacacccgcccatgatctgcatcgggggtgccctgccatgcacaggaatggggatggacgccctgggccttgcacccaaagccaa

SEQ ID NO: 18359 - DNA, 63 bp, Chlorella protothecoides
tgtttgttgtctcgacccccccttcctctgatcccccgccgtcttctgtctgtggtggccttg

SEQ ID NO: 18360 - DNA, 61 bp, Chlorella protothecoides
cctccccaccactcacagccatctctgccgtccctgggccaccccaacaaaatcaaagacc

SEQ ID NO: 18361 - DNA, 65 bp, Chlorella protothecoides
gcacaggaaagaagctatcgatgtgaggctccaggccctggcggcgccggtcggtgctgagtgtg

SEQ ID NO: 18362 - DNA, 68 bp, Chlorella protothecoides
cgggccgccggccaagcggcagcgagcggacgaggccgctgagggggagtaggcgggggcagggctgg

SEQ ID NO: 18363 - DNA, 102 bp, Chlorella protothecoides
aatttcataaatagatggtttttataatttttttcaaatcgaatttattgttttttaacaaaaaatacaattgaaaaaaatatagtctctttttttctctaa

SEQ ID NO: 18364 - DNA, 67 bp, Chlorella protothecoides
cgggtcgggtcgaggccgtctgccgccccgacggccaaaacggctggtgccaagcccaggccggggt

SEQ ID NO: 18365 - DNA, 8542 bp, Chlorella protothecoides
ggggggggggagggggggggggggggcagcgaaggggaccgcatgtgctgctcgatgcgtgcctggtagtggagagggtaggggggggccctggggccgcctcgaaagggatggatgtgtggaggccgagggcgatgcaccgactgggtgtgcacctctcctcgtgcgtggatgactccccgctgatgcctgtttgtgttggggtgcctggctccaggcgcaggggccgtgtggcgctgctcagggcagctctcgtgggaccctcctgctcgtgcccgcacacatgtctgccccccacactccccccaggtggcgtgcagcgcgtccccgctggccatcctgggcggcagggacgtggaccgcctgcccactgccagcacctgcaccaacacgctgaagctgccggacttcaggaggagcgggaccctgcgtgaaaagctgctgtacgccattcgcgccggggcggggttcgacctgtcctgatgagcacatgctgcggatggcagtgtggggcatggtgcttgcgctgcatgccgggaacgggccggggacgccctggcccgtgtcgcttgcccaggtgcatccatttgagcacaggggggtgtgcagcattcttcgctctcgccatgactcgaccgcaatcaggtcgacagagcctgccgctggccttctgtcagcatccccttggcaggcatgaacagccatgtacaagatgtggaggttccactcgagccaccgggcaggcggaaatctctgggcacttccctcatgagccatctggggggattacgttacagcagagcttacaacaagactctcgagcaggggcacggcggtgcgtgcctggacatgacgccgtgcggagtcgcggtccggtccatggcccacgcccttcccgagatgtttcaggtgcgcacggtcatgtgccgcaggatgttgaactcgccgcctgccacgggcgtggagagcaggcgctgcaccgcctgggaggtgggcgggctggccgtgtaggtgtacagagcatagatgccctccgtgaacctgaattgttggcagggatgaggtggggagatgggagaaggccaaggggtgagtgctaccccaagggcccaccctgtccaccgaatctcacggcaaagagcttcctttctcacgtcttattcctgccgtcctgatgagcacatcacacccctcaaaacacgactcacttcctgatggggtacgccagcctctgtcgcccacgcagcgtcacgttgaccctgcgagcagccttgcccttcagaaacgcctcgaactttgcaagttcctggtccctgttggcatcaagggtgagaagggcgatgaggacgtaaaaggggtctgtaaaactcacgaagacagggcccaatggcaatgttcccacgaatcacaggacacgccatcgacttgcctctcctgctcgctgagggtcggccgaaggatgatcagggtctcatagctgcgagtgcacgggtgtgtattgggtggtcagttgctcctgtactggagctcatggagctcgagggagggcgctgcttgacctgcaatcggaattgtgaccctctcacttggtgaagccgggagggacatcgtccgtggtctcgatctcgacaagggattcctgcgatggtatcacaattccgagaatttcaatgttaggtgccttgcttgctggcatgtagaccagcagtccaagggacacaaccccaccactcaagcagcgacacccagacccattcacctgaacggtccgtacagccagcgagctcctgtgtggaggcctctgactcgacctaaatgcatgctgggatggaatggatgcaatgcatcgtggtgtgagcggtaggagggagcgggccgagccggtgctcgtaagccgtggctgggtggccgtggtgaggataaccatcacgagcggacgagacgggtatgccgatgcccttgggctaaatattccactcaagtctcgtggtgtggattgaagaggcatgcgtccggagcatggggaggtggtggcgacgggtgaccaggattatcttcacggggggccccgcgcgcgcgattggctgttcgagcctgggtgaccatggcctcccactgatgcacccatccccacgtttcgcaccagtatcgatcacacaatatcagttcgaggcaagctatgtcacgacagcgcgaatggtcacatgcagtgctgcatcatcaaaccagtgataggttcccgggagggcagcatccactgccctccggaagcgccgcacggcagccagcagctcctcggggcccaccaggaagtgaaccagggtgaccccgaggtgcgcgtcggcgtagtgcgccctgcgattgccgtcgcggctggcagcaaaccagtagtctggggcgccggactccgccaggatgcttgccaccctctcctcctgctcacgcggcggcaaagccccctccccctcgcgtgcgggcctcaaggggacgctctggacgctcagcgtccgctccagtgagcggcactggtgcaccaccagctgcgcatcccggacccgcagggaggccgccgaggccaggtcggcgctgtgcttggcgcaaaggtccagcagcacccgcagctggtcgggggtgaggcgctgcctgtcgtgcaggcagccgagggaggtctttggccagagggagcccggctgctcggagggaaggccctggacatttgcagtcaggcgtgccttcaggtcaaggagcgccgccgggaaacccctgttttgaatgcggggggagtttgagagagttaacacgcgggctgcaatgagatgttgcccgctcaaggggagttgtaggcaggggggagacctggcgatcattccaacatggcccatgcacctgctggtcacagcaaacctcttgcctgtatgcaaatgtgagtacgccctgccacgaaacgaagaatgcgaggggtttgagctcgcactgtctagacaattccaattccttcacaagaagagagtcgtattcctgcttcatcgctggagtggaagtgggttggcatccattccgcatttctcttgcccgcaataagtactcgaccaacaatctacatgtgggagtctactgatataggcttgacagtcgatgtcgaacaggcattttcctgaataagactgagcgttgccgggcgatgtgctgcccaaaggcatcgacgcccgcccagcagattttccttctgcggccaggtcgtgtcggaagccgtgaggagtcctgtagtaccattcccttgcggagaggattccatcctccgacaatatggtgccgcccatctcatgcttaaagagttgccgttgcagcgtcatgtcaagttgttgtgtacagatattccttgattgctcagcttggctgtaaagccgtcgtggctgaaaagcaagataaatcggctgtgctcctcccaccagcccatcaacataatgatcattgggcagaagggcgtcaagtacgggctcacagtaaaaggtcccaagaccagtgctgcctccaaaacgctcaaaccatcggtgttcgaagcgggcgactctgacgacgagcatgacaacgtggagcaacagattgctcgacagcaagtccggaagcaggacgaccagaaggtgctcctagattggaaacgtgcaagaaatatgtgttggatgtttgtctcgcatgcatatgctttgggggagattagggccggtggttctcagcagtagaattcctgtctcgacggtcgtgtggcgccttctgccgcgaagcctctactcaatcctctaaacgcaagggaaacatgccgaactctgaccataacgtggatatatgcaggtagcagcgttgcatgccgcagctctggctgaggacgccgctgtgtttgactacgatggccactatgatgccattcaggaggccagggaggagcccaagcgcagagagaagaaggagcgccaatcccgctacattgctggactcctaggtgggcattgctgggacgagaaaggtttgctggagtgcctgtgtcaaacctttggcccagcagggcttcagcatcccctgcccggcctgttgtggtgcagagaaggctgaggagaggaagcgggagcaggacgtcctgtatgagcgacaaatgctcaaggagagggcagccgaggatcatctgtttggggacaaggagcgctttgtcaccgctgcctacaagaagaagctggaggaagaccaacgctacgtcgccaaccagaaacgcatgtgagtcgggagtgccctgcacgagctggggcgtccggtggaaaatcaaacacggggctccctctgaagtttgtcctgcttgaaactcttttgctctggctggtgggagcaagggagcagacccttcatctacattggcaggcaccggtcgtcctagccccctctgctgccgaatttccctcctgatgatcctcctatcacaatgtcatgcagccaagcggatgaggaggcgaatgcggtcgagaagaagggccacatgggcaacttctatcgcaacctcttcaagagcaatgtggcgtacaatggcagttccaggtgcccagggctgcagagcaggggattgttcctcagggtgtcccagggctgggtgcatgctggtggagttgaggagggtgcgctgatctattcgaaaagagtgacgcgacgggtgccacacctctctctaacgctactatgcccagggcgggagaggcggctcagagtgcagcatcctcttcacatgcacttgtggcatccagagatgggggagccgcagagagaccagtgccggcaagccgaggcaatgaggtggagccagccttcgagcccatgcctagtgcaagtggggagcgtcctggcgcgctgcaccatgtgtctgggtcggaaaggaagatcgaggccgagaagcgacaagaagggccatcccaagacagtgcagatgaaacagcaggctcggaggacgaggctggcaaggctgtggggtccacagcagcgcctgccaaaccctccttgcgggacaggcagaaatctgtggctgcggcgcgggagaggtacctggctcgcaagcggaagacggctgagggataaattaatacgggttgcgacgaaggcctgtgcaacctgcaccttggcagcctcctgtgattgccattctgtgtgtcaattacaatggtgcccaatcttgaatacactgggcatcccgggtttgcctgggatggggaagaaaccatcaggggcatccatgagatgagtgtgaggggtctgatcaaggatcgacctgaagatctagttgaacactgtcgtgaacgtgcatcgtctatcaggcgactggcccccctatcaatcattcgcacattcgaatcacaatgtggcgcgtgcggcgcgcagctgtcctgctcaaactcggtggcgcagtctcatcgggccgagcaaagttgtacaatcgatttactctgacgctgatgagctgagacgagaggtaacagagagcctctccgcgtattggtacgccgccttcagctcagtgtctcgagattcaaccatggtgctcgaacttcgcacccgtcaaagccgcgcattggtcgatccaatctcggatgacgaggacagcttcgacgatgtattgcccttacaaaagaccaaatgcaatgtcaaataccttgacaagtttaggtgagtacgccgtgtcagggccttgctgcgacctgggcccctatggaggcacagtgtgggccagccccgattccaaaatgcctccccccgactccacaggtgtgcgtccgactcgactcatagacgtctctcagagccaaaatcaggtatgtttccccagccctcaatgcttcggggtggcatgtgcaaaccgctggactacattcctcctctgtgagtgaggttgcatggaacagctggtaagaccacacatacacatcggcatgtcctccaccccaccctctgtgcaggcttgctggagcagcaaggctggaaacttgcaggcagaaaagcggcgccggtacctgctcccactgcgcgaaggagcactcgtccagctgccaccaatcctcgcgtcactgtgatcgacgatgtgagggcgtgggacgcggctcattcagacatgggtctgcttgatgtattcaacccatcgcatcccttgtctactgttgctgatggtatgacatctgctcccagccttctccctccctgttcctccagtcgagtgaggaggagtgccctgacagcgtcagtgagggctccatggcggacagcgatgcgtcctcgcaggataacgaggaggatgtcgggagtgtgggatcggccgacagcaccagccaggatgaggaggacgaggaggagagcaactcatccggggacgacgcctggccctcagatgcagagaacgtcccacagaatgcccagcaaagaaatgaagtggcagctggcgaagcgggtgagtcaaagtgtgcacctgacgccgccgcatgatattaagggtcggagtccaggcctcgcatcaccttgcctgtcgtaacagagcagtgtctgttgcaatcacccattgtctacggcatcacacccgcgccaggagccaaggttggccccaagccatcgcgcccaacgagcgtcagaggtaggcactggggtcaggtgccggggacctttggccagtccaggccctggcatcatgtctgcctgcccagaatctgtctctgtaatcattgccaaagtgtggttctgtttgaacacgtgcaggggccgcgctgctggcggacaagatcctggacacgcgtgatggagccgatggcgcgccggagtgcctcgtgaagctcaagggtgcgcatttcgctcctctgcagggttgcttgacggagcccattgtttttggcaggacggatggactcttgattctgtagagagtatctcgtttcattgttgtcggtcccgcttggcgccacggtgtggtgggcctatgccacatgctcccgacccaatcaccaccctccgcaaacccttggtcctccagacaagagctaccgagaggtgcagtggctgccccgcagatccctggaggagaccaagccgggcctgctgcgcggcttcctgaagaggcaggaggcaggcgagctcaacccctacggggacctggcctcgggcatccacgccgactggacggtcgtggagcgcgtcattgcgcaccgagcagggccggccgagcgcttcctcatcaagtggaaggggctggggtacagtgaggctacctggatccctgcctccgacctccagccagcagaccaggcaagtctgccgaaagagaggcaggcgatcccaggaggcatgatgagggttgctgggtcaagagattgcttttttggtttgtcacaccaccctgatcgactagacaccaagagcgacaagccacattggctctgacaacctgagatgtggaggctggggacccctttcatgtctccagccattcatcagcccctgaccgcgcctccctggtgcaggctgcagtgacgcggtaccatgagctgcgctcaccggggtaccacaagaagctcacccaggctgctgcctccaacccgaagaccaccgcaggtaggttgtgtggcgctcctcgcaccttcatgtgtcgtgtagggcagcctctgtgatccctccgtcccggtgccagctgtccactgtattgcgtggctgcatctcgtcacctgcttgctcataccatctgctacgcccgccattcgccactctacccccctcgcactctccccacccccaaagttcccaccttctgcaacgggcgcgagctgagggcgtaccagaaggagagcctggcttggatggcagccaactgggtggccggccggagctgcatcctgggggatgaggcaaggccaggagggaggaagagagggttgagctgggaatggtgttccctagaccttgttcatcagcaaggccggacggcgagacggtctccgtggcgtcggccacgccggaacgcaggtcctactgccaattcctgacccatgccccagcacttcgtattccttgctcattccccaaagccacactgtcttacgcctcttcggaacgctgctccctcccaatccccaacccatgcatacctcccccccttgaacacccccccctttgctccagatgggcctgggcaaaacagcccagtccatcgccattctggcgctgcagcagcagtctggcggcgtggccggccccttcctggtggtggccccgctgaccacgctgggtcactggcagcgcgagatcgaggcctggaccgcgctggactgcgtggtgtacgctggcagcgctgcagaccgcgaggccatccaggtgcacgacctgtggcgcgccgcggggccggcaggcggccgtgcgatccgccccagcatcgtgctggtgtcctttgacaccatgctgcgcgacaaggccctcttcctggtgagaacgaagggttttccgggggggggggaagggagggaatggggggggaggg

SEQ ID NO: 18366 - DNA, 338 bp, Chlorella protothecoides
aacaccatctaattcaccaccataaaaagtaactgaaacacctacttgttcaatactatattttgattctgctctacggaatggtacatcagctcgaacaacaccattattatcaacaagtaaaactgggaaagtttcaaagaaagtcggcatacgtcgaacaaataattgattaccctgtttatctttaaatactgcgtgtcctaaccaacctacagcaataccatcaccactattcatagcacctgtacggaaaagtccacctttcgctggattatttccaatataatcataaaatactagtttttctggtatttcagaccatgctgctgttgctg

SEQ ID NO: 18367 - DNA, 333 bp, Chlorella protothecoides
cctgaagcggcgagtgcgcggcggcatcctgccacccccctgcggcttgggcttgggcgcgtaggtaaaattcactctggagagagggacggggcgtttgtgcacggtgcgatcctccgagggccagtatgtgccggcatcagaccgcacgctgcccatggtcatgtggacggtggcgacgcggcgcacgagcagtgcgcagatggactccagattctccaggtgtcctggattgtcgcaccgccaagtcagcggctcgcgcttggcgacggggagctcggggagacagcaggcgtccaccgtcaggtgtgcgacggtgtgcggagtgatgaa

SEQ ID NO: 18368 - DNA, 160 bp, Chlorella protothecoides
caggtgtgcgacggtgtgcggagtgatgaacgtgtcgcccatttcgatgctcgggccttcccagcgcacggtgcccatgcgcaccgcaaacacctggatggaggggtcactgccccatcctcggtggtgggtgtcgggcacagcgcattgcgcctgcaga

SEQ ID NO: 18369 - DNA, 142 bp, Chlorella protothecoides
tgtgcagaggggtgttgtgccatggggggtcgtggtgatctggaaatggccgcaatgtactaggtgtcccaggttgccagcttcctgccggcctgcactcaagatgtgcggtgcctaccaccgcatgactcttagcctcaca

SEQ ID NO: 18370 - DNA, 71 bp, Chlorella protothecoides
gcctgtgtcagtgtgtggattgttgattgcttcaatggcttggtgtgggtgggtaggatcggaatgaccgt

SEQ ID NO: 18371 - DNA, 61 bp, Chlorella protothecoides
agtcaccatgaaacacattgatgcagagcatccctgccgcaaacgaagttcacccatggat

SEQ ID NO: 18372 - DNA, 2127 bp, Chlorella protothecoides
caccaagtgtggctgccccagttctgcaggtcgccaaaaaccgggacgccacgctgaccttcactgtgaccacagcctcctactcgccagagacgatacacctctacattgactctaacacacagccctcctatacatgggatggtgctcccggagagcatatgcacaccgaaaccacggaggatgcttatcccgagggcaccaaattctgctttacttgcaccgctctctccaacggggtgctgtcggagctgtcgaacaaggtgtgcataacgatctaagttcttgtcgagagtaatgtttctctcgaatcgtgactaaaattgtaagctcttgaccgcccgccatcatgaaaggtagtgagtatggtgaccgtgatcgtccctgtcggccaattacagctttcctcgataggagtagcctttcagataatgatggaaggactcaaagaagtatggacttgagtgtccagggtgtcaggtacaactgttgtgggggcgggttagaccctacaacgtggaccgctgtatttgacctaagttaggaatgttacaggcaagaccccgaatacggtgaggggcttgggtttcaagaacggtgccatgcgtcgtaggcgcggcgcagtgcacggatgtagatggaatgggtggaaggctccctaggagggggcccccacaacaacccccctcttccccatatcctgggaaatcgctcttgctccagaggcacttccagtctatttcctcacacgtatcgcaatggagcagccgacatgttctcaggcagggcaatcaaatggattggaagtggggatcgcgagggtcacgggtgtgcacgggtcttgaagccaaagaagggggacgaggccttgctcctcagagcagatcacatggatctggggatatcgggaggtacatgaccaattatggaatcactgagcaaacaggaatctggaggtgacacggtgggagggcgcccacactgaggactcggcaggggcccacactgaggactgggcaggggcccaccacgaggccccatccgctgcagggctggcagggctgacagagatgacagaatcggaactggactccgtctcaatgtagggggcaatttcggcaacagccagcgcggccagctcctcgtggcaagggttgcgccactcagcgggcagcaggttcatgtcgaactccggtccagcgtatgcctcctcgacttgggcctgcacacgggaacaagagcgaggcgctcagaacaggctgtctatgccgcggatcgtcgcagttttcatggcgcgggttattgatgcgggatctgtcgcgtcggggtaactgccaccaaagggcaggcccgctctctgcaccctgggccacgtgcccccttcctcaccgacatgttgtaggcgttggacactgccatatattcgttgatctccgcggacatgtcgaccaaccgggcctcaaagggtttggcaacgggctcctcggatgggaagcagaaggccagagaccagtcgcgctcaaagctgcttcccagagtggtgcggttagccgcctcttccttaaacatggagttgatggaactgatctggcaatgctccacgatcctcgtgggcaggtcggcccacacagggatggcggagttggggatctgtcgggaaggggtcgcagaaccgaaaccgttgggcaaaagcaagtggtcatgtacatcgcctgattgtggtcatggctgccatcatcagtcatgtacactggtggattggtttgatgtgatgatctataggcgcgacgcgggcgatcagattaccgatgcccccacttacgttgtacagcagcttgcgggcaacacggcgggtgggctggcgcacgggtgacgaagccattggggcgttgcttgagggtactgttgaggatctggctgagtcagttctggcttgagatgggagggaatgtgtgcgatctgaagcaagtgcctgggttttgaatgaattcgtggacagatgtaagccccccttccaccgaacgcccgggtccacatgctccgccccaaacagcacgggttgtgctgtggactagcaaaacagatcgagcccgcatcgcatcgatccaaagtcgctcgcctgtgaaa

SEQ ID NO: 18373 - DNA, 73 bp, Chlorella protothecoides
gtcttccgtgctccgctcccccttgccatatgtatttgttgggtggcgcccatcacttccctcgcagattgga

SEQ ID NO: 18374 - DNA, 139 bp, Chlorella protothecoides
ttataaaaacaataagaaaggagtctaaaagttttaaaaggtaaatttttttctataaatttcatactattgattgataatttataaaattctggattagtatttactattagtacattacccccattttctaaaatct

SEQ ID NO: 18375 - DNA, 67 bp, Chlorella protothecoides
ggcgcctccgtcgcctggaggtccgtcgagggtggcggcctggccctgccctgcgggccaggcatgg

SEQ ID NO: 18376 - DNA, 77 bp, Chlorella protothecoides
ccgtgatgggtttcggtcatggacaggtagattgagatgcatggctgtcctcgctgggaatcttagatctttaacgt

SEQ ID NO: 18377 - DNA, 10588 bp, Chlorella protothecoides
gatcgccgctcgcccgcggccgagcggcggtcggcccgggctgccaagcgcgcgcgccacgcggcggtgtaccaggcctcggccctggcggccacctttggcatcgtggcgctggcggtgggtgccaccgcgctgcgcatcacgcgccacctggacgccggcgacccgctccccctgggtgagctggccggcacgctggtcctcatggcaggctccgcggtggccatggagatgtacgcgcgctgggcgcaccgtgtgctttggcacgacgcggcctggggctgggcgctacacgccagccaccacgcgccgcgcgagggcgccttcgaggccaacgacctcttcgcgctggccaacgcgctgccggccatgggcctctgcctttacggctttctccggcccgacgccctgggtggcgccctcttcggtgcgggcctgggcgtcaccctctttggcatctcctacatgtttgtgcacgatggccttgtccaccgccgcttccccgttgggcccatcgccgacgtgccggtgctgcgccgcatcgctgcggcgcacaagctgcaccactctgacaaatacgggggggtgcccttcggcatgttcctagggccgcaggtgagcatgcgtgggtgtttcaggacagagggagagggaagggggatttgaggtggctttggggggcaccaggggcgccagcgcatgcgtggaggtggctacaaggaccgtagggccctacagtggcatgaactgctgtgctggtagagttgagtagcatggataggtgccgagaacttggccaggcgccagagggtcccgctcttgactctgcatggcgttgcccgggtacactcaccagcaaaaacacactggaaactcacccaggagctggaggcggtgggggcgggtctagacctcgaagcactgctcgccgctcagagcgcgaaacgtggcgccaaggacgcagaccccctggccgatccctgattgctgccctgggaccagggcaggcaagcacctgcagcagcagcgcaggtcctgcacgattcccacccttggacgcttccccttagccttcccccttcgcctttcttgccatacctttcatgctatgccagaatccatccctctgagtcgcacgcgccgctcgcattctttgagacccccgcatgtacgacctgacacccctctcttcccagggaagccgcctgatcgactgccacgtctccccttttcgatttccgttgtgttgcgtctgcccatagccatgctgccccccccccatttttgctattgtcttcccagccagccgtggaatcggagggctcgttggtggggctgccctgctccacgcttgcacggcgctgcccctcctggttccgttcacctcgcaccctccccatgcacgtctgtgtttgtaacaaactgcgcaagtgttgagctaaaggtttgtgtgaggcaaggtgcgggggcccagccacacttgggaggttgatgacagcatgccccttgacaagttgagcaaaggactgttcaatggcaattctggactcaggacacgtccatgaactgtgcagtgctcaacaacctcgggccttccagtttggacaagaggggcagcattgttgcgaccctcgacccggtgagagatgaggggtccaccatgtgtcacgcgaacctcctggaccccttgccgctccaagagggtcgcgccctgcccgatgggccggcagccccaccgtcgctgctggacatggtgaacaactggcggcgggccagctcctcgtctgccagctcctcttcgggggtggaaatcggggcgtgcgccgccggcgtgccctctgcggtgggggcctcggcccggggcgcccctcccccaccgatgcgcagcacggaggagaggctcttgcccaggctccgaaggctgccgccgcggcccccctcctccagccccgcagccgctgccgcgaggctgggatcggaggccagggccgccaggcggtcagcctccagctcctgccaggtcttgatcccgggcttgaaggagctggcggccgccggggcggggcgcgcagtcacgggtcccgatttccccgtgcccgccgcgcggcgcccgctccagctctttgtcacggccgcctgcgccttgccctctctccgccgccggtcccagaccagcaatgcgatgacgacgacgatggccgtccccgccacggcgcccacgctcaccgccacaatcgctgcgacgctgaggccgcccccacctcccccaacaggtttcgcccacggcgagggaggggccggggggggcggcgcgtctggcggtggcggggactcgtacgggctgggaggcgggctggggacctccggtactggggacaggttggtgatggaccccgtgcccgagaagaggacgtggagtccctcaagcgtcaggccgcctgcaggcatgggaagcggtgtggagttggatggctgggggtacggcagcggcggggcgggccgtgttggagagagaccaggcatgtggcacgcagtcgcggcgtaggagtctgaggcttgcctccaaaaacacccttgtactggaccttccatcagctatgtcgcccttttgcgcccctttatgaagaccccggaccctttcagcatcacccccagctcgtcaacccctactcaccggcttgcagcgcggagatgagcgtgccattgtcgatcttcccctgcagccgcgcggtcaggcgcccggcgttacgggtagtggtcgcgaagaacaggtgggctccatccatgcccgacgacacgcgcgaggaggcgccggccacccccggcggcgggggcgggggcggccagggcctctccatgcggcagttgcagcacagcccctccacgccagacttggtgtaggtggtggggctgatggtcgacccgggggcgttgcgctgcttctccaagcaggcctcgctgcaggccgccatgtcgggctccaccgtgtggaagatggagttgcagaccgtactgctgtcctgcaacaggcggcggctggcggggggaggggctgaggggctggtctcggcgtccaggttgcagttgcagcaaattgcgcctgtgaggagagtgggcagcaggggagtggttcaggcagggatataaatcggggagagctgtcaagagggcccagcaggaaccactggagcatcacttggtccacgacatggagctgcacaccaccaggatccctgcagcagatgcatggagctgcgcatccaggaattctccggccccacaactcccatcgcaactgagcccactgcaagggtgctcccccaacccatcagaaacgcaccctccgccgtgtatgtctctggagcgacggtgctcccggcgcctgcatccacccagccctggcagttcacggagcatagggcggcggtggggaccggaaagtctgccgccgtggcgcagagggaggtggggttggtggtggagatggtgggctcgaccccagacttaaaaccctgctggctgctgaaggtccaggggtcatacatcatgctgctcaaggcatctgacacggccttcgtctcagagggcaggagggagtagggacagcccacgagggtgattatggcatggtacaccaacttatcggcgcccactgcaggaaggggaagcgaggggccggtggggacaatgactgccggggacccctgagctctaagctgtggcgggtgcgagagtcgaacataatgcatgcatatatcctgcccttcaagccgtgtcgaggctgcagcaggctgcctacctgcgtgatgcacaagggaagccaagatcaggagcctccaggcccaaggtagcatggctgagcggcgtagcgacaatttgccgggggggcggcttggtgctggggcagaaatcctggatcacgagacgacccagtgttgaggttgcatagctcttgaaagtttcatcacgcgtgaagatgtctgtgacgtggaaccttctccgaaagggtgagcatctgcagatccgcggcctagtgcccgagaattgggatccttcggctgaccttcataaacatatgatgagtatgagtggtaaaaaatactttgaagctctccaagaggatactgggggttggctctcataagcccgataccccatgtattccgagatgcgactcgaggttgctttcttcccgcggagcgcatcagcccggttcgcaattaagttcctgtgcaatacgtacagtgcgagctgaggtctcctgcgcattggaggtgcagtaaactggcccttttagactgaatcgcagccagtaacaaagctttctcgggctgcgggattggaaggctccaatgggcacccgacgaccgtggcccatccctggcctcgtcatcgcgacgcttgctctggcatgcattccatcttgtctagcagagcaggtgatagatcggagcgtgtacctctcgatgatgcagtagctggtgccctgcccagctcaacagggagtgatcgaaagtgtgtgtgtttgtagagcagcgagatcttgccctgatggcgctcctcttcctccacattcagagcgtattgagcgtatctgacattcatctgacagtggaagacggagaaggggtcgtgctggcgtcgcacaccatcctgcggggggcgacattggaggacgccctgacgctcgagaagggctgttcgctcaaggtgcgcagctgtggtcgggctgctggtggcttggtatgttataggtctcaattccaaggtatcatgcattgagtggtagccctttcaacacgtatctgccctcccggccccagggcacatgttgctggggccttcagtacaatcccgccccctctccccactccccgctgcccccccttccccaggcatccttcaagccagtgctggggtcgcagtccaccatgttcctgccgcagcaggccttcctgcgcgtcgactcgccgtcaggcaccgccaccgtcgccgtcgccgcgcggccctccaaggccggggacgcgttgattgccacggcgggccactccgcgctcgccgcacagctcgcgcctgggcccacccgcctctctctggtcctgggcgacgcctccctgcccctcggactggaggccgtcctgggcacactggtgctgggccagccggcgccgggccggggctacaaggcccccgtcctgggccccctgcccgagatccagcaccggcaccgccagccggagcggcgcgccaaccccttggcccccctcaccgccctcggcggggtgctggccctgggcgccgccttcctcctggccctgccggcccgcctgggggccaacctgaaggtgggcgagggtggggataatgacgattggaacgggggggtgacaggagtttttaacccactgagaagaatgtgcagggtgcgcgtctgctctgcatcaggtgcgggggccacaggaacccacgtcccctcattctcgaatgatggccttgcctcgctgcaaggacgcgctcttgacagccaaatcccccagcccccgcacccctccgcatcccacgcagggcttccccgctggtggcagggcgggcctggcagcgctgggctttcacgccgcgctggcggccacgctgggcacgctggccctgttctggctgcgcctgaccctgctacagacgctgcccgcactgggcgcgctgggtctggtcgtgaacgggacgggcagggcgctcgccgcgacgcgcgccccggctgctggcgggcggaaaaaggccgagtgaagagggggcctctgcgcgtgcaggctgcccgggtttcggccccgtggcgctggtctgcagcacaggagcaggccctgcttctgctgtcttgccgaagctgggcgcctgcactgtgcctgggctcgggcctgggcccaaggggtccacccgtttccatggtctcccaccctctccctgctgtccacccctgctcctgctactccgccccccacgggccccattgtatgtaagaaaagtttaccctggttaacaacgcggcgcccattggtgcatgggtgtgtcgaggacactgcttccctccttgcgatgctgcgcacgcggcgaggggtggacgcgcgggcacccgagccgacctgcgctcacagtcccatgccggtgagcccgccgtagggcacgggaaggtgggtgtcgagcgcagcgtgctcagcgtgcgggtccatgtcgtccaggagcatgaccctgatctggagcgcgacgatgccggcctggccgtcggcaatctgctcatcatcccactgcagatgcggtgggggcaggtaggggtgacgggctggcggggtcgctgtgcgccctctccaatcacgcctccgggaggctcaggctgcatccccaaacctggcgccctgcaaccagcgggtacagggctgatcgcccgcaccctgtgcgccactgtgcacacgtcatcggcacgctcggcggcctgccctcaccttgcggacgggcatgaggacggggtcgccacccaccagcatgacctcgatgcacttcttggcctcggcgatgctgatgtggcgctgctccaccgcgctgatgccctccataccgctccgtatggcctgttgcaaggggtggggacaggagggtctgccttttctcaacccagggaggcagtgctgggccatgctcgcccacctgtagggtcctgcaacccaggcccgcccctgagccctgggggcccaactcagacctgcaactcccatcccccccccgccgcagcagcgcacctggggcagcagctccagcatgcgctcggtggtggcatctgccaggcagcggtcgaaggggggcaccaccagcacgccgtcctgggtcaggcaggccacgtttgaccccggcgcggccgccacgttcccctgcccgtcctgcatgatgcccatgtcgaagcccccggcctcggcgtcgtgctgactcagcaccaccgccaggttgccgacgctgcgcagggtcgcaaagtagtcggggatggcggggacggggctggtcttgacgtgccagcccctgagatactctggagggggaggggggagagagggagtgtgggggttgggaaggaatctgggccgggggaagaaggctgcatcgtggaaggaatggacaggcagttgtgcacagtgtagaggtcccatgggagactttgggggggcatggttacctgacctggtccgcccaccatgcccggcagtcagccaggcacatgtcatgcacacgcggttggttcttgctgaccttcctccttgctcttgggcaggggggcggtggaggagacgaggacatagaaggaggaggcggcacaggtggtccccgccaggcccaggtcatctcgtccagcgcaggcgatgaccttgatggtgcctgttggggatggcaaggggcaggcgctgtgggagtgcacgtggggtcagcgcacgggcgatcgtgggtgctcatgcgcgatggaccaggacccgatgccccaaacctctccagcatgcgccacccatgacccagggcatgccatggcccaggcatgcagaggctcctcaccgctcagcttggtggaggcggccgccgtctccagcaccgttcgtgccatctgatcaacgcccaagtctggtgccaggggtatgtctgccttgaccatggagaggaagagcctggggtggcggagagggggacgaggattggtagagggggggcttgggcatgactcgtcgctctttatcctgatccgacatgcccaatgatatggaaagaaaggtatgcctcagcagcacggttcccatgcatcaagaccccgaccagggacacatggtactctgctgcaccacccatgcatccacacctctgcaggtgccgcttgagcaggtagatgtggccgtcctccaggcgcagtgtctcgtagacggcgtgcccccggtggaaaccgtgctcgtccgcatgcaggagcatgagcgctgggtcggtcacgatcccacccagctcgctggagaagaaggcggcggcgcgctccctctgccagcgggactggcgggcgtacatggcctcgatggcctgcggagggggtatgggcagggacgtttcatgcatgggctgaccccccacacccatcgtgtgggggcatgggcatccggtgggacaccgagcctcacagcgagtggccccgccgcccacagcgcacctcatcggcgtccagtcggcgcactgggtaggtacgggtgctcgtgggagcaataggagtatccaagcccgccgtcgcgcgcggagcatgacctcgtcggccgacacactcgtgccgcctagggtgcaggggtggtcttgtcttgaaccacgccgttggactcggagacggaaccacacacatcgcgctgggagcgctccacgcgtgtgaaactggtgatatcattgcattatgcactttgaattggctgggaagaggatgtggtctccgggcgccacagcttcaggcgtgcttatctgggatgcagtgctccacaacagcaagcttgtgctgcagagggcaaagttcccgatgaatatatgcgatgtattcttttgaatctgcatgaggctcccaagcttcgtgcggtgaaaggtgcacaatccatgtcgcgaagttgaacgataacgatgcgtacgaaggagggggtgcaagcctcctcaccagtgagaatgtgatgatcagcactgcagctgataagatatccccaggtcttgtctctgcagtaaagaaatcacacaaagccatggtacttttgctccgatgtacactgcaagaagattgataccctcaggctgacacagtaataccactcacaactgtccgtccgcttcatggaaattccagaactaccacagttgaagtgtgcggatttttggacctaaaagataaagagctactgtaggtcccaccaaagatcaattcgatgagctgtggggaggaggcaagctaggactgggtggttgtagggtttcgagagtgcaccgagaacccctaccaaaccctatccgcgcggtattcaggaacggcctccctaagtctgagcaattgtcgacataccggacggttgtggactgctacaacatgcattcatcttcgagggagcaatccgcaggcactttgagctcctttgcgtgctcggctgggccaccacgaccctcgggagcaccgcgccgggtgctccggagcccagcatcaggagcagaagacgccagacaccggtacagatgtttgttttacggtgagcgagcaaacagcaccgagatctgcgccgagaggtacgccagaggcagctgccctgcaggctttgtgcacctggcctggcgcctgtgctgtggcatgctgcggcgtcacccgctcccgaggatgagcggaaacgtgccgccttgtcacgcccgcacggggtgtcgcccgagggcgcgcggtgtgcagcacagagtttttagcgatagtttttatgtttatccgcagcgcagggccttcgtggtaccgtcaaaaccccagcagggtttggtaaaccctacgccctaggggccactctccggaactctcaggatgagtcagcgggcgtataatgtgtggactgccaaggaggtggaggcgctaaaacggggagtggaagcgcatggagtgggtttttgggaacaaattcgcagcgatccgcagttcgaggtcctgaggtgcgcggggtgtgcggagggtcccgggtgagggtcaccccactggcctcagcatttcggcattgtcctgttagagggtttggggcagcatgggtgccatcaccgttccgttcgtcggtgcaggggccggacgggtgtgcagctgaaggacaagtggcgcaacatagtgaagttccagcgggcggccgcgctcaggtgggtccagctggtggcacggcgggacgcaggggcgctcgcgagctcggccgagcctttaagtcaggcctcatgactgcgtgctgtcttgcaaacgtgctggtctcacggggcctggtccctgtgggaggccgcatgctgctacaactcgcccacggctggcccgtcccgacggcctgcttgagacgtgcccgctccctctccctccagccatgccatcccgttcgctgcacaggaatgaggcggcgagccccgcctctgccaggtggtctcggcgggggccccgcgctgtgcgcactcccagcccgcccccctccaccgcagcgagccccctccccatcttcaaggaggagccgggggtcgccgagcggatgtacgtcgccgcgctggcggctgcctgcaccacctccgcgctggccagcagggacccgtgccccgccaacatcgccgcctgtgcggcggcctcggccgacctgcacctggcgcgggtgcggctgctcggcgctggcgccccgtgccccagccacgccgccggccagcgccgctccggcagcgcgccgtccgtccagggcttcgatcgggggcttgcgggcccggcgggcgcgcacggcgtcgcgctccccctcctggacctgcaccggggcggggcgtcctcggcgccggcgcccagcggcgg

SEQ ID NO: 18378 - DNA, 79 bp, Chlorella protothecoides
aaaaaaagttattagtattttttattttttaatatagaaagaaagtaaataaatgaaatttttaaaatataagtatttt

SEQ ID NO: 18379 - DNA, 334 bp, Chlorella protothecoides
ttttttttaataaaacccgcccaattaaccgtgtttcgttatctggattattaattaaaagtcctgtgccagttccacaatctgcgctagaaactacaatatgttgcaccgtatcaactagcctgcgtgtaagataacctgaagttgctgtacgtaaggctgtatcaactaatccttttcgcgcaccgtagcaagatattaaatactctgtaagtgtaataccttcacgaaaattactttgaattggaaattcaacaatggccccttgtggatcagccattaatccgcgcattcctactaattgtcgaacttgcgaaacattaccccgagcccc

SEQ ID NO: 18380 - DNA, 62 bp, Chlorella protothecoides
aggaaaggaaatgggggttccgcacatggcggtggagcaagcatgatgtactgcaagcatcg

SEQ ID NO: 18381 - DNA, 65 bp, Chlorella protothecoides
tttatataatttatatttttatgttttttgtactgtttaataaacaatgcaaaaaacataaaaag

SEQ ID NO: 18382 - DNA, 9415 bp, Chlorella protothecoides
  modified_base (436)..(445): a, c, t, g, unknown or other
  modified_base (858)..(867): a, c, t, g, unknown or other
  modified_base (1783)..(1792): a, c, t, g, unknown or other
  modified_base (2054)..(2063): a, c, t, g, unknown or other
  modified_base (2445)..(2454): a, c, t, g, unknown or other
  modified_base (3401)..(3410): a, c, t, g, unknown or other
  modified_base (3858)..(3942): a, c, t, g, unknown or other
  modified_base (4639)..(4648): a, c, t, g, unknown or other
  modified_base (4906)..(4915): a, c, t, g, unknown or other
  modified_base (5385)..(5394): a, c, t, g, unknown or other
  modified_base (6855)..(6864): a, c, t, g, unknown or other
  modified_base (7801)..(7810): a, c, t, g, unknown or other
gtccgccgtttcctggcgcgcacggcgcacggcgcgcgcgacgcgcggcgaggccattgtcggacggatgcggtggcgcgaggaggtggcggccaagggcgcggcgcggggggtctggctgcgggggcggggagttgaggcgcgggccggggcggtgggggtcaggctccgttccgcggccgagcgccgcgtctggatggtgcccagctccgcccgcacctgcttcctcaaccgaatgcggtccgcctcctggtgcatcgggtatgggaggggcagcgcaggtgtgagggacagacagcgagtagatgcgctggacgcctgtatccaggcagttgagtggtgatcgagcagcggtaggctcagccgaggagacatgtacgcccatcccacgacaatcgatcctacgccacaccccacactcctgcgaatgcgccannnnnnnnnnggttgcgctggacgcctgtgtccaggcagttgagtggtgttcgagcagcggtaggctcagccgaggagacatacccgcccatcccacgacaatcgatcctgtgccacaccccacactcctgcgaatgcgccagcgaccccaccacgaccgccagcacacggccaaccacacccaccgtgagggcgtcgcccatgacctcagactggagctggctgttggatgcctccagctccgtgtccaggcccctcaggtccctcaggatggcagagaagtcgtccagaaaggcgtcgcgagcaggcgcgacctccgccgccttcttctttggctcagcacgtcgcggccgttccttctcgcgcggtcgctgctgctcaccctccctcccctcctcgccgtcccttccctcctcctccccnnnnnnnnnnattccttctcgcgcggtcgctgctcgccctccctccgctcctcgccgtcccttccctcctcctcccccggtatgaggagaggggggcacagggcccagcccgcctccagcctctccagcgcgttggagtagcccaggggctccaacgtcctgaggtgcgtggcctccgcgaccgcaaaggtgcggtgctcgggcaggataggccggcgggggacggggtgtgggccggcccgtgggaatgcgcggaacggcacggcatcccggggcagggatccgcaggggaccaggctcccgctcatcatgccgcgatggggggcgggtcgcgcctgcagcgcggcgcccaggcgcagcagaggtggagttgctggcagggcggaggataagctgggcaagctcccggcaacgccacgagaagccagctcgttttccctgaaacaactctaaatccacttttctaatattccagtattgatacacgctgggcaacgctatgcgaggacggaaaggcatgtcgaggctggtgtttgtggtggaaggggctggcgggaagtatggatatggtcacgtgggcgacactgcgtaccactgtcaacattaaagctgtgctggaggcacaactcccgcatttgatggatcccaagttgcacacagtaccttggccgtcccttagctgcgaaataaaggggtgaggtcaaggtgtgaccatgtccacttcacctcagcgcagagcaccgtggtaagcaaatgagcaggcacaccatcggtgtgtgtggcagaaaatatagattcttcacgtccagaattggcgattcaagtatggtatattgggatctgtgacagtccctgctttatggcatctgccttaggtgaatggcgacgctggcaggagtggtgaggatcagggttgacaaattcgnnnnnnnnnnaattcaagtatgatatgttgggagctgtgacagtccctgctctatggcatctgcctgaggtgaatggtgatgctggcaagagtggtgaggatcagggttgacaaattcggtctcccagaaagcactgccgtgcctgtacagtcaggaacttcgccggcagcatggcggacatccttccgcattccccttcagcatctgtgccttacacaatgactgactgtggtacgcttaagagtcacaacaggatgtctccatgtgcagnnnnnnnnnnattcagcatctgtaccttacacgatgactgactgtggtacgctttagagtcacaacaggatgcctccatgtgcagaggcagggcatatttatgcgccgcatcggtggacagccagtctctcaggagagggcctgggctctacctccaccttgcatcctctgattgagcatgaccttcagtttccactcagtggtgaggaggcctgggagtcacagcgtgcctgcagcaaccccagctgtggcccttcagtggtggtgggactcctcgtgtccgtgtgcctcctcatgaagctcgtgctcaaagtgagcagcgggcccatactgcgtggtatggataaggggatggtagtttttggcagataaatgggtgatgtttcacacannnnnnnnnngtcgtgtccatgtgcctcctcgtgaagctcatgctcaaagtgagcagcgggcccatactgcgcggtatggataaggagatcgtagttcttggcagataaatgggtgatgtttcacacaaggcatgcacaataaacctcgcaagaataccctcagctcagctacactcaccacaaagtgatcaaagtcgtggtagaaccggtagagcacccagaacctgcattgtgcgatcaattctgttgcgctgaccgcggatgcggcagataccagtctctgccttggcaagcactggccctcctggcacgtcccaaccctggcactcaccacatgacaccggccatgccccgcccgatgttgacgtgccagggagaggccttgtgcagtgtgaggccctcatacgttacatcgtgcccgtggccatgccctgcagtcattgcgcatagggcgttggagcagggggacattggagagtgtcacagctcggcaggtcgagtgccccagacaagcacagcctgcaaaccccacctgaggcaaagcttcgctgctgtagggcgttggtgttggactttggtgcagcgtgcagggttttgctgccggtgctgtacagctgacgcgcaaccctgctgaaagcggacatgacacccctccgaccgccaggccgcacgggtacgcaggcttcctggaccaagctgatgaagttcgtcgggtgctgtatccagatgtcgtgacatgggccaggtggatgtggcttacaacatgggaccgtcctggagtctcgcagagcgcacccgagcctcgtcggaggaaagtgggggtgcccctaaccaatgtctgaggaagccttgacgccaccctcgcggagatctgaccaaggccctcgggatcttgtcgtgtacccaacacctcgttgaatcaattgaagatcagcgcacgttgcactcttgcatcnnnnnnnnnntacatgggaccgtcctggagtcccgcagagcgcacccgaacctcgtcggaggaaagtgggggtgcccctgaccgatgtctgaagaagccttgacgccaccctcgcggagatctcaccaaggccctcgggatctcgtcgtgtacccaacacctcgttgaatcaatcgaagatcagcgcacgttgcactcttgcatcctcatccgacaagccgtctccaggccgggagctggtggctgaggctcggcaccaatcgacgggaaggtcagggtcgaccagcccccctccaatggcggatgatgacaagatcaaagccatccgggagctgaagtcccgctttgaccacaacaacagcgccttgaaacaggtgtggggccttggggtgctgcttggggacctgctgagaaaaggccctgcatcatgtccaagatggacacttgggggtgcatannnnnnnnnnnnnnnnnnnnnnnnnnnnnnnnnnnnnnnnnnnnnnnnnnnnnnnnnnnnnnnnnnnnnnnnnnnnnnnnnnnnntgcttgcccacagatggagtcgcagcgccggcagaacgaggtgacgctgcgcagggcggccttcaccgcagcccagctcgacggcctcccctccgacacgccctgctaccgcggcgtgggcagggcgtgagttctgggtgtgggctcgctgtgtgctggcagatcgtgcctgtggtgtccgaggggaaataagtgtagccagggctctcatcgggtgggcgttgctgtcgccaaggccctccccgtccatcccaaccctgcaggtacttcctgcagcccaaggagtcggtgatgacctacctggagaccgggatcaaatcttgcgacacagacctcaagcgcctgaccagctcccgtgacgccctggtgaagagccaggaggagctgcgcaaggagatcaccgagctgatcagcacgcggagctgaaagtgtagattgcatggcgtcgtcgccgggcagggtgcccccatgcgcgctcatattgccctttctcgatgcacaagctgcgcatcaagtggcattaaccgcagcaatccacgccgaagcaaggctcgaccgtgccaaatcggcagctggtttgtccatgtcatggcctagtgtgcttatggacgcctgtctgcctgcgtggtttgctatcacttcacctttgctatttccatgcccgtctccgccttccctccttctacttgacagcacnnnnnnnnnnccctgtctgcctgcgtggttggctatcacttcacctttgctattttcatgcccgtttccgccttccctccttctacttgacagcactccgttacacaagttacacacccacacctgccgctcataatttcagcaagggcagcatgcagtgcttggggcttccatgacggtgccgagcatcaagcagtcggcttgaggagggtgccagtggggccagccaggggcagaccaggggcacaaacctccagcagggataacnnnnnnnnnncgtgcttccatgacggtgccgagtatcaagcagtcggcttgaggggggtgccagtggggccagccaggggcatcccaggggcacaaacctccagcagggataacaaaagggagagactcggagcaagcaagggacaggcgtacgtgaatggtaccggtggtggtgctggaagataggttgcagcatcgggcggtgtttgaagcgagggagcaaaagcgaggaatcggtggtgggtatgctggggaatccaggacctgggagtggaggcctcggcgcagaacaacacaggagcctgagtgccaagcggcccgctcctcgtccgcctcgagtgatgccgccccacagcatgccgcgccggccatacaagctctcgcacccatctgccaggccagcttttgcccccgccatgaaatccccctcccaggtctctgcgcgcgcgggcctgcgccgcccctacttgatgtccaccnnnnnnnnnngtgccgcgccggccacacaagctctcgcacccgtctgccaggccagctttcgcccccgccatgaaacccccctcccaggtctctgcgcgcgcaggcctgcgccgcccctacttgatgtccaccagcttgatgaccgaggcgttgccgatgcgatgcatggccaccacagtgtcgccgcgggcgcagtacctcgagtcgcgcgcgtggtccagcgccgcatgcagcagctcgtcggtggtgtcgctgtcgctggccctgtgggtggcaggtgggtgggtgggtggggaatgttggcggcggtcggagggtcacgaggggttcagttgaaggcccctttttgtgtgtgtggtgggggggggggcataaccgggagggaggccgcaggtgccagagataaagtgtggcgagggggagacgccccacctgttggggatgtcaccaacagggtgcccagcaaacggatggggcacctgatacaggagctccctggatgattcaggtggccaccacgcagcacccttccccaacccagcacacttcaaacacccacccaaaccctaccaacctggcggagccttcggccaggatggggagcaggccgcgggagatgagcatctggcgcgcggggctctcgctggagcactgccaggtgaggttatcggtggtgagcacggggacgacgaccgtaagcacgggcacagtggggcggtacttggcgacgaggcgcgcggtggcgccgccgcgcgtcagcaccacgatcaggctggcgccgactttgtgcgcggtgcgaaccgccgacgaggcgagagactccagcgggctcatgggcagcggcacgcgcttcatgatggcccggaacagcgcggtgtagttgatggaggcctctgcctcatggcagatcttggtcatcactgccaccgcggccacggggtaggcccccgccgccgtctccccgctcagcatcacgcagtccgtgccgtccagcaccgcgttggccacgtcggtggcctccgcgcgcgtcggtcgcgggttcttggtcatggactccagcatctgggtcgccgtcaccaccggcttccccgccaggttgcacttctggatcatcagcttctgggccaggaagatcttctcggtggggatctccatgcccaggtcgccgcgcgccaccatgatcgagtccgacttgtccaggatgtcgtcgaagttggtcacgccctcgtggttctccacctgatgcatgtacgtggcggccgacggggaggacatgagcgctgggggcctgggcgctgcatgcagtgcacaggtttgggtcgtgcgtcccagtccactgcatgtggtgagaaacgctgcgccacagtgctacccccgcgctgtcacccgggcgtcgtcgccccctgcgctgtcacccccacattgtcaccccgcactggcgacgccccatcgtcgtccctccctccttcnnnnnnnnnngacggtgcgccacagtgccacccccgcgctctcacccgggcgtcggcgccccctgcgctgtcacccccacgttgtcaccccgcactgacgacgccccatcgtcgtccctccctccttcaccccttgcaaccatgaacagcccccccacaccttgctgatgatcttgatgtactgaccacgcgggcccagcaccttgcggatgtagtccaggtcggagcccttgcgcacaaaggacgcggcgacgaggtcgatctcgttgggcacgccccagttctgcaggtcgtcgatgtccttgtcggtgagggtgggcaggtccacgatcacacctggcaggttcacgttcttgcgctcgcccagcttggcagagttgaggcagcgcgcgcgcaccgtgcccgccgccgggtcggtggacagcacctccagcgagatggagccgtcggccaccaggatgaccagcccgggccgcacgtcctgcgccagcttggcgtaggacatggcgatgagccccttgttgccccgcaccccgtagtcggtggtgatggtcacctcctggccggcgtccaggaagacggggcgctcgtcctccaggaagccggtgcggatctcggggcccttggtgtccagcatcaccgcacacatgatgcgcgtctggcggcacgcctcgcgcaggttgtccagcacgccctggtggtactcgtgggagccgtgggagaagttgaagcgcgccacgttcatccccgccaccagcatctgcttcagggtctccacactggcatttaggagggggaaggggggggggaactttcaggcgatgggccccgaggaggaaggcctccaccgctgggcggtgaggaaggcgtgggaatgaagtgacgacgtgaatgcagctcacggcaccagaggactagccccaagacgccagaggttgggggggagnnnnnnnnnncggagtgacgacgcgaatgcagctcactgcaccagaggaccagccccaagacgccagaggttgggggggagggtcttcccgcaggctcagcagacaggggcgccatggagacgtacaaagaggattactaatcaggatgaagagatgtgcgctcgacatcgacagccttcggaacgacatgaacaagtaatacgctcgacctcatcgctcatgtgcgttgtcatcgccatcaactattcaatagacatgggcacagccgcccagcatggcccgtgcaccaaacccaattctcacttgttacatgccggccccagggtacagatgacctgcaaggagggaggggaaagggcgatcaggcggggtacaagcacgaggacgggcaccagggcacctcaccgccaggtgaatgtcggcatgcgccggctacagacacaaccatcgcaatcttgaatgatgcgatccaaatacagcacgggaggggagggcggccagcacaccatcccgtcatgcgccgcgatctgtgggggagggggcccagccctggcacggtcccccaccctcccccacccaatgcctgttagaccaaccccgcaaaccctcgcgcgccttggtcttatttcctccagtcagatgggtggacaggatggcatccggcccggtcgtgggacccgccctgccgtccattgctcgaatcgtgcgagtcgctgcacagggttgccgggtggcaggcgcgggtttgggttcgagggtccaggcgcggactctttactcgactcgccgacctcaaattgctcgacggaatgtgtgatgcgttgtgagtcccggctgcgggccttggccgcccagtacgctggcatcgctgggatggtcgtagggttcatcacgaggagtctctccccgccttcccgccatgcctcatggcctctggggtgccgcccttccagacacgatccagccttggattttgcataacagcgctcatggccacgccttcctggtgctgtgttcctctgctgattcttggcaacctacagggtctcggcgggggctcctcgtcacccccctccccccccctctcggtcatctcagacccccaaccacagggtccaggccatgaggcctgcccccagcgcgatgcccgccgccaggcgcccccccgccctgcaccgccgcgcctcgggccagagctccagcacgcagaccgcagccatgaggccgcccacgccggccagcatgagctgcagccgcgtggccgtcagcgccggccgcgccacacagatgaccagcagcgcgcccagcggctcgctcagccccgaggcggcggccaggcccagcgcgcgcgcgcgcgaccccgtggccgcgtagacgggggcggccacgatcacgccctcaggcacgttgtgcacggcgatcgccagcgccatgaggggccccaggggcgtgaaggcgctgaaggccaccgccgcgccctctggcaggttgtgcagcgtcatcgtgccggccatgagcaggcccagccgcagcagctcgcgcggcgactgcggcctgcgtggtgacggcgatggtggcgggggtgttggtgggtaggtggcggagggggtggtg

SEQ ID NO: 18383 - DNA, 78 bp, Chlorella protothecoides
aaaaaatttaatgcaaaaacagttaaaaataaatgttatctaaaatcaaaattttttagtaaacaagtttttacttca

SEQ ID NO: 18384 - DNA, 81 bp, Chlorella protothecoides
aaaaatatttttaaaaatatttttcaagtagttatttaattataaattagacgaagcagctgaatcctgcaccatagatgg

SEQ ID NO: 18385 - DNA, 69 bp, Chlorella protothecoides
gtttccaagggcaccccgaaggtatccgagtgtgcgtcggcgtgccaggctggcaagacaggtgccgga

SEQ ID NO: 18386 - DNA, 365 bp, Chlorella protothecoides
ttttttatatattaagaactataaaaaatcagaatattaacaattaaaataaaattattctctgatcatattatgatttcaacagatacagatacaactaatttagaacaaataagacccgtttttccttttaccgctattgttggtcaagatgaaatgaaactagctcttattttgaatgtaattgacccaaaaattgggggcgttatgattatgggtgacagaggaacaggaaaatctactactgtacgcgcgctagtcgatttattaccagaaatagagagtatagaagatgatccatttaattcagatccgcatgaccttgaattgatgagtaaagaagttcgagaaaaaatacaaaaaaa

SEQ ID NO: 18387 - DNA, 11441 bp, Chlorella protothecoides
cccccccccccccccccccccccccgggtgccacccttagatctgggcgcagctggtagaggtcagcccctcgcaagccagcggcttcgacctgtcacccctggactcgtaccgatggtggcccgggcccgaagccgtccagctggattccctgccccaccgccagctcagcgcgccgttcctggtggacaccctggacctgcaggctcgggcgcgtgccgccgcggctgcgcaccgctgtgggactggacgagggggaggcgagcaaggatcggagcgaggcagcggtgggtcctctcacgagcaaagttgcgaggggcctgccctgccaggtccgccgcagccacctgctgccaacaggtccgccgcctgggaactggacgtcgagctcagcgtcccgaccaccggtgatggaaggctgacagcggtggccttttggtgggacgcggagctggccccggctgccggccccggcctcgcccccacgcggctgaccaaccgggcgcccgacggcggcccggtcacgacctgtgccgtggcgctgcagcacctcgatggcgtggccgtgaagggcgggggcgcgctgtcgctgcgcgtgcgccgagacgtggggcaggtcttcttctccacctccccaccgcagtgcagggcgcggcacgccctggtgccgcgctggcactttgacatggtgcgggacgaggcgcgcaatgtggcctacgacggcgccataaggtgggaaggaagatgagaggggaaagtgagggctgcgagcgaggctggtctgtgatggggggagtgaaaagggacgtgggtgggagggtcagctgaccccacaggcggtccaaggtccgtggtgctggcctgcgccagctgcgctgcagtgccggatcatccggagactcccctcttacgcctgtcctccacatgctccgcagccgggccgtggcgcggctgaaatctcggaggccgggcggggtgcatgtcctggacatgggcgccggcacgggcctcctctccatgatggcggtcaggtgggtgcattggtggtggttggttggatggaaccctgccaggggcaggccgtggtgaggcagcatcaactgcactcgttccagcccaagtttctgatcaagggggggttaggaccaagcgagcagggcgggcagccggggcgtcgcactgaccgctccagagccctgctggcagccccctgtcatttcaggttccgccccccacttcccccaccccaacccctcgttgcagggcgggcgcggcgtcggtggtgggcgccgagatcaaccgacacatgtgcgatgtggcggaggagtgcctggcgagcaacgggtgcctgggacgagtgacgatgttggaccgcgacgtgcgccgcatggccgccgagccggggccggacggcgcgcccgccgacctggaaaggcgcgtggacctcctcatctacgaggtggggggcctggcgaggggagagggcagggggtggggggaagggaagcggtcacgcttggtgtctgcggtgcatgggggaccaacctcgacgctcaagatcccaggatgatgtgggtgctgggcgccgccatgccccatctcaacagggactcccccagatccactgccaaacatccctgcctgtgtggcccaggtctttgattcggggctgatcggggagggggtgctgcacatcctggcggcagccagggagaagctggccgcccccggcgccctcctcgtccccgcgtcggcccgggtgttcgcgcagcccatccagatgcgactggaaagcgcggcgggctttgacgtcagccaggcaaaccgctggcgctggcggccagactacgagggcgtcgatttggaggagtgccggtgggttgaggggtgggcggtagggagagggctggcagggtcttggacagtcggagaaagggcagcacgccatgtgcacatgcagggcagtcaatgcccatcacagtaaccccatatcccctgcttgacccgcggcgcaggaacgactgggtggcactggcggaccccgtcgaggtgtttgcctttgacttctcggccagcctggagaatatgcggccggcctcagcccctcacgagctcctgttcacagaggtgctggggttcaggggcaggggatgggtggcctgctctgagcccggcggggtgaaaacacccctgggggttggtgactgacgccatgaggccaaagagctgagtttctgcccccctgccactgagacatggctctgggggccaccagccgtgggcgatacattgcccgtcggccctgcgcaattcctcctcccggtgaccggccctaacatgatgacttccatcccatgcctcgcatgccctcgcatcgtacaggccggcgtcgtcaacgctgtggccacttggttcgagctggagctggacgaggagtgcacactttccaccagcccccaccgctccggcaagggcccaacctggcagcaggcagtgcagtgggtgcgggaggagcgggtggccccgggccagacgcgggtgctgatcgcctcacacgacacctattccatcagctacgctctggaggaaggcgcagcgcccggccccgaccacgccggcggcgtgcactttgtagagctgtcggacggggctggggagctcgaggatcgggcgacgggcgtgcccctcgtggtgagcactgggacaggtggaagtgggtgatgctgcactccaggtctgaggccatctagggaacgtctctgagtatggcagcgtgcaggcactggctgggctgtgcagtgtctgatatttgttttctgagagccagagcttggaaacccttcataacccacacccccacacacactgccgccgccacaggaccctgtctggaaggaggcgttcgattcgctgcagcccctgaactcccagatcgtgcgggcatgcgtccaggaccccctggagtacagagccattgcgctggaggccgtggcctttgcctcccggccccacgactacgacctggacgccagccaggccaccgacttttgcgtcaagatgatgggctgaggttgcgggaggaagggtgtatggctgcctcagtgaatgcatggtgagctgtgcaatgacaccgtgctgacgcaagaacttgttctgtttatacgcagcagagttccacacggcgtgtctcttgacatgagggtgtcgagcacaagagtcagtgagactgaggcaacagcaagctcgttttgcactcgcgtcgtttccatgggattctcccttccaggcagctataaaattcgaaggaacagggccctgcgcacgcaccccggtcgcttgcgctcctcccatccagcccccctcgcagccctctcacacgtcggtggagaaggagaggaaggtgtccaggatctggaggaaggtgggcaggtactggttcatggcggcatgccccgcctccttgaaaacgacgagccagggggccggcacacgctccgcgatggcccgcagggactggatgggcaccacgatgtcgtcctcaccccccacaagcagcaggtcgttgtcgatgccgggcacggcgtcccagacatccgtctccacgtaaaactggaaaggtttggggggagggatactgtgatgctgccatgggtcgccatcgtgaggcggtaagacgcccttgctcctctttggaatgtgctttcgaggaacctgatatcaacccctcacaccggacagtcttccccacaagatgctccctcacatagtctagtatggcaagggcctggcggccaaaggtggtgccattgtaggtgtcgtacacggcagagtcggggtcgatgaagcgccggcatgccgcctcggcggctgcaatgtcgcgggtttaagaaggatgcggggatcgaatgcctgggctcgaagcattcggcgggatcaggcccttccctcccacagtaaatccactgtgcagcgccgtgctacacaccagcccgccccaatccaaccagccctggtacgcacccacggggaactggagggggaaggaggtgttcagctggtccagctccgtggcattcgggtcgctgaacacctgctgcgcctggagggagggcgcctccgactccgggctgccggcgctgccagacacgatcacgaccttgttgtagtgctccccgtgcaaccctgccgacgcggtagcaataaagcctcccagggacaggcccaggaggttgggtttgactcccagctccagggcctgaggggggtggagagggagcacgtcacatgctgtggccccagggtgcctgatttaaagaaccagtgcaaactccatgaagagctctggaaattcatgtctgggcagtacgctgcaggatacaggtccaacgaaggcttcacaccccgcacctccacaaaggcgagcgtgtcattggccataaggggcaccgtcagcggcttagttgtaaagtcctgtgtggccacgacggtaggaaacagttgacttcttgtgcatccgtctcgtggcgagacagcatagagattgtggcaaggggcatgcatagccagggagacagctgctcgatgacggcggtattcgatggcaacccagtcagcacatcaacagaccacggtcctcaccttggtgtagcccatgcccctgttgtcaaagatgatgacctcctggtcctctgccagcgactccaggagctcggcggaccagaaactcatggtggatcccaggccagccaccagcaccaggggtggccggcccgtcgtggtattgccgaagcggtggtatccaacctccgcgcccggaatggcaacggtgcgaagaggcccgacgaagtccagactggagcggagctcgggagccacatcggaagcagttacattacagaattccagggcggtggcgagggcatcatctgcatcggggattgattttctcgggtgaggttgtgccgcgtcagccgcaccgacagcagccgagatggaagtggctcaccccatgcgacgggttccgaaggggagaaccatcgtcaaacactttcttccatcattgcatgcatttgggcgaaatctcatacctgccgacacacggtcgggggccgtgagggcggccaggaggacaagcacagtccaggcggcattccgaggcgccatactgacgctaggctacactgtggactcaaatgcgccgcctgtggaatgatgatcaccgtgtccgaggcatccccaagcaaatctcatacctggcgtttgtgggtctgtgggagggtctcagtatgacgtggcgtcccgggttgccaaccatgcgagagttgacggtgactccccatcatatttacagggccacctccggaagcaatcggggggcccgtggggaggattgcacacacatgtcattgcagcatggtgtcgatcacgaatctgggcggtggaaggtacaaaaaattggttgtggtatcacatgtccgggtatgcatccaggaacaagtccagcatgctgacgaagctgggcaggtactggatccaggcggcgtttccggcctccctcagcaccaccagccagggggtggtggtacgcctggcaatcaccctcaggccctgggaggggatcatcacgtcgtcctcgcctccaaccagcagcaggtcgttcttgatcttggggagggcctcgtagacctcatcgacatcgaagaactggcgaggggggggggatgggggtggggttgggtggaagggtttgagcagggatggggggtagactcccgcattgctccagcccatcggcaagcgactggcaccgtgcggcaggacctcaaggagcgctcatgcgagtgcaggctccaccccaccccaccctgactcacgaactcagagaaggcgcgggcctggcgctcaaaggtggtgtagttgaagaagtccaccacggagggctcggggttcctaaagtacgcacaggcagccgccgcagctgcacatggatgggagtgggcattgagacagggagggcgtttggtgtcgatggcatgcctcgtgcttactttgcatgtcaaagttcggcatgcattgaatggtgcgcgggtgctggcgtgcatgtggtggtctgctctggggactccgagccccccaacccctccccccagcgccagcaagcagaggccaggccctgccaaccccgccacgcatctcaccgctggtgtgctccagggggaacaggagccaaagcttctccagctcggtgggctccgggtcagacatcaggatgcggttggccgtgggcgtgatgtggcgggagtgcaggctgccggcggtgccggacagcacgatcaccttgttgtagtacttgccgtgcagggcggcgcaggtggtggcgatcatgccgcccatgccccagcccatgaggttcaccttgacatccaggtccaggccctgggggtgatggggaggaaaggaggaaggggtaagtgtggaccgtgggtggggtgcaggcggcacgcgagcgaggcatggccccgtggcattcctgcagctgcatgtgcaaacttagtggagggcccctccccgggcgcacaaggcgaaatgagcagcaggtcaccaccgtaatctgacaacacgcaccctgacaaaggcgagggtgtccagagccatggaggtcacgttgatatagccctcagtgagatcctgcgcatggaggaggggggcggcgtgagggtgtgctcaagggcaggaggtggaagctcgtgggctgacggtcgcatgcaggttttcagggttgggcagcgtgcgcagacgcatccccatcctgcctgatctcagaggctgggccaccaaaggtgctgacccgcccattcaacaccttcccaccccccctgcagaacaagttcgcaccgtgctctggccgatccccctgttgtcgaacatgatgacctcctgctgctcggccaggtactccaggaaggaggcgggccagatggcggaggtctcgcccaggccggcgacgagcaccaagggggggcggccggtggaactgttgccgaagcgacggtaggcgatgtccgcatcacccagggagacgaacttgacgctgcccacaaaatccatgtccttggtcagggggggggccacgtcggcgggggtgatgtcgcagaagtcgtagaccgtcacattcttggtggctgcagggcgtgttgacaggcatgctatttgaatccatgcatcaacttgtcgtccggctcgccaggggcagtggacggatcgagtcccatgatcctacagatcgctggtggcctgatgctgccgccgcgcggcatcgggcatccgtagggtcccagggcagggcaggcaagatggcaccgaacagaaaccaaacaaaacgcaccacctttgcctaccgatcagtcccgcggcggaggcggacaggacgcatccgagcaggagcacggccacagcggccttgaatgaggccatatctatgcagatgtgaggaaaaccggtggaactcgagtgcgtagaagtggccaaattgaatttgtcgggggcgaaggattaatgtggaggagagaatgagggtctgcgatgggatcgccgacccttgtttgcttccagatgctcggccagccgaggaccgcggggagttccggcatgggaagaaatcggcactacgcgcttccggacgtcgtcatgagacagctggagccgagagcccgagccccaatctgtcccggcgcatcacagttatcttgccgctcagtaatgcgcatgataaaaagaatatcttgtatgcaataagtggctcggatggttgcatcggatcgagcctgtcggatcttgggcctggcgtcatcaaaaatttttcatcgacccaggtcaccgtgttgccagagacgccgtccgctcgactggtcagcgagcggagggggcccctccgaccccgtcagattgctgtgggcctctcaaacgctcggcaacaagaccattggggttgaggcaccaaggcctctccttctcctctgctctgcgtacttcgcattcaataggccaaggaatctccacggcatcggcatccgagatcgttcaactaatgtgatcaagcgcaggctatgcttggagctcaacacatcgaaatgatgaaggaatacgttatgggggcgattccccttgcctcatcgtcatctacgctcaggccactgcgccaggacattgttgctcgggcggccgctctttcgatttgtggagcctggccttatgcctggtagggcaattggcaaagcaggccgtctccagagcgggatcgcgaaaggcttctggcggtgttctcccaaaggcaaactcacagctggaaagtggggcagatggtggtgagtggacgtgtaggtgtgaacaggtcccagcactgggctggtgccccttcgtcacgcaaacatcagcaatcaacctgccagtgtggtgccctcacatgggaggctccagggagcgttcgtcagagcacgaggccccgcacctcacctgaaatcgtcgtagtttggcgtcatcgtgagaggcagtcccatgtcctccatgaaaaatcgctgggtggggaacttgcagctgttcaggcagacggacgcgcaccctgactcctccaggtacctacacctgcacccaaggggaatggcttgcgacatctttgcgaattggccagtagcacaacctggagacggcaagacgttgcgctgccacgcttctctcgtgacatcacgctggggcaggcagaatgcacccataccggcaccggcccgaatcaagaatctccgcgagcaatgccagcagcccacgtgcctctcgactttcacgccctggccggcctttggctgaccgtccccatcgtccacggccacgactgagcagggccccatcagccactggcaggtgactgccgtggcccaagcattcaatctcgcagagaaggcggggaagggcttggagaacatcacctggaagcgcggggggcaggcagggtgttggggcgccgcaccgatgacacacattaaggccgttgaaaatgcacgagtcttgcagacagaagccggtgtaactcacagcaaaggcacccggcagccaggggggaaacagcgacttcaggatggacaccgttgctgcctgggtgtcggcgggagtgtttggagcgtcgttcagctcccgggtgaggtcgattatcgctgcatatctgggaacatgtgtgaaggggtccaggttttccagggtccttgcatctgtgcccggcagcagctcagtatgccctcgctcccccaccgcacccctgctttgggctgtcatgtccgactgcagcggccattttcctcctgtagcagtcatgggagatgtgtgcctgggtgggcatgccctgcacgcgcctctacccatcgcagcactgggcaatcacctgaacaggctgtaaactaccctgttgagtggagttccatccagtgcgctgtagtccgtgttgagggggcctggttccgcatgacgcaggccaaaacccctgatcagatggcggggtaagctgccaggatgcctcccatgacctgggtctgtccggaccccaatgggacacggcgcggggctgggcaagcccaatgccatgcgaaccggagtctaatggcctgtaatgagctctgtgagctgtaaagtttcgtcggcctgccccagcccattccgttgtcaagttgcaccgtgggcgttgggtggcagaatccattccatggttctggtggggggccctggccccggctcagggcgcgagagctgtcatgccgcatggacgctgaggatgggaggacagcggccgtcgccgagcatcggcattggtcttgatttctgatacacatctaagagagcagggccagtgctccatgagcagcactgcctgcatagctcacttcctccctccgccaaagctcgggcccggccccgcatgggatggcagcggcagggcccgcgggcgatgcaggccctccaagacgattcgaagcacccacaaatgtgttcggagtgcaatgcaccctgatccatggatggcggtcgcgggactgaccggcctgagttccgcggcggttggatgggggtggagggggaggcgtggcgttgcgggcccctccccgcctccaccagcgccctcacaggagccgcacgtcccctgtcgcaacagggacgacgtgtgggagcgggcctgggcgccctttgaggtcgggcggaccagggccccacgctgcagaaccctagtgctcatggtgagggggtggccggatgcccgggccgatgataggcccctggactcgaacacccagtcccatatccctcagggccccaacagttatccctcctttcttccccacgcaccagggcatcgcaccggcagagcagtccaggctggttgccttggcgctggctgcgttggaacggggcctccccgcccttcctgccgctgacctggcaggcgccgagaaggcgtccctcgctcgcacatgccatgcagtgctcactggcgcagccagggtagtggcccaggcctggctggggtacctgccgttcaatctggccggcggcaccgaggcctgcaatggagaggcaggcggtgcgcaggccggcgccgtagaacggcggcccgaccccatcgcggcgcggctgcaagagactgcgcccctctgccacgccgtcattcgcctgctggggagccagaacgagtggggggaggcgagcggggccgcggggcgggaggaagccctgctgtcggccgcgggccccggtttgggccgggccgcggccttgacgcagctggaggccggaggccgggccgccccgaggtgaggcaactgggcgacgatcatctggcgccaacggcactcgtgtatactgagcgagtgcccctggcagacggcatgggggtgcgccgtcccgccggcgtgcattggttgtgctgtgagcctgactcccacagccctgtgtagggctccaaggtcccccaaaacacccccctctcccgctgcaacacccgcgctcaggggttggagcgcggacactcacgggcgcgggccctcccctgccattgtctccctggcgccctccgtcctgcaggacgccgcggtgacggtggccgaggcggtggcggcggcctacctcgccgacgtggcggccgggaccccaccccccgccctcctgcgcgcctcctcctcagcgcaccagggctccggcgccggcctgggaccgccagcggcgagtcgcgacggccacggtcgatccagtgccggcggcgcatcccaagttgagccgcccaccgtggcaggtggggcggcgcttggcgctgcatcggtccagggaccccgccccgccccgctccctgcagcaccctgcgcgcccgcgcccgccgtcacccccgccgccccggcgagccccgcccc

SEQ ID NO: 18388 - DNA, 68 bp, Chlorella protothecoides
aaaaaaagaaaaatatatataattcccgttaagtttaaaagatgaaccaaaaccattaaattttttta

SEQ ID NO: 18389 - DNA, 90 bp, Chlorella protothecoides
tcagaggaggggagccaacccaaaggccagtcggtgtgccgtgggatacttgggatagctgggcgccaggactgccgggcagcctggccc

SEQ ID NO: 18390 - DNA, 142 bp, Chlorella protothecoides
tagagagtactgtggagtgcacaaaatattcggcggggttaaggaatgaccgaaacagctgcctttccgggcaaacaggttccaccttgatcaggccttcctggaacagaatctcgaccatctcctttagaattgggagcag

SEQ ID NO: 18391 - DNA, 80 bp, Chlorella protothecoides
tgatcttggaccatgctggtcatgtgccggctccagaaagcggttggcagtcttcctctggtcgattcccagaggatgct

SEQ ID NO: 18392 - DNA, 61 bp, Chlorella protothecoides
ctcatctggagagcatccatgtcactcccctctctcatcccccactccaaggcatacccgt

SEQ ID NO: 18393 - DNA, 120 bp, Chlorella protothecoides
gcggcgtgagccggggtgaaacggcacctagtgcagatcttggtggtagtagcaaatattcaaacgagaactttgaagactgaagtggggaagggttccatgtgaacagcaattggacat

SEQ ID NO: 18394 - DNA, 4610 bp, Chlorella protothecoides
gggcggccgagccgccgctccccgcctgggtgctcgggtgcaaggtgtgggcgggggccgggccccgcgatcccggtccggaggcccccggcgcggcgcgccgccgcgccgaccagctgctgggcctagccagggcgctggacccggggctggctcgcgactgcgtcgcgctgtgcgacctgcgcgcgcgggaggaaagggcggaggaggcgctgcgcgcggccgcggccgagaacgaggcccagcagaggttcgtttaggttttactcatcattctgggttccggaggggggggggccaagcgcacgtatggtatggcattcccttcaagggagggacggtgaatgagtagacgagatggtgtttggacggcgcggttggcgagcgacgctccatgcgcggtttcgggtctgtatgcggcaaagtccggctggctgaccccgctgtcgccacccaccacccacccgcccaccatcccaggacgctgacggccgtgggtgacgagacgctggcgctggaccaggaggtagcgcgcgccatggccgcggcgcgcaagggcgtggccagcctgcgcggccggctgacggaggtgactcagcgtgaccttgagggcctggccggccatgtggcggtgggcgccggcgccggcgccgacggcccctggcgcgggctgccgctcctgcgcgctgtcattcccgtgcccgcggcgggtcccagccacgtcccggtctcggcgccgggggggccggcgtacgtgcgccaggtcagcgccccgctggcgggcctggacgcggccgtgctggcgcaggtctacgccgacgagagcgagatggtcgtcggcatcgccgtggccgaggcgttcccagacggcgcgctggggccgggcctggtggtgcactggggactggtgagccatcagcacggcacctggcagccggcgccgcatggctgttcctgcgacgcgccaggtgcggggggtggggtttggatggaatgaggagagttcgcagatgcatgtcacctgcgcatgtcggccgtggttggacgcatgtcatggctgttcctcgaccacgccacccgctgcattcccctcactggagcctcccgggcaatggaccttggctcccccagtcgcccctctctcacgccccacaccatcccccactttgcagcccgaggcctcgacaggggtgcgtgcaccgacgtgccgctggcccaattcaacctgtatgccgaggacggcagccccgtgttcgtggaccccgtgctgaacgccgccgtgatccggctgccgcgcgccggcctgcacggcatggcggggctggagttcctgctccgctccgaggacgggcgctggatgcccgtgctggccccccatggcggcggccgctccaactgcttcattcccctgcactgctgacgccgcgcacaggaccgccctactccccctcgaaatgcttccatgtaacaacagagacacgtgcgtttggtcgggttgagcacagcaagggcacagcagtgggcattaggtgggaaaaatgaggggtcgagccggctaaagggtgggagtacatgctgcagggagcaggcgtgctagaggatggggaggaggatggtgcacgctgtgtcgcagcgtgcccacaaccccaaatccatggcagtgaggaaagaatagggcgcaggggggcttcatgcgcccggtcatgccgtctgctgggccggccgcggcgcggtggtggccgccgccggcgcgggcatgcgccgggggcctccgggtcccggcgccttctcgatccaggcctgcgccgcgcggccccccaccacctccttgatctggctctgcgtcagcgtctcctgctccagcaggctggctgccagggcgtgcagccccgcctggtgggcggtcagcaggccccgcaccctctgcgcaggggccagggagcggaggggggagtcgagacgggcatcagagtggggcgacatggagaacggcagacggtggtggcaccgcagacaggaaggggcacggtgagtgtgctggccggacggcttgcatgcgcagaggggcagcacgatagaggctccgctgagccaggtttaccccatgctggattgcaaagaccctcacgtgtcgcttgcccagcgccagccctcccgattgggtagtagaccctccctgtttgagtccgtgcttggtccatggcaccatcccatggggccccccaacaggaccttccccctcccggcctgcacccaaacccacttcccacacctcgtaggaggccttgaggatgtcggacacctcggcgtcggccaccttgcgcgtctcggagcccagcttgtcgctgagggacagcggcccgatgcgagcgctcatgccgcagtcctccaccatgtgccgcgcggtgcgtgtggcggccgacaggtccgaggtggcgcccgtggtcacaaactcctcgccaaagatgagctcctccgccgccttaccccccatgcacacgtcaatctgggccagcagctgctgcttggtggtggagtactcgtcgcggtcggggagctggctcaccatgcccagcgcgtggccgcgcgggatgatggtggcctgggtgggtggagggtgcgaggggttgcgaggaagtgggtgagaggccttgtttggggggggggggtggcaaggaactcaggaggacccgcatgctgggaggagggaacaaaggggaaaacgcggctgacaggagaaccagaggagctctgaaacccccacaacgcctccctcaccttgtggatgggccgggcgcccggggtaaagagggccaccagcgcgtgcccgctctcgtggtaggcggtcagccgccgcgcctccagcgtctggctcagcgcgcggggcgagcccatcaggatcttgtcccgcgcctcgtccagcaggcccgcatccacgcagtcccgccccgtgcgtgcggccagcagcgccgcttcattcaccaaattgctcagctgcgcgccggagaagcctggcgggggcgggaagcgtgtgtgtggggtgaaacaatgggggaagtgactccggctgaggggaagcttcagtggcacggcaccctgcagctcccagcagtgctggtcctgcacactgggttcccccacacaagatccacaccaagacctcctcccaacctaaccccacctggagtccggcgcgccaggctgtcgctgtcgacgtcagcggccagcggcttgcccttgaagtagaggtccaggatggcgcgccgaccgtgcacatccggcaggggcaccgccacctggcggtcgaaacggccggggcgcgtgagcgcggggtccagcgtctcgggcaggttggtcgcggccatgaccaccacgccggagttctcctcgaacccgtccatctcggtgagcagctggttcagggtcttgcgcgacccgccagacgcctcccagttggtccgcttgccgcctgggtgacaatcgtgaggggggcgttgagaggggtgtggatgggtgccaggaggtatacaggaatgtgacgcatgcagggggagcagaatgctctggggaatgaagcaggtgcaagagcatgtgattgaccataaacagtcagttcccctcacaaccaccttctcttgccactcaccgacggcgtccacttcgtcgatgaagacgatgcagggcgatttggccttggcggctgcaaacagattccgcacccggcgtgaccccacccccacaaacatctcgtcaaactcagagccggccctgtggagcgagcaaggaggaggcaggtcgaggagaggtagtgtggcaagaatgcattcccctcaggcaaggggggagggactttgaagacaatcgcgtggcccccgttcccagatacctcactccctcaaccagactcacttgtagaagaaggggacgccggcctcccccgccacagcccgcgccagcagggtcttccccgtccccggcggccccgtcagcagcacgcccttgggcagcttcccgcccaggcgcgtgaacttctccggggtcttgaggtaggccacgatctcctgcagctccgtcagcgcctcgtcgcagcccttgacgtcctcgaacgacttgaccgacgtctccgccaacgcctcctgtgaggagacgggggtgggagttgtcgtagaaggaccggcaggggggcaaggtgcgctcaaccatggtgtggggaggaggttccttcttcgtgaacccctccttccacctgtacccacccccagctcctccaaacacccctgcatcccccccacctatctcaccttgttgtactccttggcggacatggcggagccctcacccggggccatgcccgcgggcgcgccgcccgctgccacgcccatggcggccgaggagttgacgcccgcggcgcgctgcgtggcccggaggcccagcaccgagatgaagcccaggagggcgagggtgaggccgaagctgagggcgctgtgcaggaaggtgaccaggcccgagggcggggcctcggcggcgggggtgaaggtgacgtgcaggggccgcgcggcgctcgtccccggctcgggcgcggggcccgccgactcggcgcgcgcgccgcc

SEQ ID NO: 18395 - DNA, 1592 bp, Chlorella protothecoides
gcggccgcggcagccgcagcctgcgcgagggcggcggcggcgggcacagcgccctggccggcgagctgcgcgacggcggccagggaggtgtccagcaggcggctgagcagaggggaggcctcctcggtggaggcggccgccagatcgagcctgtatggttggcggtggtgcgcatgaacagggggccagggggccgatgaggtgagccctgttgccaatccctctccacatcccaacagcatgcccacctgtgcgtcagcgccaccacgatcgcgtccctccaggcccccgcaaggaaagcgcgcgcgctggcctcctccgcccaggcgttgtgctgctgggcgtggcgcaggatcagctggaaggccgcccgcgtgtcctccacggacccggcgccggcggcgacggcctcgtcaaacctatgcgggagggggcagggaggaggaatgtcgcagggtgacagcatgcgcgcagaggaccatgcattgaagcctgacacggccccagcgggttcgtggtggtggagtgcgacctacgaaagcagaccaagacaggggctctagatgtgtcgtgcatgccactgcttgtctgcgctccttggtccccatcaccatcccaaccagggtttcccgccctgcacctcatacctgtgcagcaggtcactcttgagtgcaaagaggtccacgaccaccacgcccgtgtcgcccgccacctcggccgccagcccctccagcacggcgtggcacggcgcagcagagagcgcatctgcgaggcccagcgcctgcgcattggcggggggttgatgggggacggaaaaggcgtggatctgctgtgcgcaaaactaggtctcgaagcaggaagctcgcatggccccgcaggcggtatcggtgccctatggccaaccctttcctacagttccgagtcgcatgcaccccctcgcacgcgcgcacacacctgcacgaggtgctgcagcttgggcggggcgtcggacagcgcgctggcgggggccgtcgtctccgagcccagcgactccagcaggccccgcgcaacgctccctgggcgagcaggacaagatcgaaggagtgcttggtctgattggaggatgactgggtggtgaagtgggttcgatacggcgttataacagcaaggtaccacggggaagatgagaggggttgaggcccaatggggttgttgggccccccacggtgtgcgttcaaggagcctcacccctgggctcccggcagatgactgtctctgtatcggatgggaggccggtggcctacgtccgcgctgctccccactgaatccattctccgagccctgccaccttcctctcccccgcatgaccgcttaccacattccccccatcccccccaaattaataacagcaggaccccagcccacctgcgtcgcccagcagggtgcggagcaagagtttcagcgcttcgcggtgcaggcccaccgccgcgtcggcggcgtgcagggcctcggccaggaggagcaggagccaggcgcgctgggccaggcccgcgggcggcgcgcaccggcccccgcccgccgtggcggcggtcaggtggcgcgcggcggctgcc

SEQ ID NO: 18396 - DNA, 250 bp, Chlorella protothecoides
actaaaaaactccaatattgataaatataattaaatatacagacacctagagaaacataaatacataatttgtaagtagtcgataatgcttctgtaatatcagttgattgtaatatttgatctaattgtagaaaaggtctagatataagatacatcagctcaagttgataatagtagcaagtaattaatgtacaaattaaagaataaaatatataaaatatacgataacgtatttcattgtaatgaaata

SEQ ID NO: 18397 - DNA, 68 bp, Chlorella protothecoides
caagcatgtcggtgatcatgatcgtgatgatatagactgatatgatgtcgaggtcagtgagtggtatg

SEQ ID NO: 18398 - DNA, 179 bp, Chlorella protothecoides
aacaaatcgtgacgacgacggctgaacctcagtggatcgtaacagcaaggtcactctgccacgtacagtaccgcgacgggaatcagggtggtctaccaaggatttaccccaatgcgcgagcgaaagtgcgatgcttgggtgggctggagggaggtgtactcggtccggcccagcaacca

SEQ ID NO: 18399 - DNA, 395 bp, Chlorella protothecoides
  modified_base (131)..(307): a, c, t, g, unknown or other
tgtttcggaatgtgctgtgtgaaggggtaacttacgtgacatggggtacacatgctccccctgcatgccagtcgcacatgcatgagatcgaagttccattctgctccccacagacgagaagactcgactcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtccggctagcaccacaaggacgtaacaccagcccgtcctgcgaatccaagggttcgtctacattccgaggagcgaaaccagcgattt

SEQ ID NO: 18400 - DNA, 74 bp, Chlorella protothecoides
gtggggcggggaatctacagcatcgagcaaatttcctgagacgagcaggggacacccctctgacaagaaagtcc

SEQ ID NO: 18401 - DNA, 434 bp, Chlorella protothecoides
gggttgtaaacttcttttctcagaaaagaattatgacggtatctgaggaataagcatcggctaactctgtgccagcagccgcggtaagacagaggatgcaagcgttatccggaatgattgggcgtaaagcgtctgtaggttgtttaaaaagtattctgtcaaagattagggcttaaccctagataggcagaataaacttttaagctagagtttggtagaggcagagggaattcccggtggagcggtgaaatgcgtagatatcgggaggaacaccaaaggcgaaggcactctgctgggccaatactaacactgagagacgaaagcgaggggagcaaatgggattagataccccagtagtcctcgccgtaaacaatggaaactaggtgttgggtgtataaaaatcattcagtatcgtagctaacgcattaagtttc

SEQ ID NO: 18402 - DNA, 103 bp, Chlorella protothecoides
aggggttgctcccaccctcacgtgggcgcaccttgacacctccttgccacccgcccacaaaaaattcaatcgctccatgcacaggcgcgacgcactggggcca

SEQ ID NO: 18403 - DNA, 310 bp, Chlorella protothecoides
aaaaaaaattaaatattatgtttaaaaataataataaaataataaaattagaggatatggtacaaagtggaatgcattttgggcattttacttctgaatggaatccgcgaatgaaaccgtttatttatggcgaacgatatgggcggcatattttagatttagtgcaaacatattatcttttaaatgacttattagggtttttagaaaaaagtgctgctcaaggaaaaaaattcttattcgttggcacgaaaaaacaagcagcccctttaattgaaaaaacagctattgcgtgtaatagctattacgttaa

SEQ ID NO: 18404 - DNA, 318 bp, Chlorella protothecoides
caattggtggggtacgtggtttaattcgatgcaacgcgaagaaccttaccaggatttgacatgtcacttgtttcttcaacttactactttaattggttttaagcggaaacattaaaaagtgaacacaggtggtgcatggctgtcgtcagctcgtgtcttgagatgttgggttaagtcccgcaacgagcgcaaccctttttttgaattgcttggcgcttttaaacgcttttagagaggaaattcaaaatactgccggtgacaagccggaggaaggtgaggatgacgtcaagtcagcatgccccttatatcctgggcgac

SEQ ID NO: 18405 - DNA, 294 bp, Chlorella protothecoides
ccccagtcactagccccgccttaggcatccccctccattagatggttagagtaatgacttcgggcgtagccaatttccgtggtgtgacgggcggtgtgtgcaaaacccggaaacgtattcaccgcagtgtggctgacctgcgattactattgattccaacttcatgcaggcgagttgcagcctgcaatccgaactgagaccggatttttgaggttagcttgtcctcgcggggtcgcttctctttgttccggccattgtagcacgtgtgtcgcccaggatataaggggcatgctg

SEQ ID NO: 18406 - DNA, 234 bp, Chlorella protothecoides
gtcacgatgggcatgtcggggccccgggcgcaggtgaagtacgccttcgcggcccaattctgtgacaaacgtcaaggaaagagaaaataatgtggtctttgcaagcacagactgttgcaggccctgttcagcagcagcacacgcaagtccgatggggtctgcattttgagtttgtaccggggttttcgaaatgatcttagcgagatgtggaggctgagtcccgagacgccggag

SEQ ID NO: 18407 - DNA, 75 bp, Chlorella protothecoides
aaattcgtaaaaaatctaacaaaaacagtaaacaagaattataccaatttcaatcatctccaattcaaacaggtg

SEQ ID NO: 18408 - DNA, 421 bp, Chlorella protothecoides
tgcttgatcgtcgatgggacccagcatccagtcagggaaccccattaccatttttggtttctgtcttatcattgtactctatctgtgtagggtgtcgagtccgatttggcaaatggtcgaaggcatgcccatccctttgtgtgggcaacccgcgttcctgcgctggcaggatcgtggctgctcctatcataagcctaccttgcttcaccatactggtacatgctctgtgcacgggccgcattgagcatcccgcttgctgccggagggtgatgtgagcccactgcctctgagcaggtgctggagcacctgacaccgaccagcaagaggatttgagcagctggtggcgacgcttatgccctgaggggtgctgcaggcgcgcactccatggacacttgcgccgtgtgatcaccgcgcatggtgg

SEQ ID NO: 18409 - DNA, 126 bp, Chlorella protothecoides
gacatggagccatgcagcactgattcaacgccatcacactatttccaccacgacggcatcactacgacctgcacacctgggatgctcttccaaggatgatggcagcggtgtcacggtagcactcat

SEQ ID NO: 18410 - DNA, 284 bp, Chlorella protothecoides
atttatatttaaagcacctaatattcaatttattccgcaagggttagttatgtgtttttatggactcataggtttattattaggaatttatatttggttaactattatttggaatttaggtcacgggtataacgaatttaatttaaaaacagatgaggttcgtgtttttaggtggggctttccgggaaataatagacgtattgacttaagatacccgattaaagatgttcaaagtattagagttgaaataaaagaagggattaatacaaaacgggctatttttt

SEQ ID NO: 18411 - DNA, 151 bp, Chlorella protothecoides
caaagttcaagtccctttttgcccaaagtttaagttcctttttgtccaaagttgccgactatttttaaaaatttccttaattttccttaattttcatttaagtatttccttaatcttcatttattttatataggaataatctatatagaca

SEQ ID NO: 18412 - DNA, 112 bp, Chlorella protothecoides
tttctgcatatgtccctggcagtctcttgatgctggttttaaaacccgtgctcccagcaatccacatggcatgcaagcgcacttgatcgccacatagcaccagtctacctca

SEQ ID NO: 18413 - DNA, 170 bp, Chlorella protothecoides
ggtggcccaggaacacgccacctctttctccgagtagaatgtcaactggaggtgggtcagtggtccgcagcccaccatcctcaagttcatgtggcacttgttggttaccacaatatgaaagacgctcaaaacataactccgcctcatgcttgaatatcctaggaagtgag

SEQ ID NO: 18414 - DNA, 494 bp, Chlorella protothecoides
gaatatttaggaatacttatttatttttttattgcactagcattatcactattattattaggattaccttttgtagtttctacaagaaaagcggatcctgaaaaaatctcagcatatgaatgtggttttgatccttttgacgatgctcgaggccgattcgatattcaattttatctggtagcaattctatttattatttttgatcttgaagtagcatttctatttccttgggctttaactctaaataaaataggtttttttgggttttggtctatgatgctattcttattaatattaactataggttttgtttacgaatggcgcaaaggagctcttgattggagctaataacttatattatttttttgcctaaggttttaaaaggctattaccgacaaaaaaataaaaaaagaaaggtcaaataaactttgtttattaaaatagtataaaattaagattgtaattttatattttaattataaaaaatatatata

SEQ ID NO: 18415 - DNA, 270 bp, Chlorella protothecoides
atcgaggtgccaaaccttcccgtcgatgtgaactcttggggaagatcagcctgttatccctagagtaacttttatccgtttagcgacggcccttccactcggtaccgtcggatcactaaggccggctttcgcccctgtttgacttgtaggtcttacagtcaagctcccttctgcctttatactctacggctgatttccgtccagcctgaaggaacctttgcacatctctgttaccttttaagagatgaccgccccagtcaaactgcccac

SEQ ID NO: 18416 - DNA, 165 bp, Chlorella protothecoides
ttttttactataacaaaaagttttttctttctttttttagtataccaattttttcaaagagcttcaaagttttcaaattgttttaattcatttttatatttggcgaacgacggggtttgaacccgcgagtgatggagtcacagtccattgccttaccacttggct

SEQ ID NO: 18417 - DNA, 89 bp, Chlorella protothecoides
aatttttaaattttttaactaattaattttatcgtaacaactattaattagtatacttgaggagtagagagtattaaacatttttagga

SEQ ID NO: 18418 - DNA, 234 bp, Chlorella protothecoides
catactgtgacaaggaactaaaaagcatttccactttcgctgactattttatgtggagataatggcatatgactgtgtgtgttctctggtgtgctccatgagaagccgcacacctctgcactctgaacataattggaacagcttaccactgatttacccaacacccaccaatactggtaccattaagcaagactagaaggctaacggagtaccactttctatgagggcaggtct

SEQ ID NO: 18419 - DNA, 242 bp, Chlorella protothecoides
ggcgcgagtatgggataacattcgaagcgatccacagcaagtcatgccgctcttgctgggcgcagctaaccgacgactttccatcgaacaactttcaattttttgatgttacacagagctggagttatcccgtgatgggcatgtgtgccaggagaaccgatcggaggtgaggctgcttgccaagagggcatggtcgcgcacgcgtgtgccaggcggatggactaggccctcctgtcaaattt

SEQ ID NO: 18420 - DNA, 80 bp, Chlorella protothecoides
tcatgtcaatgactcttcatttactgcaggaggtggatgcgagaccatcgaattctatcacaaaggaagctgcagagccg

SEQ ID NO: 18421 - DNA, 179 bp, Chlorella protothecoides
gaacaccaccacgttgttgcaacgtgtgacttgtttgatatcggccaggtggacgcgagtcccctgtcgctctgccagtcacacgctgcacacacccagcaaccccagcccaaacaacccatgcctgaagaatcacgcgagcgtgcctgcccatgtgggcccctcgccaaccagagaca

SEQ ID NO: 18422 - DNA, 86 bp, Chlorella protothecoides
ggtggtcgtgagagccaggtcccatccagggggatgacgagtgcatccaacaactcgatggaagtggtaaagccgacgctgaggca

SEQ ID NO: 18423 - DNA, 162 bp, Chlorella protothecoides
attaaaaataaatgacaacacaaaaagaaagtctctattatactgtttctggcgctcggcgatttagtaattatttttggggatctttaatgtttatcggtggaataggatttttagcagtaggaagcttaagtgctttaaacataaatgatcaattattta

SEQ ID NO: 18424 - DNA, 97 bp, Chlorella protothecoides
gcagccgcagctttgccgcaatcgcagcgtccagcaggcagagctccgcgccgctgtcgagcagcgcggtgaactcactgctcccaatcctcgcctt

SEQ ID NO: 18425 - DNA, 61 bp, Chlorella protothecoides
cgtgtctttgtggtatccacttgagaaaggtgcagctcatagggcacaagatgggggcact

SEQ ID NO: 18426 - DNA, 2717 bp, Chlorella protothecoides
cccccccccaaccccacccacacactccaggagctgccctgcggacacttcatgcactcccactgcttcgcggcctacacacgctacgcctacacctgccccctctgcttcaagagcctgggcaacctggagatgtactggcgcatgatcgaccgcctgctggaggcggagcagctgccggccgaggacgccggccggcgccagtccatcctgtgcaacgactgcggcgcgcgcagcgaggttgccttccacttcgtctaccaccgctgcgcgtcctgcaagggctacaacacgcgcatcgtgtgagtggccttggccgcccagctacaggcacgggtggcggcggcggctggcgggatgcctgcgacgggggcgagacttcctgcatccaatcccacgccttgatattaatcagttgagcttgaagcgcattgactcagttctcccaaatttttgatgcatcatgttgtatcatacggagtatcgaatggtagtcgatcttggcgtgaagtgaaaagccacgtggctatcgcgagagttttctcacgctatacagcaggtccattgctgcgaccaagcagagtctacttccataatatcaagttgagttgtcttccagtcaaaacttcactgggcttttgaagagaggaccctgtgtgcaacgtatcgaaccgctcgacgtctacacatcccccaacatggtgacgacgctgaggtcgtcgtgtgttccatgcatgacacagacgcagcgacgaatggccctcaaagttagcacgccatgcatggctggccagagcatggcattcctcgggcatgggccgtgccacaccagaaacttcttcaggaccggagtggcctgcccaagcatacaccctcgtgcacgcgcacgcaccgtgctgcagagtctggccagatccgatgcggtggatgcgagtccctttgacgatgtggcggcagcctcgccgggagatgcagcccgtgaggagtctcggaaccccagcccacccaggaggaccctctccgtcaccttcacctgcaacaagtgtggtgagcttctgagcaaggtctgaaaacttgcttaaaggtgaccagcttgtgttcagagcctcacactgcatttcttacctgctctctcaggtggaaggacggaacgagctgtgaaccctgtggcgtggactaggggcttggtcatcgcccagtgtggagagtgtgacgcttggcataagctggcagatgctgcaaatctggtggacgagattcggtactctgacgaagtatagcgtctacatctggcacccattggggagcttgcattatgctgcttgctgtcatcctcatatcttcctgttcttctgcaagtcacattgtttgtatgcacagacatggttgtgtatgtattatttacaataagtaccatgtacgatacctttcagtatggacgcttgtgcttcccaacgtgtgagctgtacacacatgggcgccatccagcaacgtcgcatgacagaaaggctcctcggtgcccagaaccccccctggtatttcaacgcctatcgctcgctcgaagtatacattcggcagtgcatgggatcagggtgcaggcgaaggccgaggctccagcttccatacatacagaccatggtgttctccctcattccccgacccgcccaaatacgaaacacatctgtccgacagagtatggcgccttccgagattcgatgccagaacaactccggtgccggcgtctcctcttatgttgatatttgtataacagagcgttgcagcagcagcattgcacagcgtgcacctctgccatggcctccgggaccatcggcccagacgaggccaagggccagggccatgccctggtcctccggcttgtcgaccgcattcggcagctcgagcatcagatatactccaatgagcttgattccagggcatcaagctccgatacagatgccacatcgcgcttgggccacctgatgaagcgtgctcaggccgggctcgactccggactggcatacatgtgagcaaggggcggggctgagcacaaactgaggcctgaggacgaaaggtggcatcctgtgatatattttgggatttgaagagtatactgcatcatgggagtaccacctaccatgcagtctcggcgaggaggaggtggcccaggcaaaccaggacgccgcccgcatccgggaggcggaggaggcgtgtgccgatctgcaggcccgcctggatgcagcccggacgcaggtgcagaaggacgccgtccacatcatgcacctgacccgccagctggacgccgagcgccagaacgcagcggctgagaggttcgtcgtactacctggaccggcacgtgtgtgcatgatggtgaagcatgcagatgagcagatcccgtatgtgcctgatcctactctttccgtggccagtgcttgagcttgctggtgcacagactatgcatcacaagcccagtaccccgccacaggatgctggctgggtccagcatggaggccgcgctgctggatgccaggcgagcggcgcatgaagaggcggcgacggccctggggcgggcagaggcgcgggccaaggaggaactggccgctgcggtggccgccgcaacgcagaattgcgaccgggaggccggcgagctggcgggccgcgcggaggcgctggaggccgccctgcgagcggccgaggccggcgccgagcggcgggcggcg

SEQ ID NO: 18427 - DNA, 80 bp, Chlorella protothecoides
cgcacagtgagtgattcccagggctccattagcgtcttgtgggactgagtaggtgcaggaccactgttcagtggcttggg

SEQ ID NO: 18428 - DNA, 62 bp, Chlorella protothecoides
cccccccccccccccccccaaaaaaaaaccattaatcacccgaggtggcgatgaggatgttg

SEQ ID NO: 18429 - DNA, 80 bp, Chlorella protothecoides
tccaaggcaaatcaccttgaggagcgcacataatatctcaataaacacacggatgctgaatagctcaagtatgcctgccc

SEQ ID NO: 18430 - DNA, 281 bp, Chlorella protothecoides
caatgcttgagcggtcctcctgcacatcagtggccatacaacaatacacagcagtacggtgcaaaccagcaagataccgtcctgctccttgagagtatgcggcccgaagggttccatcaacattggtatcgtgtgatttctgctttcatcacaagctccaactgagaacatccaacagtgcagctgtgctcaatgtgggtgacctggtgctggtaggccaacatgcactaccaagacggctcggttctaatgtgaggctgagcgttccaccaccttctcat

SEQ ID NO: 18431 - DNA, 2166 bp, Chlorella protothecoides
agccccagcccgtctcccagccccagccctgcatacgacgcctgccccggaagcgtggttgcgtccagtggaacttgtccggcggggttctatccaggtatctgtttgagctacaacggcccctttgcagaatgtgttaagacagacaaaccatctgtcgatgcttgtcctgctgacgttcgttacccttacaaaggcgtttgcgaggaagcagcttatcaaaaacttgtggtatgcgaggctcgcagtactatttacgttgcctgcaccagagcttgagcatgatgtttgactccttcgccctcatcggactggaaaagtatagaaactccttttgccaggattgtcatatctgttcaattgccatgtaagctggtgcccaggcgtccaatccactgggacctgcatgcctcccaagcctttgcctgtccaccttcccatacttgcctactctttaagcatacagtgccatataggcatgtgaatgctagcatcgtaacagaagcgcgggtcggccgaggtggcgtacgaggctctctgcctcaaatgttcacgcaaaacctaaagttggtctcaaccttgtcagtcaataatcagcctatcggagtggcgaggatgtggtgttacaggagagcactgaaggcatgattattctcccagccagggcagaagcccgcggcccaagggtctgcggttcatgagccgcaacgtcccgttgcaagaatgctgtgactggctcatcagcatgtacacctcacgaaagcgctcgataaaggtgtacaggaagtgcagcacttccaaaatgcaaactcgccatacttcttccgcttcgcacaaggcctccggctcgcccgcacgccagccatcgtcccgtccaagtccagcagatttccctttccagctgggtgtgtaggctgaccttggaatattccatggtgacgaagcccctataaaagtgctttgatacgctgatctacctcactctgatacagcgtcacgactgtaaggaccttgcaagcgggcgctacatcgtattcacgccttctcgatggcgtgcatgggccgtcgcccctcatgcgcggcgctcatttctatccttgcgttttcggttctcgccgactctaggtgggtttaatgtactcccaatgccattcgtggagtcgagatctttccgcatgcatctgggagggtttgttgggcaagggcttcgggtttcagcgctgccgccgccattatcggagagactggacgacagaaaatccagggaccctgacgccatgctgagagatgcaactcatgtgatttcaggacgctacaaggtaccgtgagtcttcatggaacgtcagacggcgatgtctcgggcgttgtggaaacttcgacgtcgtcgggtttccaagcgtccggaagggcatccgcgtcagccattggagagggagcaacggcggaggccaggctgaaggcctggagctctcaggccgactcgggagtaacaggcctcggcactgcgacggtacggccagccaaccgagagtggaaccgaacctatgggctacaggactgtcgtggatctaatgaagttcccaatgtatttctactcgggcatatcatagactccaccctttgtacaggctgttggcagcggtacacatcctgccagcgccaccactggcttctccggtttgaccgtgggtcctggaaagactgcgagcacccatgcgtccgccacagccgtcagttcggcgactggtcccgtgaaggcctctgcatatggtgctgccacagcagacggcgcaggagcaaaggtgtgtgtccgtggatgcaagggcggcgaggtcgaatagctgcaacttggatgcaaggtaccgcctttgctggatgacgatcgtgctgaggtggcagactcagccatccaaacttcacaacccggtcgcgcaggcagtcgcagggtgcaactccagcacgccagactccttggatcacgttgagctctccgccgcaggagcgattgctgcagattcggtatgctccactgactcaagcaaggcgtctccttggcccagcccctcccttttgcccagccccagcccagaggcatctcccagccccagccccttcccatcgcccagccccgacgtatcgcccagcccctccccatcgcccagcccc

SEQ ID NO: 18432 - DNA, 62 bp, Chlorella protothecoides
ttttttaaatatttttgcactaacgcaaaacgtgttttttcacgctcaatcatacttttttt

SEQ ID NO: 18433 - DNA, 67 bp, Chlorella protothecoides
tgacagggaccggaaaccgggtgatgtaagtgtaaaccaatccgttgagagtttgtacagcgcccaa

SEQ ID NO: 18434 - DNA, 264 bp, Chlorella protothecoides
caccattgttccaggctactcatttggttgtataaaaatggctgagtattgctgcaagaccaatctgctgccttccagttgtttgctagaggtatcttgagccggacacagtaccggagccgggcaccccaggccaggccggggtgacagcaaacaaaggtgcctgtgcattatgcacccacgcacacaggaagcgacaagcttgctttcctgatacaaccttgccttttattatgtaatgtgatgtgccttgggcgtgaagaa

SEQ ID NO: 18435 - DNA, 141 bp, Chlorella protothecoides
tattttaagtactatcaaagataaaaaagctttatctgacgaattattaaatactttaaaaactttctttgatggattcactgatagatttattacagcacgataacgaataactgtaattaattatcgtctttacttggt

SEQ ID NO: 18436 - DNA, 77 bp, Chlorella protothecoides
aggattcctgctcccgtctggaccgagttgtagttcaggatccatgcctcacgatcgcggtcgctcctgcagggggg

SEQ ID NO: 18437 - DNA, 73 bp, Chlorella protothecoides
acactgatgtagtcagcctttacattcaacaaccccataatgcacactcaccattcttgcaggtatcccacca

SEQ ID NO: 18438 - DNA, 61 bp, Chlorella protothecoides
ataaaaggcactgtaattaaacctgccggaacagcagccattaaaagaacacctaacagtt

SEQ ID NO: 18439 - DNA, 210 bp, Chlorella protothecoides
tgatggtacctgctactgggatacccgtagtaattctagagctaatacctgcgcaaaccccgactttggtggaaggggtgtatttattagatccaaggccgaccgggctcgcccgactcgcggtgactcatgataactttacgaatcgcatggtctctgcaccggcgatgtttcattcaaatttctgccctatcaactttgtcggtagga

SEQ ID NO: 18440 - DNA, 133 bp, Chlorella protothecoides
gaccagggagttgggggactcgggcagcacaatggagccgacgcccaggacgaaggcaaatgcagccgccagcgccagagacacacgccagccagaggccaaattctgggtaccgtagttgaccaggccggcg

SEQ ID NO: 18441 - DNA, 249 bp, Chlorella protothecoides
gtacgacaaccaggtcctgcagaccttcacctccaccatgttcctggcgggcatgttctcctccctggtggccgccaccgtgtgccgcaagtacggccgcaagcccaccatgttcttctccgcctgcctcttcatcgtgggcgccggcctgcaggcgggcgccgtcaacctgggcatgctcttcgccggccgctgcatcctcggctttggcgtgggctttgccaacaccgccgtgcccatgtacctgtc

SEQ ID NO: 18442 - DNA, 78 bp, Chlorella protothecoides
agaagtaaattgattagaattaataaaatttgaaagaaaattatttttattccttttttgaaactttaacaaattttt

SEQ ID NO: 18443 - DNA, 93 bp, Chlorella protothecoides
gccggaggaccccctgcttcaacagaatctacaccaccatatccttgataaataacatcctcaggccaaacatcttcataatgatagtctttt

SEQ ID NO: 18444 - DNA, 117 bp, Chlorella protothecoides
tatcaatgtcgttggccttccaccaagtattgcaatgtgagagccagtgacgagagggaggcagcacggcatcccacattcgccaataaaagccctgcccctcgtgtgcagtggaga

SEQ ID NO: 18445 - DNA, 138 bp, Chlorella protothecoides
actctaggttttaaaaattcacgaaaatctacagtttacgcctctggtgcggtagcagaagctttagcaaccaaggcatttaatagcggatatcgtacagtaattgtaaaaataaaaggcttaggttatggaaaaaaa

SEQ ID NO: 18446 - DNA, 186 bp, Chlorella protothecoides
atttttaaatacatgttaactttaaaaatttttgtatatactgttgtaacattttttgtttcacttttcatttttggatttttatctaatgacccgggcagaagtccagggcaaaaagatattgattaatttttctattttttcaaattcaacatttattaatatataattttttgtattaactag

SEQ ID NO: 18447 - DNA, 236 bp, Chlorella protothecoides
atcaggttttggaaacctgcgttctaccaactgaactaaaagcgttctcgggatgacaggatttgaacctgcgaccccctgttcccaaaacaggcacgctaccaaactgcgctacatcccgaaacttatattttatttttatgatataaagtaatcttccatttttcaattttaatggattttagtaaaaaactaaaacttatatactaaaaataaataaattttatctatttttt

SEQ ID NO: 18448 - DNA, 24689 bp, Chlorella protothecoides
  modified_base (304)..(448): a, c, t, g, unknown or other
  modified_base (1392)..(1628): a, c, t, g, unknown or other
  modified_base (3745)..(3872): a, c, t, g, unknown or other
  modified_base (4325)..(4334): a, c, t, g, unknown or other
  modified_base (4885)..(4894): a, c, t, g, unknown or other
  modified_base (5108)..(5117): a, c, t, g, unknown or other
  modified_base (6299)..(6308): a, c, t, g, unknown or other
  modified_base (6681)..(6690): a, c, t, g, unknown or other
  modified_base (7390)..(7399): a, c, t, g, unknown or other
  modified_base (7705)..(7714): a, c, t, g, unknown or other
  modified_base (11925)..(11934): a, c, t, g, unknown or other
  modified_base (12352)..(12361): a, c, t, g, unknown or other
  modified_base (12883)..(12892): a, c, t, g, unknown or other
  modified_base (13144)..(13153): a, c, t, g, unknown or other
  modified_base (13600)..(13666): a, c, t, g, unknown or other
  modified_base (14609)..(14618): a, c, t, g, unknown or other
  modified_base (14906)..(14915): a, c, t, g, unknown or other
  modified_base (15530)..(15539): a, c, t, g, unknown or other
  modified_base (18828)..(18837): a, c, t, g, unknown or other
  modified_base (18932)..(19062): a, c, t, g, unknown or other
  modified_base (19769)..(19778): a, c, t, g, unknown or other
  modified_base (20011)..(20020): a, c, t, g, unknown or other
  modified_base (20745)..(20830): a, c, t, g, unknown or other
  modified_base (21219)..(21228): a, c, t, g, unknown or other
  modified_base (22411)..(22420): a, c, t, g, unknown or other
  modified_base (22953)..(22962): a, c, t, g, unknown or other
  modified_base (23377)..(23386): a, c, t, g, unknown or other
aaaccagctgaaacatacgctgtgttgaaaaataacatagcacacatctgtcagcggaagaattgacagtgaagtgcaggcaatttgactggagacaaaatccctcacttggcagcagcgtggctttgctgtcctgctcttggagattgtgttcttgagcgccgtgattctaaagagagaatgggtgagggaaagcttgtggcgacttccttgtcacgaattcaaggggttacaaaaggggtgtcttcccttctgtctttgtggacaaatcttctgatgcttgaatctgttttgcacatgtgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattactcgcgaggacaatgtgattgtgaaactgcagctttgtcagataggacatgcgaagaacaactatgtggaggttgcaaacctgcatgctcaccgaataaattgatagcattgccgcccgcactcctcacagcatactgtaacttaattatggagtcaaatgtaccttcaatcgttatctcaggcctcatgaggacgcatctttcatcccatagatgtaattgacgagggtataccttcagggtatctccaaagttgcctcgagtcctcagccatgtgagacaggtcttggataagctgaatagagagattctgcactggcttcgatatacatcccaattttctctctgccaacttggaaagcacatcgccctcagcggaactgggaaaaggagcgatttatgtgagccatttactactggaagtacttacaaaagctctaaataatgaatctcagactcgtaaaccgtctaccttgtcatgaacatcagctcgcaaaactctcatggtgcctggcaggaacttattgtagcattgctcggggtctaccctgaatctaccccaagatgcacacttttggatcgacagattgtatttgcacatcggatccgtgtattgcttggttactgaagcatccatgtaagtggatgctgtttgcccatttacaagcgatcatatacacgcccgtttgtaagctgcattgcacgttgatagcacggcaacgcacaatttccagactcagtaaagacatactacaggagttgcactaaagacggtataccagcttatatttaacccagactcctgatccagcaagctcagtgcaggtgacacgtttgtagtagccggtttgcgatgcaattaatttttgccaccactctagcgtcttgcgcgcttgtgcctgaaccttgacagcccttagccatgatcaagacggctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggtcttctccttgcagtaaggagttgtgcatgtcgagcatctccgtgggtgctgtggtatgtcaggcacgtaaaactccctcaacgttatttgtgctattgggtatggacatctttaagatctgctctgtggcatctcgtgcgcctgagatgagatagccaagcagtcctgctgttgtatcgaggttttctttggccaggactacagcaaaggaatagatttggtttcttgttgctggtgggatcggaggcgccagcagatgtaccatgctgctagaattctagatcagtgaaccagaggatcgtctccagctcctccgcggtagagactctcatgttaatatcggccagaggtggaagcttggtgatgaaagaagactccttcctgccttacaaacgtacagcagccttaaccgtcaagtaactcttggacactacgacatcagcatcagaagtgctagtctcatctcgaggtatctcatggaattatagagggactgattcgatctcctcaggcaagcatatttgatgcagggtgcgctaccggttcgtcgtcttttggctcgggtatggccactctgcttgatcctcgagtctcgattcagtgcggtatctgcattgcatgatgtggaggcaattgtccaagatcaaaggcagtagaggccaggtacgcatgcggggactcttccatgaactgcaatgggttgcagcgagatactgggggctaatctcagatggaggtgtgacttcatatacagctgcaagccagtgaagttttctttggctgctcctcgcagtctcgtattgctgcgttcgcaatttctccatagtccctaacatgcattcatcccactggactcatcttatcttgccaagcaaccgctaaacataatagagatcatcacgattaccagggttggagcaggtcttgccatcctgccagagcatcccatcatcctatctaggtgagcaaagatattttcgtgttgtttcacctgtgagttctgtttcttcccccaacctggttcattagcctctcagggaatggagcacggcagctcttttggtgcaaattaaagatttctttgcttcgctttgcgtgaattatttaatcgataacgagcgtggcatttcagggcaagcatgaaaccccatgtctggtttttgaccagtacagatgaaaaaggcactcctctactgtatcatgtgagtgcgaactcccgctatcttatgtacattttacatccatctgagcgataccagcagagacgtaccggcgcaatgcagcaacgcaacaagacttcatcatcaagcatgagagctgttgacaataaaccgtaatcatgattggtatgcgacataaatatgagactgcctggttcacagtcagcagatgtgcacgatactgcagtaagttcaggctgatgcagtttgaagcgtcattcagtgaactgttcgctatcaatttaaaattttacgtacgtcgagtaggccaaaagcagcatgtgttgccgctacttcatttaaagcatagtcaaccaagagtaagaagggattgcctaagtctgcacaaaatgtatatattgttctcatgtggctgcaggatggtggacgtacgtagcccatgctcctgtgcaagagaaacggtctcgacgagttggtcatggaccataccagttggatgttatcgcagaaccacatcattggtggacagcttgaggctcttataaagggtaaggagatcgcatgatttccaagcactcgtgcagcattcagaggtgtattgtgtgctctcctttagcttcggataattcctacattgattcatcgcaacaaaaatggcaataacggacttgatgctgtgtcgctctcggtccctcttaaaattatctgagtaaggcataacacaacggcgcatgcatgtcaggcatcttgaacatagtatgtttgctgggccggactgtcaatttgctaggagttccagacccctacacgaacgcgtcgatactatgagattcagttggagcacttccgatggcatgctcacattgtgttcaaaagggtttctaaccttgtgacttgttagggtgctggtgttattggcaaattttgttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttgcacaaatcaagagaagtgctcggagacacactttaaattgatgttcgtaatggctttctagcagcaggcaaacagtcagtgcagttgcagacagataatctcgatgcctcctaaatcgcgagtctacttgaagacgcatggcagcttttacctcggatgtttatatcatttgccggagacttcctgggtggcaggtcgaacaatagtcctcgagtacagctgtggaaggacttctccatgtcaagcttagacaagatctcattagcaaatgtggaggatcttggacaaccaccccttcggagcacttttgcttcgcagtggctcccttgagtcactcaccatttgtcgtaccaacaggagggcgagggctgcaagattggcctagccgacatcgcgtaccagtaagcgaccttgtcctctgctgacagtccagttgtaaacgtgattnnnnnnnnnntatcgcgtaccagtaagtgacctcgtcttctgctgacagtccagttgtaaacgtgattgtgtaaaggatggacgtagcgggctcttcaccgagtgttgttgtgttgcttggcatgggcaggcagttcgattcaagtttgttgaaggcccagtgttcgctttcgcaggactagttggcgttactcagatgaattcagcctttccacatgttgatgagcctatcgatagctgtgcaggaccgtcaccaggtcgctctacctagcccaggtgccaatggtgcaaaaccattgtcacattgggtctcggcagcagggcaggagtctgtgcagcactccagggctcgtcacatttttcccgaccgctgagctaattgcacccgcaaatctgaaatggaggcgtgtcttccccgtcaaattcagtgcctgtaaaagttccgaaagtgcggaaaggtcaatcccaagctttgatgtttgaggaataatcggtcccctctgccaacgcgttgatgggcgcgcttggtctcgaaagatcaataatctctgagatcttcannnnnnnnnnatcaatcccaagctttgatgtttgaagaatgatcggtcccctctgccaacgcgtagatgcgcgcgcttggcttcgaaagatcaataatctctgagatcttcagaaatgaggcctgctccttggcaaacctaagacatccttgaatttaataacattcttggtctggtcgtgccccgggagacgtcagcgtcgacaacttgctgtcgacgacccnnnnnnnnnnagcaaacctaagacatccctgattttaataacaatcttggtctggtcgtgccccgggagacatcagcgtcgacaacttgctgtcgacgaccctcacctcaccacccacccagcagcagggcccgcatgcgccctccctggcgcaggctgcacaatatataggagtcgatctatactcctttgagacactctaccgatggcgacccttgtgtttaagcttttctcgctgaccctcaaaacggtctccaagccccttgcgaacagactcaacggtgctctcctcacgcaccctgtcgtgaggcagcgactggtcaaggtcgccaacgtaaggaagtgttttcttaaaggttgcgcgcattcgtactctcttcaccaccaagctgcgacggagagtggggctgttggtgtcgtgcatctcagcgcgatcccccctgtcgaccccttcgagcagttcatgcacagagtcgaggtcaggattacccgaggagcggagggtcgtacaggaaaggccttcatagctgatatggatgaggagcatgccatggaggtgatatcgaagttcatcaccgagacctttctatattcggtgagctgctgggggtatgcgagtgtgggataggggcaggccgctgcctgggaagaggacggcagccacgggcaggaatcagaccaggtggatggtcagcttgtgtatgcgctattcatgcgcttcttgctccttcctccagacagcagtgttacttctgctgctagaacagcaacgaaaggccaatgaagatgaagtaaagcaggcaaaaacgattgctgaccgcgcacgcgtagatgctcttcatgagtggcacctgggcgccgagaaggtatggcgcgctggatgataagaggcggttggggtggatggtgagatatgacacggtgtgccttggtttcagttcatggatgctagcaaaaggaatagactgcaggatttacagttttgtcctgcgtttgcagaggctgagcgatgtgacaacagacttgcaacttgcaatgaagtccatggaggagagactggagacgctggaacggatgctcacgccgcctgagaaaacacagcgatcatggtcatttcggtgatgttgcaggctcagttaaatttgattctcatgtaatcataattgctatcaaagcactggggctgggatcnnnnnnnnnnccagcgatcgtggtcatttcggtgatgttgcaggctcagtagaatttgattctcatgtaatcaaaattgctatcaaagcactggggctgggatcggccatggtccttcagtgacaagtgcccaccgcggtgccgtctggctgatcaagccagcgaaacgggcgcagcaggcagggtttggcaagatcggtgcatctcttctctgcctgctctgctgcgatgatgaggaaagcacctgattgcacggcctcgcttataaacaagataacatcaccaattagggacaggacccgagtgggagtggcgtttgagttgcaagcatcggcacctagaagatactcggtgtcccagctcgtccactcggagcgcataannnnnnnnnnctgagagcaagcatcggcaccgtgaagttactcgttgtcccagctcgtccactcggagcgcataatatcttgttttgacgcatcaagcatggcctttatgaatattgcaaaggcactggtcatcgcgtctctgctgctgctcggtctcaccggttaccaggcgatgcagtgtgagtgggctcccctttgctgggaatttgtactgagcaggacggtctgcagacccgtacccagaaaagctcacttcgcgatgcagatcgggagacactcagactggagcagctggagttcacggggctgccgggaagcctcttgctgaaccttgtggtggcagccgtgatcggtctggtcggtggtgtacagtattggggcaatttcagcccgatccgcctagctgataacccaaggtggggaatcaatgtcctagaggtgctgtggacgagcttgccatggcacggcgctgctctgaagtgcatcagaagtagacaatcccaagtttcagaatagacctgcctctaactggttccaaatatctttcccgctcctataggcccatccacttgagacccttgcgacctgaatttatggcgttcacccacaggggtgaagtgctctcatcccttcctcacataagggctgcggggtcagtgcccacaatacgctgagcatagattgcccctgccctttgagcttggcccannnnnnnnnnccctcacataagggctgcggcgtctgtgcccacaatacgctgagcacagattgcccctgccctttgagcttggcccataaattccattgcatcttccgctatttgcttgttcaaatagactatagcatgccttcgggtagctgcatatcagtacagtcggtccctttctggcatggcagacgatcgtgagatgcccagcagtatgggggattcttcctgccctaccgcagtgggaaacaagcaattcgggtcgtttccttgcgccgatctttccattcctcacttcggaccgtctctggggtgcgnnnnnnnnnnttatttgcttgttcaaatagactgtagcatgccttcgggcagctgcatatcagtacagtcggtcgctttctggcatggcagacgatcgtgagatgcccagcagtaaggggtattcttcctgccctaccgcagtgggaaaccagcatttcgggtcgtttccttgcgccgatctttcccttcctcacttcggaccgtctctggggtgcgatatgacttcgggctgcgtaccctgccttcccaaatggcaagctcgaggcacgccaaccctgctcggaggccacaggcgcccaccccgcactccattcgtcgacctccgtgagcatgttacttcatacccacatcttaaatcgctgtttcaatcactttcgagctgtcgagagacatcccgtggccgtacgagaggcgagcggttgagcagcagttgcgctcggcgacatcggggtcctccatggaaagccatggccttgacgccttgcacctggaaggcctggcggaggtttccaatcatcaagtatatgacctgaaggaagtgttggtcggagctggcctcttgtcaaaccaccttgccaccaccacgccccagagggtgagtcatgggggtgcccacagggaaggagcaagccatcccgatgcaattccttgcccagccagaaagccaggccaacaatggtcggtgagcctcagaaacctctcactgtcctcttatgagtgcagagtcaggagggcaagcgccgtcgactgaccatcggaagtgagccaagcgagacaccatgcagttcctgcagagacacgacagaggacgagtgtgatgctgtggcagctggcctgcaagctgtgctccgtgggaagatgcgaacttggtcccgtaatctggtcagactgcagccaaaggtgggccagagagacgccagtgtgtggagggacagctgcatcccaaacagattcaagctctgccagggcaggagtcgtgttgcatcgataacatcttctccagataacaatggtaccctcctgctcgtacccaggtgcatgtctctgagtatctactggaatgcggtctgtggctcttccgcaatcttcgcaaccttcaagtggccgctgctgcagccggagtattgcctgcggcttatttgacggaggaacagtatctgctgcacgatctgatcgcctgctggtggctggcaatgaagcactgcagtgtgcgcacagcagtaccaaacaggtactggggcggtgctcagtttgagaagatgctggggcatgcaccaagaatacggttctggggtggcttgctacttccaccttcgttcgtccttttgttaccccctgtagccccatcaggtgagctagagacttcccgccaacccacccaaccagtcccctatatcttgtgctgccaaattgcaggacgttgatgtgtcgtgccacaggcgcctgcccagcactgctgtcggacagggagctggctacactcatctccctgaactggagggtcagcggggtcctgagcaggggagacctcctcagctgagcccttagcgggcagtcgtttaaatgattgcgaatgccatgccctccttcccaaccctaccctcacattctctgcaataggcagcccttccctccacgccgtgctcaagcacgacctgtatacttgctgatgtgtgccctgccaagatgccctaccatcgtaaccccccccacctctcacacacacacacacacgtgcttttctctgttacctggtgtcgatagatctttgcgtgccggcatgcacaacatgagcagcggcatgacccaatctcccccttggttgtgaggtgtgttattgatgtccatgcaacatcctgatgtaagaatagattgaggttcattccaggctgtgcctgctcagagccgacgcggatcgcattccttgaaccagaggcaggtccaggaacggctcggcatggcacaaagatggaagcatgtgtgcaaggggatgtcaaggctccgccaaggagaggcgggcccagctgtggaggcagggctggagggcaggatcttcatctgcagtggcattgccttccacctggtgcccgctttcttgcatgccatgagaaagtcagtggaccatccacggcacaccgccactcagcaggagcaagagcatatgctcagtgcttgggcaagtctcgtggcttgcgagcctccagggggctgacttcccgggcctgccgctcctccctctgctttcccttgatcgtctcacggaccatgtcggcgaaaagcgcgtgccagcgggcatccccaacgagctctgggtggaatgaggtggccagcaggtgtccacttcgcacagcaaccacaaccgaggcggggcgagatgagtcttccgccgcctcctcgggtgtcaggtggtacctggcaagcacctccacacctgggtgcatcagggaatgcaaacttggcggaggggacagggagcgacgaccactcaaagttgacaaacatgaccctgatgaaactttcacaatggactgtgttgctgtcatactaacctaccaggtacctacctgggcctgtctccaggatggcgggggcacggatgaacagggccctgaaagtaggctgccctgccaccgctgtgggggcatgcaggaggcactctggtgcagtcagccgcgtctcgaagctgtggatctgtgcgccaaagaagtttcgggcaacagtgacgtccagcccgcccagaagcgcttggcctccggtcttcgtgccgaccgcgcggtctgccaggaagatgaggccggcgcaggtgccccagacggggcgctggagctccctggtgaagcgctgaagctcagggatgagaccccagcgctctgccaccaaggccatggtggtgctttcaccccctgtgatcgggcatgacaaagggagacctcatggcaatgctggagcttgatttcacatgcaggtctgcccgaccttgagggacttgttgctgaccaatcaccgctctgggtgttcagtgtgcacacttacacacgtacatacatcgcacaatgggacggaaggccctgcacatccccccttggtggactgcacggcctgagatctgccagaggctcgtcacctgggatgatcaggccgtctaccccatccagttgctccttcgtcctgacctccacggcttccactcctggcagggattgcaggctggtcacatgctcccggaacgcaccctgcagcgccaagacaccgatgcggctgtccgctggagcgtcgttcatgacgacgacgtggggctggtgacctgctacacgaccagtccgagcgacgaccgcgattgggcaaggtggcgaaggttttcgcaataattccctcggagcagctttgtagggagtttcacgtctgaatgtgatcttcaggacgagtggctaatgcatgcatgtggcccgctaaccagaaacgacaacctgagtcttgcagaacatggcatttaatttattgatgtctttcaccttcgccggtcgatgtagtataacggtcagtatacgtgcctgtcaaatggtgctgagtgccagtcctttctggacgcacgtgatccgggttcgattcccggcatcggcgacattttatattttgcttaaggtctgctgtgcaggctgccatgctgccatcacacctgcttctcattcccaaaccctgcgttgaagctcctccggcgacacggattcgggagcaagaagctttgggtgcccctcctgtaggtgcagagaaagaacgagccacgctgacttgcgccagacgtgagctggtccgagaatgccgaggttccatcatgctaggcaacgatgggcacacacgcactctccttctggatattttgtgtcgttataagtcgagcccagactctcagcccatccctgcccttgaggactgtggcggcagagggtcctcccggcggacggcagcatggcgaggaagattgcctgcataggtgagctcgatcccttgttgcctcaaacagattataatgtgtaaacggtgtcttgtgcaccttcgttggaaagatatcagccctggctccggcatgcccggaatgtgatgatgacgtcatgagcgcgaatgcacgtaactgagagcgccatacactgcaagcatgcacctcatatggccttctaagagcactgaatccaatcacttgctccgactgcaggagcgggctnnnnnnnnnnagatgcacgtaactgagagccccatacactgcaagcatgcacctcaaatggccttttaagagcactgaatcgaatcacttgctccgactgcaggagcgggctatgtgggtgagtcgggtggctatgcccgagttcctcatcgtctgtggtcgtgggtttgcatgtatctggtgcatgctgtctctgtcaggcacacactgagctgcaaatccctttcctcactcggctcaggtggaccaaccatggcaatggtaggattgcctcatcagctttacttggtaaaatcatgggggttaacatgtgcctgcacacaaactggaaacccgtagaccacatcgatgccctgtgcagattgcgttgaaatgcgtggacctagaagttgtcgttgtcgacctgaatgtctcccgcatcgccgccnnnnnnnnnnttcaaatcatggggattaacatgtgcctgcacacaaactggaaactcgtagtccacaccgacgccctgtgcagattgcgttgaagtgcgtggacctagaagttgtggtcgtcgacctgaatgtctcccgcatcgccgcctggaactcggacaagctccctatctacgagccaggcctcgatgaggtggtcaaggcttgccgcggccgcaacctcttcttctccatcgacgtcaagaagcacgttgccgaggctgacattgtgtttgtgagcgtcaacacgcccaccaagacgcgcggcgtgggggcaggcaaggccgccgacctcacctactgggagggagctgcgcgcatgatcgcctccgtgtctacgtcctccaagataatcgtggagaagtccacggtgcccgtgaagacagctgaggccatcgagaaggtctgtttcccctcgtttgccagcttggaatgtgtatttgaaggaatcttgcggatcttcgttccggcggggtcaagtgaatgatcagnnnnnnnnnncgagaaggtctgttccctctcgtttgcctgcttggaatgtgtgtttgaaggaatcgtgcggatcctcgttccggcggggtcaagtgaatgatcagtgtcctgtgcacgcgtattggactgattttggaggggccataccatgatttcttgcaattcttaaggcctcttcctcccttcttcacgcaggtccttagatgtaattgcaccagtgcatccgtgcggttcgacattctgtccaaccccgagttcctnnnnnnnnnnaattgatttggggggggccacaccatgattttttgcagttcttagagcctcttcctcccttcttcatgcaggtccttaggtgtaattgcaccagtgcatccgtgcagttcgacattctgtccaaccccgagttcctggctgagggcacagcggttgcggaccttgcaaatcctgaccgcgtgctcataggtggcaaggacggccctgctgggcatgctgctatagaggagctggccgccgtttatgctcgatgggtgcctcaggatcgcatcctgcgcacaagcttgtggtctgcagagttatccaagttgactgccaatgccatgctcgcccagcgaatcagctccatgaactccatctctgccttatgcgagactacgggtggggaagtggggtcgagttgatgagacgctggagcttgtcgaggattgttgggtgatagctggnnnnnnnnnnnnnnnnnnnnnnnnnnnnnnnnnnnnnnnnnnnnnnnnnnnnnnnnnnnnnnnnnnntcgtcatccttgatgcccatttggattacgagtcaattctccttacctctagattcttccctcaccaacgtcgcccaggtgcggatgtgcaagaggtcgcacactccatcggaaaggactcgaggataggcccgaagttcctgaacgcatctgttggctttggcggctcctgcttccagaaggacatcctcaacctggtctacatttgcgaaaccctgggcctcaaggaggtggctgattactggcatgctgtgatcaccatgaacgattaccagaagcagcgctttgtggagcgaattatcacatccatgttcaataccatctcgaggaagaacatcgcaatctatggatttgcctttaagaaggacactggcgacacgcgcgagactcctgccatcgacgtctgccatggtctggtggccgacggagctcactgcgtgatatatgatccccaggtgggagcggaccaggtgcaccgcgacttggccactccaaagttcgagtgggaccaccccagcaggggtcaggctgccatcgctgggcgcgacgagatcaaggttgtcaaggtgggtgaggcgtcgatcgcagcgctggtgtggatataagagccagcttgactgaaggcgtccttggagaacagtgcatgcagttgagattcgagagcaggggttggggcccggggggtggcatctcacatagcgcaggctttgcaatcatattcacaagctccaacattgtatcaagtgcaggatccctatacggctgcgcatggcgctcatgccatctgtgttcttacggagtgggacgagtttgcacactacgactaccaaaaggtgagcgcctgtcactatacatgctgacctctcttgagggacgaggtcgggggaccctgggccacggtgtgttcacgcatgcatttgactcccacctcccacatgcattnnnnnnnnnnagagtgggacgagtttgcacactacaactaccacaaggtgagcgcctgtcactatgcatgctgacctctcttgagggacaaggttgggggaccctgggccactgtgtgttcacgcgtgcatttgactcccacctcccacatgcatttagatctatgacaacatggtcaagcctgcgttcatttttgacggacgaaacgttctggatcatgctgagcttcgcaaggtgcgcccccaagggtggtttgttgagttttaattgcctatgtgggatggacaacatcttactnnnnnnnnnncgcttcgcaaggtgcggccccaagggtggtttgttgagttgtagttgcctatgtgggatggacaacatcttactcttggtgtcatcgtctgtgtgtgtgtcatcaccaacccaacccctttccacagattggcttcattgtgtatgctcttggcaagcccctggacccattcttatagagtgaacacggggaagcttagcttgatctcatggttgatctcttcattgcttgggctgctgcaaggatcgcggttcgttgactcgccctcctcacaagtcattccctgccatgttgtggatgcatcatctcataccttcccaatgctggtctttttctgtagttgcaagctgctcagcaacttgtgcatcaaggagccggcatggctttatgttcttctcattctcaagggatctagagggactactgttcccatggatccatctcaccatcactcgtgatcgctgtttgcaagcttaatgtgtcttctgaacccttgtaaaaatatgcataggccctcattgcataggttgaagcgctagacagcatggaaataagccatggacgtcggcatcatgtacgaaacggtatttgtaggtaggatgggcagctggtggnnnnnnnnnnaacggacgtcggcatcatgtacgaagcagtatttgtaggtaggatgggcagctggtggtttgccacctgatgtggcggtcactcatttggcataccaaacataaacctcggtcggtgcttgcattacagccagatagcatctctcataaccacaattcagggaattccttcgcgatcaagtatgctcaaggtaaggcacccatcgttttggggaaggtccaacccgggcctggctggacctcgtcaccaactacattacaataggcgggccaccattgcgctgttggtactgcagacctccggtggagagtgggacaccgggagacgatgacgaatgtgaggaaaaggctgtgagaacagacgttttctgcgccagtgcttatgcttcctattttaaccacatatagaatagctacaaggccctgttaggcgcagtgcattccctgctcagagagcgctaaccaccggagcagttggcggttgttcaagagcaggcctgcacacaatgaccaagaagatcgcgtgcatcggtgagtttgttacgctaagctgggatttgatgatggcgtgagccttgcggactccgacgcagttgttgtggtgctgggatcttgctacctcttgctctggtcgaactagatctagggcctctatttcgacatgtggtccgatattccagctgcaaatgatcagaccgatacctattcgtcatgtgagtctccaactcactacccctttcccaccctgtatgcctgcaggcgcgggctacgtcggtgaggctccggattgccatcgaagataaatgctgttatgcacatgccgcatacgcaccgaatcagtaccactggttgacactaactcatctaccgcttgcaggtggacctaccatggccatggtgaggcactcaccaagcccatcccctagcccatgaggtaactatcacccgggcattgaccctccttctcctatcccaaccctccacagattgcgtacaagtgcccagatatcgtggtggttgtcctggacatcaacgaggcccgcatcgccgcctggaactcggacaagctccctatctacgagccaggcctcgatgaggtggtcaaggcttgccgcggccgcaacctcttcttctccatcgacgtcaagaagcacgttgccgaggctgacattgtgtttgtgagcgtcaacacgcccaccaagacgcgcggcgtgggggcaggcaaggccgccgacctcacctactgggagggagctgcgcgcatgatcgcctccgtgtctacgtcctccaaaatcattgtggaaaagtccacggtgcccgtgaagacagccgaggccattgagaaggtgcgtgccactccatgagtgagggctttgtgttgggcattgagccttcgtgcatttcatgtgggaagtaggggtgccaccccaagcgcaaaccacttccctgtgtctctgatagtgatgtgacagtacaagcatactgaggttacacttctttggcatctgcaatatccgcttgcatcaacttcacatgctcaccttccacacatccatgcataggtcctgcgtcgcaactgtgccgacccgggggtagacttccagatcctctccaaccccgagttcctggcagagggcacggcgattgccgacctgaccaaccccgaccgcgtgctcatcggaggcaaagacaaccccgctgggcatgcggccatcgagcagctggcagccgtgtacgcgcactgggtgccccaggagcgcatcctgcgcaccaacctctggtctgcggaactgtccaagctgaccgccaacgccatgctcgcgcagcgcatcagctccatgaactccatctccgcgctgtgcgaggccacaggtatgtgtctgactttgagctgcagaaggcaagacggcaggttgatgggtttatggggattccagagctgcagcctgcccatgggacgattagatgctctgtctcagcctggacagtattcatctgggagaacagtgctttacgcatgcaatgtacatgtgcataggatctcctctcgctcatatcccgcaagatcaggcacctacagtacaacacgttcaccatctgaaacgatgcgtagtccgcccccccccatgtgccgcctctatctcgaaccctgccagatttgtgcatggtctcagaacatggcacccaacatccacactgccacccttccactaacacgtttcaagcccatttctcacctggctgatcgctccagtgacgtctctggcctcccccctccatgccccaacatcccactcacgatgtgcaggggcggatgtgcaggaggttgggcgctccatcgggaccgactcacgcatcggctccaagttcctgaacgcctccgtcggctttggcggctcctgcttccagaaggacatcctcaacctggtgtacatctgcgagacggtgggcctgaaggaggttgccgagtactggcactctgtcatcaccatgaacgactaccagaaacaccgcttcgtggagcgcgtcatctcctccatgttcaacaccatctccaagaagcgcatcgccatttacggctttgccttcaagaaggacaccggcgacacgcgcgagacccccgccatcgacgtctgccgcggcctgatggcggacggagcccactgcgtgatctacgacccccaggtgggggcggaccaggtgcaccaggacctggccacgcccaagttcgagtgggaccaccccgcccgtgcgggctccaccgtcatcggacgtgacgagatcagcatcgtgtcggtgagcggggggcgctgcgccgggtgcactggatgattggaggattggtgtttgccgcattttctccgcggcggctggtatgtgccggtccgaccagggggtccgcacctgcaatttgagccgctccaggaccgaacagagttccctgctcgatcccacacagcttgattccccaccgtctcgcgcacaggacccctacgaagccgctcacggtgcccatggcatctgcctgctgacggagtgggacatgtttgccacactagactaccagaaggtgagcttgggataattgtcctttcccggccctgccaggcctaaagggactgggaagtcacgcacagaagacccgtgccgatcacttttccaggatcattcagcgctcccagcaacacgagcgcccctgcccatcaacacagatctttgagaacatggtgaagcccgctttcatcttcgatggccgcaacaccctcaaccatgccgccctgcgtgaggtnnnnnnnnnngaagaccgtgccgatcacttttcaggatcattcagcgctcccggcaacacgagcgcccctgcctatcaacacagatctttgagaacatggtgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctccgccgcttccagtctcccgagtcgccaccatgcttacacttgggccccccaattcccctgtcacagattggcttcatcgtctacgccctcggcaagcccctggaccccttcctgcagtgcgcatacaactaggctgggcagcatggcgcaacaagtctgcttgccccgtgccttgtgtgccatgcgtctctgcatgcgcacttacatgggacatgccatcccttgggtgatcctggaacaccctcacgcttctcacacatggcacgactgtctgttcacaactcataccctcacgatcaccgggaagagcgtcgtctgagggcagtgtgtgacgagatgagtgtggctcatctggtccagaaggtcctgaaaagtgacaaaggctgggcatcacggcgcagaaggcgcgtgcaagtgtgtaaccgcgacttaatcacagctgccatcgaccagcattgggaccggtaactccgtattccgaaagggcgtgggttcgaatcccactggcgacagctccgactgtcggtcgctatgggggagtggtctaactcgatacgttaaggtcttccaatcgcctttttgcctttttctggtcccgaattccgggcgaacgtggctttccggctcagactctgccctctacacggtgaccatgctgtagcctactggtcttcacctttccttcgggacctgcttcacaacnnnnnnnnnngcacggtgaccatgctgtaggtcactggtcgtcacctttccttcgggacctgcttcacaaccagaagcactgtgctcattctgctgtgcgagtatgtaattatgtgcagccaaacatggatcaggagtgtctttggtcccatcggacaccccaggaccttgcatgtgtggcaaccgctttgagcagggagaccctccacgcgtgcacatcagtgcgcatcatggccaggcaannnnnnnnnnagacaccccaggaccttgcacgtgcggcaaccgctttgagcaggaagaccctccacgcatgcacatcagtgcgcatcatggccaggcaagtagccggtctgtggtgctccagccgcggcgatccggcacaccatggaaccgagcagcggtggggtggggctgatcatcgccgctctgtcccttcagaaggcaatttgatggggcaggatgccctttcctcgcagtggtcagcccacctgcgctccagccctggttcccgtccaccagggatcggggtcgccctccggcgtccacccgccggcagccagggcgtcttcctgggacgcaccgtgccgtgtccactcgcccaggggggcatgcagcgagggatgccgtggtctggggcaggtgggcggcatctcagcatgctgcgcatgtccccaacctgtgtgtcctctcggacgtagttcccccccgtcaggtggtccacgggaagagcaggctgtcttgccccaagcctggtgcgccgcgctgtcccagcccctgaggttgcagggggtccttggcggagcccaggggcaaatcgctgccagggatggcatagggccccgaagcccccacgagcgcgctcctgtcatattctgcggtgcgcagtgggagcaaaaactgagcgcggctcccagtgcatcgcccacgctcatccccagacgcagctcccttgcaaacgggtctccaccggtggcgtnnnnnnnnnnnnnnnnnnnnnnnnnnnnnnnnnnnnnnnnnnnnnnnnnnnnnnnnnnnnnnnnnnnnnnnnnnnnnnnnnnnnnnggtacctgcggcatcagatggctccaggcccttggaacgcccgccccgtgctggaccctccccatgcgcaggtgggggagcggggggctcgtgcctctcccccgcatgctccacgggccggaagcggttgctgtgcgcgcctcccagcccgaacgagctggcatcgaagaaggtgcgcttacgcggcagggccaccaggctctgcttcagcaccgtcaaggggcctgtggtgggaatgcggggggggatgagcgatggatggctgttctgtgccagggctgtgtgtcggctgggatgcagtggaccggcgggtcccctgcccgctacaagacctcaaccctctagggggcggtccccaggctctcccaccttccacgaggcacccattnnnnnnnnnntggctgggatgcagtggaccgtggggtctcctgcccgctacaggacctcaaccctctaaggggcgcccccctggctctcccaccttccacgaggcacccattgtccttgaagtggtgcagcagcgcgccccagatcatctgctttgccaggacctgggggttaccgagcacgaagaggccataccgcgcacgcgtcagcgccacgttcaggcgccgcgggtcggacaggaagccgatgccctggtgcgcgttggagcggacgcaagacagcaccacaaagtccttctcccgcccctggaaggcgtccacgctggcgcactccaccgccgcatactgctcggcacgcagcggcccggcccgggccagcgtggccagcacatgcgcgcgctggccctcatagggcgtgatgatgccgatctgggagggcgccacgcccgcgcgcagcaggtgcgtgaccagcttctctacagccgccgcctccgcccggttgaggtacgacgtcccgcttgcgctgatctcctccgcgcccagctgcaagggcagggggtgcgatgcatgggtgtggggtagtgggctcccgccgacgcgatcagggcgacgctggggtggtgatggatgccagcatcaacctgccaaacagcaacgacatctcatgaactagaagcagaggttcttgacggcactcgacgggccgacagggtgaccctgccccttgtcccaccaactccttgccccacctggacgtggaacatcatgggcttgtcggtgggccaggggaaggtctcggccggcagctcgcgctgcgcggccgacacgccgttctgcagcgcgccctcgtaaaaggtgtcggaggggaagcgcgacagcgcggggtgcatgcggtactgcaccgccaggcgaatgggcttcacgcccagcagcatcagccgctcgaacaggctctgggccagccccgcccgggcggcgggcttggccagggtcaccggacccagctggcagtggtcccccaccagcaccagctgggaggatgaaggggaaggagggtgtgggtgtaagtttgagatggggtgaaacgaccagggaggagtagcagagggaattctcatcctgaggcacatgcacttatcctggacacgtctgtccagacatgtaagacacaaactgccctcccagcaacccttgnnnnnnnnnntgagggaaggagggtgtgtgtgtaagttcgagatggggtgaaacgaccagggaggagcagcagagggatttctccttctggggcgcatgcacttaccctggacacgtgtgtccagacatgtgagacacaaactgccctcccagcaacccttgcagtagcagcagcacctgcttggctcccatgaccaggggaatgagggactctggctccaccgcctgcgtggcctcgtcgatgagcacccgcctgaagcggaagtgggccaggcgcgggtcgccggcgcccacgcaggtcgcgcacacgacgtctgcggcctgcagcacctcccgctccagcgccctcagcagcgtccggtgcttgcgctcgtctggaagtgtaggggatgggatggtgggtggcgggtggtggagatggggcagtgggtgtatcgggaaagtcagcggtggaggtcacccaaatgatgtccgttgcccacgcctcccttcgcacgcgcaacaacgatgctcaccttgtgcggacagctcgcccagctcgtnnnnnnnnnntggggcagtgggtgtctcgggaaagtcggcggtggaggtcacccaaaggatgtccgttgcccacgcctcccttcccacgcgcaacaacgatgcccaccttgtgcggacagctcgcccagctcgtccttgagctgctgcagcttgtaaagctctggcgactcggcggccgccagcgccctcacctgcgctcggtcagggggtgttgggtgttgcggcagcatacacgtgtgcaggcgtcccaggcggcagtgctgctccagagtctcgtcgcgcaatagcccgggcgctgcacagcaccacatcacaagaatccaagcctcttttcgtcccttggctgacggccctggtcacctcctctactcccttagcacacacaaaaaaccaaaaagcacctgctggtgcagcgtcaggtgcnnnnnnnnnnccacctcctctactcccccagcacacacacacaagaaaagcacctgctggtgcagcgtcaggtgctcgacgttggaggccacggcctcgcgcgagcgcgcctgcagccgcaccaccttgagccccgtgacggcggcgcgctctgccaggtggtccactgcgatgttggagggcgcggtgaccagcacctgccccgcgccggcgccctgccgcgccagcgcgtagacgatggaggcggaggtcacggtcttgcccgtgcccggtgggccctggattagggacagggggctgcgcaggacacgcgacacggcgtccgcctgggatgcgttgagctctggcaggcccggcgccgacaggcgcttcggcagcttcaccttgagcgccgtctcctccacgacgtgccccaggatcttgtggtacaggtagccggagacgctggtctcgtccactgcaaaggccttcatggcgcgctgcatgcgctcaaaggtggcgcccttccacacaaactcgacgcggaagcccacggtcacgtcggtggggggcgggccctggcctgtgttgagtgcgggggcgggggatcaggcacggttggatgtgtcgtgaaggatgacgccgatggcgacgacacttccccgtcgcctggcatgatccaggcgcgcctcagcacctcgtgcacgccaccagcctcaaagcaacccccatcaacctccctcccaacacctccattccagcagcctacccttctcgcgcgcgcggagctccaccacgatctcctcccccgcatcacccaggcgtgtgaccaggcccatgccctgccagggcgccgcgcccaggcgcggcagcgggtggcgcagcagcagctcgtcgcccaccaccagccgcatgtcacccgagtcgcggggaaagaagaagcgcgccaccacgcgccggttcaggcccacactccactgcaccgacacgtcctcccgtgccagtgactccttggccgccttgtcgtagtctgcggattgttggtgtgagagagaggggttgtgtgtgtgtgtgtgatgaggctattgtccgtcatcatggacatacggaaggggggagcaatcctgcgatactttcctaacactcaggctgccatgcctgctagagaggtccatgcgcattctgcttgtcactgatccctccccagctcccttgaagcttgggacgacactgctccatggagaactttgacactgcatccccagcacttcctaatcccaccccacccacccccatcccccatccctgccatcccccatccccgccatccccca

SEQ ID NO: 18449 - DNA, 104 bp, Chlorella protothecoides
ttttaaaaattaatgaaaatagagcaaaaagtggaagaactaatataaaaaatacataatttccaagcattactcctataagtaattttggattagtttttttt

SEQ ID NO: 18450 - DNA, 61 bp, Chlorella protothecoides
caatgtcattgggcgccagtgggtgcctgctgcctccatccacaccaaaacattcagttcc

SEQ ID NO: 18451 - DNA, 46498 bp, Chlorella protothecoides
  modified_base (691)..(700): a, c, t, g, unknown or other
  modified_base (1413)..(1422): a, c, t, g, unknown or other
  modified_base (2395)..(2404): a, c, t, g, unknown or other
  modified_base (2776)..(2785): a, c, t, g, unknown or other
  modified_base (3166)..(3175): a, c, t, g, unknown or other
  modified_base (4181)..(4190): a, c, t, g, unknown or other
  modified_base (5263)..(5272): a, c, t, g, unknown or other
  modified_base (7081)..(7090): a, c, t, g, unknown or other
  modified_base (7286)..(7295): a, c, t, g, unknown or other
  modified_base (8172)..(8181): a, c, t, g, unknown or other
  modified_base (8411)..(8420): a, c, t, g, unknown or other
  modified_base (8923)..(8932): a, c, t, g, unknown or other
  modified_base (9422)..(9431): a, c, t, g, unknown or other
  modified_base (9983)..(9992): a, c, t, g, unknown or other
  modified_base (11102)..(11111): a, c, t, g, unknown or other
  modified_base (12770)..(12779): a, c, t, g, unknown or other
  modified_base (13479)..(13488): a, c, t, g, unknown or other
  modified_base (13753)..(13762): a, c, t, g, unknown or other
  modified_base (15670)..(15712): a, c, t, g, unknown or other
  modified_base (16166)..(16175): a, c, t, g, unknown or other
  modified_base (16657)..(16666): a, c, t, g, unknown or other
  modified_base (16751)..(16760): a, c, t, g, unknown or other
  modified_base (17356)..(17365): a, c, t, g, unknown or other
  modified_base (18014)..(18023): a, c, t, g, unknown or other
  modified_base (18419)..(18428): a, c, t, g, unknown or other
  modified_base (19284)..(19293): a, c, t, g, unknown or other
  modified_base (19377)..(19386): a, c, t, g, unknown or other
  modified_base (19463)..(19472): a, c, t, g, unknown or other
  modified_base (20280)..(20289): a, c, t, g, unknown or other
  modified_base (20406)..(20515): a, c, t, g, unknown or other
  modified_base (22062)..(22071): a, c, t, g, unknown or other
  modified_base (22669)..(22678): a, c, t, g, unknown or other
  modified_base (22908)..(22917): a, c, t, g, unknown or other
  modified_base (23777)..(23786): a, c, t, g, unknown or other
  modified_base (24930)..(24939): a, c, t, g, unknown or other
  modified_base (25980)..(25989): a, c, t, g, unknown or other
  modified_base (26143)..(26152): a, c, t, g, unknown or other
  modified_base (26767)..(26776): a, c, t, g, unknown or other
  modified_base (27300)..(27309): a, c, t, g, unknown or other
  modified_base (29051)..(29060): a, c, t, g, unknown or other
  modified_base (29792)..(29801): a, c, t, g, unknown or other
  modified_base (32019)..(32099): a, c, t, g, unknown or other
  modified_base (32221)..(32230): a, c, t, g, unknown or other
  modified_base (32407)..(32416): a, c, t, g, unknown or other
  modified_base (33365)..(33374): a, c, t, g, unknown or other
  modified_base (33669)..(33678): a, c, t, g, unknown or other
  modified_base (35418)..(35427): a, c, t, g, unknown or other
  modified_base (35497)..(35506): a, c, t, g, unknown or other
  modified_base (35761)..(35770): a, c, t, g, unknown or other
  modified_base (35847)..(35856): a, c, t, g, unknown or other
  modified_base (36032)..(36041): a, c, t, g, unknown or other
  modified_base (36550)..(36804): a, c, t, g, unknown or other
  modified_base (37264)..(37273): a, c, t, g, unknown or other
  modified_base (38856)..(38865): a, c, t, g, unknown or other
  modified_base (38921)..(38930): a, c, t, g, unknown or other
  modified_base (39043)..(39052): a, c, t, g, unknown or other
  modified_base (39291)..(39300): a, c, t, g, unknown or other
  modified_base (39378)..(39387): a, c, t, g, unknown or other
  modified_base (39481)..(39490): a, c, t, g, unknown or other
  modified_base (40582)..(40591): a, c, t, g, unknown or other
  modified_base (41375)..(41384): a, c, t, g, unknown or other
  modified_base (42593)..(42602): a, c, t, g, unknown or other
  modified_base (43079)..(43088): a, c, t, g, unknown or other
  modified_base (44790)..(44799): a, c, t, g, unknown or other
  modified_base (45322)..(45331): a, c, t, g, unknown or other
  modified_base (45566)..(45575): a, c, t, g, unknown or other
ctcccccccacccccacccccttgaccctcccaatccatcacccttcaccaactccccacctccagcaagcgctgcacgaaggccagtgggtccttggcccgctccgggtcggtgaccagcgccttgcccgcctcgcgcaggtgcgcgcccagcgcctcctgcaccagcacaggcccgcccggcacgcgcgccgccagccggtacaggacgtgcaggtcgtcgtactgccgcgcgcgcagcatgggcacgagccccgtgccgggcaggtccagcagggcggggagctggtcgccgatcagcgcgcgctccacggcgcccagcaggcgcggcgcagaggcggggcagaggtaggcctgcgcgcgcgcgcgctcctcctccagcctccgcgccgcggcggccaggtaggcggggcagtcggccgcctggagcagggacgcggcctccgcctgcgatcaccggtggggatgaggaggttgacgggggatcagcgcttggggggccgctggtcatgggaatcggcaacgtcacagcgatgggctgaatccaacccaggcaccccatcctgtacgcagactcccgcatgcaccaccatacccttcccccctccaccccctggcttcaagagcctccttttctgagaactccagctgccccaccacccccctcccgcgtgctccccgctcaccgcgnnnnnnnnnncccacgcgccaccatacccttcccccctcccccctctggcttcaagagcctcctagcccgaaaactccagctgcccccaccaaccccctcccgcgtgctccccgctcaccgcgtaaaacagggaggtctgctccaggaagggggtctcaaagtcgtcgcggtacaccacgggccccaggtccatgtacatgcttgtgatggccttgagcagcgaggcgtccaccagctcgccccccctgtcccgcgcgacggcctccagcagcagcgcgcgcgcgcgcggcgcgatgcgcggcgcgcggacgacgccgtcgcgccacaggtccagccccagctggttcagcggcgcgagctggggctggttggggatgtacatgcgctccatgtacaggaggaaggcgcggatgacgcccatgctcttcatgtgccgttcccactcgtacttcagcccggggaggaaggagggggagggcaggaggtccaggcgctccgccacgccgcgcaggtactcggcctccgcctcgcgcacggcggcgtacagccggtgcccaaacttgtccaccaccagctggtaggcggtgctgtgcggtgaggttggaggggggaggagaaggtttggtgagagcgcaggggagggatgacggcggggggtcggcatcggtagcggtgagtaggggcatgctcagcgcgtggcagcagcggagggcgaggccagnnnnnnnnnntggtgaggttggagggggggggagaaggtttggtgagagcgcaggggacggatgacggcggggggtcggcgtcggtagcggtgagtaggggcatgctcggcgcgtggcagcagcggagggcgaggccagacatccacgacggaacaatcccagccagccagggtcgcgccctcaccggtacagctgctcgaagctgagccggctggcattgtggttgttgatctccttgatggcgttctccagtagcgcccagtttgtgtctgcatcgccaggccatgggtctgggcgtgagcaaggacggcagtcccgaggaggagccgcaatccagccatgcagacccccgaaactcacgacgcaccaaagtatgagtgatccagattcttccgaaccggatgggtgaacatgtccagcttcagctgcggaggtgggggggtgatcagggccggggaggtgaggcacacgcacacagcgggcgaggtgcatgttgcagcttcgacaaccaagaccacgatgctcaccctgccgcctctgcccagcgacatcgcgccgtgtgcctgcaggcgtcaccacgccctgtgggtctcggtcaaatggagggcggctcccgcgccgatttacagggctccggaacaggccctggcgttgatatggagcatgacaagacccgatggtgaatggaaggagccgacaggggctgggagcgggaggcgtcctatcttgcgagcaaggggagcaacccgggaggggccactcgtacggaatctttgcccagcgtggaggccagaagtcgcacagacgggacgtggaggtggatgtggaggtcgtgatgttcgatgccgaggtggtgggaggggagagggaccccttccctcaaaagtttggtggaaagtcgcgaaatcgaaacgggaggtctctcccctgcagggtgcagaccctctctgagagaatggaggtcggcctttacatccaagcnnnnnnnnnnacccctgcagggggcagagcgtctctgggagaatggaggtcggcctttacatccaagcagggtcaccatcatccaggacacagcattattttctgttcctcagttgaaaatggacttccgcttgggcttcaccacttggtctatgagcccgtactccttggcctcatccgcgtcaaagtacttgttccgcgcaaagtcgcgggccacctgcggatgcgggggcgcgatgcttgtaatggggaacgtgcaccgagcatcgcatattgccggcgccaggtcccgtgcgtcccccaggtggcaaactcctccctcctctcaggcatgccgtgcttggccacaccgactccctcaccgtgttaaagtcctggccgnnnnnnnnnngttgccggcgccaggtcccgtacgtcccccaggtggcaaagtcatccctcctctcaggcatgccgtgctcggccccactgactccctcaccgtgttaaagtcctggccggtggcctctgccagcacggcattcatgtagtcccgcgtcttcagcagctcctgcgcctcgcggttgatgtccgaggcctggccccgagccacgccagagggatggtgcagcatgatcctcgtgttttgcagcaccacgcgcttgccctgcgaagcggagcaggaggaaacagagtctaatcgtgtggggttcactggagcttgcagcagcagcaagtgtgatgtcgcatggacggcaccgacactcgccggcccctgcaaggccccaagcgnnnnnnnnnnggagtctaattgtgtgggggttctggagcttacagcagcagcaagtgtgttgtcgcagggacggcaccggcactcgccggcccctgcaaggccccaagcgcactcctcagaccaggtcgaggggatgacccttcctccccatgcacttctcactgacgctctcgagcctccactccttcccgccctaggtaacccgcaacctcagtgccaagacgccacccctcttcaagaatcccgaccttttccctctgcatacacaccctttcctgcccttctcaccttcttgcccactgccaggaggaagcctggcatgcccatggcgccaccaaagccaaccgtccccacatcgctcttgatgtggcgcatggtgtcggccagcgccaagcagggcatcacctcacccccagagcagttgatgtacagattgaggtccttcttgttctcagagtccaggtaaagcatggtggccaccagctgatttcccagctcgtcgtccacggccttggagaggaagatgatgcgctcgcggtagaggcagttccagatgtccacccagagccactggttctgcttgggcacccggtacggcacccggggcacgccgatggcgttgcagggcgggaggggccggggagcggaggggcggcgggcgccgaaggcgcggtgtgggggaggagtgaagctggttcgggaggtaggcgagactgcgggtgtgtcggatgtggggcccaatgtgatgaggcggacaatgacaagcgcatgagaatgatggatagccagtcttccgactcaatgcgctcccttgtctccgtaccgtgtccctgcatgccgatgcaggcccccagggaggccatacccgccctctccgggcgctgtgggtggggtgccccttctcagagacagagagcgctggcttcgggtcaggagcgggacctggacaggtttcttgagggatcaatggggaatgcagatgttgcgggatgccgcgatggtggatcgacgtccnnnnnnnnnngctcagagacagagagcgctggtttcgggtcaggagcgggacctggacagggttctggagggatcaatgaggaatgcagatgtggcgggatgccgcgatggtggatcgacgtccggtgaagcgaggagacaccctcctcaacccagggcgccttgaggccagcctggcattatccatggtctcgaggttccacccacacagtcgggacccacatgcgcatgtttgatccatccgcgcggtgctagtattcagactcttccacactttcagactgacgatgtcatgttgcatgatgtcgccctgcccgacgaccgccgtgggtgtggcctcacgcctcgcgcccacgggaaacctctttcccttccgcggggtgctggtccccctgcggcgcagcaagcagagctaccgctgcattagatgccacaccacgctcgagtcccaggccgagcctgccaatcggcgggagcccgaggcgtcagaagcccccaccgccccggtaaccctgaagcccccgcccagccggcgccccgcccccatctaccgcgccccgccgtcgtacactccaggggacgattcacggcccggcgagcggaggggccccgagggagcacccaggggccagcctggcacgcgcccagaccgaagacccaacaacaggggcccgcctgggggtgccaggccgctcccatctggcacgcggccgcctggctctccccagcagccttccaatggcagctcgggccagccataccagaggagcgcgtcccagacggccagcaggggccggcaggccaggggggcctacaacactcgaccgcccagccgcaatcctccagtgccaatcacaccagctgccacagaatcgccgcaggccgcatcaaatggtgcggtgtttgcgatgctgcaagggctcctggaatccggtgggctcttttaccttgcatgcctgatgatgttacgtccagatctcccaaaatggggttgattgtctcctcgccatcgccggcagcagtgcgctccccccccccgcatcccgcaggtactgcgcagaacgggcggggtaaggggggccnnnnnnnnnnctgcatgcctgatgctgtttcgtccagatctcccataatggggttgagtgtctccccgccatcgccggcaacagtacgcttccccccccccgcatcccgcaggtgctgcgcagaacgggcggggtaaggggggccctggcccctccataccccaggaaaaggagaaaaagcaggagtgggtggacctggactccaggaggcgcgcccgcctgaaccgtcggtcggagcggcgcgaggagaggctggccaacgtggcggtccgagaggtgagtcatgctttggatgtgtactgggtaacgggattgcccggctcggtcttaatcgcgctggcggtgcagaccctggggaggtcgctacggcggctagctgccttgcagagtcttgtcccaaccctcccctggcccccttgcccctctccacaccgcaggaaatatttgaggtcgggccggagggcatggcagtgggcgacctggcggccatgctggccatccccgcggttgacgtggtcaagtacctcttcctcaacggcgtgatggcggccatcaacgccaccctggaccccgacaccgtcaaggccgtgggcaaggtagggtgtgggtgtgattggctgttgttttccggtcgctcattgagcacgagcgtctgccggccaaagtcccctccccacctggcagtggaccccgttgctggcgcccccttgccaagttgctcgatctcacggccccgccccccgccccccgcaccctggagcctagcctcagggggttcacatttgaataccccaccccccctctcttccttcctcgcttgttcacaggagtacggggtggaggtgctggatcgagatgtcgccgacgtggcgtctggcgcggtcaagtcgctggacctgtccctggacgaggacgaggtggcggtgccgcgcccgccggtcgtggcggtgatggggcacgttgatcacggcaagacctcgctgctggaccacatccgcagcacgcgcgtggcggcgggggaggcgggcggcatcacgcagtccatcggcgcctacacctgcgccgtggactctggcggcgagcgccgcgccatcaccttcctggacacgccggggcacgaggctttcggggcgatgcgcgcgcgcggcgcgcgcgtgaccgacgtcgcggtgctggtggtcgccgccgacgacggcgtgcggccgcagacgcgggaggcggcggcgcacgcgcgcgcggcgggcgtgcccatagtcgtggccatcaacaaggtggacaagccgggggcggatgtgccgcgggtcatgcaggagctggcggcggaggacctggtgccggaggcctggggtggcaagacgcccgtggtggagatctcggccaagcgcgggacggggatcgacgggctcctggaggtggtgctcctggtggcggagctggaggagctggtggcctgcccggaccgccccgcgctgggcacggtgctggaggcgcgcatggaccggcgccagggcgcctgcgccaccctcctcgtccagactgggacgctgcgcctgggcgacatggtggccgcaggccaggcttacggaagggtgagggagtcgggcggggtggtcgatggggggatggcgtggggtttgtgcaggaggggagtgaaggccggtgggcgtggtgaccctgatcggggaacacaagggcgtgatctggggagcagcaaccggctggcttccgggccgtcgccccggcgcacccccacaccacaccgcacgcccaccctccacccaacctgtgacaggtgcggagcatgcagagcgcggggggnnnnnnnnnnagcgcacccgcacaacacaccgcacacccaccctccacccaacctgtaacaggtgcggagcatgcagagcgcggggggcgcggtggacagcgccggcccctccacggccgtggccatgctgggcctgtcggaggtgcccaccgccggcgacgagttcacggtgcacgccagcgaggcggcggcgcgcgccgccgcnnnnnnnnnncgcgactcgcggcgcctggaccgcctcgccgacctggcctccgggggctccatggtcacgctgtccagcctggccagcagcgactccggggacgaggaggggccgggggggcccggggatggcggcgccggcgccggccaggcgctgatgcacatgaacctggtgctgaaggccgacgccagtggcagcgtggaggcggtgcgtggcgcgctggcggcgctgccccagggcgcggtggtgctgcgctacctgctggctgcgccgggggaggtgagcgagtcggacgtggcgctggcctccgcctcgggcggcgtggtgctggccttccagacgcgggcgggggaggccgcggcgctggccgccaagcaggcgggcgtggagctgcgcgcctactccgtcatctacgacctcgtggacgacgtgcgcgccgcgatggagggccggctgaccagcgtgcaggagagcgtgcccctgggcgaggcggtggtcaaggccaccttcggcggaggagcgcgccgcgtcgcgggctgcgaggtcaccgagggcgcgctgcgcaagggtgccagcctgcgcgtctggcgcggcgcgacgttggtgcacgaaggcacgctgacttccctgcgccgcgtcaaggaggacgtggccagcgtggccgcggggacggagtgcggcgtgtcggtgccggacttccacggctgggaggcaggcgaccgtctggaggcctttaagctggtgcagaagaagcagaagctggagcaggcacaggcagccgtcgcctccttcggggattgagccggcgtggtgtcatcccggagccagccggcatcgccgcctttggggattgatccagcgcgactctggagtcgggggcgacccnnnnnnnnnncagggtgtcctcgcgcccaggagtgcgcctggcgcttcagcgcgtagagccactgcacacgagctcgccccaggaaccctttggcagcccggcgccttcccgtctgtgcgctgtgtgcccaggttcctcgccacccaaccccactgagcatgagcagtgctccgtctgctttccgctctcagagtggactaccactcacgtcccgagacaccattctttgcccccttttnnnnnnnnnnaagggtgtcctcgcgcccaggagcgcgcctggcgcttcagcgtgcagagccactgcacacgagctcgccccaggaaccctttgccagcccggcgccttctcgtctgtgcgctgtgtgcccagtttcctcgccacccaaccccaccgagcatgagcagtgctccgtctgctttccggtctcagagtggactaccactcctgtcccgagacaccattctttgcccccttttcatccgatgctcatcttgccgggatcatgccagcctggcatggcccatccccaatcacaaccgctgccatgtacacgctgcgatccagacgtcggcgggagtctacacacttccaatctgcacagtggaaggcaaccgagaacggcgctcagcgcgtggcggcatgcacgcgacgcatcatcgctgtgtcctccctggcccgccttcggcctgctgatccatgcttcccagggacagggcggcgatgacggcctggaggtcggagatggtctgnnnnnnnnnncggcgctcagcacgtggcggcatgcacgcgatgcatcatcgctgggccctccctggcccgccttcgacctgctgatctatgcttcccagggacagggcggagatgacggcctggaggtcggagatggtctggtccttgtccagcagcgcctcatagtggaggcgaaacaccttggcgttattttccagctccccttccagctcctgcacgcgggcctcgccctcccgtcgcagcttctcgcttgctgccaggttcccccgacaatcggtcaggagggtttccagggctcgcactcgattcagcagggactggagttggggttttcagggaatggtgggtttgtgtccaggtgcttgcaaatgcaaggtcctgagctgatgggccagaccgatattcatgaaccatttcagacaaactcctgctcatggtagcaatcactcagcacactctcaggaccccctgagccagccgaacaccccacctgcttggnnnnnnnnnngatgcaaggtcctgagctgatggaccagaccgatattcatgagccattttacacaaactcctgctcatggtagctatcactcagcacactctcaggacccactgagccagccgaacaccccacctgcttggcctggtgctgctggctggcgggaacggctcgttgccactccatggtgtcgaggtacagggcctcgtcgagggcagaggcaagcgagtctgcgcatgtgctggctgtgtccaagttgcgaagggccgcttgccacctctcgggcaggggctccacaggctcagcggtgagagcctgggaaggacggcgcagggatccggcgctggagagtggctccatgttcagccgcaggggctcagcagcgcctggttgaaacattgtgggtgcctcctgcgaccggcaaggtgcagcgcctggcggtctcggatcagagcatgctcaattccgtcctcccttgggaccggtcagatgccggggtgtaggatctggatttaatttcagcgacttctgtacgggtctgaggaaagggatccggcgatcgcnnnnnnnnnnccctggcggtctcggatcagagcatgctcagttccgttctcccttgggaccggtcagatgccatggggtaggatttggatttaatttcagcgacttcagtgcgggtctgaggaaagggatccggcgatcgcggaatcgcacatgatgacgcgccacggcgccaagacgagatcgcttccatgcatggtggggccatcgggaagaggacaagtcacgacccttcgagccgagccatgtcacgatcgaggatgtcaacgatgtgcatccggaagtcacgcttaatggccgtgacgtatctcgtatcaatctcggcaagtcgctcttttggacctgacgacgtgcatggagggcacccacagtagctgggagcagctgtcacagcactacaagccgcccttggtgcgcggcccatgcattgtcgccaagaggccccacagctgctcagagccatggttcgttgcctctcatcaactcccttgccatccccctcccccagataaagggcctgacacagggcccctgccaccccgccaccaaccgcaccctgctggccctccgcctgcgggactatgcggcggcggagcgccaggcctgcgccgcgctggacgcctccccgcacaccccgggcctctacgacctgcgctgcgccatccgcttgttccgcagggaccatgagggcgcgctggaagacgccaggagcgcgacctccctggaccccggcgcgggccgcgcctgggcctgcctcggcgcggcccagctcggcctgggtcacccgcgtgccgcgctttccgccttccagcacgcgctggcgctggagccgggcgaccgacttgccggcgaggggcgggcgctggcggagacggcgctgcaggcccaacccggccgccgcgaggccgtgctggagtagcgcacccactgtgagactctgctgcggaccccatgcgaggcttaccaccgatcgccatgcgaggcgctgcggcaaacgctgaggctgtgccctggcacgccccacaccgggagcgccaggcatggcccagccctcccccccccccagataaactctgatcagcgtcaggtgatatgtacaaggctgtcacgtcaagggtgcannnnnnnnnnccatggcccagccctcccccccaagatgaactctaatcagcgtcaggtgttatgtacaaggctgtcacgtcaagggtgcactgcactcaggcctgccgccaggtcatcaggcctctgacttggcgatggaagtggcgaggctcagccgccccacatgcgccaggagtgtcgtcctgaggaactccgccaccgccctgcacccgttgctagccagctcgaccacctcctcaaacacctccatgctgagtctgggagcggttgtggggagagaagattggtgcgccgggggttgcacatgcgcacatgacagtgggactgattgcacaacgtcgtccggcctggggctcttcaggaaagatagcggcgcgcctgatcgtcaccttcctgtcagtcgtgccaatccacccccctgtaccctacgcctgcctcatgacaatctgtaacctcctccagagtgctcacttgctgtcagtctgcagcatcagcacctggtccagcccagtctgcagggccactgccacctccgggccgccaccgccatcctcggtgtaattgaggtccaacagggcggtgccgtcaaggtaccccgccgcgcaggcggccacgctgtcccgcatggggacgccggcgtctgccagggcaaggaaggctgcgttgatggcggcgcaccgcatgcccccgtcggcttggaggacctttggaggatgaggggttggacattttggggggagggtttggtggactggatccagtcagaggtgggaggcgagaaccatccctccaaggtatcaagtggcagcttccagccaggcccatgcagtagaggagcacagtaggcacaagattgcatgcagccctcaccccccatgctaggccaacctgcacgtagatgtctatttgtgtccggggcaggagctctgtcaggatgttctgttccaacgtgttggctatggccagcgacgtctcggtggcccggcggtcagacttgccgtgcctgcgccgctcccctgcgagtgtgttactggtgtgatgagggctcaggatcccatagcccaccggagggcaagacccagttgatattcggagctaccgcctgtcctggtcctccgcgcaactcaagcaccgagagctcacctgaactgaaagcggccatggagtattcacaccgcacagtggccttggaggtgttcgtctgggccctgttgctagcctctcgaggaccgtatactgccgccagcacctatacggcggacgggtgcctcaggtgtaggggcatggtgtcttcttggagcgatcactacgagtgttcaatcccttttacacctgaaataccttggtgttccccatctcaaaagtcgcagacccgtccgctgatgccagggtgctcatctcggctcggagctgccgtatctcatttgggcgcctcccatcaagccgcagccccaccgtattcacgtactccatcgcagtctaaatcagtgatttaagattttgattttgacacataatgttattgcccacgaagcctctcctgctccttagcatagcgaaataccacagagggcagtgtcgtgctgtgcatgctgccgaggacatggctcggctgtgaaccaaagtcgcgcccaccgtggacttgaaggactggtggcacgacaaacnnnnnnnnnntatcagtgatttgggattttgattttgacaaataatgtaattgcccacgaagcccctcctgctccttagcacagcgaaataccactgtcgtgctgggcatgctgccgagtacatggctcggccgtgaaccatagtcgcgcccaccatggacttgaaggactggtggcacgacaaactacttgaacatgagttccctgctctgtgacgcaatttactgggaagatgttcccttagactggaccccatactctcgccggcttgatatgatagcccccacgcatttaggatatggatcttcactaaacacctactccagttctcttgtcagcaggagatctgccccactgcacaggtcaacgcagcagccttctgtgaaaccataagcccctctccattgacccaaacctgctgcctgcatggcaagtacacggttatgtcctttgcgattggggtaaacatttgcatagaatatgccggcagctactgtgaggctggcatggagcaaccataacaatctctttactatctcaaaccgttcagattgcctttgagaggagttgctcgcactatctcctacagagttctggttagggggaggtggtttctctacctcatggcatgccatctgtcgtctcttgacacgtcccttccccgcaatccctgggattcatgagctacgcatgtaacgggggtctaaagnnnnnnnnnnaacacgtcccttctctgcaattcctggtatttatgagctacgcatgtaacgggggtctaaagtgactaatcgaaatgatgaggactgcatcctgtcggggtttgcgcccaggaaggttataaatattgaggcgatattagcgttcggggagttccgactcccgagcaccgggagtcttccctcctgatgttctcgccagcgaatcgccccgcaaatagtgcaaagtaggtagaactcacgttcatgtgaacaggatgacttctgnnnnnnnnnnccagcgttcggggaattccgactcccgagcaccggcagtgttccctcctgatgttctcgccggcgaatcgcaccgcagatagtgcaaagtaggtagagctcacgttcatgtgaacaggatgacttctgcaccgagctgcgtgagaccgcagctcaggataagcccatcttacttactggtcagatccccgtggggctgggccacggagggctcgcggcacgcccccagaccacaccaacagcagtaagcgctcggtcgcacaatacaaataactgtcatcgcatgcgacgaacttgctgagatccgatgggcttcgcgatcagaagatcttgaaaagtacacgtaagctgacggaccgccacccgatctatgccgaggccgcggggctgcgtcggactgagaggcaggcctcgatgtagcacgagcattgagagctctcgatagccggaacgcggccgttatgtgtctctcttatgatatcagggccctccctgtgtctgcaccctgaccacacaccgctgcgcggtactggagcaaaccctcagctccagcccaaccctaggagcagattcagtccgcggggtctccgaaatatccactatccaccttacacccagccaagtcgcctgtcttaactcccatcaccgctctcaaaacatttttgcttacaacaaaccatttttcagtggtcgacgtaggattcagcggtctggcaaatagccggcaccatggcggagctcatccacaaggtgtcccaaaaccttgcccgcatatcggcagcggctccgaaacctcttggagaccaacaatatgcacgtacatctatgcaccatgaggattttgtcaagcatgcctccatggagaaagggtctctgtccggcaccgacgacgttatcgacgacggcgttccccgctctgggtgagcttggaaggctcccggcctcattcggtcgacacttgatggctttcagggccacattttcgtgtggaccatcccaccatcacctgcgcgcttgggctcgggaaagcccttgcggtgccggcggcctccgggactagtcggcaacacctcccaaccactttcctcccccaccttccccgcaggaacaccttcacggctgtgggacacaccatcacggccgtgattggggccggagttctgtccctgccctatgccatctccatgctggggtgggtggcaggtcccctctgcctgggcctgttcgcgagcatcaccctgtacacctcccagctactagcagactgcggcgtcatcaacggcctgcgccagcgcacctacaccaacgtggtagagaccacatttggccgctggggctacctcaccattggatggtgcgtttctcggccgtggctgctactgactttccgtgtcctgcaagcattgggagggtcacagcctcatgcagaccttacgctcaccagcccacacctctgtgcttccctcctctcagggtgcagcactccaacctggtgctcacggcgttggcctaccagatcaccggcggactctcgctgcagtgcgtggggttgaggcggggatgctgctgttttaggaatttaccttgtgcggtacctcatctcttcccgggagccacacctccgcccacgttgcagcccctgtatgaaaccaccccacagcctgctctatttgtttgtgggcattctcactaaattcctccatcaacccccccctcccccccccccatatatccctctaatctaggactgtagccaagtccatctgtgcggcccagggcgcgactgactgcttcgacacctactggaagtgggccatcatctttgcagccatccaggtcctcatggtccaaatgcccgacctgtcttacttctgtaagaagaggagggggggggggggggggggggggnnnnnnnnnnnnnnnnnnnnnnnnnnnnnnnnnnnnnnnnnnntgcagggcctggaggccacccaggattgaggaagctgatggccgaggattgtggtctaggagtgcactgaaccttgcacctgactgacaatgcagcaccctcacccaagccccccacaaagctcaaactcctcaatccctcacgccttgtagggtgggcatcactcattggcgccgccatgtctttctcctactccaccattgcgctcgcgctgagcatccgcgaaggtgcgctgggagtgtgtgggagcacccctccttcttggcttttccgaggatggtgtcgcggctggggcaggctcaggtcggacgttgatctgctgagccccaacatacttgccataccgcatggcacccgcctcgacgccagtgcgggtgccgccgcggccacgccagggctgtgcactcagccaggcacgcaaccccctccgcaggcaacacgcacggcactgtgnnnnnnnnnntgccagggctgtgcactcagccaggcacgcggatccctccgcaggcaacacgcacggcactgtgggcggccagagcctgacgccctcagaaaagggttttggcatcctgaactctgtgggtgccatcctctttgcctactccttcagcatgatcctgattgagatccaggtgcgtgcagcctcaggggacaggcaaacctggctctgcctgcaccgcgctgtggctgtccaatgtttgccggcgccagagtgggtaatgaattctggggccctcacccactgcccgagccgccgaccacctcgtaggacacgctgaaaggcgctggaaagggcggccccgtccgcgtcatgcagaaggctgtccagatttccgtggctgccatgacctccttctacatggtgagtgcgggccgggggagggcggggtgcatgctaacggatagagtgtagcgccatgggggcacaatgcggtcccaccatgnnnnnnnnnngccgcgctgtggctgtccaatgtctgccggcgccagagtggggcatgaattcccgggccctcacccactgcccgagccgccgacnnnnnnnnnngggggcggcgtgcgtgctgatagatagagtgtggtgccatgggggcacaatgcggtcccaccatggcttcgagctaccctcgtctggcgttgcccctgctgcgcaaacatgccgcgcgcttctcgaccctcccccctttcaaaattcctcacctggtacaggcagtctccgtcgctgggtacatggcctttggcaatgcggtgcccggaaacatcctgaatgctttcgaccagccccgctgggtgattgacatggcaaacatcatggtggtcatccacatgatccccgcctaccaggtctactcccagcccttcctggccttctccgagtaccactacaaccagtggcgctatgcgccatccttcttcaaggtgtgttgggccagcagatgtggctgggaaggcagggacagggatatgcgctgcctgttgccacaatcggcacctcatacctctccaagcccctaaacacgtccccatccttcctctcaatctcttccccctcccattgggaacacctcgattctcagggcattaccttccgcctggtctaccggacggcctatgtcatcctgatcggcttcctgggcatctgcnnnnnnnnnnttgggcatctcatacctctcaagcccccaaacacgtccccatccttcccctcaaactctttcccctctcattgggaacacctcgattctcagggcgttgccttccgcctggtctaccgcacggcctacgtcatcctgatcggcttcctgggcatctgccttcccttcttcggggacatcgtgggtctagtcggggcaatcggtgagcgactggaagacttggcagcttgcctaggagtttggcgagctgccctggaccacctctcccaaactctaaactccccctcccaacctgctccacaggcttctggcccgcgaccgtcttcttccccatcgagtgctggattcgcgtgtatcgccccaatgccaccaagcgcatgtggctgcgggtacgaagtttccaaggggctgcgcttgtctcgggggcaacagctgcggagggatgtggcatgtaatcgtgcgacaagcatggtgtgggtccccgggttaaaaaaggatcagtgttcggccatgcttgtatcgaagccttgaaggcaagaatgttccctcaaaacgatgacgctccccactccctgtactgaacgctaacactgccttcttccctgcgcagtgcctcaacgtcgggtgcttcattgtcaccttggctgccnnnnnnnnnnatgtgctgaacgctaacactcccttcttccctgcgcagtgcctcaatgtcgggtgcttcattgtcaccttggctgccacagtcggcagcgttcagctgattgtcgtcgactcccagagctacgaaatcttttccgactagccgcaaaactcaacccaagcctcagatcagtgatgagcacctctactacatcacggtgcgatgtaatttttacctacctacagtgttgctttcttgtgcagcaactcacgcccagcttcagcaagcaggcgccttgcatcctgcttaccaaacatcatccatagcttgtgttaatcaaagaagtatgagaagtgtagtgacaaatgaaacaccaggaaggatcccctgggcgctgtgaagctgatgtgtccggccnnnnnnnnnngaaagaagtatgagaagtgtagtgacaaatgcaacaccgggaggatccactgggcgctgtgaagctgatgtgtccggccggttgccggagttgccgggaagggtactaaccggtgcggtctgttgcaggaaggtttttcaatcatacactcgaagggatccacgacaggattacatgaaaaagcctcgaggtttatgtgggtccttatcgtgtagttcgtgatcactcgtcagagtaggagaggtgtccaagccctaggagggtcacagggtggtggggcaatgcccgccgacctcaggctccgggaaaacaagaaggccgacaacagcctgctcatctcagggttgcaattggatggcgtaggattggaaaagggctccatcaccggagcctacgagctggaagacgacggcgtattgcgtacagggcaagtgggggggtttaagggcgcaaccctctgactgcccactacctccaacatagagtgcctgactgcctgaaactcgttgaaaatctctcctgtagggaccttccgatgccatgcccgctgcaggaccaccttcacggccgtcgggcacaccatcacctctgtcattggggcaggcatcctgaacctgccctatgccgtctccatcctcggctgggtggccggccctgtgtgcctcctcatattctccttcatcacccagtacacctcccagctcctggcagactgcggggtcattcggggagttcgccagcgcacatacacagatgtggtggaggcaaccttcggtcgccgcgattatgtcatcatcgcctggtaggtcatgcgccggtgcgggcggtgcctcgggctccacacccctgcacaccnnnnnnnnnnctaagggtgcaaccctctgacggcccactacctccaacatagagtgcctgacggcctgaaactcgttgaaaatctctcctgtannnnnnnnnntgtggcccgccgcagcggcgtgcggcacctcgaacccctcctgcatttgctggcggctgccttcccacatgcccagnnnnnnnnnnagtggcccgccgcagcggcgtgtggcacctcgagcccctcctgcacttgctggcggctgccttccaacatgcccagcgccctgccctgcaccccgcagggtccagcactccaacctcatcctggtcaccctggcctttcagattacgggagccctctcgatgcagtgagggactggtggaagaggaaagtaggatcgcgcgtatctggcacagtgcaagccccaggatgcgagtctgctctccgctcctcagtatcatcacccccaccacaggaccgtcgcaacttcggtctgcaaaattcacgggatcaccaactgcctgtcatcctactgggtctgggcggtggtgtttgccggcctgcagctgctcctcatccagatgccagacctctcctacttctgtgagtccagcagcccagccgggatgggtttgggtgcttcggcaaggtgacctcaccaataggtcaggggtgtttcctcccctacccgatacccatgcgcaataggatcacatcgtccattggagacaggcatacgggagtacccgtggccactgccctatcagtgcgtcactgcacagaccttgcacacagccctagccgtctcactttcccacagggtgggcttccctcgtgggagccaccatgtccttctgctactccaccattgctctggggctgagcatagctcaaggtaatgaagacaggcgtccggcacgcctggctatctggtcagagggattgcgcctctcagggtaacccccctgcaacgtctttgtggctgctttacattactcgcaggaaacacannnnnnnnnnacccatcagtatgtcactgcactgaccttgcacacagccctggccgtctcaattttccacagggtgggcttcccttgtgggagccgccatgtccttctgctactccaccattgctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattgcgcctctcagggtaaatcccctgcaacgtatttgcggctgctttacattactcgcaggaaacgcatacgggacagttggggggcagccgctggagcctgcagcaaaggcctttggcgtactgaatgccctgggctccatcgtatttgcctactcgttcagcatgatcctgatcgagatccaggtgtgggggaactgatatgctaggatgtgcactctgactgcgcatggacccacaccctgctgccggtgggaaaggtggatctggaacaccacaggcagcctgcgtccccttctctgagcacaggacacaatccaggggacgcagaaggccggccccatccagagcatgcagattgccgtcaaaatctctgtggcatccatgaccttcttctacctggtgtgtgatgcttgttttgactggggtgtggggtcagatgggagagatggcgcggcaccaatcacacagatccacagcgctccatcccttcacgacaggctgcattgccttttcctgggatgtggagtgtccggcatgcggctgataatcgcacatgcctggctccagcgcacacagtgcctgctgttcctcaccctcccccaaggatacaatgcaacaggcggtggcaaccgctgggtacctggcctttgggaacgacgtaccagcctacctgctcaccggctttgagcaccctcgctggctcatcttgacagccgacatcatggtggtcgtccacatgctgcctgcctaccaggtgtggcttggcacagcctgggactgagcgggccctccccaggctctggcacccagcttaacggggcaggcggacccagttctccaccaccccatcacccactccactctccactccatcatctccacaacaggtctatgcgcagccattcgtggtgtttgtcgagtttcactatgcgcaatgggctcgggcgccgcgaatgctccgggtaggcaatcagggcccggtgaggggcgtgtgccaggcatgcgcatggtgcagtatccactccgccaccccgcgctgcggagcttgagctccagtcctcacacatgcagggcgtgaccttcagaatcctgttccgatcagcatttgttgtcctccttggagtcctgggcatgtgccttcccttctttggagacatcgtcgggctcgtaggcgccatcggtacgcagagaggccggaataatctgttcagcagcgtaaaatcatggtttgtagagctgagggtctcggaccaggtcaacaccctggctgacttgcctaattatccctcctcacctccttcggccccagggttttggccagcaactgtatactaccccatcgagtgctggatacgggtgtacaaaccctcagagagacgcaaattctggctgcgggtgggtggcggtgggtcctctccgggcagggaggtgggagcctgccctcacatggatatacctctcaccatgtcccagagaaaccctttccaccaccatcctttgtcacaggtgcttaatatcgcctgctttgttgtcaccctggcgnnnnnnnnnnctcccagagaaaccccttcccaccaccatcctttatcacaggtgctgaatatcgcctgctttgttgtcaccctggcggcaacggtgggcagcgtgcagctcattatagttgattctaatagctacaccgttttctccaatcaatagaggtcgctaaaccatgcaaccttggattgaaatgtttctcgacagcttcatatgcattaccatgctcccttgagtcatcaatactctgtgtaacaagggcttacatagaatactgcatgggtagaggttgcttcataagatcatctgctgggcgttgtggagcttgctcgtctgttctcaggtcctaggtggtaaaaagccgcacccgctctaacctgatcccatctcctccggacgaaatctagggtaaccggatcgcacacgagacgcgcaaaaaggagagggaaggcctttgggttcacagaagggactgaagggacagtaatgattcttagtatccctggagatgagctctgcggtcattcaccctgtctcaggaggctccagtgccgcgtgacgcccgaaagccgacgccgaccgaggggcgccacggttccagtccccgagtcccnnnnnnnnnngtccagtaccgggtgacgcccgaaagccgacgccgaccggggggcgccacggttccagtccccgagtccccgagttccagcaccgaccgggggccactgcgaagtctctacacccacgtcgtcttgggcggcaaacccgcatccgacagatataatcggactactccccccaaaatagcctcactgcgcagctcgcgtagatgtctcgcaccccagtaccaggtccaggnnnnnnnnnnttcccccccaaataacctcactgcgcagctcgcgcggatgtctcgcaccccagtaccaggtccaggggggaacccacttgggagtgcaggccgagtaccggcggactttcgagccgactccttcgagggcgatgatgcggctttcaaagaggggattgacgaaattgaggacacggatggcgtcgaacgaacagggtagctattgcgggcttataggcctgccggtggtcgcatgggggtggagggcttgagcaggcttcaggccacgcagcacaaacacactgacacccccgcgttcgtttcccaagatcaccacatgcattccgtgtggttaattgtgagggcctgcggccgagtaaggcgtacgtctcagcccagcatgccccacctctcgcaggggtgtggccacggctgtgggccacaccatcaccgccgtaattggggccggcatcctgaacctcccctacgccatttccatcctgggatggatagccggcctgttgatcctgctgggggctgccctggtgacactgttcacctccaacttgctggcggagtgcagcgtcatccgcggcgtccggcagaggacctacaccgatttggtgctgaccacctttgggaggagggggtacatcatcatgggatggtgaggcacggccgcccgcggtgggggagatgggttggaggcactggacccaggctgaggaggggctgccttggcacaaagttgcgtaaagggctgatcccggtgtacgtgagtgaccatcctcacgcccttgcagcccctgaattgccccttgtctaaacaaattatgtacctcatccatccatcccccaccatagggtccagcacatcaacnnnnnnnnnnacaccctcacgcccttgcagcccctgagttgccccatgtctaaacaaactttgtaccccatccatctatcccccaccatagggtccagcacatcaacctattcgtgactgccatcgcgtaccagatcaccggcaccctctccctgcagtgagtgctttggcatgtggggaaggatgtgatacttcccctgcatgctcaggaccaagcggcctgacattccccaggccccgcggcccttgcccaaggttcctaatatctcacacccaggatgcttgcccggtcaatctgcaagaccaacagctctgtcgactgcctggacacctattgggtgtggagcattgtatttgcgggagcacagctgttcgtggttcagatgccatccctgcaccacttctgtgagctggcatggaatcttcagggtgctctaaagggtgttgggcgtttggcgacaaatcatggacttccctgctgctggtgtctggcgatattgaccagggatggtctccactccacacctgcacggcccgcatttccggctccgcagggtgggcttctctggtgggcgcagcgatgtccttcgcatactccttcattgccctggggctgagcatcgcagaaggtgagtgggtggcaaagcacccttccccatggtcaggccttgtgggggcccgccagccaagtgaccatgctggcacgctgtgtgacagggtggcatgaacaagcatgcacctcatccagggcggggaggatgccagcaaggcgtgggaagtcccctcggtttgctggcagcagctgcacaggcctcctccaccagcctacccaggacagccctgacaacccctcgccgcaggcaacacctatggcacaatagcgggccagaaattgtctccttctgctaaggcctttggcgtgctgaattccctgggatcagtgctctttgcctactcattcagcatgatcctggtcgagatccaggtgagtggaaggccggcaggcggagtgctgcgtgtggagtgcaggaattatcacatgatcgaattcctgcggtgctaagcaacaacaggccgcaaggcaacccccagcttcacgtgcctgcacccaccgcgccccttttgtctcctccagcctaattcaaccccatacnnnnnnnnnntgggcctgcatccaccgcgctccttatgtctcctccagcctaattcaaccccatacaccccacccgtctttgaagaacacaatcaaatgtagaccaggggtgggcgtcatcaagcccatgcgcagcgcagtcaggacgtccgtgctcatcatgacctccttatacatggtgcggagggggcgcagctcctgggtggcgtccacgtctaccccatggtgctcgccagggcgactacccgagccacccagccccgcagatgcttggctgcgccttcttatgacgacttccccatcctccctctcgcgccaggcggtgtcggtggcggggtacatggcctttggcagcagcatccagcccgacatcctgacccggtttgcggggccgggttgggtcctcatctgggcaaacgcgatggtcatcatccacatggtccccgcctaccaggtgtacgcccagcccacattggcattcatagaggagcgccatgcgcggtgggctaaggcgcctgcatggtccagggtgagtggaggaggcgcagggggcagcgatctgggtgaggggggctggaaaagggggtcggaggggccaggtcggagcgggaaagtgtgatcaagcaggcctctaggagtggcgatcctcaacccccgcccctgcctatgcatgctgcgcagggttggaagctgcgcatccccctgcggtccttctatgttgtggccgtctgcatcatagccatctgcctgccgttcttcaatgatatcgtcggcttgataggggccttgggtgagtggtcgggtgttgatgttggcagctagctcttcataagacgggaaagccctaggacccttgacggagtgggtccaatgtcgatgtggacatccaggatttgcctgatgggagggtgcccatgcattggcaatgtctggggtggtgatagggcccctacctatgccaggcccgcttagcacgccgaatgaaaggctggcgtagcaaccacttcaccaccacccaaccaggcttctggcccaccaccgtcttcttccnnnnnnnnnnccctttgatagtttgccgggtctgaaggagtgtcgcaatgcttggcgagggcccaccatgcctggtgacaggtggccatgtgtggaccttgccggacccagcaagcccaatgcggaggggcctctggttccggctctgtccagatggcccatgnnnnnnnnnnccaaccactccaccatcacccaatcaggcttctggcccaccaccgtcttcttccctgtggagtgctggatccgggtgtacaaccccgataagcgaaagcgcttctggttgcgggtgcgaatgggcgatggggtcacatgctgtggtgggggacagtgccgagatgcatcctttgacagtttgctgggtgtgaaggaatgccgcaatgcttggcgggggcccatcatgcctggggacaggcggccatgcgtggactttgccggacccagcaagccccatgcggagtggcccctggttccggctctgtccagatggcccatgccagctttgctcctgtgcgtgactgagattccataccatccccccccgtgccttgccgcaggtcctcaacatcgcttgcggcatcctcacccttgcggcaatggtgggcagcatccagctcatcgtggtcgactcgagcggatacagcttcttcgactgattccatgaactcttgcatagaccttgcgatgggcacggctgctcaccactgccgcgccagccttgcatgtcccttgtcagcatacaacccaatgcatcgcctcaactgctagcacccgatcatgggcagtgcgannnnnnnnnncccatgaactcttgcacagaccttacgatgggcacggctgctcacccctgccgcgccagccttgcatatcccttgtcagcatacaacccaatgcaccgcctcgactgctagcacccgatcatgggcagtgcgagtgcttgagcatcgctgtgatatgattctgacgaacatggggggttgaggccactcggaccaatcacgggaaagcaggaacaattcaggggttcacctctccagacatccattccccttccatgacatgccattgcctccgtgtgttgcccaccagatccacgtagtccaccgcctccacctccaggaacaccaagtcaaatgtgtctggcggcacatcggagtccacggttgcctgcgagttgagtgccgagtacgaggtctgagatgtgacacaggcaaggctggagcacaggtggcatgatctttctcacacatttggccaggcattcatctgaccgtcaagttcgcgcctctctcacacccctgcacctgctcacctcactgtcctnnnnnnnnnnacttgcctgcgaattaggtgcggagtacgaggtctgagatgtgacacaggcaaggctggaacacaggtggcatgatctttctcacacgtttggccaggcatgcatctgaccatcaagctcgcgcctctctcgcacccctgcacctgctcacctcactgtcctctgtgaggtcttcctgtgtccgagcatgacccggagccagttggaagaactgttggcgcccagggggcgacatcttggcccaagccctgtctcgcgcctgcatcatggggcggttgtcgatacagtcgatcctcttccaccaaaatgcatcctttgtgctcccattatctcaccctccccggcatcctgccgtggcaacccccttacctgctgcagctctttctcctgcgttgatgcactcacgaccacggccgatccagaaaagcgaaactgctcccgcgtgaccgggaggtaccaggcagcttctgtccaggggttgctggcgagatcctggatcttgctgctcctgtggcagtcatggcggcagggagctcatgaacgagcaagagattctgtgggagggcggggagcaaggacaccactcatgtgcattcctcaaacccaaaccacacctgtggtctgtcacaaagctgagcttgctgcctggcaggaaaccccggaagacgacagtgcgattggagggccttcctgacggactgacagtggctatctggtaatatgtggaatgtctaagctccttattggcctcgagggcctgcagaacctggccttcccaaggagcaggggaagccatgccccgaacaccacgaatcccagataccgcgcggcagcgccgactcaacccccaagagcgggccgaagctgttgcagtgcgcatataatttaggagaataattcgctgagtgcaaatgatgccacatctgaatcgatatattggcgaaccagatttagatcttcgcgcccttcggtccacacacgtgaccaggaaatctgcgcagcctccgacatcctttaaaccactttggcgtgaaattctgggacattagtggtgttgagcttgagagtgagtgctgcgagaaacgttttccatgggcgtctcagtgaatgcatggacagctggaccagcaaatagcgcccgtaccgttccgttccgggcaggcccctgccgcgtctatcgttcccagcgaccacagcgagcatgtgtgactacctttcccgagatagagcggcgcttgaagcagcgagcgtgtgcgacagttagtaccgacgcggatgtggccagcacttccgagaagtcgctggatcagcttcccgacgacatccacctctacaaggacctgcgcgactccattgccaccctagacctgcacgaagatgatgtagatgcagcggataatctggagggggtctggcgattcctgcccggcccggtgcgcacctttgtgcgaggcctgagccccaggctacggggcctgctgctgtgcaatctcctggtgttggtcgtcgccacgaactgggtgagtgcacatgggtttgggcatgcatggtcgccacgtgtatgtccctcaatatgcgtggcagctgtaaatgtgtgagggaagggacgtttacttctgtcctcctgcatttccgcggtctcaaaaggagggatcagacatgcgcgggcagtccaccttgtcgtgcctccttctttcatccccctgtccccctgcaatcgtctcacaggtggtggtcaaggnnnnnnnnnnctggtcgccacgtgtatgtccatcaatatgcgtggcagctttaaatgtgtgagagaagggacgttaacttctgtcctcctgcatttctgcggtctcaaaaggagggatcagacatgcgcgggcagtcccccttgtcgtacctcctcctttcatccccctttccctctgcaatcgtctcacaggtggtggtcaaggacgtcggcgagagcttcgaccccttcacctttgccctgctccggttttcggtggctgcggcggccttttccccctttctgtccaccgcgctcaaggaccgcaccatcctacgcgccggctgcgagctgggcgtcttcatggcggcggggtacctggcccagagccagggtctggcctccaccgacgcgtcgcgcgcctccttcctctccacattcaccgtgctggtggtgcccttcctggcgggactgtctggcagcagggtgcgccccgtcacctgggcggccgccgcactttcgctggtgggcgtgggcctgctagagcagtcgggccgcccgccctctgtgggcgacatctggagcttcgtgtctgcggtcgcctttggcatccaggtggaaaaaggggggctgggggggtggggaggtgttgaagaggaggaaagggcaggggtgcgcatggacgtgagttgcagcgatggatggccgggaggggagtgttccgtaaactttaacagtatcagtgcagcactgcatgccgttnnnnnnnnnngggggggggttccgtaaacttcaacagtatcagtgcagcactgcatgccgtttgctgtgggtgtgtcgtggcatgccttggattactccctgtctgactgcacgtgcgccattttcaggacacacccctcccttcctccccacatccgccatcgccagattttccgcaccgagcactggtcccgtcgcctgggcgccgactccagcctccctctcatgtcggtcgtgctgaccacgactatggcggcgtcagcaggcgctgtcgccatcttgcaccctgagtacctctcctccctgctgcatcatccgctgctgaccagcctgcagtcctggggcagcatcacactgccctggcgggaggcgctgtacaccggcctgttcaccaccgacgcggtgctgctgatggaggtttttgcgctcaaggacgtgtcctccaccgacgccgccatcgtgtacacactggagcccgtgctgggcgccgccctggcgttcgctttcctgggcgagcgctggacgccgcgcggctgggtgggcgcggccctcatcgtgggctccagcgtcttctcccaggtcgccaacagcaagggcaaagaggagtgaggggaagggccattgcgacggcttcgacatcggggccgaaattttgtgtactgcgctgcccaccacccctgctggtcgtgtggcagtggggggagtgggatcaggccgcccgagtatgtatgtgagtgtgaagaagactgtaacactgaataagcacgcaaaggggtctgggaattcaggcatcggcatccatgcatcatgctgggaatcttttggtgacaaccccgcttcccgtcaactgcatgcacggtgaggctcgaatgtgtgccaggtcgatgtacccagtcgacaacatgagtccagccaacgtgtggtggactggtgactgcactgaataatccagcgagcatccttggtgccgccagtccgatctgggatctcggacgacctagggctggacacaccacactgctagagggggcaggaggacaggcacgtcccgctgatgatgtgcccacggcatgaactttctctctgcaccattcgaaccatgctctcctgcccgcgcctgtgcagcacggcgacctgtagggatcgggctgccgcctcgtcatgccggtggtcataggcatggtggtcctggtccgaagcctcctgggccgtgccttcggacgtaagccccgcacgccatacggtgaggaactggggtggtgtgcgtgtttggggttcaccttgtactgccccaggggagcataagtcctgcaggctcaggacggggcagtggacaggaaacagtggacaggaaatagtggacagagctggactgcttgccctccccctctgctcctcatgcctgacccagaccttgcctcacacgcaacctttctccacgctccgcacctttggcccctcacctacgcctggccgtctttgatccctccctcccttccccccccaaaaaaacaccaaggcaaccgcctgccgccccggattcatgaccgcctgtccctgtcccagacggtgggccgccgcgtcgtggtcatcggcgacgtgcacggctgcgcctctgagctggaccgcctgctggccgcgctggcccgccccgacgatctgctggtcgtcgtgggtgacctggtgaacaagggccccgcctcgccccaggtgctgcgcctggtgcaggagcgcggcgtgcgcagcgtgcgcggcaaccacgacgaccaggccctggccgcatggcgggcctgggacgcgggcctgcccatccccaagccggccaagcacggctgggtgcaggggctgcacgccgacctggcgtgcgagctggaggccttgcccttcaccctagacctgccggcctatggcgtcaccattgtgcacgccgggctcctcccgggcgcagatcttcgggaccagcccctgtcagacctcttcacggtgggtgccggggtgtgggagggggactggggaggggggctgggggcgggccaggcgggagggggacagtgaacaagggcgtgcttctgacccaggcaacggaagggcgagtgggtctgcggctggcaagatggcatgatggactcaacccacttgtatctgtttcccaagcgcagatgcgcgacgtcgtccccgcaagcaccaagggcgccgggtccccggccccaggaggcaaccctgcctgnnnnnnnnnnnnnnnnnnnnnnnnnnnnnnnnnnnnnnnnnnnnnnnnnnnnnnnnnnnnnnnnnnnnnnnnnnnnnnnnnaggccaatgcagtcggtgggaccggtcagccctgggcaaaggtgtgggctgggccccaccacgtcctcttcggccacgacgcggccaggtggggaggcagaagggtgggggtgggtgggggnnnnnnnnnngcccggcgggatgtggatgggcttgcagtcggagagcaatggcagcctgcatcaagcaaggatgccatgagacaggcatcaaagcaacaacatgccaggatacgatgctttgcgagttgttaaatccttttgctgttgaatatgatgcacaggcggctgcagctcgagccatatgcnnnnnnnnnncaccaacaacatgccaggatacaatgctttgcgagttgttaaatccttttgcttgtgaatgtgacgcacaggcggctgcagctcgagccatatgcgacggggctcgacaccggctgcgtgtatggtggtcagctgaccgcgtgcgtgctgccggccctggaccatgctgggaagccggtggaggactccagccctctaccagaaggcctcaccgggcagagcatccggctgcaagggggcaagggcatcgaggcgcaggtagtatccctgccctccgcaaagacgtactctgacaaattcctgaagctggagcaggctgcgcaagtgcccatggtgcatggcgaactgtaaactcggtgcacttcaccgacgttgttctggagcaaggtatgggtggcatccagagcatggcatggccggaggagggcgcgggaggttcacaaggtcccgatctgatgacaagtgcatgcaggcacacgtcattgcaccgctcaaacacttgggagggacattttcatcctcccgcattgcatcgagcttcggggcctgatcactcgagcagtggggaattcagagcccgtctcgaagagggcggggtcgagagctacaccaccttctgggccgtcctcacatgcaaaacagtcatacgttcctgtatctttcaagtggataacaattgtgcgaactgatctcttcttacaatcagatagagctccctgtgcttccgacccctggcggagagaggatcacttccttgagtagccatccagaccaccgtttctcgccgttcctgccccgtcatggaaaccatcgtaagctatgtagaccttgcgcggtcccggcagccatctcgcgattcctgcacgcctggatcacactcccagccatcctttgcactttccccctgcccagaacgctgagatcctgacgctcacatacggcagcatcnnnnnnnnnntggtcccggcagccatctcgcgatccctgcacgcctggatcacactcccagccaccctttgcactttccccctgcccagaatgccgagatcctgacgctcacatacggcagcatcgtgcggcagttgatctccgactatgaagacgtggatgaggtcaacaagcagctagaaaagatgtacgtggtgtccactcgctgccctgtgagatgtggagagtgagagcgtcccccgcgctcccaacgcacacgcacatacacaccccccttccgactcccagggggtacaacatcggcnnnnnnnnnntgctgcgctgtgagatgtggagagtgagagcgttccctgcgctcccaacgcacacacgcatacacacaccgcttccgactcccagggggtacaacatcggccaacgcctgatcgacgagtacctggctcgctccaagacaacctcctgctccgacttcaaggaggtcgcggaacgcatcgcccacgtcggcttcaggatgtttctgaacaccagcgccagagtggcggcttgggcccccgacggtcggtcctgcagcctgatcctggaggacaaccccctcacggactttgtggagctaccggagcagctgcgggggctgagctacagcaatatcctgtgcggtgtgattcgcggggccctggagatggtgcgaagtgtggggggagaggcacacgcggggtggtgacgtcgcttgtgaagcgttgctgggtctccttgaacccctctcccagcttcttgtccttgtccttgatgtgcccaagctccactcacttgatgagtctcagttggccttacaatgtaccgcggacaagcgcaggtgaacatcgatgcagagtgcagttttgtgagggactcgctgcggggcgacgacgcgaccgagctgcgcctgacgttcgtggctgcagcgccagaggcctacccctacaaggacgacgattagggcgacaggcagggcaggggcagaattctgtggcgtcaagccccgcctgccgagctgtcaagcaccctgtgcctgagctgtgcatgcgccccgccgcctgtcaccattcagcgcactgtgaaccattctttccgaagagtcgagcgctgggtccctagcgggaagctgctcagcaggcgcagccagaggcggcgcctgcacctcccgccttggcggcggaggagggtgcaaggttgatgtccaccaggtcctcctgcttggaacctcccaagctctccatccccggcagggcagcggcgatcttgcggaagagggcctgcgtggcgagggggtgggtggcctccaggctcagcgctggctcgcgcagggaggaccatggccctgtcgggggcacggcgcaggcatggcgcccgcgtgccgtggagagaaataccgcgcgcggttcaccttgatgttgaagccagctttggcgctggtctcgatgaacaggatgcccagctccttggccctggtgtcgccctcctcgatggatacttgcctggcgatgggaatacagagtggggggaaggtgacattggaggggtgtgccctgcggggcctgccgaatcgtgttgggtcgatgcgttggatcagtcgacctgccttcgaagccggcctgccgtatgtcacaccgaccatacgcccctgcccagctcagtgacgcaccgcttctcgaccagatccgtcttgttgccaaccgccacgatgatgacgtcgctgcccctctcccctcgaacctcctccacccatcgctggatattcacaaaggactggcggtctgtgattggggcagcacaagggtgagttgctggagggcgggactttggcttggagcaggtaaggacgcatgtgggcaagtcaagcgccccgcccgcagcctcacttgtgacgtcataaacccaccacggccaccgaagagtctcggatgtagctgggtatgaggctgcggaacctctcctggcctgcagtgtccctgcgggctcgaaaggaacatggcaaggctcacatcaggccggcaggctgagtctggggacggctnnnnnnnnnncctgctcgagtccccgacccgattgccaatctgcaaactcatgcgcatcctggacatgcacctcgcacannnnnnnnnnttcctggcctgcagtgtccctacgagctcgaaaggaacatggcgaggctcaaaccaggccggcaggctgagtctggggacggctgaagaagaacagcccacatcagcaacagccctctcccagccgccctaccagagctgcagcctgactgttcgatcttccaagtacattgtcttcgacaggaaatcgatgcctatcgtggcctgcgagggtagagccaggggatgggtgtcggctctgcttcccagggcaggnnnnnnnnnntcagggtacctgtgactactgatcgcagccaccttgcgcgcccaactttcgaagctcgcatccgagagcgcatcaannnnnnnnnnaggttcccctggagcgcatcttcaatcggtccctgtaccagaagtttgcttgggcaatggaggtggaacccgagtatgctttctgacgggagagcaacgagttggagctgctcgagtccccgacctgcttgccaatctgcaaatccatgcgcatcctggacatgcacctcgcacannnnnnnnnnagatcggcgcgcctgcccgcacccacgcacagctcacctggtaggtggtatcgaatttgtcatacatgaagcgggtgatgatactggtcttcccgacgctctggtcccctaggaagactagcttgtacttggccaacggcgtcaccatcgacgcggctgccattgctgctggaggatggtcgggcccgaatcacacgcggtatgagtgctgagcgatgcacccggtgtgaaacgccgggagagcctcgcacgcgccacagcagtcttaacagtcgagggacagcgagcaaggaggcagaacaaaaggtgctggggaagtcgcccaatggcgttgatacaatcagatgagcgcactgaggagagtgtccatcgttttgcagtgcccagtctgccccccatctcagtgcgattgatgcgctctcggatgcgagcttcgaaaattgggcgcgcaaggtggctgcgatcggtagtcacagggacccagctctaatcgccctgggattccaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctctgaaagggtgcggcactagcgctgctccccaagggttcaaggaggctgtcccatctggagcaaaaagcccgggcgcccctctcccctttcctcaccatgcgacagtgatccgagggtccaggtagttgatcttggacgtccccagtgcgacagtcttcaggtcctccttcacctgcaccggaaggagcggagcatcgtccctcagcgtcccaaacctcgcaccaaggcgagtatcatgaacagcagacctccagataccctacatgtgccttccatctgccagccttaccttgaagttgatctctgccttctcaatctgctgctgcttcttcgataccctgttctccagcctgcaagcagtggcggggagggggcaggggttggggcagccacgcagcaagcggtgcacaatacacatgcccgtcagcaccgactcctcccccaagccgtcacttnnnnnnnnnngccctgttctccagcctgcaagcaggggcggggagggggcaggggttggggcctccacgcagcaagcggcgcacgatacacatgcccgctagcaccgactcctccccaaagccgtcacttctgacttcagtggcgcaggccttggaccccccccggactcacgactctgcattcagcttcctcccgtccttgccaggcaggcccttcagggcgagcttcaggtcggcttgcagctcctgtgcagggtatgtgcgagggtggttgtggcgaggtagcgcaaaaatagaggccagggctgcatggcaccactcacgcgtcccatccttcaggaccgggattcacgacccgcctgccggcccctcttgcaccgccacgccaacgcaccgccagctcagcatgaagcgcctccatcttggcggtcagcttctccatctggcctacatgccctttgggaaccgcgcgctggtggttgcacagcaccgccacctccttgttggccgtgtcgtaagccgccttcttggcctccacgctctccgagtccacctccccggtcagcagccggtccagcacgatggaggcattgtaggtacggaagacctggaggtgcgtggggagcagagagtgcggcgggggagggtgtgtagaaggctttccgaggaccagccgctggaggatcaccagccaggggagagggcacgcgggcaggggcgacatgagggtgcagggcgctggtcgacaccctcctcccatcgactccagccatgcaggagaaggtgtgaggatgacttgggcacccaggcttgcacacagaaactggcttcccaccccgaatgccctcctgctggaggcacctcctctcccgcacacacaaaactccaacagggagatcaccttcaccgacaggccgtccatcagctccttcagcctcacattcaggtcttgcgcatcaaaacactcaaacagctggtctcccggcagcttggctgcagggtgtggacggatcaggttgtcagtccccgcttgactgtggtcatgacaggctctgcctcggcccgcacacgtggcaccctgtcggcaccgtgctcacctttcccgttggcgtcctcgcggctaaacaactgcaggttctggaagaccttggggtctacgtccaccgtgttctcgtaccggatggagtccttgcctggtacattggatggtggccgggtcaggcaggtcgggtctggcgccaggggaggcgttctcaggggaatgctgcaggaatcgcagcatcccacccacacccgcccatctggcttgcccatcacccacacccgcgcctcacccaggaagtcaaacttgatgtggttgggtgggaggcactccacattctccacctgtgatgatgtgaaggagccggggctggggcacaaagattcagctctcagcaacccccagtcagggtgctgacatgctttgtcgcgtgcagggcactctgccggcacctctccttgcccaggagcgcaagccaacccacagaccccacccaccgcccccccctgacaactgagcaacccaccttgagggtgcagcagcccaccgtnnnnnnnnnncccgcccccacctgacaaccgagcgacccaccttgagggtgcagcagcccaccgtnnnnnnnnnngtgtgaaggagccggggctggggcacaacaattctgctctcagcaacccccagtcatggtgctgacatgctttgtcgcgtgaagggcactctgccggcacctctccttgcccnnnnnnnnnngtcggcctcatcctcgtccttttcgtgcccagcacggagcgccagcttgtcgatgaagtagagggcggtggccatctgcttttggggagggtggtgggagtgagaggtcgagggctgcagccagggtgagcccatgcaggccccactctggcgccaggttcacaaggcgggcccgccgcaacacggccgttcctggagagaccccggcccctccagtccctcaacccctgcgctcggcnnnnnnnnnntcacccactcaaactcagagctgtcctcctggtcccccggaccccccaccccgatctccacctcctcacttgagcagnnnnnnnnnnctcgtacctgcgggcgggcgtgcatggtgtcggtgcttgggcatgcttactcggcacagtatactgctgtggggcagaacagcatcccagcgannnnnnnnnnagttgcgggtgtactcggcccggatgtcggcgatgctgtccttgagcttgcgcgccttttcatacctgcgggcgggcgtgcatggggtcggtgcttgggcatgcttactcagcacagtattctgctgtggggcagaacagcatcccagcgattggtgagtgccattgcttcgagtgctgagatgccgatgtgctttccacctccccacccacccaaactcagagctgacctcctggtgccccggaccccctaccccgatctccacctcctcacttgagcaggtcgctctccgacttccacgtgctggtggcggccaggaagacgtacttgtactccttggtgttcaccgggtccctccagtacgccagccacgtcaccgtctggtcgtgccggacctgccatggtacaggtgaatgatgctcagtatgaggttggcatgcaatgtttcaggcaggggcttgaaagccaagcgccccacagccccgacaggcatgagcaccaagggtcagaaggctgtgcccccgcaagcccaggccccttcgccgatgccctccgcttgcctacatgcttgacgatggcatcaaacccccacccacccacatcctccctcgtcctcggcgcacctccctccaggtctgccccgggaaggggtgcttgggcagcgggcagcccttgccgatgttgatggtgatgtcgcgggggtagatgcgcttcttgatcttgcccatcttggggtgctccccgcgcccgcggaacaggcccggcggctccacgcggaagttgcccacctgctcctgcttcccgtccacacgcgcaaacttgtagtcggcctcagcggcctcgcgctcctccttcagcctcagcttctcctgcggcgggcatgggtgaaagggggatactaggtggggagagcgacttgccgcgcactcagaaacagtcgtgactttgaactgctggcagcaggtgcggccagataccatgaccaacccgacgcggccggtgcacgattgatggacactactcatgattgtgctggagcacccacccacacccttccctctcctgccttgctcccccgccaacctcccaccnnnnnnnnnncgcacgattgatggacagtactcatgattgtgctggatcacccacccacaccctcccctcccctgccttgctcccccgccaacctcccaccctgaaacacccacctccttcgtgagggcgcgcttccgctcgcgctccgccatgtgccactcgtagatgggggtgaagtcgcacttcgtcaggcactggatggcatgcttgggccccaagacctcactgaacccctcccagaagtttttcttgaacgtctccttggtcatgtagtctgcagggggggggcggtgggtgagggaaggaggggggaatgagcacgcacacagcctgtctcccctgccaggacgccctgaggcctggattgggtgccaagcgcaggacaaactgcgttgggttgcccctcaagatgccctctctggcggtacagcatcgacacccatacccgtctccagcatgacggcgtaaaaggtggccacctcctcctgctccggcgtgaggtccacggggacgccgtctgtatgaaagagcgcaaactggaaaagtgggcaggtcatgccttgggatctcaggttaggccccaaaatggcacaagaagtcaaaaccctttccttgctatcatccatgcagcctttttcaaacccccactctgactcaccatacagcatcttgacaccatggggctgatactccggggggaagaggaccccactgtgctcgagtgtggtccaccggatctgtggaaggaaggaattggcaaagttgaccgccttcagagcatgctggagcgcannnnnnnnnncccttgggatctcaggttaggcccccaaacggcacaaggaatcaaacccctttcctaactatcatccatgcagcctttctaaaccccccaatccgactcaccatacagcatcttgacaccatggggctgatactcaggggggaagaggaccccactgtgctcgagcgtggtccaccggatctgtggaaaagaggaattggcaaacttgaccgccttcagagcatgctggagcgcagtggaacgccagcaccccccatgagaagcagaggtggcgaaaagttgcggcctgttgcacaagcagcaggaaagagtccctcttcaccctcgcacctcggctgcatccggggccgcctgttcagacctccgaggccgggtgctggcatcgctctcgcgtgccttcttcttgatggagccgccggtgccggtgctcttgcgtttggtgtctgttcgctggctggactgggagggcggcctggaggcctgggaggcgggtctggcagctggctgaggtctagcagctgcaatggatggagatgtggatgtgttggtgagttaggagagtagtggtctcccagcacgtacattcagcgaggaaacatgagaccttccaggccacgagagtcggtgtcccgagtgacatcctaccccctgagaactgcacactccccacccgcaacgaacctgcaaggctgagcttccgctgtgccaggggtaaatcttcatcagagtccgaggagtccgtcagcatcaactcgaactttggtttgggcctgctaaccactggtagttccaccgcgtcgccgaagatgtctgctttctgcgtgcctgccgcttctggcgcagtggcagtggccatcctggcctgctggtactcttaataccagaactatgccagatatggagccacggggcaacagggccgcaggtagtcgctcgaccgagtagtgcgccggggtgcccaaggaaagtatcgacgtgtgtgattccctgggtcgcgagaccccgatatgttggcttatatgcgaatctgatgttcaaatgctgatgttcagggtcaggtgtgcccttgtgcgtctggctggctggcttggggggtccgttgtctatgagctggtagttcgagatcgcatcaagttcactcgtggacggcctgcgctctgatgagcctatctgcatctcctccctgcgcccccccgcacacccggcccnnnnnnnnnnagcttggggggtccgttgtctatgagctagaagttcgagatcgcatcaatttcaccccgtggacggcctgcgctctgatgaacctatctgcatcacctccctgcgcccccccgcacacccggccctgctgccatctctgtgctagcttacagtcaaaggtgcacgttgcgagcggcagccatcgggcggcgctcacttctcctccacgggctccaccttggcgccggtggtgggcaggcccacaaacaccttgaaggcgtcgtagatgccccactgcagcccggtcagcgtgccgatcatgacgatacgcaggggcagcccgcgggtgaacaggttcatccagcccatctcggacacgatctcgcctgcggagtgttgggaagggggaggaggagggtgaggacccgcgacaagacattgctcgacccatgcttgtcatccacatagtgccagttccatggctgccgcaccgggcannnnnnnnnncgacacgatctcgcctgcgggatgttgggaagggggggaaggagggtgaggacccgcgacgagacgttgctcgacccatgcttgtcatccacatggtgccagttccatggctgccgcaccgggcactggcatcccaggaaggcaccctgctcgcagcatgccctgcactcaccgacagacacgcccttggtggagttcagcttggacaccaggttgtcggcggggtgggacaccacggcgcagagcacgcccgcgatgtagcctgcggcaaaggacacgcccagctgctcgcccttgctgcattcctcgcgcggcttgggcaccacgtacttgtacaggccctggaccacattctcgaaggccgcgaacttcatgatggtgtaggggatctgcctgccccagagggggaccacgcccttccacagcccgcccacgccgccctcggccacgaacttgggcaggccgtcgccgaagccgcgcgcccagccgggcacggtctgcaccttgaccttgacggcctcaaaggggcacagcgcgatgtcggcgatgaactcggccgaggcggagcccgccacgtagatcaggttctggtagcgcgccgcgtactcggggccggccaggtcggagtagtacttcttgaagaactcgtagaagccgaacttgcaggcgccctgcgcggagtagccgagggcggtgggaacccagcccttgaacaggccgcgggcgccctgctcggtgacgatggtgcggaagccctggaagatgcccgtgtacttggtgggggcggtctgcatgttgcacttcaccacgtccaggggggtgaccgcagtgtgcgtgaggccgcaggccaggatgccgcccacgccgcaggccaggtagtagtcctgcgcggggataggaatgggaaaaggaatgattatttgtcagtcccatgcaggggggcccgtcgggcgcccgggttctcctcggcgagggggccagcaggggttgggcgcgccagggcgtacccgggagtagagggcgatcttcttctccgtgggggcatgtgccacgaagccggacacgctgcgggcaagcagattgtcctggggggccgcagaccgctgcagggactgctccttctgaacggaggcagccatggccgcgttcagggccgtgggggtgtatagggtgttgggcaggaacatattggcactcctctacaggacgtgagcctgaagatcgagtcttggaaagagagatcctatagacacaggcttcgggttttgggtgcagagtggcactgccggcaaggatgcgcgcaactgtttagtcaaatgctgctaacgtcgatcgaccccggagcgcgctcttccataatcagcccctactcccagaattcactctgcattggcatcgcaaggtattcccaaactgcatccacgtttattttcaacgtttgttatgcgtctggtgtctttttaactttgttgccgatcaggtggtcacggagtgtgccacacttcttgaccagataacataatgaatgggttcctgacatggcttggaagcaacagtgatgaatctgaaacccatgtgagccttcacatgctcccaaaccggcgtgggttgtttattttgaactcctcggtgatgtcacatacctgagtgtgggtgctccagagccgtaaaacaagcacactgcaagatctcagcagaactnnnnnnnnnntgcgcgaagcgtacgccacatttgagccttcacatactcccaaacccggcgtgggttttctactttgaactcctcggtgatgtggagtgtcacacacctgagtgtgagtgctccagagccgtaagacaagcacactgcaagatctcagcagaactggctccaaaatcactgcattgtgcgttttcacgaagacagcttgccatcgttgccgctgggacgcccgctggcgctatgtggctacaactctgagatactcaacaagtctcagacttcctttgaatgaaattattgcgctgtatgtccagtcattgtattagtgggagagtggggcggggaatctacagcatcgagcaaatttcctgagacgagcaggggacacccctctgacaagaaagtcctgattctcatgaggcaaagaattctcaaaagacgccccttcgcttcatcctgattcccataaaagcgagattgtcggcataccatctccaaaggctcgctcaggagggctcacactcgtcgcttnnnnnnnnnnacctgattcccataaaggcgagatcgtcggcataccatctcaaaagtctcgctcaggagggctcacactcgtcgcttggccatcaggtggggatgcccaccgaggagtgcgatgtggaagggtgccatgcgagtacactccagtcacggaggtattgtgagtgacatattataaatcccttttgcacacagaccccgcatcgcgctgagctgggatgccggccgacagcaagggnnnnnnnnnngtccagtcacggagttattgtgaatgacatactttaaatccattttgcacacagaacccgcatcgcactgagctgggatgccggccgacagcaaggggcctgcaagctctggctcgtctgggagcaggtagcactgaggtgttgcaggaagggcggctttcaccctgatccatcccatacggggtctatggcccgacattccccgcatgtaccactgcaggagcggaacgagccggtcatccaggagtagtaggtcctccggctcctccttctccagccggtcgaggtcgagctctcgatcccgctcgccccctcccaggaagcagtccaggcctgacagcaaggaaagaaagcctgcatccttggacgttcccaaggtggaggacgattttgtgactgggcatgcctgcagggtcctgcacgcatcaccggcgtcatgatgcctcttgtgccgaccccagtggcccaccaccccctggcaccaggacgtggcgatcgacaccaatgcgcgactgcatgtggggcacctcacccgcaatgtgaccaccgcacacgtccgcgagatcttcggcacctttggcgagcttaaagaggtggaggtggccgtggaccgcgccgtcaacctgcccaggtagggcacacatgcgtcgacagacggcaggtgcttgccaccccaccagtgcccagtggacttgccgccctccggtgcttcttagatcaggtatcatctgccgggcagcgcagctcaatagctcccaatccccccctgcgccaggggctttgcgtatgtggagtacaagagccatgaggacgcggagaaggcccgggatcacatggacggcggccagctggacggcaacctcgtcaccgtgcagttcgtgttgcggccgccaccccgcgcgcgctcgccgccgccccgcgcg

SEQ ID NO: 18452 - DNA, 2229 bp, Chlorella protothecoides
gcaaccggcgcaagcctggtagcggcatattttcggctcgtgcgaagcatacgccgccttcaggctgatgaggctgactgctgagacgttgatgtttgtagacttgagacttgctgtacgcacggccccgactttggaaaagcctcgcttcctgggggccggttgaatggatgtcgagctaaaagacatacatatgcctgcaagctgtgggcagaggtgttgctgggccaacacccgcttctgtacccgaacatacctgcaaaaactgtcaccgctgtcacttgtcagcagaaatatcttccctccggatctatacattgcgaggagacgggtgttcttgtgtgagacttcccggcagcagtacccggccgcggtgagctgtgggctctagtgcgcacggtggcgctagcatctgtggttgtggagatgaatacctagaaacctcactgcaatcctctcttacctcgcagagggcagagcgaagaaggtggatttacaagccacctgcgaggcggggggtaagaggccttgcgcggacctttcatggagtttcgcagcatcgtcgaaccaacgcagacacaatcgtaccgtcgtctgcagcagtgtggcgaaacccaggaggaggagcagcgaaacacccaggttcggtcccgctctgcctgccatcctgagcggaatgctcttactccgtcaccaagtctcagctctctctggccaagacggaaagtgccgactcgcaccgtgcatcaaggtcgcccaggagcatcagcaagtgtttaccatttggcgtttggtggctatcagagctcagtggtgcccgtatggatatggagctgtaaaatcgtagcttcccaccggtaggggttgggcaggggacagactcccggagtccggacacctccgttccgaatctcagtcctgcactccttgtgtcgctctcccgggaacgcgtgcatccggtacaagaatagcgactcccacgtacccagtactatgtaataatttggaggccttttcagtctacagcagcccgcgcaggactcctggtcgaacccatctcactatagccctcatttcgaccccatcagacatcgtccttggagatataaggcacccgtaagtcctcaagcctattcctctgggctaagaaaacaataagaaggtatatgaacgactctccggccatcgtggatatgcgttgctctattctcggcggttgctgccgggctccgaggcggccttgcaggggcccttgggcccttcagaccccttgaaacagactaccccccccccccggacccctgaccttcggcccttcaacgcctcgcttccaaccacgcgttagctttccagcccctgctcccaaaatctcggctcccttggtcgacgagtcagtggatagtttgacttggcagactttgagaggtacaaaatcatcacgtcatagtatgaagctggcatatttgttataagctatctcaccacagaggtcccttttgcacggagttgtattgccagatccaatattccttcaatcctaagagcatcctcgcacacagcatggacttatggcgacaggtctaccaattcagtgtcaaggcactggagaggcctctggtcgagctctctgccaccacctgggcgtacgccacaaaaggcagttgacttgggtgcagggagctggtccacgtgtaatcggcggagtcgggagtttcgctgccactctctacgagaccaccgtttgcagagaagaatgcgtagtacagggtgtccgcagcagacactccagtcgacactgtaaatgtgaacctgggagtactgtaggtgatgctcccagtgatggttccaaagcttggcgggggcggggggggatccgaggatggtgatggaggattgagtagagttaacggtgcgacatcgttgaggtcttcgcggttgatgaaggccagtaccgagccaatgctgtagtataagaacacgtaatccatttccccgttattgttgatggtggtaaccatgcttgatgcagccactgcaccgtatgtcaacaacgtgaagttggcagagtagaggctgcacctgatgccgctggggatgtaacccacggcggtcacgacgaatgttacgtccacagatgagtcaacgatggtgaactcgactgtgcctgaaatgcttgagggagggggaggactggggggtggaggagggctggggggtggaggagggctg

SEQ ID NO: 18453 - DNA, 61 bp, Chlorella protothecoides
ctgtggttactggccctgtccgggctggacacccctgtgtgttggctacctattgcttcac

SEQ ID NO: 18454 - DNA, 61 bp, Chlorella protothecoides
aatctgcaccctcgcacctcctctttccccacctccttgcgatacatgacgagacacacca

SEQ ID NO: 18455 - DNA, 5442 bp, Chlorella protothecoides
cggtgcgccagcccctgccgctcaagcccgggacgggcgcggtgtgcattgacgcggcgcggcccccggccgccggcttccggctcgaggtcgggccggcgctgccctgcctggagctggcgctggagggcctgtcgcccacctgcctggccggccaggtggcgctcgccacgctgcgcctgcgcaacgccggcggcgtccccctggccggcctcaggctggcgggcggggcagggtggcacctcgccggcgccgtgcccgcgccgggaatcgacggccacgccctgagcctgggccagcgactgttggtgtcgtccgaggcgggcgactgggccgcgggcggtgtgacggagggtgcagagcccgtgcaggcgccggggccgccggcgctgaggggccagttcgcactcaaaaacctggcctggacgctggtccccgggacccccgcccggctctactccgcgcccgaggtccagctggcgccgggggaggagctgagcctgccctgcgtcatcaggtatcgaacgatggtgcatgcggggcgggccagggggctcgccaggccctgggtggggatgccagtctgggagctcctgagcctggctgggctgaagccgccgggaccgggggcctggggcgccgtggggagggcgcgccagggcatccagcgtcgtggagctgtgggccacccttgcggaagggcgaccggatcgaacttcccagctgaagaccgttccatgttgattccttgtcagacacccctccacctacaaaacaacaacaacaccctcaggctgacgcggcccggcccgcgcttgctgtgcatcgcggcgtcgtaccgtgtggccggcggcgccgtgcagggcgcggcgcagcgctcgacgcgctgcgcctttgagacggtggtccagccgtcgctgcagctgtcggccgccgtcgcggcggggacctgcgagccgggggccgcgctgctgcagctgggggtagtcaacctgcagggcctggaggcctttgagctgcaccggccgcgctgccccggctggacctccagcgacatgggcggggggttggagggcggggcgcacggcgacgccggggatagccccgccgccccgccgccacgagtggacgagcttgcggcggggggcgccgtcacgcggcacgcctggctgcgccggcgggatccggcgcggccgctgccggccgactgcgacgtggtgctgccctggttggccgcgaagcgggcgggggcgggcgcgagacgcgggctctccgccgtgccgcgccagttgtgagtggcgacggggaggggagggggaatggagaggatgggggggcgccgcacggcgcacacgagggctcagcgtcgttgcagcaccggctcacccgtgcatggcgcgacgctctcgtccaggtccactctaccgcctcgaaaccctgtcattcaaacatgcacacatgcccactaaccagagcgagtatccttttccacagggtcaggccgggcccgaggatccacgccctgctggccccggccgcgcccggccccgtgacccacccgggtttccaggagcagccgctgtgccgggtacccctcgtgctgcgcctttggaccacggccccagcgcacgtggtggtggagctgggcggggcggcggacgaggccgagggcgctggtcaagggggaagcgggacggcggcgccggccgccccgctcgcgcacgtgtgggcggggcggacgcggcgcgcgctgggtacgctgcgggcctgctccgagctggaactggagctggaagtcctggtgtccaggccggggaggcacgccctggccgacgtgagtctggcctggggccagcccggggcccggcagctggacggaagccggcccgtgccgggctgcctgatagaggtggttgaggcgggccctgggcctggccgacaggggttgcaatgaatgtaacgccaccttctgggacaggtccgtgggccccggacgcctccagatcaattgtcaagggtgtgagatgtgagtcctcgagccgtacatgaagcgatgcggtcgaccgggccccgatccccgtgccgcaaccccgcaagcctggcgatgtatttgtttcttaagccattgcgcgccgagggctgcattgtagcgtgcaatgaagcacgacaggtgccccggtcgtaaccggagctgctgcgcgcacagctgtgtacttctgttctggaaaggctgcgcgtccgcgacccggaccggctgacgcggcccctgggcatcgcctaatcgagatgaaaggcttaatctgacgcagaaaatgatctccggcacccttgaaacacgatctgggcctccacaaacattataatcattgcattttacgccatcgcgacgtctgctggccgctcgacatcgctctcgtccgtctcctagccacagtccacactctcgttgcagcgcaagctcacgatggccaccgtccatcagtccaagaacaggtccgatctggacagcaatgagctcctcttggagcgtctcgacaagatgaccaccatcatggcggcatcggcacagggtcactaccgccggacctaccaggcattgtgagtgtggcttccttgctccagtaccggggcatgctggcagacagtctcagctcgctgatacgcagttttgcatgccccgaccagtctgagtgtcggcctcgaacatggccagcctccagcatgtcggagcaattcttccccccttccttccacagtgacattgccagccccggccccttggccttcttcagttttgccatcgcgactggtgagtcgggggcacagtgaggaaggagcggggaaaagcagatcggggaggatgttgacttcagtctgtcagatttacgatgtctgaccctgaggcatattcaagcatgaagtggacccttccttgcagactgaagagtgccaggatatcaggccaagacgcgcagctcccccgccttcccctctcagccccagtccctcccgtctccactcgacaggcatgcagggtctggtatacaccgggactttggaggtgcagggctcccagctggtccttgttgtcgggtgagtatgacgcatgagctcgcccacctcacccactgcccattccagccgctcgtacttgtccagcctggagtccttcctgtggcgctttgcatgggccctcaccccacccctaccccaacccaccctcgccccaccccaaacccacccctaccaaatgactttccacatcgccggccagctctgacccccccatcccgcctccctcccaggctcttcatcggcgggttcctcatgttcatctgcggcttcatggagttcctgcgccgcaacacctctggcgccaccatgttcacgctcttcggcgcattctggttcaccctgaccatctacaacctgctcttgtttgccggcgtggccactttcatgctcactgccatgcccaagaccgtggcctgcctggctggcaccctgggcttcatcaccgccgtcatggccattgtcgtggccaacctgaccctggccgtcgccaccgcacagggcctcctggccctcttcctcatcctgctggcggcggcgcagatgaaccccgccaaccacaccctgctcaaggtggggggcgcctttggtatcatcaccgccatagccgccttttatgttgccatggccctgagctgcgaggaggtgctgggccaggagatcctgcccatgctctactccaagaagtttaagatgcacgccggcaacctgtacccccggatctccctgtccgaccccctggcgctgtcggcgggggtgccctacgaaggacgctacgagatccacaagggcgacaatgtggccgccatgcagcagccctccttggtggacctgaaccgcatccaggcggaccagagggtgtgagagcgctggagacgggcccctgggccctgccaaaaccccattttggacccatagttttgtcagcgccgggtggatggacacatcaccccaacattttgtcagaatccctatcaggacgggtggcgagaggcccccactcctcacctcccacacagcatgccaccgccctgtcccccaacccatgcattgcatcaaacccactttctaatgaactcatccggtcgtcgtagtgtgtaaccaaagtgcttttccaccaatggcagagaggcgccagctggtggagtaccccgcggagaggttgaggggcagcatgctgggccaccaccctggccgaccaagcatccctttgaaggcgttgaatcgacctcggcagtactttctgcgctgacccggggggagagggcgggggggggtgccacgccccggcggaataagagaaatgcgtctccggtcgagagtcgccaggggcgatcctgcccaaaccacaccggagcctccacgtgcagagcttccggccagctccgtacacgcccggatggccggggccgcgctcacagactcggcacttataatgcgccagccctgcctcctcaaccacagactttcctcaagaattctctgcggaggatatattttcaggatcattctttggtcgagtacaggtgccgggtcctcatgggctcccgcgcatgtttcgtgggaggacttgtcctgctcctcgcagccctactcggcgcacaggtgggagtggaaaaaagtggggagagggcaacccaggaagtttgtacacattgtccactgcgacaatgcaattattctcactcatgaaccgatcgtgtcctcccttcatcgcagacggcatacggcgcggactcatcttctgtgctccagaaaccatcagaccacgctgaaggccacgtgcagagtccgagctcgagctcccaccacgggcatgacaccgtggtctcttcgcagacagcttcatctcctggcgtaaagggagcggataaagctccctcccaggagaaaaaacctgcccaactgaggaagctgtcgccgggccccctcaggcagagcccttccagtggtcagaagaaggagagcagccctctgacggcctccaaaacgaagagccgggcctcccactccaagaagaaccctgcccccgcactcaaggatgacgggccgccatcagacgtgacggtcagcgtgaccatggcagcctgccaggcggtggggaaggagtattactgcacgggccacgtcaccctgtcggagagcctcacccagggtaccgtcgggctggtgtgggacgtggacgggaagaccatggaaggcaccaccatcccggcgtcggggagcacggcctcgcacaccgacggccccttccccagcgcggcgagcggggtggtggcatcctacgccggccccggcaacgaggacgtggagttctccaacatggcccccgtgccgttccacgttccccctcccccctccccccctccc

SEQ ID NO: 18456 - DNA, 2795 bp, Chlorella protothecoides
  modified_base (2219)..(2329): a, c, t, g, unknown or other
cgggcgcggcgcggaggcgggggtggggcctggctccgctgcgggcgccggggctggggcctgggggctggtctcccgcggcgtcgagctgtccgtgggcctcgccacccacctgccggtggtgagcaccagtgggccactgcccccgctgcgcgcggtggaggccgcggggccgggggaggtggggcccgggtcggcgggcgcgggctgctgggcgggccccggccctcgcaccaggtagcgctgggcgatgggtcccctggccctcttgggtggggggggtgccggcctggggtccacctgctgcacctctgcctgcggcgcgggtgctgggccgtggcgcggtctcaggagcggcacgtccttggtctgccgccggcgcgtggcttcgccccccagggctgcacacaggcattgggatgggaggagcagggggcggggttcagagccatgtgcacagcctgatggcgggacgcttgggcccctcttgctggttggcgcccccgcccccctctccacacacacatacactagacgcaccctccgcggcaatggccatctgcagagcacgggtggtcgccttgccatggagggcctcggcgaccctctgcacgtcgctgcggcccacagcccgcccctcgccctggtcggggtgtgtgctggcgcccaccatggcagcagcggggccgtggtctcctgcagggggtggcccgtcggcgccgccgggacggggtgcgggcacggcgacccgggcgccagggctctgctgccgcccggtggaggtggggggggtctgggagccgtgcccagaggcaggcccaggctgctgctcctcagctggggcagcctccacctccatgggtgcaggtgcagcctcctccaccactggcctggaggggccagccccctcctcctcctcctccatgggcctgggagctgcagccctgcccccctccatggtggcgccagcctcccccccctccctggtggcgccagcctcctcctccacagctaggccaggcaccaggggcagcctggccccctgcacagagccatccccctgctggcaggcaggcccctgcacagagctggggccctgatccaggtagctcagacccagggacttcaggtcccgccgacccttggtgctggccatgaccacaggggggtcgttcttccctgcaccatgggtgggagcaggggtgctcagcagggctggccagcaggtggggggcgcctgtgcatacaccaggccagagggtgggagctgccctccccccccctacccctacccacacacacacacacacacacacatgccccacaccccaccagactcactcccttttgggcgacctcggttcttggggggtggagcctgcatgccaagcccagcctctccctctggtgcctggggtgcatgggtggccaccagcctggctctcatatctgccacagttctcatagctggcagatctggcagctcccccaccaggaaaagctgcatggacctgaggaaggcctcccgtggcccaaggacatcccgcagctgcaggagggggggtggggcagggtaatgggcctgggctcagcccctctggtgtgatggctcaccagcaagcaggccatgcatgccagccatgcctgtggggaagggggtgcacactttgagccccatcctgccagcccacccgttgggtagcccgctcagctcgctgctggtggccctcacccacagcctccacaatggccatatcccattcgaccctgagcagcaggaagaggggagagggggatgcagggatgaaggttgggaaagggggggttgggtgtgaggctgggagggagggggggtggaccctgcaccctagtcctaagcccagcatgcctacacctgagggggggcagctggcccaacatgtccatgggatctggccccgacccatccccagggccccacctcccctcccaccccccctggcccacctacctgagctcaggggggtcagccactgccgccatcaggcgcaccacgtacgtcccctccggtccgggggcacagaacacagggatgtgagcgattttcctccgattccagggcagtatgcaggctggctgctccctccggagcaaagtcccctcgtctcgtttctgcaggctccatgcgtgaaagatccccatgagactgcgggatgcggggttgtaaagggggggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccggatcccagaagtgtcccctcacacgggcccgcggcggaccttagggctcgtctgtcatttctcacagatcccgtgatcttctcgcagaaggtattgatggccgctctggactcgggggggtaggtggccgggtcgcaccgcgtctcggccggctcggggacccggaagctcggtgggggcatggtcgccatggttcaggaagctaccatgcccacaaattcagggtggggccatgaaagggatatccctgccgaaaccgttgggaatcaagggccctcagcctgggctagcggtctcgtccgagggaatccgggggggagaagaaagtggagatgacgtgtacactgatgcgcccttcccagaccgagccagtgtcgcgcgaacgagttcattgagctgtttgttagccattattaacttgaaaagatacaacatatctttttcgaagcgagagaggcggcc

SEQ ID NO: 18457 - DNA, 362 bp, Chlorella protothecoides; identical to SEQ ID NO: 60

SEQ ID NO: 18458 - DNA, 263 bp, Chlorella protothecoides
aaaacctctttttgaaatggctgaattagagcctaattttaattatatttgtgattattatcttaatatagcagatcaattattatcacaacccgaaggtgttgttgctaatcaattggctgatcgtgaactttttacgctattatcagatttttatttaaatattaaaaaaacgccaagtaatcctgtttctcctgaattagactttttaatgatttaaataaatcctaaaattgataaaattatcaaaaaataatacttta

SEQ ID NO: 18459 - DNA, 67 bp, Chlorella protothecoides
gtcgaacttgactagtgtgaaaggagactgcaggtcactgaacacaaggtccaactctctgatggaa

SEQ ID NO: 18460 - DNA, 4635 bp, Chlorella protothecoides
gcgccggggagcacgcctcgtgcgccagcgccaggcgcatgcccagcgccagcgggcagcctggcgcgtgcacgacggcgcgtgccaccgcgccgcactcggcgcgtagcacctgcgccagcagctccagcgccgcagcgcggtgcaggcccagcgtgcgaagcgcggccgtgcgcgagaaggtggtctcgcgcggcgccgaggccaggcccagcacgcggcgcagcgtgggcagcgcgcgaagcgcggccgcggtgaagggccgcaggtcggccagctccgtgtcggccagcatgggcagctgcggggaaggtgattgggggggagggggagagatttgagaggggcggggttaggaagggagggaggtgctgggggaggtgcgcgaggtctctccaggggggaagcggcaaaggacggcgagagaggccgcggggtgcaggggcggcggagcgaccgtgtgacgcatgcgcggcgcgtcgcggaaacgcccccgcgcgcccctccccaccacgctttcgccaccactggcaccctgcccaccatgcaggagtccatctcgccgcggacttggtccgctatggcggcgagcggcgtcgccaggtcggcggtcgtccgggtgggggactccagtgcctggttgacctgtcagcacagggagggaggggcgggggacacagggtgtgggatcctggcagctccctggatgcaaacgctgctgcggagtgcccagaccaaggctgcatggatcggccagggttcccctccacaccaggggaccccctacgaggttcaacacgccccggccgccgcgccagccgcacctgctcccacagctccgcggacagctgctccggatcgacctgctcggtggggctctccagggcctggccctcgtcctggtcgtcctcgtcgacctgctggaaagcggggagggactgggtgtgcaccagaggaagcatggtgctgcaccagggcgtgggatctacccacacaaccagggagctcggggcacccatcaggcacacgagagatgtgcagcaaggccggatgagttgctgcttggatgtcatccaaccctcccctcgcgcttgacctccacagggtcccgcccgacggcacccagagcagcactccgcccctgcccagcacacaggcccacgcctgtgcacctggaagaagcggcggacgtaggggttgtcgcgcagtgagccggacagggatgcacccccctccttgccagcctcctccttgccggcctcggcgggcggggctgcaacgggggccggaaggggacccagctccacgttcaggattttccgctccttcagggtcgcccgctgcaggcaggggagggggacatggggtgcctcggcatcggcggcctcgcagcgggatcagcgagcctgggcaccgcagaaccggggagtcacacctgggttttgtcagatgcttcctgaacaacacctccaccacccgacagcgcaccactgaggcctctgccgcgggcgagagcgggttgtccctgaggtccaggtctatgagattgggtgcggcgccctgggcgagggccctcgccagcgactccgcgcctgcatggcagcaagggtttggggtttcgggccgggcagggcagagggggcgaacgagctaggtctgccgcccgacaggggctcattgggatgggagcgaggtccaccccttccagcagcatgctgtgagcgggtctgagcacatcaccatctgcagcacagccgccgccagcctcactcactctcgtcgtccaggcagtttccagccaggttcagggacagtatctcagtgtttgcagcaaggtgggcgcacagctgcacacaagattggcgatgtgggtgagcgacggggggcagggtagtgggagctctcacgctggcccaccccacgtgaccactaactttgtgtgaacactttgagagtctattctaggtttacgccaattgatttcccactccaaaccacctcaccttcttcaccgtctttgaatctacggctgcagagctcagatcgacccagatgctgccagagctgttggcacgcacgtctgccagagcgttgctcactcgctcctgctgctgcttccggacctcggcatccaccctactggcctcgctggaggcctcgccgttggccttcttcttctttttctgcatgggccagaggggcagggcggggccatgagccttgctcaggtggatgccagacaccaagacgaccagggagcagcctaacctccactcccctccagttccaacctccggcaccccacccaggctcacctttcgtttctttttaccagttccagtgggctgcgatgcatcggtatcgtcatccgtcaagccctccccagatgcgcagctcgcggtctcagcgtcctcctcctcctcctccagctctctggccgtttcatcggcatctgccgtcccggcctcctcctcatccaccttgggaagatgtgcggccggcatgcaatgcgcccgggagctccaaatcgtaggtgacttgaactcgaaccgaacagggttggcaccggcgcccgacaccgacgagcgaggccctgatcagggagaccactgattgccgatggcaagatggagagttgcaggtttcaagctcaccatggacacgactggggatgcagaggcatgcacatcgcgcgcttgtctggcatttgctgcgcatgcggtgttcggagtcgcgcatcaacgatggcaagccggtcgctatcacaaggcaacactgttgcgcctgcgcctgcatcatcgcactctacatacggaagactccgaactgcgatgaccggggtccccggttctgggccgctgccaagctcagaccaaacaccatgcgagtgtccgcagggtcgatgacgccatcgtcccagagcctggccgaggagaacgacggctctccctccgcgtcatacctgggtgtggaatgcgaccaggatgttgatgagggtgcactcgccggcgtggtgactgcactttgacttggcagcagcagcacatccagtggccaacactttgcatcaccactgggcagaactctgtgtcgaggatgagaacccaccctggcctccttcccacctgtccttgatcgccttcttgaaggcctcctgctcctcggcgggccaggaccgcccctcccgctcccgcttctcgctttccaggaggtgcagcacggcggctgcctgctcaccccccatcacggagatgctgtggtgtgttgccagggagtggggtcaggggatgccagggatggtcggggctacactggacccagccttccatattttccagaaggagaatgtcatgcaagggtgggcagatgcccttggctgtccgtttcctgaccctttacacaagctagtacggtgccggcaactcaccgagcgttgggccacatgtagaggaagtctggggagtaggcccgtccgcacatgccgtagttccccgccccaaagctgccgcccatgagcagcgtgatcttgggcacggcggcgttggccaccgccatgaccatcttggcgccgtcctttgcaatacccccagcctcatattttttgcccaccatgaagccgttgatgttctgtgggagaggatgggaaaggtttgggggggagggtgatgcaactgggcggtaaggtcgaggtgcctgggcgtgggggtggtggagtgcgacgggccggcacccaaacagcacctggaggaagatcaagggaatgccgcgctgactgcacagctgcacaaagtgcgcccccttgagcgccgactccgagaagaggatgcctgggcgaggggagggaatggtgttttggcgaggggagcccatgcatcgcgcgtgcctggtgaaggcttgactctggtgtgacgagcccttgccactgctgaacggaaaaacagcggcgaccagaatgccatttgcattggtacaggcagtggaggatttgccccagctcattccttccccaacactgcgcgccgcctcctttaaatgcctcctcaccgttgttggcgacgatgccgacgggctggccatacagggagccaaacccagtgaccagtgtggtcccatactgcgccttgaactcgtggaaacggctgccgtcaagcacgcgagccaacaccgccctcacatcccacggctggcgagcgtcggtgggcaccacacctgcgagtgttgtggtgtgggagtgccaggtggtggcggcggggctgggggacttggacaggccggacgccgcaggggcagcctctcctcaagcggttgcgggctcgccagtggggtgcacagggatgcatgcagcgggcaatcgcctgccagagcatggcccggcaatactcaggcctcacagcctctccaggccggcctcacgccgccagcaaacccgcctcgctcaccaccacaccgcgccccacctcggagctcggcggcggggaagcggggctcttcccacgaaccctcggcccagggaagcggcacggcggccctggtccccgggccaaggttcctcactatgttgcgtgccaggctgagggcatgctgctcgttctcggccatgtggtccgtcaggcctgtgggaaggggggggggggg

SEQ ID NO: 18461 - DNA, 78 bp, Chlorella protothecoides
cctgtgtcagagccgatgacatggttgttacgctactgtgtcttccttggaatcatcgtggcgtcccggcgagcacaa

SEQ ID NO: 18462 - DNA, 4694 bp, Chlorella protothecoides
gggggggggtataaacgagcggatacctcgcctgtcatgttccatcccgttcccacctgtggaacctcggcatggggcgtctaacagctcagtctggcacatggtgcccatccacgctttacactgctccaccccctctcaagctacccctccatactcctccctgaacccgagaatactccggtgctcctcctccacaggcggccaccatgatgcgcgagtctttgtacaccgccggctacctcggggtggccccattgctgaaggccaagctgacggggcactctgcgtttgaggggacccccggtgcggcgctcgtcgtgtccggcgtatcggccggcatcctcgccacgctcaccagccaccctgcagacaccatcaagacgcggatgcaggtggggtgcctggggagggcacagggagggtggcattacaaggactggaaggaggtttgggttgaagacagaggctgatgagcagcgattgcatagagatgggctgtgggttctcttcctacagtcggtggtatggagagaccggctcggcagcgcagaggagggcagtcgcccatcactgcatcctacctcggatcgggtgcctggcttgtggcacgcccagttgtgtgctgcaatgagacacccggccaccagccgaccagggactcctccccgcggtcacgccacccactctcctgagagcccgcccccctgcattcaatcccgccgcaggcccacccagacaacacggcattccctcattattccagcgtggcctccacggcccgccacatcgtggccgccgagggctacggcggcttcttcgcgggcgtgctccccaggaccttcaggctgatcggggcggtgttcatcctgacaggcatccgcgggacgctggtggacgcgatcgaggacgcgcgctatgcggggtccaaggcggcctcacaataaatcgggcgccaggggctgacctcgtaccccttatcaagcccgccatctcattctttttgccccctcagagctcgtgtgccttgcatggcctgtcccccggattccctgctgccttctcttgcagtttgcaaaggccaaatgcctcttgacagttcccgctttccaagccgagaagggccccacggtcaggcagcttccggccaatgccccccgtcccgcgaatcagcgcaagggaggtcgatgggcgcacatcagattgtgcaggccggcccgcgaaccgtaatgacacacacgcccgcattccagcacatctgaggctttcatctgtatttggaagggccgggacggcagtcgccaaggatggcgaccgagaccacaccccagaacgcctgggtggagagttatctcaatgcccgtgagtgggagggtgcgggggatgcctgcgcaatgcacctcccctgtagaatccatcgtcattcacaaggacctgagtgcgcatgcatcgctccccgcagtcctcacgtacggcctgtcctccgagtacgccggggagaccaagaccgcgcagtccaagaaggcccccgagtcggataggtcgacatacaacaggtacatcgcgatggtgcagatgcccgattgcaggccgcaatggctgccggttgggtagggtttccgcccatgcatgcatgcatgggcatgataccctataggtgggggaagcgactggcacgcatctctcaccacccctctcccacgatgtgcagattctacgtgcagagcctgctgaacctgaatgaggaagccctcagcgccgcatggctgaaggtgcatggcaagggggtgggcggctggggtgttggctgctgtgggctgacgtgtggaaagggcgacaaccgggcctgaggccctcctccctgcaagaccctggcacgggcaggcttaggagaggagcaatggtctacaccgctctgactgcgcatgatgcactcccctctgatcgtttccatactcttccacccccctccaaaccctaggccgcatctgtgaccaagcacggcaacgacaaggacgcccgcctgcagtacctctcctggcgcatctggttcatgaagaaaaagcacgccaccgtggtgcgctcccggccgcaggaggtggtggaggaggactccggcatccactcccccgaggagctgagcgaggacgaggggtccgccgcgggcgcgggcgcggcgggcgcgcccggcggcgagccgcgcgcagggcgccccgcgcgccgctccgcctcctcggccaagctgtccagcgcggtgccctccccctcccccgagccgcggccgctgcccagccagacgggatggcaggccgagggcggcagcggcgccgacctcaaggtcaaggtgggccgccgccccggcgtgcactttgacaccgcgttcgaggagttccacgccgcgccttcgccactgcagtcgagcaccccgcccttcggccccgactccggcggcgtgtacgacaagctgtacatcatcctcatctccctgcacggcctggtccgcggcgagcacatggagctgggccgcgactccgacaccggcggccaagtcaagtacgtggtagagctgaccaaggccatggcccttcaccccgccgtgcaccgcgtggagctgctgacgcggcaaatcaccgacccgggcgtggacgcgtcgtacggcgtggaggaggagtgcctggcgcgaggcgcgggggacacgggcggcgccttcatcgtgcgcctgccctgcggcccgcccgacgagtacgtgcgcaaggagctgctctggccccacgtgcgcgagtttgcggaccgcggcatcgcgcacgccgggcgccagctggcgcgcatggccgagggcgggcgccgctgcgagctgtatgcggtgcacgggcactacgccgacgcaggggaggtggcagtgctcatggccagcagcctggacgcgcacatggtcatgacggggcactccctggggcgcaacaagctggagcacctgctgaagggcggcgccatgacgcggcgcgagatcgaggaggcctacgccatcggacggcgcatcgaggcggaggagcgcgcgctcgacaccgcgctcatggtcttcacctccacgcagcaggagatcgacgagcagtgggggctgtacgacggctactccccgggtctggcccgcgtgctgcacttccgccgctcctacggccgccacatgcccctgctcaaggtctcgccgccggggctggacttcagcaacctcaaggtcaccatccccgccgaccccgtggtcaaagagttcgaggccgcgcgcgccgccttcgccgagcgcgagctcgcgcccgccgcgccggcggcccagacccaggctagcggtgacgccgttgcggggggggggacgcccccgccgtccccggcggcgcagaccccacgcgtgccagacacgctggacccgcgcgtggcgctcatccccgagggcccgcgcatctggcaggacatcgcgcgcttcctgcgcaacccactgaagcccgccatcctggccatgtcgcgccccgatcccaagaagaacctggtcacgctagtgcgcgcctttggcgagtcgcccatgctgcgcgagctcagcaacctggtgctcatcatgggcaatcgcgacgacatcgagtccatgtccacggggacgcagaaggtcctggttcaggtgctcaagctcatcgacaagtacgacctccacggcaggtgcgccaagtctgaggggtcggggggtctgaaggggtccgaggggacgccctggcctgcatcagggtgtgcggtgtcgcgggccgaaccgcctgcaccgctcccatgttcccttgccagtccatgtcatcccctcaaagggtctcgagccctctcacctcctcccaacaccaatcccccccttttcgcagcgtggcgtacccaaagcatcacacccaggccgacatctccgacatctacaaatttgccacctccacgcgcggcgtcttcaccaacatagccctgcaggagccctttggcctcaccgtcattgaggtgggtgctgtgggtttgaacaggagacctgggccccatggccctggtgtcctttcacagcagcgtgcctcatgtgggggaatggggcatgtttcttgacgctcagggccctcaatctcaccccctacttcctaccgcaccttggctgcactcacacactctcacacactcttcacacacggctgtaccccaggctgccgcgcacggcgctcccaccgtggccacggccaacggcggccccgtggacatcatggccacgcttcaccacggcgtcaccgtggaccccaccgacacccaggcggtcatcgcggcgctgctcaagatcctgaccaactcccagacctgggatgagatgagcaaggccggggtcaacaacatcatggcctactcctggccctcccatgtcaagcgctacgtggaggccctggatgcggaggtccgcttcatcaagagctacaaggtgggcaggcaggagttggtttgcatgggtctcagaggccgtgggctgcgactggctgtggggcggtggggcgcgagcgcctggaagcaaggcgacaaggtcaccatgctcatgtaccatgcgctgaatggcggagggagagcatgtagtacccccccttcagcatccataccccaatggccgcgcgcgccccccccccccccccccccccccc

SEQ ID NO: 18463 - DNA, 74 bp, Chlorella protothecoides
agtgtccctgactgcgatgcagatgcatttcattgtaagcccacggtgcgatggatcccttgaagaatatggca

SEQ ID NO: 18464 - DNA, 82 bp, Chlorella protothecoides
tcacagagttgtgtttaaaatattgatttggcctattccgctttcgctcaccactactaacggagtctcggttgattttttt

SEQ ID NO: 18465 - DNA, 71 bp, Chlorella protothecoides
caaaagcagcggacgctgcagacccagtgcacgattgcaggtcaggcaacattccgcatcgcaccttctcg

SEQ ID NO: 18466 - DNA, 119 bp, Chlorella protothecoides
aataaaaattctaaaaacttatatttattgaataattttgaagtatttaaaaaacaacttgcacaaataactaaatatcatttttataattttcaagatgtttatcaagcatttgaaaa

SEQ ID NO: 18467 - DNA, 252 bp, Chlorella protothecoides
atttaattttgtataattaaattaaaaaaagtatagtatccatgattctaacagtaaagttattccacagtttaagaggcagattctcacgcgttactcacccgttcgctactctcctcaaagggagcgtacaacttgcatgtgttaagcctacggctagcgttcattctgagccaggatcaaactcaatataattccttattctttgattgatagattattcctatatctgtctatatagattattcctat

SEQ ID NO: 18468 - DNA, 61 bp, Chlorella protothecoides
gcagactgctacaaggagtggtgggaggggtgctgtacttgcagaggagcactcccgtgaa

SEQ ID NO: 18469 - DNA, 67 bp, Chlorella protothecoides
ccagccactcagcggtccacactgccctgactcgattcgcaggccgaatgctggcgagctggtacgg

SEQ ID NO: 18470 - DNA, 61 bp, Chlorella protothecoides
tttgtaaaccaacctgtatctttagaatatctgttattaacgcagattaatgttttacaaa

SEQ ID NO: 18471 - DNA, 66 bp, Chlorella protothecoides
cagcattgtgcacaatgacctgaagagctcgaatgtgctgctggacggcgaggggagggccaagat

SEQ ID NO: 18472 - DNA, 245 bp, Chlorella protothecoides
aaccgccttctttggcagacacgatgagtcaagacaggaagcttgtactttgcacagtatccaaggtccgtgtattacggcagttgctgtctaaagtattggttgccagtccctgcctaacaatatttgcatcagtgtgccagggacttgcctaatctggacacctcgcaccatgcttgtctgatcttcatctaggcgtgcctctgctatgaatcagtcttcccacacctcgaggaatctgaggt

SEQ ID NO: 18473 - DNA, 235 bp, Chlorella protothecoides
aagggagcggatgcagcatgctctgcttcagacgcggtgcccgtatggttttggtatcggttgaccaggcgggcatctcaggcattacatctgctgtcagcagctgggagagtgcatcggggtcctcgtgcactgccttgtccgccttcagggtggtccggggcgccagcctttggtctgcatcagtgaataccgactggccctcggtggcggactgggttacctgtgatgctca

SEQ ID NO: 18474 - DNA, 248 bp, Chlorella protothecoides
aaaaaaaattaccaacttgactttttaactccgggtaataatccttttagtgcatattctcgtaatgtattacgagataaattaaaatttctataaaatcctttaggtcttccagtaatattacagcgattatgtaatcgacttggggcactatttctaggtaattgttgcaattttatttgtaactgaaatttttcttccattgagtttgcttgttttagcgcgctttttatatcttgacgtttttt

SEQ ID NO: 18475 - DNA, 114 bp, Chlorella protothecoides
attagttaaattttattgtaataaataaaaattttttatttatttttataatagcatataaatattatttatacaaaatattgttataatttcaatatttgaatattgaaatta

SEQ ID NO: 18476 - DNA, 76 bp, Chlorella protothecoides
gggcacatggcccctgtgctgacgtcctggatgccaggcatgccctagctccctgggcgacagactccccggcagg

SEQ ID NO: 18477 - DNA, 104 bp, Chlorella protothecoides
gagtaatactaagtactggcatggggtgggataccattctaccttactcagagctcacctctttgccttcgtctcactgtgaagtaccaacactgtgaagtacc

SEQ ID NO: 18478 - DNA, 90 bp, Chlorella protothecoides
aatatacaagacatatcaatgcatttttattatttgcttgatgctaaaaactcttcagtgaaatcttttaaactatttttcaaaatttct

SEQ ID NO: 18479 - DNA, 78 bp, Chlorella protothecoides
atttggattacgttacgatttgaatcccccagtaggggaaatcagactgggaggtaaaacctaatggcacaataaagg

SEQ ID NO: 18480 - DNA, 435 bp, Chlorella protothecoides
  modified_base (133)..(352): a, c, t, g, unknown or other
ccacccaccccacctgagcgaccggcgacaatctgcacggcgagcaagagcaggcacacacgaaggacgcccatcctggcctgtaagatggagtttagatggttgatgatacgaatatcggaaagcgtgtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattcggaagacgggtgtcggacacccgtctggaggtacctggattgcccatgtgcctttccaccttgtggaacgtttggtgtc

SEQ ID NO: 18481 - DNA, 6944 bp, Chlorella protothecoides
gcgggcgccgggggccatcagcgcgcgcatgagcgtcgccaggcccgccgcgtacccggccagcgcgcgcatctcgccctcgaaggccgcccccgcggccgcgctggcctccagctccgccgccagctcggcaaccacggccgcgccgctgacgcgcccgccctcgaacagcgacaccgagtggcgcttgcaggcgggggtcagcgcgcccatcatcaggtagcccgtgacctcgctgtccaccaccagcgccacgccgcgccccccccgctgcgtgccgggggcggaggcggggttgctgggcccgtggggtgcctgccccggcggcgcagggccggacggcgctgggcccgacggcgcccggctcagggttccctgccccgggtccccctgcgaggccgtgtgaagcccgccctcgcaggcgctggtggtgcggggggtgggcgtcatgcccagcacaaagggctcggacagcgaggcgcggggggaggggctgggcgtggagccggcctgcgacgcctcgcggctcagccccgcctccgcctcgtccagcttgcggcagaatcccagccggcacgccatcgacaccgccaccttgccgttgtgtttgggaacggggggttggtgagggtgggtggagtcacgtgggctcaaggtagtgtgggggggtagagaaacaaccacacaccgcacggcctggcgcgttccgcggggacccattcctggtgggacacagaatccccgagccctgcccatgcccagctcaagtacatacttcagccccctttgctgcggatgtccttccctccccccctacaaaaaaagaaaaacataaaccacacgcacagaacagttcctactttccaaccccagccctacccgcagcgtgggcacgtccacgcccaggatggcggccaggtcggccacggtcacgcgctccgaggcggccacgaagacggagtagagcagggtctccagcgggtcggcgtcgccgccgccgccggagcggttgctgacgaagccctccagtgggggcaccgagatctggtcgcgcgcggcgatgggcacgtccagccagaccaggccgcggcggtgaagggaggccaccagcgcgggggcctcggggccgaggtcggcgaggcgcgcggcgccgccgcgtgcgcccgcgctggcccggcacagcgccagctcggcgggggtcaggcgccggtgctccgcctcgctgacgttcaccacgtgcaccgtccaccagggctcgggcgagggcggccgcggctcggcggggaggtggtcgcgaaccgcgccgcggttcatgcgccacatcagcttcttggacttggcctgaggtgacgggagggtgcggggtgtgggtcccctggggactgcgacccagggtgcccatgctcggggtccatgcctcccgccgcgctcagggacaggcgcctcttacccccctccccccccctcagacacacgcgcgcacacacagccagccagccagccagccagcgccctcgcctggaccatggcggcgatgtactcgttgcgcccgatgcccaccacccgcacgatgtcggcggcggtgaagttgggcaccgagtcgtagggcaggtcctcgcgcatgaggtcggccagcaggccagagtagtacttgaagggcgtgacgcgcgccacgcggcacacatactccgacaggtggtaggggaagaggcggcggtgcgcgcggcagtgggccagcaggtcgtcgtagtactccgcctcggggcagacggtgctggcgacggaggccacccagctgaagccacgcacgatgcagaatgtcttgaccctgttgccatgcggtggtgtgggggaggattggaggggaggtggacattggttttgggggagggaggggggtatgatgaagggtaggcgggagggaagagggtgggcctggttcccatacaccgagtgtgcgagcctggctcttaattgagggggccactcccggtggccggccaccccacccacttgcggcgccagtcgtcctcagtcagggtttgtctgaatctggggggcagatcctcatatctcttgccctgttccaggaagcgaaacaggtactcctcggtggccatgcgggatgggcgtgttacgcggtgacaacgccctgggcaaaccgaggggtcagggacatgcctggcaccgctctagctcggctacttgttgcatgctggatctacgcacatgatgaatcacgagcaaacctcatcatatgccccaatgggggggtgtgatcgtgcacatcgccgtggtcagcgcttcctcgatacgaaactgaatgcggaagagtgtcccgcgcaaagacctggcccgagagagcccgtgatgatcacgatccctgcaggcaccgaactctccaaactctgcatctgcaaatcgattctatcaatcaggacgggggccgagattcccatatctgtcaccgctgtatcgcaaaggactggcgtaggggagaagcgatcacagggagctcggcctcaagctctaccccagctgtgcctgccatgcagctcgatctttccatgctggagcctgtcaccaggaacgccaaacagacacaggaggcgtgcctgaccgggatatccggggagggcatcgacgccttccccctcccagccgtggccgatgtgagtcctgccctgccgcatcgtctgattgaaatttagattattcatccagcatgcgatcatgaagagctccatccgctaaatcgtttgctgcagctggactcgttcgagaaggaggttgtagagtacgtgaagccctcccacggcaccacgacattaggcttcatcttccaaggcggcgtgatcgtggcagtggactcccgagcgagtcaaggctcctacatatgtgcgtgtgttgggatgcgccgtgggactggggcgacgtgttgaagggtgcatcgatgagttttgagtgcgcatgatcgccttatgcacccttctccttattccccacacacatcgagcagcctcccagacggtgaagaaggtgattgagatcaaccccttcctcctgggcaccatggctggcggtgccgccgactgccagttctgggagaggaatttgggccgccaggtagtgtgggtgggtggggattgtatgaggcatgtgcacatctgctagagtctcttcttcctcagcactgtctgtgcagcttcagcgtgtggcatcaggttcagcgcgagcctaccatgctgcgacctgtaaaggcggatgttgttgcacaaatgcctcaccgcttgccctccctttctacagtgccgcctgtatgagctgaacaacggcaagcgcatcaccgtgcggggcgcctccaagctcctggccaacaccatgttttcataccgtggcatggggctctccatggtgcgaagagtggagcagtagtgttacttgtcggggtttagacagggccccctccccgacgactgtcgatagtcgtagagagatttgcattgcaactcccgggctgccctctgcagcgctcggttgtgtctgtcacgagccgcacctcactgacacagtccctaccacactccaatgccagggcaccatggtggctggctgggacgtggcaggccccggcctctactacgtcgactccgatggccagcggaccaagggccagcgattctcggtcgggtcgggttccctgtacgcctatggcgtcctggatgcagggtacagctggtgagcgagaagggtctgattccccgggtgggcgcggcacgcagagcgttggcggagctctcatttggtatggtgatggtgtctgtcccagagtatgcttgggatgtggtcagcggtggggctctccagctctgtgtcctggcacactgtttcccggtgcgctcccctgagcctggtccgtcaacaccctcccttcttgtcaccctgaccgcagggacatgtcggtggaggacgccgtggagctggggcagcgagcgatctaccacgccacggcccgcgacgcggcctcgggcggtaccgccagcggtgcgttgcgcttggtggaggctgatgcggggatgtcggcacgccggggtggcaggcgccctcatgccacggcgcggggggaacacccggcgcgagtgctggaacagtcgggcagcgaaccgtgcagttttggggctgtggggtgaggcagggcgccgcgctccccgccagacggcaggctgatcactcgccctgcgcccgtgcagtgtaccacgtgacggaggcggggtggaccaaggtccgcggcgagtcagtgggggagttgcactacaaggtaggcggggtggaaggggcggagggggggtgccaggtcacagagagcgaacagtttcagggaccctgtcgcggagagcatgcgacctccctcatcgccgtgctccgcctacctgtaccagcccctgtgcgcacggcagtggcctcacccctcgccccatccctcgatttccggcagtactacccggacccgctggtgcgttcctccatcgccgtggacccgctggcgacgtgagcgcagcgcgcgcatctgggccggagcccgggcgcaggcgcgggctggggcccagagcccgggcgcaggcggctccctgggccaatgcccctcttgcagacctgcaccctgccgtgcaccgctgccccctgcatgttacgacaccagcaagcagggctcccgggggggaaggggcagcatgggacgggcgccagcgcctggcgcatgggcggcatgcatgtgtgggactggcagcgagcacctcgccgcacagggcaaccggcacaccgtgcgcgcgcgcgccgcacgcggtgggtcgcgggcgtggcgtccgtaaacctcccccgcacagagccctcagaactgctggtagatggagtaggcgcgcatgatgcgctgcaggccgcccagcttgcgagccaccggccccggcgcccccagctccttgagctccgcctgcagcgccggccactcggaggaggcctggcccccaaacaagcccctgtgccgcgcgaacagcgagcgcgcctcctcgtacgccgccgccagctggaaggcgtagaggccggcggcctgcgccaggtcgcgcccaggctcgggagtggccaccaccgccaggctgcgctccgcctccaccagcgccaggcgcgcaggcacggcctcggtcttggggtcggggggggcgggggtgatgagcctgtgggcggtttcggggagggtgttggcagggggggagaggtgggagagtgtgcgcccagcgtaggtaggccaaggccagcagggagccgggtcagcgcgctgaaaggagtgttcccaggggagagccaggcagcggggggttgccagacatggcccgggcacgagaagtctcgcccccccccccggcagacgccaagccacctgctagtccagtacaggaggccgcccgcaatcaggaacgcgggcacggcggcgacgagggcgatggacagctcgttggacttgaggatctggtcgatctccagcatggccgactcggagtccaccttcagcttctggacctgcggcgggaagatggtgtgcagggagcgagtgagccggcgcccaggcaggaagggtgccctcatctggcggtggtgagccaccccgaacgtctactgctgccgctgagaatcgcaagcacacttcatggggccgccttccaggggcacatgccgtgtggctcacgaggacccacccgccccccacaatccttactcgcctggatcaggaggcagcgtgccaggtcgcccgccaccaggttccggatgggcttcttcagctcatgctcgtaccgccgcatcatcgtgtccatcccctgcgagcgcgggggggggcagcggggcggcgggtctggctgccggcgggaggcaggaacgggggaggtggggtcgttgtgcctgtgcaccgcacgtgctgacatcgcactttgggagggggcccaccgcctctgggggctggcaacgagcgagcgtcgccatcctccacattccgcccttccagcagcctgcccacctggacgagcacggcgtcccccgccgtgggagggggcgcccccggaccggcgcccccaccgccggccccgcctgcagacccccggtcccgctcaaagtcgcccagcatccgcgccagcgagtcgcggtccgcctcgtactcagcgaggctgacgatgctgggccggctgcggaaggtggtgaacagctcgtcccgcaccgcctgcagcggcgccagcaggtgggcgtccagcgcggcgcgcgtggcccccacccccgcgctccaccagcgctgcaggtcgctgctgccggccagcggggagtgcctggggtacggatgggtaggttgggggggggtgagagggtcgaggggtgggaaggaggtctgtggtccagtcttggcaggccttccactggtgctcatcgggatgctgtggctgtgaatgagcctgcagatgaaagccacgccgctattgcaggcagggaggaggagggtcgaggccccacctgccgcaaagtccccaccgtggcaccctgtctcgagaccccttgcgctgccccatccacgccttgccctggcctcccgccccatggccacccaccacactctcgcgatcaaaacatgcatgcccccccttttctcacctgaccacaaacagggcccccgcgccggtgagcgcccacacgacgccgtacttgacccagtggcgctgcagctcgctgggcatgcgggcccagcgcggaacgtgcaccagacgctcggaggaggaaagcgcggcggaggccgcgatggcgtcgcgcgccgcctggtgcaccgtggccccgggcgcgggctcgagatccggggcgcccagggtggcgcgcagcgcacgcagcgcggcgctgccggcggggctggcgcg

SEQ ID NO: 18482 - DNA, 61 bp, Chlorella protothecoides
cagggcatcttgtgtacaggatcggcggtggttcagatgacaaagtcatccaccccgcctg

SEQ ID NO: 18483 - DNA, 5358 bp, Chlorella protothecoides
ccgccggcgcgtgcgcccgccgccgccgcccccaccgcaggcgccggccgcggcgccacggcgcaggaggacgagtggggcaagtggtagggcgcggggcggcgcgctgctcaacccgtggccctgataacgcatggcttgccgacgagaactgtgaagcatggtgtaaggctgtcgctgtgctcagggcacggagagtgtttgggggcgcctcagcatcatccgtgctggggacgcacatgggcagcatgcagccactccagcagcgtagtccatgcgcgcatgcttgtatcacagcatcgagggccgctgcacagattttactcaacgtatcgaaagaatgttgcgtttgggaaagtaaaagtctccgatggaaggcttgcggcccttgcttggcagcatcgcggtcggtcccgctgtgggcctggtgctgcggaggacctccttgcttgaggatcaggatgtccaggtaatcctataacgggagggcgatggaaatctatgtcatgatatgggtgtccgacgagtgctagtcatgtacatcgctcctcggctgacttggtgggtccgcctcccaccctactccccaggtggccttgcgcttcgtctcgcagataacgctcccctccctgatcctgcacactctgggcgggcgagtgaccctgattttttgtggagaggatcagttggggatcttccatgatgaagtggctcgttgagctggtgtggggtacctgcagagcctgccctctctgcatccttcaaagccacatctgctcaatcatttacaccgtttcatgtcctgaaacactgcaatgcgccacctgcaggccgcttccaacttacccatgggtgccgacgctgtcgctttaccttggcaccaaggccatcatcgcagtcctcgcattgtgagcagcggggtgggcgggcaagtgcggtttagggtcgccaggttacctcaaagcgaaaattcatgctagaataagcttggtcaagtatccgactcacatttgaccatgacaacttgcctatctgtgctaatagacagcatccccacaattccccccaacccgacccccccaaacacagtgcgacacatgctcaccaacccctccgtcagcggtttgccagcgtagctctgtgtctccccaccggccctgtactcctggccattcccctgctgggcctgctagcgggaccccccgccctcgccgtcggcctgacgttggccgccctcgatgccgttctgcttcgcacgctgggttttgccgcgctttccagagctgggaacgccctgccggaggcgctgtaccacgacgatggcggcaagtataggggggagctgtccggggctctcaaggacggctttggtgtttaccggtatgcctctggggcccagtaccaaggtgaggtgcggggccgagctgaacggccagggtgggggaggggatggcctcgggagcacggcgcactcagcaccctgcacaattgggcctggggcatgttcatgcacccctgggggtcgtttggggctctggctctggcatgctcctggatctctgagcgcccagctcgcccccactccatgccccctcacctcctcccaccgtgcaggggagtggagggacaatgtcaagtcggggcgaggcatctaccgctacaacagcggggcggcgtacgccggggagtggcaggcgggcgtcccggagggcaggggcatcaggacctcggcctctgggaaggcgcagtccggcatctggaaagggggaaagctcagtcagcgcacggagcccgaggagtgtgcgctggccgtcgccacggccgcccaggccgcctccgccgccaagaaggtggaggtgggcggcttcagcccaggcgcggccctgcggtccctgctctccaccccggccctgcttgcggtgggggttgtcggcgccttctggcttgcggggaagcccctctccccatcggtgagcgccatggtgttgccgacagggctttctgtcggggtctgctgggccaagcgttcaaatgcttgttctgtatagggcacaatggggaatgagcaatcaagaggaagccttgcggacgctgtctcctctttccccaaagtgcctcccttgcccgtcatcatcaggtcgtgagtgctgcaggtcggctcgctaccttccaggctcccctggccttgattgtgctgggcctgaccttgggggacggaggtgtcaagcgaggtgctagggcgcctgccccagcccaggcacgtgctgggtggaggggggggagttcagaacacttcctgccactgcgcaggctctcgtccagtgattacaaacctacaagcctggagggccatgttgtggggcaggggcgcgggggctctggtcgactcggtggagtcgtcggcggggaggaagtggccaaccgaggttgccctgtccaggagccaaggggtaccgctgacctggcattccaagtccgatcgagcagttttcccgcacccccagcatcactcgctctgtttcctgaggataacgccctcaccgcatgtgcagcatacctatccctcactgcctctagcagcgtccccgttctctttcctgactctatcccgcacactcttccgctcgcccaaagctcctgtacagtgcaccttgtgtttggccccctctgaacctccatggtagtgcaaagctacccccccaagcctccagacccctgccccgggctcgctgaacagcattatctatgaaatctgaggacacggctatgagtctcgtgcatgcgtgtgtgtcgcccctgtggctcaccacaacacctgtgcgctgcggcatgtcgcggcctgtattgcccaggcccacccagcccccttacccccactcacccaagcaggccccagacttggtgaagctgaccgcgctgcgcacgctgccttggtttgtggtgggcacgctggcctgcctgcggtggaacgagcaggctgctggcatcgtggcccccctgctcctggtcggcatgtctgggcccccgcaggagctgctggccttctgccggcggctgaggacggaggagggcatggcggcgggtctcatccgcgccgggtccctgctcgctgtcccgctgctggcgggtacggccctcgcctgcaggctcctgcctgcaggctccctggcgtggggcctgctggcggcggccgggcttggcggtctggccgcagccctggcctccaatgctctgcgggcccccagcacccagaggcagccaccggagcgcattaggatggtgtttgcccccgggactcgggcctccacaggccctgggcaggagggcccagtggcagcagcgtcctggagccaaggctccacgcggcgacaccatgcgaccccgacagcgaggcgcagacagcggctggccttgcccggtgtcctgcgcggaaggctcagatacaatgcgcccaatcgcctcacccttgagtcccattctttcagtgtacggtcgttgtagctgctttgggcatgcctgccttcaattttggtacccttggttgtgttgagcccccttctggtgtttagttgtgaaatcgagtttgctcgatttctttgtgaaccgacgacgaggacaagtaatccctctcaggcgtgaagctacgcgtctcttggatgagtgtgtatcgcgaaaactgtctacgtgttacagaacgccctgttggattagagaagttgtcggaatgcattgctattgatgtccattgcggcagtggagaagagctcgcgaccttaccgagagcactattgacaccatatttgacgacaaacactccgaaacattgcgcctccaacccctatagcaatcaggaacgtatgcaaaggggagccagtgggtctagccccagcgcgagtggcagcggggtggcacagagcagcatgacggagccttctgagaacccagagtggcccggaactactgccgatgttggagagatgatggtggatcgcgccgtgacaagaaacgcctttgtcaagttcatgatgcagaagatgcaagaggtgggcgtggtgacggagatgcatgcgtgtgaggacaccacagacatacccagtgagcactggcaggacagccacgcacagccctggcccatgggcgtcagtcctcaatcccgtgacacatccaatcgcgcaggcaggctgtgcagtcgaccggaaattcataaaggtagaacactgcgatgcgcaagtgggtgggggcttcagaccccccgacggtgtcgtggtctgtcacaaccacttggccagtcagatcgaggtgggtgccggtgccattgcggatgctgcccttggttcctgggtctctctcgggcttggtaggcctgcatgcgggtcgatgggctgactgcgcttggagatggaatgtccggaggctgggtcaccagcaactgctgggctaatttggtcccagtgagcttgaggccatacatgctcagatggagcacatcacttcatccctcgatcccacaggtggacaatgctctgacccatgagctcatccacgcctacgaccactgccgagccgcctctctggactggggaagcctagagcaccatgcctgcagcgagattcgggcggcctccctctcaggtggggctgcaggcggcgcgcattgggcagcaaggggtgccacgaaagcttcttgctgatgcagcggcccctggaccacagcaagctggtgatgcgctgggtcaggggctgccagccgggagctttccgctttgggtgtgcaatcaacttctcccagcacccccttggaatactgccccctcccattcccacaggcgactgcaattatcggatggaagtcatgaggggcaatttttccttgcagaaacagcaccaggtgtgcgtgaggaggcgtgcagagctgagcgtgggcatgaacccacactgcagaggccccagcgaggcggcagctgcggtggatgccgtgttcgacaggtgtttcagggacactgcgccctttgatcgacgtccgtgacgcagtgtcgggctgtgtgactgctccttgcgacccagccaggtctgggccagggatgatgctggagccgtttgctgaagttctgacccactcctgcttgagcactacccctggtcacaccattgcaccatgcgcttagggttacagagggctgggcatgcaagtttttttactctgcgcatcattcggtcatgggaggggcgaactccgctctcgatgcgatccttgcacaccttggctccctgggaaatgcatggtccggggtcagcgagtgcaggatctcatcacaaggacagcagcaaaaccaatagacacaagagggaggggggggg

SEQ ID NO: 18484 - DNA, 104 bp, Chlorella protothecoides
acaccccacatacacgtcttccgccttctcagtcctggcacccaccaatgcggcattcgcttccgcccttggatctggcctcctgacagaggggcaactccagg

SEQ ID NO: 18485 - DNA, 130 bp, Chlorella protothecoides
atttattttaatttcatacaaccaagtaaaataattatataagtttatttcttaataaacttcacacaacaaaatttaaaaatgaattcttctagaatgctatttcattacaatgaaatacgttatcgta

SEQ ID NO: 18486 - DNA, 84 bp, Chlorella protothecoides
acatttctttattttgtaaaattcgtggatgcagatcgcccataatagttgacatttcaggaactgcattatcggttctggatc

SEQ ID NO: 18487 - DNA, 127 bp, Chlorella protothecoides
tggaggccaggtaggcgatcacgttccagggactcctgacacggccactgatgcatgcccaggtctcctctcctgtgacgcggcgtccagggtatgactggagcccctccccgctgagacccattct

SEQ ID NO: 18488 - DNA, 68 bp, Chlorella protothecoides
aaaattatataatttttagttaataaagcctaatgaataatgctttttctgtaattaataaatatttt

SEQ ID NO: 18489 - DNA, 61 bp, Chlorella protothecoides
caatatgtaggtagaagtcttcatattttgactcagtagccatgcccgagacgcagctgcg

SEQ ID NO: 18490 - DNA, 61 bp, Chlorella protothecoides
cagtagccatgcccgagacgcagctgcgggtggccatggcctgcgaggtgaggtttcgtgc

SEQ ID NO: 18491 - DNA, 77 bp, Chlorella protothecoides
cacggtgcagagagggccagggtgatgtttggtgggagcagagcccttgggtggaggaccccatcacatccacccac

SEQ ID NO: 18492 - DNA, 277 bp, Chlorella protothecoides
gtatcgggtaaagcgaatgattagaggtaccgggggcgcaacgcctccgacctattctcaaactttaaataggtacgaagtctgggttgcttgactgaacccaggccctcaatgcgagctccaagtgggccatttttggtaagcagaactggcgatgcgggatgaaccgagagccgagctaaggcgcccaactgcgcgctaacctagatcccacaaagggtgttgattgatacagacagcaggacggtggtcatggaagtcgaaatccgctaaggag

SEQ ID NO: 18493 - DNA, 122 bp, Chlorella protothecoides
ggctgcgccacgacacccacgccctcctactcatgggggcctcgcacttgcccccatggccgagcataggccgcgcgcttcagcgccatccattttcggggctaattgattcggcaggtgag

SEQ ID NO: 18494 - DNA, 263 bp, Chlorella protothecoides
gtataactcgcagggattgcgcaggaggtgccgcgctgagagagtccccactcttgcggaggagacaccaagctacagcaaagtatgcctgatcaagcgtctaattgacctcctgccatcgattgtcagagctctgcccagcccctccctctgtttcatgatggtagcttggatgcgctctttccaccccggacaaattgcccagcagagacagcctttgaaagtgacttaggcattcatcacgaccacattctggatagccg

SEQ ID NO: 18495 - DNA, 80 bp, Chlorella protothecoides
caccaagcgctagccgctcatgatggctatattcagggtagctgccacgctgaaggactcacatgccatttaaatgctgt

SEQ ID NO: 18496 - DNA, 96 bp, Chlorella protothecoides
tgttaaagattatcgtttaacttattatactcctgattaccaaacaaaagatacggatattttagcagctttccgtatgactcctcaaccaggcgt

SEQ ID NO: 18497 - DNA, 82 bp, Chlorella protothecoides
ttcaccagccattacatcatcaagaccatagatacgagcgattccatccccaacttgaaaaacagttccaacattaactgtt

SEQ ID NO: 18498 - DNA, 108 bp, Chlorella protothecoides
actggataataaaaataataaacaaagtttacaaattaaacagtctaataaaaagtgtatagtgctcgatagcaattttaatcctaacatatctaacgtgaaaacttt

SEQ ID NO: 18499 - DNA, 392 bp, Chlorella protothecoides
aatgcttttatttttttgagcaagtgcttttatttgtcgaggccaataaaatacttcgtacaagttaaaataaatgaagtttattaaaataaattcgatttatttgtttgtctaaatacatagaatttatttagacacatagagcaattgctattttatgtgtgatcaagtgtaacggtgcagggtacgccatacaaaaaatcagaaaaaataaagaaattgctaatgctaaagcatttgttcgtggtacgcgagcagtactacaccaagttttaggagtactaaaatacattattcttattaatctaagataataaaaacaactaactacacttgtacacacacctacgacagctaatacacctagattacttccaagagcagcaaaaaaa

SEQ ID NO: 18500 - DNA, 61 bp, Chlorella protothecoides
agacgactacgtgcaccgcatcgggcgcacggggcgcgctgggaagaaggggctggccacc

SEQ ID NO: 18501 - DNA, 73 bp, Chlorella protothecoides
cgactctggcggtgattctgatggcggcgcgcttccgagcgcagatgccatcaggagagcaaaggagacccgg

SEQ ID NO: 18502 - DNA, 74 bp, Chlorella protothecoides
tttttttacgtaggtaatatatatatgatataaaagaataataaaataaatttagtttcctttataaggaggtg

SEQ ID NO: 18503 - DNA, 215 bp, Chlorella protothecoides
aaaaggtagttttcttaatttatttgcatatttaaaacattattattatatttatttctgagatgataaattttaaaactcttcaataaatataaaatatataaaacattttaatgtttttagtaatttttctagtataataatctaactatattaaattttaatcaactggttataaaataaagtttaatacaattttatactataaaaagaag

SEQ ID NO: 18504 - DNA, 9090 bp, Chlorella protothecoides
gacgcggcgcggcgcctggagcgcagcgaggccgagctggcgtcgacacgcgagggcgccgccgccgcgcgcgcggagctggaggcgcgcgtcgccgacctctctgagcgcttggaggccgaggcccgagaggccgccgctttgcgggcggcggctgcaccgggtcgggcgacggccaacggcgaggcgcgcgggattggctcggaggcgggcgaggcgccggcctggtccctggacccggacgggagtgcaggtgggggtagttggcacctgtatgtagaggtgcagggatggggttggagaggagagggagtgagtgagggaaggggaaaggaagccgccaaaggcatgcagctgccatgtggcaggaggtctctgccgccctgctcaccgagcaaccgtgccgccccccactgcaggcctgtcgtttgcgccggaggccctcgaaaagctgacggagcagcacgcggagctgcaggcctcgcagcgccgtgtggacgagctggaaagggtgagcgggtcggtgtcgtagttgggaaccttttggggattgttgcaggcgggtcctgagcgtcaggccgagtcgatggtggatggcgtgcaatatgggcccctgttctgggtcctttttgctcccaggaggccatcgcatgcggagtgagcgtgcctcgccaatcttgcagcccactcagacgcctgcctgggccatttgtccactcagtcacccattgttttacgttttccacccacggcgccccaggagtgcgccgacctggagcaggagtgcgccctgaggcaggagcaggaagctgccctgaaggagaccgtgcgggaactgggccgggagctggagcgcctgcgtttgtccggcaaacagagtgaggcgtggactttgcggtgcctgtgcatcagatgcaggccaggcggctggcgctgccggcggtgcctgtgtgggatctggggccccctgttcacgccgggcatgggctacctaacaccccccccgtcccccctccctcccttcccgttgccgtgtagtggacatggagtacttcaagaacgtcatgctgaagctgtttgagacgggggaggccggcagcctgctgccggtggtggcgaccgtgctccgcttctcgccggaggagctggagcggtgcaggaaggccaccgcgcagtgggggacagggcacgccaaccacacgcagagtgcgtcgcaggggggtggggagcagcgaggcgcgtttcgtgtggagccagcacggcgctgtgcacataccatcgcacgctgtgtgcgggaactctccagaaatcccagctggcatgccagcacctcgatccagccccatcaaacctcctgcgcagatggcgcagacgccccctcgctcctctcagggctgacatcctggctgggatccggatcttgaagcggccattaccccttatccttgccggccgcggttgaggtctgtcatacttccgaccagcctggccacttccgaaaaacacttgctactcttcacaagcactgtcaaggatgggacaccgtcaaggatggcacactgtcaaatccccgcttgcaccatcagccccagcttctcgctgatctggcgctccactccttgttgctgggtgtttggcaaggttgtaacctagttcgaacgctccacataatacccttggaaaggtgctcgtctaatgctcatgggaagccgagaacagacatgtcactgtagctgtaaagttccatatatcacaacagcaatgtcacctcaagaacgctgcattcttgccaagtgacgcagtggctgctgagggtgtttggtagaggcacattgagggagttctcaagatcaccaccttgccaaacttgttctggctcttcctaccaagagtaatccagccgtaccttgcacctctacacacatgcccatgttcaatgtttgcaaaagtgtgtgcatctccatgactcatccagacatccaggcaaggctcatcccaaaactcccaggtgcagagtaaatccctgacaattgtgcagtaagatatcgggtccacatcaagattcaagaatcagatcggagcttgaaagggtcagctttaacttctggagcagatttctgcccctcccccctcgttttgcgcgctctgtgcattgccgccagagcacggcttcatcgaggtgggtcgctcgcctggatcgcagccaggggtcggtgctcagcattcggaggatagcagctgtccattctgtagttaacgagatctctggaataattatcgcgactttggagcagaggaagggcatctcatccgcgttgcgggctgtggaggggaaggcggaggcaggatgtcggggatcgccgggggccgtatctccgctggagtgggtgccaacctcatcggcatgcactccacagaccgaaatcaggaggccacggtgtacgtgggaaacgtggatccccaggtcacggaagagctactctgggagctcttcgtccaggcagggccagtcggtgagccgggttgcatcgaggtgcaggtggtggggcagcaccccaaggtccctcttcctatgaccagcctgaactggaggagcggcgcctgggcagggcactgctggcggaagcgcgctgctgctcctgccactcaccccctggagctccaggatgtcttgccggtggcatgcctcacagccctgctgttctgtctttctggcgggtgcgctggacgctcacaccatgtttccccccccccacacacacctcttgcccacagtgaacgtctacatgcccaaggaccgggtgaccaacctgcaccagagctatggcttcgtcgagttccgatcggaggaggacgctgactactccatcaagatcctgaacatgaccaagctgtacgggaaacccattcgcgtgaacaaggccagccaagacaagtttgcgtacgatgtgggtgccaacctgttcatcgggaacctggaccctgacgtcgatgagaaggtgaggctctggggtccggactgtgtcctcgtttaaatatcggaggccggttgcacccccatgccatgcctgggggtcaacagtgacgtactactgtcacccctctgccttgatggccaccacccatcctgttgcccccctgcagctactgcacgacacctttggcgcatttggagtggtagtgggagcccccaaggtcatgcgggaccctgacacaggcctgtccaaaggatttggcttcgtcagctttgatgactttgagtcctcaggtgaattgatgggagggtgggttcaggtggtgagggggatactgttcctggtcatgaaggctgcaggccaggacgcaccggtgcgctcagcagaggcctggccggccagagctcatcctcctgcaccgcccgtccgtccacgccgtgagctgcccatgccaggatcgcacgcttcctccaccccgccacttcacgactccccagatgcggcgatcgaggccatggacggccagttcctcatgaatcgcaccatcagcgtcggatatgccttcaagaaagacacgcgcggggagcggcacggcacccctgcagagcggctgctggccgcgcagaagaagctgcagagcaaggaggtgcagcgaccccacacacgctttgccacaggtgcgctgcgggccaggccttcggtggttggagctgcattcccctgggcgtcgtttggcagtggccggcgccggggcggggtttgtgcacaggcagtggcggcgccaaggcgacctgcaggagtcgtaggatgggtggtccctgccatgcacgagatgccggcactgcctcgccggtgcaccctcctccacctttccttcgttgtgcaggcccgaggcaggtggggctgcagaccgggttcccggcgcccggagcccaggcggccatggcgcccaccgggtttgcggcgggggcacccatgccgcgcccgcccccgggggccatggtgcccggcgtccccggtatgatgcccccgccgccccctgcccccccggggtatggcagctacgcgccccccccacccatggggtaccggcacggggctcccccgcccccgccggggtacggcgcgctgccgccccccccgccccccgccccaggctatggtgaggcgaccgagtgccttttctgtcccggggtgggaagtgcgtgccgaacggagtggagtgtggcatggacatggggttgtgtattgctaacccccttgcatggatgatgacctttatgagtggaatgaatgggccacaaaggttcatccatggatggactgggtggaaggacgcatccatggcaatgcaaggcgcgacgtgctccatgccagcttgcctctcagcctgtcatctctccccctctcccatccccacggcaggcgcaagggtggcaccgcccgtgccaccgccgcctccagggtcggcgccctttgcgggcgcgggccgaccgccaccgccgcccccccctccggcaagtgcagggccggggtcactgccctcccccccgcctccccccccgggtgctggagcacagagcacgctgcccccgccccctcctcctccccctggcgccgcggcaccgagcacactgcctcctcccccgcccccgccgcccggcgcggcgccgcccgcgacgcggccggggcagcaggtaagcaccgagccccttgtgcccccaccgccaccggccgcctgattctttttccaaagctgaagttctcgcgctctctctgacctttaaccccatcctgcaacttcatcgctggtacatgaagtgtggatgcttgcagctccgaagtcgtgttcctggaaagggaactgggatacagggtgtggaagggttgcattgccataggtgcccactccatctccgctgccatgctgatgcttctgcggtgtcattcagcctggaagtctcccaggggtgccagaagctcactcaagatcgcgattaatcatatggacgggcgaatctctgtccagggccatcaagcgaaagggctcttcattgtttgtgtgagacccccagatctgacgtggcagctccgttctcctactgcaccactacgtgtctcctgcactcccctcgaggtacatggggttgcattaatattgccaaatctcctgggaagttttagagtgcggttcggtgcgaagcgcatctttgtgcgtccgcctttggtccaggaccatgaccgacagcagcggctcgtcgggcctgcagtggcgcaaagactggtgcgtcacctcacgatgttataggtggatctacattcaaatcacagtatgcatattcataaaccctttcgcaagacactgagctgtacccttgtacgcacgcagggcggcatggagcgaggcccacggcgatacccacccacccccccctcacccaacttatgatgtctacaaggtgctcgctggctttggggtaattgtttgagtatattgtggaacacagaactgcctccaggctgcttgtgtaggaagaggcgcctgctctccctgtccccagcacatctggaggggcaaagtcacagctccactctccatcacccccaggtcatagacgcagctctggaggaggatgctggtgacctgggggatatcagcgccctctccacgtacgctgcgcgtgtttgcagaccgggggctcaggaccagggccaggcagctttgggttgtcgtcgccgccatgaaggaggcctcatgtcactgcctccagcccgagcatgtccccctccttacaactggtagcctccctgcccagtgtccatcttcctggagcacgggttgctgggccacgcattgtcagcatctctcccgaatagcgccactgaccaccggcccatcattctgcccgcactcccatcaccccccccaaccccacctcgcaggatcccggcggacacccaggccactgccgagttcacggccaaggcggcgggcgtggtggcggggctgtgggtggctggcgccgtcttcgcgcgcgtggaccccaccattgcgctgacctggcgggtgacggaggggcagcgggtggagcgcggcgcgcgcctgggcagcgcccatggccccgcccgcgcactgctggcggcggagcgcgtggcgctgaactttatgcagcgggcgggggggatcgccaccgccacggctgccatggccgccgaggccgctggcacgcgcgccgtgctgctggacacgcgcaagacggcgccggggttgcgcctgcttgacaagtgggcggtggcggcggggggcggggccaaccaccgcatgggcctcttcgacatggtgatgatcaaggacaaccacattgcggcggcggggggtatcgccgccgcggtggcacgggcagaggtagggcggcgtcgagcactggagggagggaggaagggagggagggaggtaccacctcgagagatagaccgtcctgaatccctgtcctcggtggctgcttgtccacatgcttgagtgcccgcgacacgccagtccagtagaactccatggccccggatcccagtcgccgcacacaatgtgcaaggtgctgcatcgactcatccacctccccatgcccaccccgtctgtgcgcacccatccctttccacagagctacttgcgggagcggggcatccagtgtggcctggaggtggagaccagcacactggaagaggtgcgccaggtcatcagcatcctggaccaccagcctgacacattggtcacccgcatcatgctcgacaacatgacacggcggcaggagggtgagtgagggggtaggcatgcccgcggggggggtccgggccgctgggtcgaggggaaccccgggaatggctggtgcatgttcggccacccagcgtgcctcggcgtgctgctaccgcgccaccgcgtgcagtccgaggacggcgcgtggcttcccagggaaatttagtctggcggggggtcagcacaccgggggggctgcatgctcagctcctcccataaggccaaggaacactccggagcccggacgctggtcctaggcatcctccataaccctacacctcggcgactgggcaccgtgccgtgaatggatcgagggttacttaatttcatccccactgacgcgctttgacaccccgcagatgggtccctggacgtctccctgctaagggaggcgctggcgctgatcgggaatcggagggtggagacggaggcgtcaggcaatgtcaccctcgacacggtgcgcgtcatcgccgagacgggcgttcagtttatttctacgggatccacgacgcactctgtcactgcattggacatctccctcaacatcaagacggcctgatgggccggtgcctcccagtcggtccatgcagcgccatgccagatttccctcggcttggccgatagctcctgttctggtgctggcaagcattggctcgtcctagatggggcccacagagggtgctcgtgccattaaaccatacagcgtactgcattatcacacaacatcgagtcagagactaccatttaaagtcagtaaaagacacttcagcgagtcttgatccccgatccctcgctccatcaccacacacgtattccccgccatgcgcaccttcgccctcctgctggtcctcagcctcgcactggggagctctcctgccgtccacgccgcccgccccaagttcctgcagcccgagttctatggttccattgctcgccagctcattacgcagctggaggtcgactacggcctgaccccggagcaggcggaggtcgtgcaggccctgtacggcgatgtcaccgcccccgaggccgaggaagccattcaggtgagggcatcggccggcatgagccggcgatcgggcccatccggccgggcatggagagtgcgcgcgtgcaccggcccatggtgacatgtgtcccgtcctttccaacttcgcagggcgacttcgcctccggtgccctggatctgaccaagagcgaagccaccgaggccgcgcccgcccaggagtcgctcaacgtcctcaactccctcctcttcgccaaggctggtgatggcgacgtgccggccgtggaggacctcctgaatgtccaggtggggtgcaaggtgttgcgggcagcagggtgttctgcctgggacctgtcatggggtgaggtctggcaggccccatggatcacagctccctccggggtgccatctttgccccatgggcatggcccgccgctccgcaccaaacccattccccgtcctctcatgtccctcgccaggccgaccccaacgcggcggccgacggccagaccccgctcctcgccgccctcgtcctgggcaacaccgggctggccggggtgctcatctcccgcggcgccgacaccaaccgccccggccccgatggcaagacccccctcctggtcgccatcgccaactcctcggtcgcctcggccgaggagctgctggacaacgtgagtcgggccggggctctgcctgacgctgcggatctctctgacctgaagcacacaccctgcgtttgcaccgcgtcgggactcctcgtcgccgtgcgctgtccccctggcgcatcctcaactcgtgcacacccacgacacaaacgcacgtcccccggaccccccccctcttcccacgcatgcgcagggcgcggacgccaacctggccgacggcgagggcgtgaccccgctcctggcggccctggagggcggcgacgcagacatcgtgcgctccctgatcgaccacggcgcggacgtgaacctggcgggccccgagggcgtgtcccccttccagtgggtcctggcccagagccccatcgacgccgcctgggtgtcggagttcatcagcgccggggccgacgtcaacacccccaacgccgagggcgccacgcccctggacctggccgccggcgacgccgacgtgaccgcggccctcatcgccgccggcgccatcccgcccccggaggtcgaggcgccctagagcggccgggacgaccgggaccccgactcccgccagggttcgccgcgcgtcggcccctgagcaggcgagggcagcgccggccgtgcctccccccctccccccccctccac

SEQ ID NO: 18505 - DNA, 77 bp, Chlorella protothecoides
ccctcggcgatggtcacgccggcgagcagcttggacagctcctcgtcgttgcggaccgccagctggatgtggcgggg

SEQ ID NO: 18506 - DNA, 262 bp, Chlorella protothecoides
aaaaaattattatttttttattaataattatttaatttatcgggtttggagaaattttaaatatggtagaaccattattatcagggattgttcttggcttagttccagtaacaattataggattgtttgttaccgcgtacttacaatatcgtcgtggtgatcagttaaaattgtaattagtttttaattaaatttactaaaatctagtaacttgaaaaaatttaaaaacatactatactaatttatagcgtaaacaaaaaaa

SEQ ID NO: 18507 - DNA, 62 bp, Chlorella protothecoides
gaaaaataatacctgtacgtccatcaaagagttttatttttccgggatgttcaggctcaaat

SEQ ID NO: 18508 - DNA, 103 bp, Chlorella protothecoides
cgccaaccccgcccgcgactttggaccccgcgtcgcccactggatcctgcccatcccgggcaagggccccagcgagttcctgacctacggctggatccccgtc

SEQ ID NO: 18509 - DNA, 61 bp, Chlorella protothecoides
tgtattcattatttatccaattggacaaggttcattctctgatggtatgccattaggtatt

SEQ ID NO: 18510 - DNA, 91 bp, Chlorella protothecoides
ggcagagtcgtgaatcgaaagtcatccacccacatcccttatgactgacttccaatgcatctgaacatgcaaacgtcgaaaactcactgca

SEQ ID NO: 18511 - DNA, 78 bp, Chlorella protothecoides
gcacagctctgtgcggcgagaccagtctcaacgtagggagctgtgtcctcgacaggggaccaggcgggggcagggtga

SEQ ID NO: 18512 - DNA, 91 bp, Chlorella protothecoides
gtgagggcagtgctccttccctgggaggggctgacatgctctgcgcccggcccagccccgtctcaccctggttgtcgtcacccctgttgct

SEQ ID NO: 18513 - DNA, 86 bp, Chlorella protothecoides
agcctcatgcacgccctccatggcgtacccggctcctccaaagcgatgttgcatttgaaatggagaccttgcataattcaatgaga

SEQ ID NO: 18514 - DNA, 131 bp, Chlorella protothecoides
ttttttatatggtataaattatgatatgacgtgggatcaagtagagcattttcaagtatttattttttatagttggatacagccatctcctaatgaatcaattattccatattatttttttacaaaaaaaa

SEQ ID NO: 18515 - DNA, 71 bp, Chlorella protothecoides
gtgcctggccgccagagggcctggaatgtgaagttgggcagaaaagcacctgaaaggcggcttcactctgc

SEQ ID NO: 18516 - DNA, 61 bp, Chlorella protothecoides
cctttcaaaatagaaactcatgctcatgctaagattgaagcaactgcatgacgcgctgtcg

SEQ ID NO: 18517 - DNA, 181 bp, Chlorella protothecoides
ttgatataaaataattgtttcagcaattgcttgttttataaaaaaccttgaaactataagatctattaaaccgtgatgtaataaatattctgctgtttgaaaatcttttggtaattgctcttgaagtgtttgttcaataactctacggccggcaaacccaataagggctcttggttctgca

SEQ ID NO: 18518 - DNA, 61 bp, Chlorella protothecoides
gcaaacccaataagggctcttggttctgcaaaaattaaatcacctaacatcgcaaaactcg

SEQ ID NO: 18519 - DNA, 89 bp, Chlorella protothecoides
tttttttaatgatcgtgtcatataattagtgataaatttaaaatattatttatttttttacaaacaaatatttaaaggtttttaaaaac

SEQ ID NO: 18520 - DNA, 61 bp, Chlorella protothecoides
catttgcagacccccagactcgttgaggttggaggatcacagaggcatggctctgtaaaga

SEQ ID NO: 18521 - DNA, 75 bp, Chlorella protothecoides
aataaaaagatttgtcacgggcttatcgtctaatggataggacaggaaccttctaagtttctaatgtaggttcaa

SEQ ID NO: 18522 - DNA, 90 bp, Chlorella protothecoides
gaaaaacatacttgctccatttgcatgcatatatctaagtaaccatccaccttcaacgtctctcataatatgttctacgctcataaatgc

SEQ ID NO: 18523 - DNA, 61 bp, Chlorella protothecoides
gtcgtgtcgaggtgtgtgggttggggggggtggaggattctgtttgtggcaccgctgagct

SEQ ID NO: 18524 - DNA, 8267 bp, Chlorella protothecoides
  modified_base (4830)..(4880): a, c, t, g, unknown or other
ctccacccgcgccccccccccccacaccaccaccaccaccaggcctgctgacggaggtgtccaagttctcaaagtacatccagggcgtggccacgctcttcgcggacatggtccaggtgtggcttgggggaggcagggacgcgccgccccggccggcatgccctgtgccgcggcgccaggctctacgccgatgataaccccccctcccaccaccctgtttgcaggcggtgccgtactgggtggacgacgaggtggtgcgtgcctcgatgctgctgtcggccccggagctgcctgccgaggtgcaccccacgtgagcttgggggggggtggggggagggaggggcggaagatttcctttttagctgcaaggtgtcggcccctgggtcggtggaggggtgcgggaggagaccctgcgcctgattcctaccggagtccctttcgttgtgacgacctgcccgccttcgcccccacacccgcaccatcctccaacttcaccctgggcccccctctatacacacacgcgcgacacgcacagcgcgcgcgacctgaagatgggcaagcgcagcaagtcgcgcatgcagggcgccgacatggcgggccccggcggcggcgcgagcgcggagcgcgagctgcgccacccgctgctcggcgacgcccccacgctgcgcctgatgcccggcggatcggggcggcgtctcgacgaccccgagccctctggcctgctggactggtggttccgcaagccgcccatggcggagcacaaggcgctgccccccggcacgctgccggagaggatggagcccaagacctactttgccaatgagcgcaccttcctcgcctggctgcacatggcggtgaccatcgggtccatcgccaccgccctgctggggtactcgggagccacgcagagcgcgaagcaccccgaggaggtgggtggatttttctttctagtttcctcgtgtgtgtgtgtgtgtgttgtggtggggggaggggggttgggaggggtgcgtgttgatgtgagggagggggggcagggcagccagattgctttccaggcggggcattgaggccgcctgcccggcttcaaagccgggcgacagcctgcgtgcaggcagtgccttgacacccccaaatcccccatggcgcccattcaacctcccctcgccacactcccaatctccagtacaaacagccccttcaccccttcccaccccgcaggctgcaccccagtccgtccagctcattgccatcatcctcctgccggtggccctgctcatgtgcggctacgcgctcctggtctacctctggcgtaccaaccagatcgccagcagggccctcagctacatcgacgaccggaggtgggtcgtgggtggggtggggcgtgggtggccgggtgcaaactggaccgtgagggctttctgtatgcaaagcctgctcctgaccagcacatccctccccaatcccctctcaacctatgcaggggcccccgcgccctggcttggctggtggtggcggccctcggcgccatcatgaccctgggcatcgtcgacctggtggaggagatcgaggcctcgcggggcggctcgccgccgcccctcgctgccgccgccgccgtgcggcggctgctgggcgcctagagccggggtgcccggagctttggatgtagggcctgcactctgcaggctcaggtgcatggggttgcttgcgccgctcgagcccttttacatcgcctgctgccaccttgaactttggatcgcgtgttaatgtcgtgctgtctgtccgagcagcggtgtggcaggctgcacaggtggaggatcgctcggggttcgtgtcgaattgagcggaggaccccgtccggaggtcccgcctggcgccatgaaacactcctcggccgggcatccaccacatgcggcccttgcgaaagacaccccgaaggaaagtgacgcgctcgcccgtaattatgtactccggactccctgaccggccctagcatgagcggcgtctggcgtgttgggaatgctgaccctgcatgggtattgccaggtcaccattccggaggcttggcgcgcactcagtgcagctccacccatacccatccaaatgttgtgtattcaacgaagttgagctacaattatgctcttttcatgatgacccaaagtaaacatcatggagccgtgtccgcatctaagctcacttggagaacaggagtagcccggacggacggcttgatccgaatccccccggccccctcatccgccaacccatcacatccggaaacgcgacaggaggtcggccccaaatttgggtctggctaccatacgttgcagaattataacgtctgttcatcatgaggatgtgtcgaggccgcctaactctgcttgtggtgctggccgcggtggcgctggccgcgccagccgcggctcgcacagcaccattcctgcctcgcaacctcctgtcgacgccagacacatccatcgtgatcgaggtgtccacaaaccatatcgagtattccggggagtatgtcaacgtctcgtggtccggcgtagcggtgagtagattggtgggtgcccacgtgggtggaaaggggccgccgactgccttgtcgctgtgactgccgccgcgcggtcccaggcatggctgaccccaacgccgacccacccctgcagtcgcctgcagccacagacatgctggcgatgtacctagcggacaaggaccccaccaccagcctgcccatgaagtatatctggacctcgctgtcagagagtgccggcgccccaggctctggatcgtacaggtggggaggcagcctgtggcacagaggtaggggcgtcagagtcgtattcgggacttgatgctgcagtgccgggtggtttaatcctgcctgtataccgcggcgcttgtcatgtttcccatgatctcaatgcacgggccccattgccgcaccacagtttccaggtgtacaattactacgagcccatcaagttcctcttcctgcgcggcggcttcagcaacaagtcgttggtggccgagtcggagccagtgacggcgggcaacccccagcagcccacacagatcaagctggccttcaccgaagatcccaggtgtggtgtggggggtaggtgggtgcccctaacgctcagccgagagcccaacataaatgccaggtcccacggatgccacacgagaggggcggtggcgtctcatgcccgcgaccccactcgagaacgaacaaccccccctcgccccccaacctccaaactggcgcagcgagatgcgggtgacctggctgacacagttcgagggcgctccctttgtgaggtacggtctggccgaggacgagctggatgcccaggtgcccgccaacgtgaccacctacaccgcggccgacctgtgcggtgccccggccaactccaccggctggaaggcaccgggaacgatcaacagcggcgtgatggccgacctggagcccaacacccgctactactacgtcgtcggggacgaggtgcgctgggctcacgcagggtgtaggggtgtctgtggggtttgactcattctcaaggatgtatacaagtggtggctgccgtggggaaggagcgctgcgcaggcacgtcctccctgcggcctcccgagcactatctccaggggcgtcggagtgtggtctctgggagagtgacgcgcctgttcttgtgggagttgttggcccgagccaatccttggactcggccgagcagcccctcaccctgcaaccctcctcaccccctcccgcaggctgccaacacgaccagcaccgtcagctccttcatcagcgccccaggccccgatgacaccgtgaagctgctggcctttgcggatgtggggcagtacaacgaggacgggaccaagggctttgggtactggtatgacacctacggcctgtttgacgaggtctatgccatcggcaccctgcagtacactgtgagtgctgctgtggcgagaccagggttggtcatgaggggggaggctggtatggggagacaggtgccccaggggagtaggatcgacccggggccatgggtgtgaggcactgggtcctgcccatcctccacgcccgcgcacgccacaccacccacctcaggccctgcaagccgtgctggtgacgctgagtcagcaggccgaccaggacggaaccatcctggtgtaccccgcgctgatcgaggaggccagcaccggggagtaccactccgcctggcacaatggcgatgtgtcatatgcacgaggcatggcgtggcaggtgcgggggttggggtgtggatgggctggggggtgggcgcggctgggtggggggggacctgccacatgcaagcatcacatacttgctttgagtaatggggagaggagggccgaggacatgggacctgtccccagtgcggacatttgcacggttcttttcatgccggtgctcttgagcccctcaggagctcatcgggggcaaccccactccaaccacctcggctgcagtgggacacctttgggcacctcatggagcctctctccagccgcgtccccaccatgtattctcctgggaaccacgagtacgactggccaacggcgcacgactcgcaatttgcagaggccattgacagcggtgaggagggcgcacaaaagtgcgggattggggctgtcaagggaggggaggcatggtgccaacatgtgcaactaaccgcccctccgctgcatcccgcatcggggcaaggcctctttgggtctgcagcttgccagtgctgctgctcctgggaggagcgccgcttccagataccaggggaagtaaatggtgacccccccccccccccnnnnnnnnnnnnnnnnnnnnnnnnnnnnnnnnnnnnnnnnnnnnnnnnnnnggcgagtgtggcgttccctacaagatgcgggcccccatgcccactgtgtcgagcgacgacctcttctactccatcgaccatggtccaatccacttcctccagctcagtgagtttggcatcgagagtgggggaagaagagctcttattgtgcctgagatgctcagggcttcttgtggaagtcatgctagtgggccagggcatctgccatgggtgcccctgagtgccaccgtgcatgaaccgccctgcctcgctgctgctgataccatgccctccccacttttcccatgccctttgcagacacagaggctcgcttcgacgaggactcagagcagtacaagtgggtgttgggggggacggtggaggtgggcttctcggccttgcaggggcgccggcgccctggcggatgtgctgcaagtatcaacgcctgcccgtacatcccttgggttgaagctggaggtgattgggccttgctgcccgcaccctacgtctacgacccccatctgcccatccttctcaaccaggtttgtggtgcgggacctttttaccgtggatcgctccaagacgccctgggtggtggttggattccacaggatgatgtacacaggtgagggggggaggtaagagcgcatcaggggtcacatagtgggatctgcggggagggctggagcctgcagctccatgccacatccccttccatggctgccgtcacctctactcatgtgtgctgatgagtgatgcactatctgggccccggccccctcccgctaattccccctcccaacatcagatgccttcgatggcgtgtcagaggcctccgcccagcgcgtcgcggccgagatgcgcgatgtctttgaggctatgttcgtgtactttggcgtggatatgacctggcagggccacaaccatgtctaccagcgcacctgccccgtgttcaacaacacctgcgtgggctacgacaaggagggcgtcgcccgtggccccatccacgtcaccatgggccacgcgggtgagggggtggagggctgcggtgcggcgcggagaggggtggaaggaggggttgcggatggggggcgtggcgcgatttgcagtgccaggctggaggacatgcaggggctgccaccaaggcgccaggccacgccgccgcctcacgcgccctgcggcggccagcccacccccccgcctgcccgctcacccgccgtgccgcagggttcatgctgtcgcccagctaccagccggtggaggcggccgcctttgcggacacgccagagctcgccttcttcggctactgccgggcggaggtcaaccgcacccacttcaacctccaggttggttcagtggcactgtgttcccctgcaagacaggggttcactcctcaccggcggagcggggccaggcaccgcagcgtatggctccttccctcctcccctcggtgctgggggaatgtgccatggaatggacaacacccggccactggagtcagcgcctgcccctgacccccctcccacagatgctcgacgccctcaaccagaccgtgcgggacgagattcgtctctacaaacccctcggctgggagctggacgtcaatgcaacccaagcgctcatttccgacacgcccggcgctcccttcactgacaaccccaccaacgctgggttcaagtacatcatctccaccatctttcccaagctcctcctgtcggacattgtgggtgcgctgtccatcataggtcaaggtgcgcccatgccggcccctgggcacaggctgctcggcgacgggagaggggggaaagggaaggtggggcggcaggggtgggtcccacgcccgagtctgtgcctccgcctgctcaagcccctgccgccgcctgatgcatgcatctggattcccatcccccatggcttcatggtgagcatgccctggccccctggtgtaccaaactccatcctgcgcaaagtcagcccactgtcgcctcacaggcacacccatctacgcgaagctgaacgcccacccgagccgccccatctctgccgaattcatgactcaaacggcgcagtccgtcatcgactttgtgacccccctggtcaacgccaccaacctccaggtacacctggcctgtcgccggtttcctggcatgcggtgcctcgcgtgcatgcatgcatgcaagacactctgccgcgcccagccgccgcacgccggtcagcgcgacccctttccccggtcaccctgcgcaggaaatcgcgggtgcggccctgcccatgagcgccgaagccatcatggagagctttgattgggtggcatctgcctggaagggtcgcatcgctgagctcgtgggggcacaggactatgcagaggcataagatgtagatgtgcagcatgtgcgtaccagtcaaccccgccgacccttttcccaagtatgcgctacagccttgtcccagcacaagacgggctcatagctccgtgctcgattgtaacccatcccatcccttgcaagagagtgtcattggggcagggtaacctcaaggccacgttttagagccaggggcgaggtgaataagctggcactcttcctagaacaagacgcttagggcatgacgttcctgccaggaaaagacccccgagactgggaagcaatggggtcatggatccttgttcctgaggcgcatcggattcagattctcaactcgatgctgctctttagtgcaaccacctcgatcagaggcagcggggtgcccttgccagtaagtctgagtgcagcatcctaaaagtcagtattcacatcctctcaatgattggaatgatatgacagatcacgggcgcatgggataaagcatagaaggtgcacctcagatacctcgagaggcggcacagactgcgttgtccaccagtcttcgggggcaggccgtcaagagtagggcgggtttgcatcatcgttgtgggcgtgggagcctcatcatgctggtaattggaagcatagatgcagacacatagaggagtatgctggggagatgtggtctcctgctatgcactctgagtaggtaccgggggatcgtggatgaggagaaaaaggaacgggacctgaaacataccagccataggttgccagagatcagtgacacaaggattgctcattgtcaagtgacatcatcagggaagtgctcggctctggagaggcggccattgatgcatctgtgctcaggtcttgcaatactgtttgagcgtcacgctgggtggaaggaggacaacatccaagcagagcgtaggggtccccacaggacagatcaggaccagcgtaacagagacgagggaagtccctctaggacaattcgatggtgggggaggcggactgggagagggactcaacataggcgaagggcttggcgaggggctggggc

SEQ ID NO: 18525 - DNA, 73 bp, Chlorella protothecoides
cctagccctgtagcgatagatcggaggctgcgttccctccatctcctttggggtctggagtttttctgtccac

SEQ ID NO: 18526 - DNA, 61 bp, Chlorella protothecoides
gcagcgcttcctggacgcgttccggggggagggctaccccgaggccttcatgtaccgccag

SEQ ID NO: 18527 - DNA, 74 bp, Chlorella protothecoides
ggctaccccgaggccttcatgtaccgccagaaggtcctgctcctgttccagaaccgcgatggcgtggacctctg

SEQ ID NO: 18528 - DNA, 84 bp, Chlorella protothecoides
tcgcttattaaaacagcatcttcaaaattataaccttcccatggtaagtaagctataaaaacatttttccctatcgctaatttt

SEQ ID NO: 18529 - DNA, 61 bp, Chlorella protothecoides
ttttttgtaaataatacttcgccagttttttcaaaacaaacaacttataaaacttcttata

SEQ ID NO: 18530 - DNA, 65 bp, Chlorella protothecoides
cgcaaatttagtatctaaacctacagtattaattgctaataccaaaataaatcaaaaaatttgcg

SEQ ID NO: 18531 - DNA, 223 bp, Chlorella protothecoides
catgctcagttgcttcacgctcggccgcaaattgcgcgattctgtcggccatatctgggaggtagcctgtctagggcctgccatggcaccgtcagcgtagactgtagcagcgcgggtgatatctcgtagtccttctcatgatgaacctcctcgtcgtcgcccgcaggttccgctgcggcgttgtcctcctgttcctagcaagatcgggaaaccatgtttccga

SEQ ID NO: 18532 - DNA, 16321 bp, Chlorella protothecoides
ggggtgggggggtgcggggcgcggagcggcggatcgctgctactcccattgccagcaggcacctgtgtgccatgctgtctcagaccactcccatgtacctgcccagcgtgcagtgttttgaagagccaacatccctgccatcagccctgccaagccgcctctctcccccacccaagcccacctgctgctctccccgatgatcatgccctcatagacgtctccgccatccccgacgaagaggtcacccctcgcctccagcatgcccagcgcatacagcgtggtgcgcccggtggcggtggacaccagcacgcccttgcgcacccggtccaggggaccccggtactcgtcataccggctgaaggctcggtgcaggaggcccgagccgcgggtgatggtcgcgaaggcggacctgaacccgatcagaccgcgggagggcacatcaaaggtgaggcgctgcttgccgtccacctccagggggaccatctccgtcatctgttgggggggggaatagggaggggagtcggtcagagtagcgggcggtgacctgcttcagactgcgggcatgcaggaacttcgaacctcgcatgtgtcggggtgggctccccaatgggccaaacacaccgccagccccgcgcctcacctctcccttccggttggacatggcctcgatgacctcccctgcgtgctcgtccgcgacctcgcagccgacctcctcgatgggctccaggcgcctgcccgcctcctcccggaacaccacgcggggtggggacaccgacagctcaaacccttctcgccgcatgttctctggagatgggggaagggagagaccgtcgagggtggactcactggcctgcagccacgcagaggcatcctctcctcttcagaacaccgagccctcacacggactccgcaccgatgagcaggcccagctgcagctccccgcgagcctgcacctcaaacgcctcgccgccgctcgccgtcactggcagcaccctgtgtgcgagagtattgggtggtgatctgtgaaagcagcagcctgccaggctccagtacggcgatgcgcccctgcagcctaccaggagcctgggctcggcgtaggtgattccacccagcgccatcaccctgcacacacacatcctcgagcccttggaaccctgaaacccgcctgcccaggttggacaacctcagaccgctccctctgccctcccaccccctgcccttcccacctcagggacacattggtctcggcctcctggcgcagccgctcgccgatcttggagcccgtcagctgcgtaccctcccgccccgccagcggggaggtgtttggggagatgatcatggagagggtgggggggtccacctggccgggcggtagcgcgtcggccagacccacatctccaatggtgtcggccacgcccgcgatgggcgcgcccgcgatgctcacgatgtcgcccgccaccgcccgctgcagctccagcgtcctctgccccgagcgcttgaacagtttggtcaccttgaaccccatgtgctcctcgcctggcacaggcgggggtgagtgggtcttggattcaaggggaaaagggcggacgctgccgcacagccagctgggcacgcggtcgacgtggagagcaccaaaccttctccccgcgcccactggtccatcacaccctgcccaccggtgtgcttgatcactttgatggcgtcgcccacggccacgctgcccgtggctatcctgccggtggacacccggcccaggaaggagtcacgctcggtgagcaccaccaaaaagctgaagggctcggcggagcggtccaagggggggggacgtgctcgatgagggcgtccagcaggggccccatccctcccgggggtggcatggcgtcccggggcaggagctcccggctggcccagccctgcgagtgcgtgggtcgcagagtagagaggcaaagtctgctggtatccagaggctgtgatggcgtgccaagtcatgagtgatgggaaactctatgtgggcacagagtagccggcgcctcaaattcacgccccacccccccctggagctcccacatgccccggctctgccctcagggtcgcacctcacgggctgaggcatacaggaccggaaagtcgagttggtcatcgtcggcgcccagcagggcaaaggtatcgaacgcggccgactccacctctccacaccgctctggcgtcgccgccgggcgatccaccttgttcaggaccaccagggggcgcagaccccgctggagggccttctcgaccacgaacttggtctggctcaggggtccctccgtggcatccacgagcagcaccgctccgtcgaccatgcctagcacactgtgtgagtggagggtggcatggacgatgctggtattttatgtgatgagatggtgggcagccaccgcttggtgacaccgcaggcacatcaagagaaagccatgccccccatcttcacaagaaaatgtatattacacccaacactgaaagctacaacatgtggagagcctttgacacctgccaggcccagtggcaagctcaccgttcgacttcaccaccgaaatcggcgtggccaggggtgtccacaacattcagcgtgtaacccttgtgctggaaggacgtgtattttgaagagatggtgatccccctgtattatgtttgggaagaggtgaaacagtagcctggagcttggagcatgggaaagacatactctcgcgataattccttgcgaggtccaaggggtaattggtcagcatagtccagtactgcagggctgatcaggcatgttcattcaccatgccgcacctctccttctcgaggtcgttggagtccatggcacgttcagagctgagggtcccccccccagaggtgaggagcttgtcgaccagggttgtcttcccatggtccacatgggctgcaccgggcaagcggggcgcagagtcagcaagtcaccaagcagggcaccaatcccggatcatcagggcattctggctccggatgcccatgatccccagtgctgcagtttgcaggcctctgagcctcatataccgaccaccaccagcactcccgaggtagcacccaccaatgatggcaaaagagcgaatcaagtttgggtcggttgtagagactgttgtgctgctgtatctaacatgatcttggcagggtgcgcatcctcgaactgagtggagctccgtccgcaagcctgtcagcggggccgtgtgcggggttactgcacgccacagttgctgcagagccctccgcatgcccattgcgtgtatagtctacatgtaatatgttaatctgaactttaaaatctgcaaactgagccgactgctgaagcacgaccgcatgcgtaattttcgagttacacgcccaaacatgcggtgcatgccgtgcagtcggctcccctccagagcagtagtctcttactgaatctgcagggagtgaaggtaagcagatcatggtatgccttgctgactcgacatggttgtacaccatctttgtgccaaccaccccaacacctccttataccttgagcagctccacgtcgaagatctgccggacaagggtgaattaagaggaaggatcagaatcaaagaggtcagccatggaacctgcatggcgacgtgttcctcctggggcaggggcgcaacacctgctgcaatgcacattcatgttagcacggtgtgggcctcaccagggtggcgttgggggggatgacgccgccggcaccgcgagctccgtagccatagtcggggctgatggtcagcttggcgcgctcgccgatctgcatggtcgccacgccctcgtcccagccctgtgggtgtaggaatgctggaagggaatgaggtgctgtcggacaagtgaggatgccaagcatctacagctcaccatcctgcaaggttggcccccaggtgcttgaccctatgtgcttggcctttgatgggaccggaggcaatgccatgcctttgtcactctagtcacgtgatcctccgcgtaccttgatgacctggcccacacccagggtgaatgagaaaggctgcccgcggtcacggctggagtcgaacttgttgccgttctccagagtgcccgtgtagtgcacttgcacctgatcagatggcgagagttgtgcaaagcgtcggtgcacgacgggcgtgccgcatgtgcgtgggcaggatccactcacgagcatcgtgctcccgacagcgcgcacagctgctccccctcaccttctgactccgctcgggcttggcaccgctcccggctgtgatgacgtccttggtgacaccctgcgaggcagttgtggtcatgaatccccgactggcacggacagatccctgcatgggacactggctcaggaaccgcgcgggacgggcagcgaggcggagggagccgccgctcaggaaagccgcacccaccatgattgcttggttatatacttgcagataggaccgtacgaggatctatgtagaccttagggtgccggatggtgacttgatgggtggtggggatccgccgatcgatggattgcactcaggcatccgcgcgctccagactgcaacaagttgggggcacgcgaccttgcattggaatggcagcacccacggcagagtcgagaatcagcaaccatacagtctcattcaggcactctacctccctccttcccgacgcccctcctccatatacactccctggtccagtggtgcatgtcggaccctcacgcttcgcgacctgtggagaaactcgaggttcccattgtcaccgctcttggtgagcatagatacataggtggtatttacgcgccctgctcagccatatggctttcgatgaacaccttcgtctcgaataccctttgcagacaggaggctcactgtagaagacgggcagaggtccctgaccaaacctgcaataggcgcagtgccacccagcgccttgctttctaggttgcaaggattcctgccagagttggcggccgcaaactcgaccctgcatggcgagcaatctgtcagcatggaggccccagagtgagtgagagaccccgaaggatgcttgaaagagaaacctgtcctcctgaccttaaggcatgcgtttctttgagtactacgatgatccatcccgtgctgtcaaaaagaggaacttttccacgctccattgcaggggagctgacggtccagtggtcgagctagatctggcgtgcgggctctttgacctgaacaatcaggcagcagagcaggcagctgagcgttcgctcacgcatggccaggtgaggacgggtgagatcaggctttactcctggagtagcttgagatgagtcttaggagagaattcctcatgcagttcagcgcattatgcagtttgggtcgagcagagtcgattggcatgcatgagattgtgcttagtgggcaaagttcacctctatcatctgcaggctacacccaactcagaggatgattccagtgatgatgatgaggaggagagcagctccgacgaggagggtggcgcacccgagcggcaggaggctgaacatgcagctgcggctggcaggagtgatggcgcaaggaggcgaaagacggtgcaaagaccaaaggctggcatcgaggaactgtcttgacctgatctggacaccactgtgtactccgcggggatgtgcatgttctccgcgtgtgtgttgggacgggaccccaagcttggaggggccagtatggcaagggagcccagccccgattgcatcatgtggataatgccacacccctggaagctgaaagtgatgggtccccctgcactacgccacatgtctctccctggtcctccacaatgaaaacgatcgcatgcgccggctgggccagccagcggctcaaccgcccacatggacatgctcacccaaactcatcagtcctcgcgccccgccggccggccggcgggatgggggcctgcgccggccacgcaggcgcccgggaggccgaggcccgccagcctgctccgcatgtaggctgcctgcgcctcgagccctgcctccggccagtcgtagaaggggacggggagcaccctccagcccatggccgtgagcaggcgccgcttcagcgcggtcttgcccagcacgcgccgtgacgcccaggggaagtgggtgggcccgtccacctccaccgcaatcagctcggtggggatggcgatgtcgatggagtactgtccctcccgccactcctccatcagcggcgccaggcccagttcctgcagcgcggcaaacacctgcggggagggtgatgggatgcagtgctgggcctgtgcaatgtcacgggcatcccagtctgcccctgccgccgaggcgtgacctcctcaagcgtcctgaagggagcgctgtcttccagctggttgcgcctgccacccactgcgcagccggcacctgtttctgaagcgacgatgtgtggacagccccgcgcctgcgctggccatcccactccttggacgccatgttcctcagcctcccagcctgtgcatggggatttggtacttcttctcgcttcgcaaggccttctacagggtgttgaaaaccagactcaaaggatgtgcacagcgcctacctcgtacagcccctggaagaaagatgcaaagtcttctggtttgccgatgcctggggagcaggaggggcaatgggcttcagtaactccccccggggaggaggggggtgtgggctggtggattggcctgtgggaaagctacacgtccacttcctccatacgacatgccaggagcatacctgacgctgaggcagcttccagctggagggctgcctccaccaggaagagcttctgcaggtcctggtgcgagaggcgatgggcctgcagagccagagccaacctccaggcgctgaagaactcgggggggtacagtcccgccacacagtagctccaggccaggttgatcaggtgctcgcaggtcatcccatgcaccgcctgtatgtgtgagagaggttggtagggcagggcgggatgaccgtgtgcatgcagctggtagggtgaggagctcgcatgagcatactcctgacccagccgacgagctcacagcacagccaaaggaaaccctccttcccacccccccaacacgcacccccccaacacgcaccgctgtgcaggcagggacagccaaacggaagagctcctgctcgcgctcgccggagcacctgcccagtgtggcgtacgcccccaggaggagcgcgagggtgcgtgcctccggctgccggcggctgaatagccggcttggcgcgagcctggcgacggcgtcgaagaaggcgggggcatcaaaggatagccgggcgcaggcccagcacagcttgctcaccgcctgcgaggcatttttgggctactgaatcaggcatggagctggcttgcgaaatggagaggatggaagaggctactacgctgatcgctcgcccgatgccattcccaccatgcccccccccccccacatggggccaaatggcatgagcgtcccattatatcaacacgtgattccagccactgacttgcacgtcccagtcgccctcctgcaccagctggcaggcccggtccgtgatggtcgtcagcacattgggccggcggtgctgcagcgtggccagggcccaggccacggtggtgacctcgtgcgtgcccgcacccggcaccagccgggacaggtgcagcaggagcgcgtccagagcacgctgcaggtgcgtgtggcaggccgcccccggccccgccacggccgcgtggtgcagggacagggagcgcagcaggcacgccgcgtcgcgggcggacatggcccacgccgggccgtcgtcgggcgagggggggtggctcgccaggaccatggccgcggccccgaagacgcggtgcccggccagctgggagtctgccagtgcctgtgcaggggcgagggtgggggaggattgctgtctagcttgaactgtaggcgtcccaggcagggtcgatgcagagcagggcagctcttgtgtgggacgcaggaggcgtaccgggcacccagatcccacaccagccccctccgctgtccagagccatccccgcgcccacctgcagtaggttggccaagccccgcggacccaggtcccgcagctggcggccgtgcagcacgtccgcgacgtcggacaggatgcggcgcgcctggtcggcctcgcccgccggccccggcatgcccgccagcgcccccaggctccaggccagctgggcgaggtcgcgcgaggtgtgctgcctcaggcctggcgcgcccttgcccacgccgtccccggccaggctctggagcaggggccccaggaaggcgccgggccggcactccagcttggccagggaccagacgatgagcactgtctcgcgcgcacccaggctgggcaccagcgtgggggcggctgcgcagaggaaggccagcacgacctgcagcgatccagggctgagcagggactgcgaggcctgggaccataggatctgggccagggcggggccgctgcgtgccatggcatcactgcaggcggcgctggccttcagctcctcacacaaccgtgcctccagcctgccaaagtgggggctgacggcgactcgacgccggtgccgccgtgtcatcgtctgcggggcaaaggagtgggtcctgctggagtgggtgggcccttggccatgttggagggtcaggctgtggagatgtgcgcgtcaagcgagggaccgggagcttgcacaccgctcgcgctgcagctctcgaggctgacatgctgcagactcctgcaccctccaacccattccttctccacccagcgcccttgcccctgctccctcaggctctggccggtggcaccagcgtgcaccccctcaccttggccaggcgatgcagagcggtggcaatgttgatcaaggagaagtcggcggcatggtcctccagtacacagaggatggcactgggacctgtggctgccacgattttggcattgatggccttggcactggagacccggtcagggcctgtggcagagcccgctgcagcaaccgcttctgtgacggctgtcacaagtacagccaaggtttgaggcagtgggggacgccatcccacaaagtgggcatcgctctgcaagagtgttttgggtgcacattttcaaactctctggaactggcatgtacaggttacaaagagacccccaaatcatggtcaggctacgatctaggaggactatcccacaatcccagccaccagcccgttctatacgcttgtctcgtcgacaagcacaaacctggcgattccacagcgaggatgatccttggagtgaccccaccaatggtttctgacatggctgaagcgtgcaatgctgactgccagggacattggggagggcacttgaggttcaaatctatacgtaatttgtcaacggtcaggaaaaaaggcaccatgcaatgcatatcgccgatccacccccctcatgagtccgcttgccaggagatgggggtgcatgctgacaactccatgctcccgagctattcctcctcccgaccgttgcttaatgtatgcatgggcaatgtgatgtaaataacgaccaaacttctacgtcccagtcaatcgggatccaggactcgccttgcagaattgctcaggaagatcgtgtggattttgtcccccgtgcatggcgcagcgagtcttcacactcgtatggcaaggcgtcttcaaactcctccctaccgatcacagattagtagtctgcaccacttgagaggtacatatataatcctcgtatttgggcatgtagtccaactcgctcaaggacacgggcgtcaaaccctgaaggacccggagcgcaacgcctcgtcggggacagtgcagcgcgggtttttcattgcagtcgggatggctccctgctaagacctgcgcattggcactcgtacaaggatgacggagccgcagccgttctggcacggcctggccgcaggggcctgcgccactatgacgtccagagtcttgacatgtgagtctgctgctcaccacaacatgctggtgagatggaaggtgtagtgatgagaggacatgagcacacatcgcctcagccggcctcactacctccgccttccacagatcccccagacacgatcaaggctcggctgcaggtgcagggtgcagggcacctccccaaaaccaacccgctgaacaccttccagatgatcagccaggtgggacaccctttcattgggatagtgcagcgctacactgggatgccaaggttggaatttcaacggcccttgagacctgccaggagccgtctgcttgtgcctgctttgctgtgtccagcccgccgatgcttgctggatagaggggtaaagccgcctttcctgcccaatgcaccagctcctcaacacccctcgctcccatcccctcatatctccctgccaggtcttccggacagagggcgtgcgggggttttatcgtgggttcgggggcatcatgctcaccgtcatccccgccaacatgtgctacttcagcggctacgagctgggcaagcgcatcacacccccaggcctgggggtgctctctgacgtggccacggcagccattgcacagggcgtggcgggcatcgtgtactgccccatcgacatcgtgaagcagcgcgtgcagaccgccgcggtcatggaggcgggggccacccaccgtcagtttggggtgctggacgcggcccgccagatatgggctggccagggcgtcaagggtatggcgcagggattgggttggcgattggtgtgggaagagtgagctttgtaggcatgcgtgcacagtcaggcaaagctcaaaaacgaatgcgatgctgcgtcgctctgcggcagggtggacctggcctgtgtgggcagggggcgttgcaggagcctgcgaccaccctgggaaccccgtgtctaatactacctgtcaccagtattctctcccctcctggtcttctcatcactacaacattcccggagcatcccacatgcacccgcccaatccaacctctccaacaagccccacccacccaggattcttccggggatacctgaccatgaacgcgctgtggatgccctggaacctcatctacatccccgcctacgaggcctgcaagcgacggtggtattatcacgctctggagaaacagcgcactgcggccagcagtggtggtgcactgcgggcccccgccgccgacgcgccagccggcgactgccagcccggcattgccgccgagaccgaccccccgctgcagcagctgctccccatctgggccttccccctgtgctcctcggtctgcgcggccacggcggccatctgcacccaccccatcgacgtcgtgaagacgcggctccaggtgctgtcggcagccgacccgagcgtcaggcggggcgccttccagatcgcgggccagctgctgaggcaggaaggtctgcgtggttttaagaggggcctcggcccgagggtggtcaccatggcagctggcagctccgtctcctggtttgggtacgagctggtcaagcggaggcttttggagtgggagcgagatcaatgactggaagccgcaagctcacacaggcatgctcctgtcttgccccgcctgctgcctgcagagcggggcgcgctcttatgatgcacaccgattcttgtacctgcttgctgtcgctgttccttttgccatcccttcttgaattcctgcttgaatgcatcctacatgccgaaatcagttcccgcatcaccacgctaaaaatgcatctctggcaagtgccgtgagctttcgtggcagtctagacaccgtgtcacatgggcaagagggagaaaggtgatcgcagcaaccctccagatgcggcgtcaaacaagaggtcaggacttgaagttgtacatgcccagtgcacaggcttcaccaggggatgcaaaaaagtgcttgccggcgccctctggctcattatcaacacgctcacatcagacatccttgcggggacccaggatcatgttcatggtgcggccctgcatgctcgggggcgattccacgacgatggccgaccccaggtcctcgatgatgcgctgcataggtatgggtgtcgagagcacgtggtaaaggatctggagtggcaccctgagcactccggcagagtagttgtggtatgccagaggcacaggatgcaccaccccaatccctcctggctgttcgctgtgccagtcctgcttgcgagctcaccttgcacatctcgtggccctggtctattaggtccatctcgcgcccgcggaactgcagcgacaccttgaccttgttggacttggacacaaacctctgcgcggctcgcagcttggtctggtaatcatgcacgtccgtgccaggccggaacttgagttcctttgtctccgtactgcagtcgatgtgggggcggacgtcagcggggagtggcagatgtcaaagcgagaaactcgggctgcagcatcagcctgtacaagcaggaaccctcaaccaacaggcgatactaagcacgccatctcacatgttttcacgctgcttcttcttcgcatccttggccgccttgcttagctcatagttgtacttgctgatgtccatgagcctgtatcggtgataaggatactcaacacaaatggactggcatgctgtacctagagcaaaaggctctcacctgttaatgcctagatacaagctccaggtttcgccggcagcaagatctatccccagcccttgcaatgcctcctgcgtgcctgcagacaggcggtgatgcgtcggggactaccaagatgaggtccacctcccgctcctgcgccatggccagagcctcaaacgtctggaacacacccagagtctcccggtcttcatcgatgactcgcacctctcgttccctgcggaggtgatggcacggcatttatggcaggggcatcaagtcgattcaagagtctggcattcctctgagaaagcctccaaggctcacaccatcatacgattgtgaagcaatacacccaccgacttgaaaaccaagagcaccttatctggtcgttcactaagacaccaggtgtgctctgtctcctgtctctgaaggatggacccccagatcgcatctgactcgggggacggggtggtctgtacgaggagtttgcccccgccatggcgatcgtgaggcctcgggtggcccatgacgtccttggctgtgcagggccctgcggacatgaggcgctgttgctggctacctgcgaatatcggcgtccaagggtatgcataaaatgacaattataccaccgggtagctcgagccagcgtgcacctgcaggccaccggcttgccttgagatgggctggagcgacaaaaggtcgataagcaccccgaggaactgtccctgctgcatccgtgctcgccaagatcgacattttcacaagaatcaaattctctatcctgtcatgctgcccatttagagaacattgacggttactgacatgcctcggattgattggcaagatcgatcatcaagggtgcatggctgtgcttcccgccacgcgcttcgacactctctgcactccccgggcgccagaggagcgataaaccgggcggcgccaggagccgaatacaggacgacagacgctctggaaaactgtaggcggtattgtatcgaaggtttggtataatagtcttctgggcagcggctgccactcaccgcgccgacgcgcgtttcggcgcccccggcaacatgccggtgtacaacttcaagagcatgggcgtggtgcccactgcgaaagacctagtggatatcgtgctttcaaagacacagcgccagaccccgactgtcgtgcacaatggtagggacggcggggtggcggtagtgccacgaggtgcaggtgtcctgcctgcttggaggcgactttctcagttggagtgtggggcttgcctttaacacttgcatagtggagtctgatggcctccatccctcctgtgcacaggctgggccatccagagaatccggcagttctacatgaggaaggtgaaacacacacagaccacctggcacgagaagttatcgaccatcctcgaagatttcccaaaggtgccccatgggtttggctgtgtcctgaaacagtgcagcatgcatgcaccgtgtgagccgggtggggctggcccggcgcgtgcatgcacatgcatgcacctgccccgtgcggccactctgtgagctcactccccgtccccacgccaaccaggtggacgatatacaccccttctactccgacctcctcaacgtcctctacgacaaggtgactttttcgttagcgactgcgtacgtcctcagagctgagggttcaagcacccattttcagagctcgtcccctcccaaccactgcgtacgccccgtccgatgaactgctgacttttgcctaaacccatggtgacccgtcacccactcatcattttgagcgcaggatcactacaaattggccctcggccagctcaatgcggcacggggaatgatcgacaaggtttcccaggtccgcagcagcagaggcaatgtgttctggggcggcttactcaggactccctcgccacatgaggaggccctgtcatacaagcttgggcacgactcacaagtcttgtccccactccctcctttcccggcaggactacgtgcgcctcttgaagtacggcgactccctctatcggtgcaaggcgctgaagcgtgctgcgctggtgcgagagcatgttgcggctcatgcacgctgagtgccagaccctttagtgcaaggccttgagcttggggaggtcagggcccgtgtccggcatgtgcagcaaagtattgcatggagtggtggatgccgcctgactcaggccctcccttccctccccagggtcgcatgtgcaccatcatgaagcggcagggtccctctttggcatacctggagcaggtgcgttctggcttgcattgctgggtggggagtgcggaacgcctgcatgcctgagcttgagtgatgcttcatgcaccgcagcagtacctctgtcgcatgcacacgtgcccccacctgaggtactctgtcatccaggtccgccaacacatgggccgcttgccctccatcgaccccaacacacgctccctcctggtctgcggctaccccaacgtgggcaagtcctccttcatgaacaagggtgagctggcgctgggctttggggacacacccggtccactcgagcggggtacacctgccgaggggtagggagggtggggttcgcaagctgcgccgtccatgccgcaggagccccactcttgagcacctgcttggtttcgagccctttgcgcaagtcccggaccggactcacacgccaggcaaccgcagcctgatgagttgtaggtgccacactcccacccatccattcagtgaacgacctccctctcccctggccccctggccctcgcagtcacacgtgccgacgtggaggtgcagccgtacgccttcaccaccaagagcctgttcgtcgggcacaccgactacaagtacctgcgctggcaggtgatcgacacgcccggcatcctggaccgcccgctggaggagcggaacaccatcgagatgcaggtgcgcaggggagggctgccgagggtggggacccttggccgtatacctgttagtgggccttttgggggaatgtcctgccccctgccatctccctgcctgctccctttgcacccctggtcccaggcactctgttcaccatgccctggcgcaaaccacccccttgcccgcctacccctgccactggctgatcccttttgcttggccccggaaccccatccactcaccgatcaccccaccctctcacccaccttcaacacacacacacacgcccatgtctaaccccccctgcctacccatccacccacccacaaaccgccgcagtccatcaccgcactggcgcacctgcgtgccgcggtgctctacgtcatggacatctctgagcagtgcggatacactatcaagcagcaggccgcgctgttccagtccatcaagcccctgtttgccaataagccggtcctgattgtggccaacaagacggacgtggtggccctggccgacctgagcgccgaggaccgtgcgctgctggacggtgtggccgctgaggccgccaaagtgtcggcgggggggttcgagggtgacaagcccgggtccaacctcatcgccatgagcacgctgaccgaggagggcgtgagcgtggtcaagcagattgcctgcgaccgcctgctggccagccgcgtggagatcaagctgaaggtgggtagggatgtgtgtaatttccacgggccggggggggg

SEQ ID NO: 18533 - DNA, 457 bp, Chlorella protothecoides
cacaaatgtgcaatgtataccagggtgtcaagggatctgtcaattacaagaaatggattccccctcgacgtaggacttcctaaaacatctgtgtccctcccctattgccctgcaacaattctgtctatagcagggtatatagtctaggttgcaatatgacggtcatcgttgtggtacctgggcaatagctgcatcccggaataagcatccactgagagatatcatcccgcgtttaatattgtaaagccgtgtatcatgcaaatgtatgagagaataggcgtgactccttaaatgagcatcctttcacgtagatagtttgtttgcggcctctctggagtacacgatcagtgacccactatcgctgagtaggtggtgagggtcaatactgggagggatgcttgaggtccaaacattatccctgtgtattcctttactcaagggtgaggcaaggtggcat

SEQ ID NO: 18534 - DNA, 61 bp, Chlorella protothecoides
actaataccataaggatctgatacccaaataccaggaccaaataaaccagttacgtgaaaa

SEQ ID NO: 18535 - DNA, 23709 bp, Chlorella protothecoides
  modified_base (399)..(408): a, c, t, g, unknown or other
  modified_base (809)..(818): a, c, t, g, unknown or other
  modified_base (1441)..(1450): a, c, t, g, unknown or other
  modified_base (3401)..(3410): a, c, t, g, unknown or other
  modified_base (3495)..(3504): a, c, t, g, unknown or other
  modified_base (3826)..(3835): a, c, t, g, unknown or other
  modified_base (4115)..(4124): a, c, t, g, unknown or other
  modified_base (4797)..(4806): a, c, t, g, unknown or other
  modified_base (5147)..(5259): a, c, t, g, unknown or other
  modified_base (6854)..(6863): a, c, t, g, unknown or other
  modified_base (7182)..(7191): a, c, t, g, unknown or other
  modified_base (7513)..(7522): a, c, t, g, unknown or other
  modified_base (9099)..(9234): a, c, t, g, unknown or other
  modified_base (9832)..(9841): a, c, t, g, unknown or other
  modified_base (10317)..(10326): a, c, t, g, unknown or other
  modified_base (10743)..(10752): a, c, t, g, unknown or other
  modified_base (11079)..(11200): a, c, t, g, unknown or other
  modified_base (11280)..(11289): a, c, t, g, unknown or other
  modified_base (11864)..(11873): a, c, t, g, unknown or other
  modified_base (12805)..(12814): a, c, t, g, unknown or other
  modified_base (13099)..(13108): a, c, t, g, unknown or other
  modified_base (13264)..(13273): a, c, t, g, unknown or other
  modified_base (13654)..(13663): a, c, t, g, unknown or other
  modified_base (13869)..(13878): a, c, t, g, unknown or other
  modified_base (14137)..(14146): a, c, t, g, unknown or other
  modified_base (14382)..(14391): a, c, t, g, unknown or other
  modified_base (14507)..(14516): a, c, t, g, unknown or other
  modified_base (15008)..(15017): a, c, t, g, unknown or other
  modified_base (15437)..(15446): a, c, t, g, unknown or other
  modified_base (15636)..(15645): a, c, t, g, unknown or other
  modified_base (15914)..(15923): a, c, t, g, unknown or other
  modified_base (16259)..(16268): a, c, t, g, unknown or other
  modified_base (16770)..(16779): a, c, t, g, unknown or other
  modified_base (17839)..(17848): a, c, t, g, unknown or other
  modified_base (18079)..(18088): a, c, t, g, unknown or other
  modified_base (18381)..(18390): a, c, t, g, unknown or other
  modified_base (18557)..(18566): a, c, t, g, unknown or other
  modified_base (19139)..(19148): a, c, t, g, unknown or other
  modified_base (19952)..(19961): a, c, t, g, unknown or other
  modified_base (20592)..(20601): a, c, t, g, unknown or other
  modified_base (21012)..(21021): a, c, t, g, unknown or other
  modified_base (21098)..(21107): a, c, t, g, unknown or other
  modified_base (21616)..(21625): a, c, t, g, unknown or other
  modified_base (22040)..(22049): a, c, t, g, unknown or other
  modified_base (22554)..(22563): a, c, t, g, unknown or other
  modified_base (22674)..(22831): a, c, t, g, unknown or other
  modified_base (23014)..(23023): a, c, t, g, unknown or other
  modified_base (23539)..(23582): a, c, t, g, unknown or other
gcgggctcggccccggcctcgggcagcgcgccccgggcagcgtcggagcccagcgccaaccggcagcccacagtgcccagcgcggcatgcgggagggaccccgacccgcagcacgggtcccaggccaggctgtgccgcgccacgcgcgccagacgcacggtcagcgccgccagcaggggcggcagggaggtggggcctcctgcggcgtgggacggccgcctcggggtgccgccgaggcgcgctgggcgggccagaaggtgcccggctatgagcgggccgccgtcggggacctggatgcaggcgcggccggggccagagggcttgaccccggcgcgctgcagctccgccctgacccgcttctgggccgtgcgggcgcccatggtcccgtccccggcgacnnnnnnnnnncgccgcctcagggcgccgccgaggcgcgccgggcgggccaggaggtgccccgctatgagcgggccgccgtcggggacctggatgcaggcacggccggggccggagggcttgaccccggcgcgcagcagctccgccctgacccacttctgggccgggcgggcgcccatggtcccgtccccggcgacgaccatctcgaaggggggtccggggtcatgatgggaagcgcccttctggcactccccggcaagcccaccagcgtcgctggcagtggtttccacctgtgaatggtggagagggggaaatgctccaccgctcagcttgtggcggatgcccgtggtacgcaggtcatccccagcatctacaagggtgcggccacatgaacatgtccagacgcgtcgaannnnnnnnnnactccaccactcagctgtggcggatgcccgtggcacgcaggtcatccccagcatctacaagggtatggccacatgaacatgtccagacgcgtcgaaacacaatgttgcctggagacgaaacacgcccattacccaaatagcccaccttcaccaggcatttgagtagatcagaggacgtgcaggcagcaaccacggcatctgcatcggcgcccactgggacagaggccagcaggaggtggctggaggagtgcacgatgggtagctcggccagtcggtctccggtgtgaagggcgtaggccgcatgtatttcgggaatgcaaaactcccgcagctcgcggcagtccttggagccatcccaaaccagcagcagcctgccagggctcacagcctcgccgctgctacacggtgctccatgacacgggccttccagggccatgcatggcttactcgacacaatcaatgtactcctctgtcacttctgacagaattaaaataccaggcccatgccttccagtcgattagtgtgctagatcgcaaaggtgttctgcacacgtagtattcagggcgcgacctccggacacccatggaaaagtgccgtatgcgggcgcaagtacacaagaaannnnnnnnnnttccggagaccccatgaaaaaatgccgtatgcgggcgcaagtacacaagaaatgatgattacatatgactaccatatgagatcgcgaataccgagcacttacacgtcaatggacactcgcaccgtgctggccttctcagccggaacctgcataggtgcaggggcgtgctggtgggcggtacggcatggtctaccgagcaagcgcactacagagtatggtagtggatgcaggccaccactgccgcctcttccgcaccccggtgagggtcccttcgatttctccaagttcgaggaggacgaggtggtggctgagcacctcaccaggaatgtccagttcttcggcctgccctcccagaagcgaatagccgagtcctttgtcgtggtcgtgggtcttggagtgagtgattatcaggatgtggtggggggctgtctaatccagggcggagggaaggggctggtgagggatgccatgcatccctggaccacctggctgagcactgcttcttcaggcagtcagtgccgtgaagcccggggagtgattatggcacctgtgcgggcggccagagtctgcatcctttacgatctaataaccctcatccccgctctcttttcgtgcagggagtgggcagccatgcagcacaccttctgctccgctccggggtgggccgtctacgcctcgttgactttgaccaggtgtcgctttcgtccctgaaccgacactgcaatgcgacacgcgcagacgtgggcatgcccaaggcagagtgcctggcggcctacttccgccaggtcatgcccgaagcccaggtgccggaaggggtgtgtgtctaggacagccctggatgtggtgtgagcggtgcatgaaaggtcttagcggcacgcagcagcacatgccgcctgtcccacactgatgccttgactcacgccagctgcgcaacgcagcgcaagtgaatttgatccgtcgcacatacgctcacctgctccaagatcgaggccgtgcgtgccatgtataccgaggagacagaggagcacatcctcgccgggaacccagactttgtgctggacgccatcgacaacatcgacaccaaggtgtgagaggggtggggctcggggccgcgaggaggtgggaccacaggctttgtggcgccccagacctgggcatcccttttggagccaggagaggggtggcgttgacaagtgggtccttaaaatcccagtgaggtgctgcgccggcccctgcagatgtgtgggagtttccttttcgatctcgtttcatggaatcatcccagcggccccttccccatctccctctgccccattatacacacccacacgtgcccaccattgcaggtggcgttgctggttgcgtgccgggcgcgggggatcccagtgctggcctcagcgggggccggcgccaaggccgaccccacacgcctccgcatcgtggacgtggcggagtcggtggcagacccgctggccagggcggtgcggcacaggtgcggagtgaaggtggtggaggaatgggggaattgagcgtgagggatgggccatggggagggtccaggcgcgtgcggaggatctctcctggcggccccaggactggagttatggcagggtgcgatcctggcggcggtaagccccgccctggcaggaatttcattgttgcaggcatgactggatgcacgggctgggcaatggcctctgcagccttccccatgtgccacccacacacacttcccccctctctcctgcggccacatgcaggcttaggcaggagcatggcatcgccgacggcgtgccggtgttgctgtccacggagaagccgcgcgtcggcctgatcttcggcggcgaggagggcgccagtcccctcgactaccaggtgccgcggtgctgccgagaagagggatggtcacaggctggctcagggtggcggcagggacaatcccgaccgcccnnnnnnnnnngacgccggcctcgtgcgcaggtgccatcggccctcttctcgcccatcaggcctagggacagccgggcacttctccctgccaaatnnnnnnnnnnggaagagggatggccacaggttggctctgggtggcggcagggacaatcccgaccgcccgtgggccgtgctccgcggagccctacgacgcctccaggcgcgtacacccaatccctgatgcccagttccctcctcccaatcccaaaggtcgtcccgaacttccggatacggaccatccccgtcctgggcacgatgcccgccctgtttggcatggcggccgccagctggatcctgtgccagctggcgggcaagcccttcgtcccggagcccgtgttcacgatagaggtgcgtgcgaaggccgccacggggagtgactgaatgggnnnnnnnnnncaacgtcgcaggtcaagcagtaccagacgcaactgcaccggctggaggaccgcgagcacgctcggttcgggaccagcgccggtgtgcaagtagacctgcaggaggtgaggaagggtgcgcttatgggggagaggatctgtacggggctgggtgcggcatggtccatggcgccgctccgcggcgccgctccgcactgtgtcttcagggcgctgaggttacccccagagcacatggaaggcccgaacccaaagtccaccctccctgccaggtggaggccctnnnnnnnnnntttacgggggaaaggatcggtacggggctgggtgcggcatggtccgtggcgccgctccgcggcgccgttccgcactgtgtcttgagggcgctgaggttacccccaggagcacttggaaggcccgaccccatagtccaccctccctgccaggtggaggccctggtgcgggagtactggcgcggccgcagcgcacggcaggcggtgggctccaacgacaagggcctggggcgcagcatcgggcacctggcgctgacgcgctgggacgcgggccgccccgcctcgcccggcaacctggtgctgctgacacaggaggaggccgacgcgcacgacgcgctggcacaagggagccagggcagcgtgcacgacgcgctggcacaagggagccagggcagcgtgcacgacgcgctggcgctgcaggcgctgcgggcgcgggagcccgccttctgcgcacgggtggaggccgtgctgggccgtgtgcgcgcacagtttgggtgctgagcaaggccggtgttgggagacaagtcgaggccgtcccagcctcgctcatccaggcgtgcgcagcatctctcccgcctccatccggggcggtctcagagcctgcccacacggctcagagggttgccacgagcgcgcacgggacctgcgctcccaagattcgccgctctacgccacnnnnnnnnnngcagtttgggtgctgagcgaggccggtggtgggaggggagtcgaggccgtcccagcctcccccgctcatccaggcgggcgcagcatctctcccagcctccatccggggcggtctcggagcctgcccacgcggctcagaggattgctacgagcgcgcacgggacccgcgctcccaagattcgccgctctacgccacttgtatcccaacataagctgctgcacgcgcgcccccaaccgccccacacgccctgcccggctgcacatggctgttacagcgcgtccccctcacacgctgtaccatgatcaacgcatgaccatgcacaagggagtcgggcacggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcaacctcggcggccagcttgtcagcctcggagggctccgcctcctccgcaccctcctccgcctgtggtggaggggccagtggacagggagtcggctcctgccaacattatgcaggtggagggggatgcagcggcaggacaggcgttgttgacggagtgtggccctagcgtgtgggccactcctccccccttcccccccaaaaccaaatgcgcaggccctcaacgctcccggcccaagagggcccactggcatgcgcgagagattcttgggagagtcgtggggatttggcgtccagccatccgccccgcgcacctgtggggcgtccccaagcagggcccccatgtcctcggcagccttatcataggcagccttgaactcctgcgcccgctccgctgaggcaaagcgtatgcagaacagctccattcgctgctcctcgctggcaaagtcgacacaggaccagaccatggacttctcgctcccggtgtgctcctggaccttggtcccgggcatgatgatgtggttgctgcgcaccttcagcgtcttctcctgcctgaacaggaaccggatgcgctggttggctttgtgctgcagcacgcgagcctggccaataccccgctccttccactcgttggcgtcggcatcgaagcggtacagcttggacttgctgcagcgtggctcagagggttaaggaaggcggctggatatgcttggcgttgaggaggacattgatgccagggaggcagggcggacggtgacaggatcgtctgaaccagctctcgatgcattcgatgccaaggtaggctgtggtggaccctgcagctccttctcccacagtgggtagttgcctggcaaccccctccccaccacaacacccccactccacactcacgcgtcgaagagagcggtctcgtcctcctctcctgtgctaacctccacctcatctagctgcacgatgggcttgaactcggcagagcagtcctcctcgccggcctcctcgccgtcgtcaccctcctgatcaccggtggtcgcctcccccgccttcactcccgtgaatccaccaaagccggtccccgtcccgaatgtggaagatgacccgaagacaggggtgggggagggcgcctgcgtggtatgaacaaggtttgtaaaccagtgtgatggaggtgcaggcaccccggtccagcaccatcccacgatttctggcacagcttcacatgccccgtgtcacatcacctgtgtctccagcgcctccgtgctactggtttctggcttcgcgtcagacattgtgcgggactgggaacttcctcgagggggcaaggggtcaccgcagcctcggtccgatgagcagagggcagcaccaatccgatgtgtgtatggattgcgtcggaaagcttcacgtaagaagggagaaccgcacctgaagagccctggggacgctcacggaaggtccgcgctcggagggcattattgcgggagctctccaatatcactccaccggtgaatgagatcatcagacacttgcatactgcatgtgattgtacagaccctcaatttggatcacaataacagactcgacagacaaactacgttattgtnnnnnnnnnnatccgcgcgcagggcattattgcgggagctctccaacatcacttcatcggtaattgagatcatcagacacctgcacactgcatgttattgtacagaccctcaatttggatcataatgacagactcgacagacaaactacgttattgtctagggtatatgcatgaggtcttcatgctcatcacgattgtgacgaatgaccagagttgcaatggaagcggatgtgacaattggcatcatgaagagtgaggatgagttgcctggtacctgttattttgcattcggttatcgagccgaggggcatcgattggtgctgatatcnnnnnnnnnngtgcaatggaagcggatgtgacaagtggcatcatggagagtgaggatgagttgcctgggacctgttattttgcattcgtttatcaagccgaggggcatcgattggtgctgatattccccgatcatcttgacatacacaagaccactgacccttacctgctgtctgccatgcaaggtacctaagttctttctctcaagctgtgcttttaattattctgcgatggaccgacactacgcattacttacgatatgtatctgtttgcactgtgattagatcgtatctgtatttacgccgattgagccaccgagcaataacccacccnnnnnnnnnnggatatgtatctgtttgcactgtgatcaggtcgtttctgtatttacaccgattgagccaccgagcaataacccacccccttcccttgctccgggggtgaccatcgaccccggcaggccatgtgcagtgtacttctcgcagctcaaccccgggctggtgaggctgacaaatcctcttgccgacgtttggaaatctgaaacaacgccaaatcctcaaaagaagccaacatcctccaaaagcgccctcggtttcgctgtgaggagtgctgccatgggcaacgtcgtgtcgtatgctgaggaggccgtcgtcgtcgcggaggtacctgcggtgcagatagcatttgcgatactgatctgtgccatctttgattttaaggaggacgagcgtcctggcgtggcgagccccccccccccccttccccccttcctcgtgtggcaggcacccgaggctgaggaggtagagagccccgaacccgagaaggagtctgtggaggccgaggctgtcgaggaggaggagcccgagaagcgtcagatcacggtgcgtgacggtggcgcgctcttcttcgggtgaccatgaggatgcggggcaaccttggtgggtcttcccagtgactctcaaaaagtgccgaggtttccattcaaaacggaattaagcacactcttacccacaacttgacccctttgcagctgagcacatcccctgtggacttccgcttccccatcaccaaccagagccggcactgttatgtcgcggtgagggcttgagtcaagtgacatcggtcatgcggcatgtggaggtgagtttgccagcaccgaagccctcaactagcccccaccttcccaccggcgcagtactgcgaagcacatcgctgtttccagcagaagggcgaggaggattcagagtgccagcgcctcgccaaggtctacaggtccatctgccctgtggagtgggtacgttgacgcctggtgtggcctctgtggacaacttgtacctcctgttctgttggttgtggctcttgccaggtcttgggtttgcagtctgagtgtggtgtggtgtctgtggattgcatggctttctagtgtatccttgtgcatggctcgagccactgctttgggggcaggaggtgtgcaaaatcctgtgtattgcaggatatccctggaagcatcccagtgtgtttgttctctgatttgatacccaccctggaatgggtgggcatggcaagcgagtgacgcattgctgaccatcgcactgtcttctacattgcagctggagcagtggaatgaggcacgtgagaacggcagctggtgagccggccttgtatgacctgaaggatggttgtacagcctcttgatgggatgacccagcgtgtgagtcccccctgccactcgatgacacccccactctgttgtcgcactgattggcaggtggggcaagtattgagttgcgagtgcggtgaagactggcctcctgctctggctgggaccgaggaccccagcgaaacacctaggggagcatgcttggactggtgctcctccatggctgcattacccaccccctcctgttcatgcgcaaagaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgccctaccaggggggcggagcccgtcagcaaaggaatgcaatgcatgggaatacccttgtccccctaccgggcatgcgccggttgctagcagcttcttcccgccgacgggataccactggcgcagttggttgcctcaaatggcgagccgggcgatggggggttggagggaaagggaagcaggggcggggtccaccaaaagctgttgaatgaggcgccccagcaacaaagcactggtcagcatcaggatgttgatcgccccgtcgacacgccggtcgacgaccctgacattgcacatccggttgtcgcagcgcttggtgccccaggcctccatcagctcctccacccccctcttcgcctgcctgtagcgatgggtatgcaaggcggtgtgccagccgcagcacatcgttgacgtcatgtgctcatcaatcacagccaccttgcaaactttccgcaggcggcgaaggaagggtgcaaccggaagaagcgcacaaagggcagcgccaggtcgacactgttgccagagttggttggatttggcgtccacgaaattaaattgcgatcagtggcacagggtataacaagaaaccgggtgcaannnnnnnnnnactcctccacccccctctttgcctgcctgtagcggtgggtatgcaaggtggtgtgccagtcgcagcacatctttgacgtcatgtgctcgtcaatcacagccacattgcatactttccgcagggggcgaaagaagggtgcaacaggaagaagcgcacaaggggcagcgccaggtcggcactgttgccagagttggttggagttggcgtccacgaaaataaatggcgatcagctgcacagggtataacaagaaaccgggtgcaaagtctgccaggttctcccctttatctattgtgggtggcaagggcatgtgcgactacgccaaaagaaccacacattcgatattcagactcggtcaatctgaaggtgactactagcagctgctgccacctaccgcccagctgcgtgctgctgtactttgcgagcctaacaccccccgaccgacagcatccatcgcaagctagagccactgcaatcnnnnnnnnnngccgcccagctgcgcgctgctgtactttgcgagcctaacacctcccgaccgacatcatccatcgcaagctagagccactgcaatccgatggaccaagggtaaagagggtgtgtttgggaaagcagaacccctggtcatcctgtggagggaacaggggatggacggtcgttacaggctgtggcggaacacgttcagtagatacagtccaggactccattcctcaaccataacctcaagaattgactgcaaaggtgctttgtgtccaggttgcgggtcaaggatgcaagtttgccataccttacacaggaactcctccatggccacattcaagaatcagatattttacttggaccgtcgtcggggcctaggcggataagttcccatgttcgaggtccgacaggctgatggtttaaggtnnnnnnnnnngatgccctgatcgggtgaaccaggcatttcagtcataggtgcatgctctggcctccagatcctttttgtgagtggtgctcaggcgttatatatgcttatcagaaaaggtacaaagcgaggacatgccgggaggatgggcatcgggcatattactgcgagtaagatgctgagcagaggctgccttcaaaaggtcactcgtgtatggttgttgtcacccaagccacgaccgaagagctctgtgggccttcaagtacaagacgatccaccgaattcggttctggtacggccacagtaacgccgacataatccggtttcatttgtgggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacaagcgggggtagatcgaaaagagaacgcaaaattaaatcaacagtttatgcacgaaagcatttatttccccatttgnnnnnnnnnnagacgcctgggctgggggaggtgctgggatttgttgagacgggctctgcgacctccacagtggcacaatctgcggcgacttccaagcctgcatctagcgacgcgtcgctgctcgtagccccagggacgcgagagacgcaccctgtccgtgcctgcattgagaggagggaaggagagaggttcttcatgcttccattggattggaggatgccaatcccccagggccggtatgcctcgacgcccctgaaaagcaaactcgtatcaagatccacttcaactcaccgttgccaacaggtttccaacagctgccgagccttcggcaaaggcgtccgccgccccggagagggaggtggaggcagtggcaccggcactcgtgcttgccgactttccaggtccaaaacttgtcccttgaaagcttcccagtgccgtagccgaagtgttccctccactcagggcctgtgtgagatgtgaggccgattcgtgtgacgattggctgaaatcctcaccctcgatgttcgaaaactaaagaccccccaagaaagaaccgtgcaccttggctcaccgtgccacgaccgnnnnnnnnnngttggctgaaaccctcaccctcaaagttcgaaacccaaagaccccccaagaaagaatcgtgcaccttggctcaccgtgccacgaccgaatccggtcactgaagagtcagtcagggagctggagccctccagccgcgactccgcatcggcgtcgagccccgacgccgagacaaacgcaactccagacgcggagtagcctgatgaggttgcgacacccagcgtcccgaacgtgacaccatccgactgacccgcaatggtgacttcgccttgcaaggtcctgtgtgggttggcgatattcaggtgctcgtcagagggagtccggcgtgggtgttgtgaccccccaaaacggaagtaaagtttcgatggatagggaggccccgcccatcatacaaccatgccgatttcttcttatgctagcattacgtttacctggacgctgcgactgtggaaatcgagagggctcctataagtatcagtgttgcggcgatgtagccgagttcaattcgcggcattgcagctctcgacagtggaaagccgatggacagttgaggggacccgattgctcaacaaagtgcgtatgaagattatgaaccgaaattttgactgttcctcagccagataggccctgatagttcatcggcgagtggtgggtcgcaccccgaccgccatgagaatctatatggtccatccgatggaactgcgcacaaaagtgcgggtcacttacaagatccacgaaatagcatttggatatcgttcggcatgcatagtactcaaaatgctagatatagactccaggaggagcgaagggggtgacttccgtcggaccgccggacgaaccatggacaggatgctgggaagcgttatatgcacgtccgacaaggggggggacagtgccatggtatgggcaggagggttggaatgattgcaagacannnnnnnnnnattatatgcacgtccgacaaggggggaaacagtgccatggtacgggcaggagggttggaatgattgcaagacagattggaagagatggggagcaagctttcgctgttcccatgttcatgcaacactgagtattgtctaacaacccttttcgattctgggtgcacgcatgacctgtaatctcaattgaatgcatcgcagggcgtcagcctccaggcaggtagctaggtgtacagttgacaaatggtgttaaaaatgtaccgcagttgcaagaagtaatggtgcagnnnnnnnnnngggcaggtagctacgtgtagagttgataaatggtgttaaaaaggtaccgcagttgcaagaagtaatggtgcagagtggagcattacaaagggttaccgtggaattcagcacctgtttaagtatggtgtcaaggtgtccaaagagcaacgtagtgcnnnnnnnnnnatgtggaattcagcacctatttaaatatgatgtcaaggtgtccaaagagcaacgtagtgcaacaggaacatgggtagggcaaggagccgaataaagcacgttaggtgcgctcacggaaccggtacatggtctcgacctggtaagtcaagattcatcctactagaatggcgaggataaagcatcacaacgaagctcagtatgcctgcatttctgtacacccatttagcggcagaagtccctcaatcccaggccgtgtgcccgctccccagcgcttgggatgactgttgtcctcggctaccaatcttggcagagccggaggaggtcacgggggccttgcggagctcctgggccagcagggagcagtgcggatgggtcacgacnnnnnnnnnnactccccggcgcttgggatgactgttgtccccggccaacaatcttggtagagccggaggaggtcacgagggccttgcggagctcctggggcagcagggagcagtgcggatgggtcacgaccttctgtgctgacacccagcctaggaatcgtccagactgccaactcaaccattacctccaccatcaactcagaaatcaacctcagnnnnnnnnnncctgtgctgacagccagcctgggaatcgtccagactcccgactcaaccattatctccaccatcaactcagaaatcaacctcaaaaggtggttgggtgtgtagggtgtgggccaatggtgcagttttcctgcgagccttgtcatacctcacgccggaactcctccatggccacattcaagaatcaaatattttacttggaccgtcgtcgggacctaggcggataagttcccatgctcgaggtccgacaggctgatggttnnnnnnnnnnatcatacctcacgcaggaactccaccagggccacattcaaggatgaaatatttcacttggaccgttgtcgggacctaggcggataagttgccatgctcgaggtccgacaggctgatggtttaaggtacggggatgcgcatggatggggtgtgttgtggagggtctacctcctgacgccctgatcgggtgaaccaggcatttcagccataggtgcatgctctggcctccagatcctnnnnnnnnnngcttcctgacgcccatattgagtgaaaccaggattttcagccataggtgcatgctctgacctccagtttcttttttgtgagtggggctcaggcgttatatatgcttatcagaaaannnnnnnnnnaacgcccttattgagtggaaccaggcttttcagccgtaggtgcatgctctggcctccagttccattttgtaagtggtaatcaggcggtaaacatgcttatcagaaaaagtataaagcggggacattacgggaggatggggatcgggcataccattgcgagtaagatgctgagcagaggctgcctttaacggtcactcgcgtatggttgttgtcacccgagtcacgaccgaagagctctgtgggcctccgaggacgagacgatccaccaaagtcgggtctggtacgtccaccgtaatgccgacataatccggtgtcatttgtggggcaaggtgtgctccccggatggtccccggtgtcacagtttccgttcgaccagatcctaaaagagggtgatgatcgaaaagggaacgcaaaattaattcaacaggttgtgcacgaaatcgttaaaaccccatctaacaccagtgcaatatctggcagacaaggacatcnnnnnnnnnncaaaggtcactcgtgtatggtttttgtcacccgagtcacgaccgaagagctctgtcggcctccgaggacgagacgatccaccgacgtcgggtctggtacgtccaccgtaatgccgacataatccggtttcatttgtgggggaaggtgggctccccggatgatccctggtgtcacagtttccgttcgaccagaatctaaaagagggggtggatcgagaagagaacgcaaaattaattcaacagtgtatgcacgaaagcatttatttccccatttgaacccagtgcaatatctggcagacaaggacatcccagctcggcgggggagtttagtttggcaagatgccgtcgcacggacggatacctcattggatcggacttctccttcttttaggcctggctgtgctctcaaacgtaggttcgnnnnnnnnnntgggtttagttcggcaagatgccgtcgcacggacggacaccgctttggagcggagtgctccttctcttgggcctggctgtgctctcaaacgtaggttcgaaggatcatgattacatgaaaggttcttctggagggctgggagggtgccttacgcgagcgccgccgtgtgactctggcaagcctcccaccnnnnnnnnnnagatcttggttacatgaaaggttcttctggagggctggcagggtgatttacccagccctggcttctaatgctggcaagaccccaccctccttctcccagggcgcgtgcacttccaagttcttctcactcccggcagccacgtgagttgcgaatggcatactcgggtggttgtcgtcccggcctgcttaaaccgagtgtgcggccctgcttctggatgcccggacttcgctgcgcgacgcggcctccggattgtgtgtaccgacccctcnnnnnnnnnngggcctgctaaaacccaagtgtgcgaatctccttctggatgcccggattccgctgcgtgaatgtacaggacgcggcctccggattgtgtgtaccgacctctaacccccctcccacccccaataccatctccaacaggtatggaccgcaagtctacatgctggagctcaacagcgcggataccttctgcaagtatgtgctcggctcttgcatgaatttggcttgactacacatgtctggtcatttgatagaccattaagattgaggaacctcctgtcattggtcgagttctccctgtcaaccttcccaggtcccaaggattcagcaaggccggttcnnnnnnnnnnatgggtcttccagtcagtgccctcagaatgagttccttttaggtcatcaaagctcggtctaccaagatcctggtggccgtcgagtgtctcaagacggggcagaaagcatgcgctgctgacaagaagggaaacattggaaccggcaacacaggaaagaacaactttggagactacaatgacggtgacaacaacattggtgagcaggactggaaaggcaatgtcttggcactgcactcgaaggattgcccgagaatgaggggcaggagtatcgtgcatgacaaacatattccatttgcccacacccatgcacaatctctgagtgcagggagctacaacgagggcaacaacaactggggaagtaggaacaagggtaccaaactccggtgcaatgatgcaacgggaactcggaaggtagtcaacacatgcagtctcaaggatctccgcaagtccattgttgtgaagtacaaccctccgcctccgccaccaaagaaggcgtctcccnnnnnnnnnnaacatgtccggtcatttgatagaccattatgatcgaggaacctcctgtcagaggtcgacttctcctattcaaccctcacaggtcccaaggattcagcaaggccggttccgtcaggaagaccaacctcgatattctgggtcttccagtcagtgctgtcaggatgagtcctttcaaaatcttggaggcgcggtccactgacatcatagtcagcgtcgagtctcaagactggacagaagtcatgcaccgctgacaagaatggcaacattggaaccggaaacaagggcaagaacaactttggtgactataacgacggcaacaacaacattggtgagctgaactggggaggcaatatgctggcgctgcactgaaaagggttgctcatacatgaggtgcagaagtggtgtgagtgacagcggatgccacatgcccacggcttgtgatctccgtcaatgtgcagggagctacaataagggcaacagcaactggggagacaggaacaagggcaccaatctgcggtgcaatgattcaacgggaactcgaaaggttgtcaacacctgcaacctcaagggaatccgtaagactgtgcgtgtgaactacactcccccccaccctccatccaagaggccgcctcctcccctcccccaagatgccgcctcctccctcccccaagaggccacctcctccctctccaagaggtcgccgcctccttccccagcaaagagatcaccacctacacctcaaccctcttcacctctgtcccccgctccagcaccttctccttcatcacccattgcttcccccacctcaccttccccgctcctatgccctccccttcatcacccattgcttcccccacctcaccttcccccgctcctatgccctctccttcggcacccattgctcctcccacctctcctcccccttctcccgagccctcccctccaccatcggtacctccaccctctccagcttttccaccaactctgcctgccccagttttgtcggtagcctgcgatggtagggttacgacgaggatggatttcactgtgggcactgaatnnnnnnnnnnacctgcgataatgtgcgtatggcgaggatggatttcactgtgggcactgaatcctacttcccaactgaggtcactctcatgaatggaacaggcgacgttatatttacgttcacggctctggataggggccacacgtttatggcatccccagtcatcgactttgaacttcaaaaggagcactgcttcacttgcaatgcgacggacaccaatgggtggctgtccgagctttcnnnnnnnnnnccgatagggtccacacatttacggcatccccaatcatcgactttgaacttaaaaaggagcactgcttcacttgcagggcgagggacaccaatgggtggctgtccgagctttccaacaaggcctgccagacgtgtggttgatttccaagatgtgctgctcaggcattgcctgacgctgcaagtccttgaccttccgcactgcttatgagactggatgtaacgatcggggccactccgtaaatctgttgcaacctttcaaagagtacccactcagaccaatgttgtagaaacccnnnnnnnnnntgatcggggccactcccgtagatctgttgcaacctttcaaacaatacccactcagaccaatgttgtagaaacccaaggagataggaaaggtgtgtccagggcattgaggactcctccatcacatttgactcggtaaattgtcaatggacactccctcagcaaacatnnnnnnnnnngagaaaggtgtgtccaggacattgaggactcctccataacatttgactgggtacattgtcaatggacactccctcagcaaacatggaaccggatacagggttctttgcccctgacatgccgtgcgcggtgtacagtcgcagccgccaccaagcaggcatcacaggcaacacaggttccgtcagagccttgtgcagagcgccatgcttcacctgcaatcccctctgccttgacgtggagataatggcttgagctgttacagctccagaagagcggctctgtacggtggccttgacagcgaccaggtcggcaaggctacacacgccattgatcagattgggtggcttgacttaccccgcatgcttcacaggctgaacagtcattcctggttgtgagaatgccattgcgagaaaccacgggcacctgtcgtgcgacttggcgatgtttgttcgaatggatgcctccttttctttcggaacacgccatcgactccaaactcatactcatcagatgtcaacatcgtcaactgtacccgagtctacaatttacggtgggcatgcgatgggacttatcannnnnnnnnncttgttcgaatggatgcctctttttcttccggaacgcgccatcgactccaaacttatactcatcagatgtcaacatcgcaaactgtacccgagtctacagtttacggtgggcatgcgatgggacttatcagcagggcatgtcagatacggtccaactgctcgtgcaagccgtgacctgcccgctctggcgagtcgaggtggacggggagggaggggtgccaacccatgcgagcatgcgggcgatgcgctctacctcatcgatccggccgttttcagcatccatatacctacttctacatccttaaaatcattgtgcagtcatggaccgtttgtcaatccgcacagcttcgggacatgcgggcacaccttttgcaggtgctgggagggtgacgggagcagggatcccggacggccgtccctgtaaaccccaccccccaattgctgcatgacctgaggtatcctcaatccctttctccagcctttgcattccttggtgccccagccccggccacccgtgccaccttgccagggtttgcgtggtggagaggctggagggcccgggcgtcacctcctcgatgtgccccacctgccgccagcccgcctggaagaacgacctggtctacaaccaccgcatggccaacgtcgtggagagcgtgaagtgcctggcgggggtgacctgcgggccgctgaagcagggccacggcccggccagccagcccggcgaccagagccagggtgcggaggggggtggccggcccaccaagcgcccccgccgctcgggcaggcgggcgggctctgggaagnnnnnnnnnnggccagcccggcgaccggagccagggtgcggaggggggcggccggccctccaagcgcccccggcgctcgggcaggcgggcgggctctgggaagcgcggcgcaccccgcctcccggacaggggccacccgggcgcacaggcccgtgcgggttgggtgcctggcggcagccagggcgcggcgggcgtgggaggcttggcgcagccttcggaagactcgggcgtggatgctgggggccggggcccagggattgacagctcccctgccccggcccctgccgtcatcgccgcaagccccgcgccggccgccgctggccccggaaggcccgtgccggcggccgccgtcccgcccgcagcattgccacgggccgtgtgtggtgccctggcatgcgcggacgccgatccaggagccctgccccccgagccaggtttggagcccgggtgcttgcctcgcgccagcccaggccgcagtaaggcccgggtctgccaggcctgtgcgtcccagctcgatctagaccgtgtggtcctggccagccagcaggacagagccagctgtgcagagctgtcctccccaatgccgggggaaagcagtggggcggcagctctgggaaagcccgaggcgcctgcccgcgacnnnnnnnnnnccgccaggggaaagcagtggggcggcagcgctgggaaagcccgaggcgcctgcccgcgaccaggaggcagggggtgttaagggggtggaccccgactccccgagcagcgccggggcccccgggctggatgccaccccgcccggacttgccacgccgccgctgaggcacgaggtgctgctgctccagcgcgccatcctcctctgcgacgtgctgggcacgctgggctccacggcggaagctctgccgggcaccgaggcggagcgcccagctctggaggagcaggccggcactgtgggggcctcccccgccgacgtgtcgccgggcacggggcgcagcacggagcctggcgcaccggcgacgggcggggacgacgcggcgcgcccgccctgccggcctcccaccagccagggnnnnnnnnnngcggggcgcagcactgagcctggcgcaccgacgacgggcggggacgacgcggcgcacccgccctgccggcctcccannnnnnnnnntgccgcccaggcgcccgccccaccccggccgctccggcccctcccgcgccgggcggccggggggcccccgctccggccaggcgcggggtggctcggcctccccccgcccgcgctccatcgccgagcttctgacccaggggtcccaacgcgccctcgccgcggcctcgctgcgtggggacgggcgccgccgcgttgtgctttccagccccgcgcaccgagccctgctggcgcagctggcggagcggctggggggagcagaggagggcggcgaggtcacgcggtgggtggggctgggaagaggagggggggcgctctgaccctggctgccgttagtaccacgtgagagacccgggaccgagagggatctctggattcgcagttgggagctcttggccccaccctggactcggcgtgtgcccctgtcccacccctcacatacccccctccctccctacaccccttcccatgccatcgttcctcagggacaccacgcacgtgatcgtggccannnnnnnnnnccggcgtgtgcccgtcccacccctcacatacccccctcccctccctacaccccttcccatgccatcattcgtcagggacaccacgcacgtgatcgtggccaccgatgcccgtggcgtggtggcgacacgggtgatgaagctttgtcaggcgctggcggtggggtgctggatcctggcgccggcgtggctggaggcctgcatggaggcgggggcctgggtgcccgagcaggcattcgaggtcaaggcgagtgcccgcatcagagtccatgctgttgctggaaaggggtggctgcgccaagacatggtacaccttcttttggttcgccacaccactcccccggcccccctcccaacaccaccaccaccaccacccgccttgcgacgtgatctaccctacgctgcacacagggggatnnnnnnnnnnaaaaggggtggctgcgccaagacatggtgcaccttgctttggttcgccacaccactcccccgggccccctcctaacaccaccaccaccacccgccttgcgacatgatctaccctacgctgcacacagggagatggttgctgcctcggcgggcccgccagggcacgcaagcgtgcggacaggggctgccccggcctgtttgcggggcgcaccttccgcatcgtcggcaaaggtggtgtgaagggggtgggcaggcacagcgctcctcaccctgcacccatgccgccgggaagagcccctatcccggggccccgtccaaacaaaggcgtcctccagaggcctcactcatggactctcttgcctccccaccccccgagcgcaggtcctttgcatgctgccgggctgaccaaggccatagagctagcgggagggtccatcgtcacccgcagcctccccggggcgtgcctcgtctcgctccagaacgacctggagttcctcagcaaagcnnnnnnnnnngccccgcacccatgccgccggggagagcccctatccctgggccccgcccaaacaagagcgtcctccagaggcctcactcgtggactctcttgcctccccaccccccgagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgggtgtgcggtgccgggatggcgcggcgatgacgctggccgccctgcgctcgcatgtcttgtacctctcgcgctgagctcctcctgtttcaacgccttggatgtccatgacgaggggcactctcgctgccgagagcccagcggcccaagtaccagccatgcccttcctcccctttcacagnnnnnnnnnnatgggtgtgcggcgctgggatggcgcggcgatgacgctggccgccatgcgctcgcatgtcttgtacctcttgcgctgggctcctcctgttttgacgccttggatctccatgacgaggggcgctctcgctgccaagagcccagcggctccaccaccagccatgcccttcctcccctttcacagaagtcgtggggcgtccagccggtgaccagcagctggatcctggaccatctttcgaggcaggaggagttagagccagtccagcaggacccacaggaaggtagcgccctgtccatcgatcccttgagcgtctgagcaggccctgttcaagcagccttgcatgcgacatggacccagcccagggtagtgcactctatatagatttcatggctcgtgcagaatataagataaaaacattgccgtacatcagcaattccgaagagaagcacatccgactcgttttcgcaaccgtgctgcgcctgcggggacgagagaatctgaacccaaacccatcagnnnnnnnnnnnnnnnnnnnnnnnnnnnnnnnnnnnnnnnnnnnntgcgacatggacccagcccaggtttttttttttctttcgagtgcactctatataggacggcttcagagggggacggcactgctgccatactccactttgtccccaccccccggagttttaacccaaa

SEQ ID NO: 18536 - DNA, 71 bp, Chlorella protothecoides
tgtccccaccccccggagttttaacccaaactgcacagcaattcctagggaactgccggcgatgggaccgg

SEQ ID NO: 18537 - DNA, 62 bp, Chlorella protothecoides
aaaacaagggagtgcccaggcgggccacctatggcgcgccatggctacaaggggccgatgct

SEQ ID NO: 18538 - DNA, 61 bp, Chlorella protothecoides
ccagcgcggcgtgctccgcctcgggcacggtggggagcagggcgcgcgcgccgtccacgtc

SEQ ID NO: 18539 - DNA, 386 bp, Chlorella protothecoides
atatatatattgataatatagtattcttttagagatactatatagtttgagtagaacgagaacaaacttgtttgaaaatagggggaccaccctctaagcctaagtacgcactcttgatcgatagtgaactagtaccgtgagggaaaggtgaaaaagaagtgaaataaatactgaaactggatgtatacaagcactcaaagctttgtaacttatttatatttaaataagctgtttaacaacaacacagagtaatggggtaccttttgtataatgggtcaacgagtaaataaatgaagcaagcttaagcgactaagtggaggcgtagtaaaaacgctaataaattagatttattttataaatttcatttattttaacaagtgtcattt

SEQ ID NO: 18540 - DNA, 72 bp, Chlorella protothecoides
tacttgaacttactgttgattccacacgaggagacatttctattattttaaatgaatccgttttattaaaat

SEQ ID NO: 18541 - DNA, 314 bp, Chlorella protothecoides
ccaattccgataccaagtccgcccccatctccttcccacagccgcgcgacattcatcgtcacagcaacagctcgccctggcgcagctttctgttcaaattggggtacatcttcgggagctgcttcgggactgtgcctacagtcactattgatgctcatcccatccccgccaagaagatgcccaagcgtccagagtcccccgtcgccacagaggccccagtgcaggccaccatgtcgtcgaaccccgattgcccctgcgcccccaacatgatcctcgccatccgccccgagatgcccctcgccatccaccccaag

SEQ ID NO: 18542 - DNA, 73 bp, Chlorella protothecoides
gagcaaggatggccatgcagggatgccaactctcatgaaggacacacaccttggggtactcgaggaggagagg

SEQ ID NO: 18543 - DNA, 598 bp, Chlorella protothecoides
tatatatataaatatataacataggtgtttctcgcatcgagtgatatttaacgacagctatcctttcgttttaaccgtccatcccgtgccggctcccacttcgaccaaagctgaacttactaataataataatgatggtggtaataaccaaaatgaaatattatttaaacgaggaaatgccatatctggtgcccctattaaaataggaacaaaccaattaccaaatcctccaagtaatgctggcatcaacataaagaaaatcattaaaaatgcgtgtgctgtaataattacattatataattgatgatttccgtttaatatttgattaccaggttgtgctaattccatacgtattattaatgaaaatactgttcctaatacaccagaaaatgcaccaaatataagatatagagtacctatgtctttatgatttgtagaatataaccaacgtgtaaccataaatctaaaattcttattttatatagcaactcgaattgaacctacgagtaaaagatatattgtaaatatataaaataaactgctatctcatcatactaaaataaacaaaatttattattctatttcagaaaaaagaatg

SEQ ID NO: 18544 - DNA, 81 bp, Chlorella protothecoides
gacctcgaccgtgctgggctcctgtctcagaaccttgacgatgaaccacgccttgcagccctgcttcagcccatctcctcg

SEQ ID NO: 18545 - DNA, 61 bp, Chlorella protothecoides
tcgattcttcatgcaaggttccaaccttgtaccctccccgcccatccagaccctttccctc

SEQ ID NO: 18546 - DNA, 81 bp, Chlorella protothecoides
ttttaattaaaaaaattactctataattaaaaaaattatttaattaagatttcgttttaatttgaataattatcaaattag

SEQ ID NO: 18547 - DNA, 61 bp, Chlorella protothecoides
tcgctcgctgcgagcgatgtggatgaaggggaggtggcggtgaggaggcagaacccgtctg

SEQ ID NO: 18548 - DNA, 75 bp, Chlorella protothecoides
aggtggcggtgaggaggcagaacccgtctgggccagcccatcgccctcttgggtggccgcgtgcgaaggacgaca

SEQ ID NO: 18549 - DNA, 63 bp, Chlorella protothecoides
cgatcgggatttgagagcaagggtaaggaaaatgcctcaggacacaaatggccccacgttctg

SEQ ID NO: 18550 - DNA, 227 bp, Chlorella protothecoides
caagctcataggcacggcatgcaatacccaagtctcaggcatgacgaggttgtgcacattgaagaagggagagtgcactgtccctgatgatctgacatgggttgaacatggacttccgcatccctgcatgtgtggtggcgagttttgggagggcatcaacgttgccaacagcatggaccccagtatcccaaacctcacctgcagaggtctcctgtactcagtttgct

SEQ ID NO: 18551 - DNA, 287 bp, Chlorella protothecoides
cctcagctctcacagcctcacgaaagagtacggtaaaacctcccgagttctgagcgtttttgaactcacgtgtcggtatgtgactccgacatattcccttgacgcgccctgcttgggtaaccggaaaattgtatgatgagattctcatccgtccggcatgtgaccgagcgtacacagattcctcccgcaaaccctcgccaatctccggagcattcccatatggtttagaaacgaggtcgttccttcatagtgtcacgttttagtttatggggccttctatactgaca

SEQ ID NO: 18552 - DNA, 61 bp, Chlorella protothecoides
cttgcctttccagatgcacatcagcagctctctcttgcaccagcactgctgtgcagtggat

SEQ ID NO: 18553 - DNA, 130 bp, Chlorella protothecoides
cccatggccttgtcagaaactccagcacaactgaggcatggacaagcctaccttgcccagcaaatgatcatgtccagagtctcattgcagtctccctgcaccgtacctgtcccgtgtagaccctggcctc

SEQ ID NO: 18554 - DNA, 77 bp, Chlorella protothecoides
accctcgtggcacgaatttttgcccaagccatgccttgagcatgtttacttgtcgcctgcctgagcttctgaatgtc

SEQ ID NO: 18555 - DNA, 120 bp, Chlorella protothecoides
ctccagggagcgtctgcatccctttgatgccgcgctgcttgacctgacggtgggtgggaggttccatggagatcctgaggagctgtcctgcttcgaattccgcatgcacgcgtgcaagta

SEQ ID NO: 18556 - DNA, 61 bp, Chlorella protothecoides
cttcgaattccgcatgcacgcgtgcaagtaagccctggctgaccttttgccaccccgctgt

SEQ ID NO: 18557 - DNA, 79 bp, Chlorella protothecoides
gggcgcagggcgggggcctgcgattccctggaggggagcaagtggatgcggaggtattgagggagcgcaaatcatggct

SEQ ID NO: 18558 - DNA, 61 bp, Chlorella protothecoides
cttcaaccaaaggccatcggtcacagctggtcacacagccacactacattcgcgcatcggt

SEQ ID NO: 18559 - DNA, 86 bp, Chlorella protothecoides
tttgaaaaggttgagaccaatttaaccatataggtgtatgcatacttaaactgcctttttcaaatgcttgataaacatcttgaaaa

SEQ ID NO: 18560 - DNA, 89 bp, Chlorella protothecoides
cagtgagtgtgagcacgggtctgagcagtgagtgtgagtctgagcaaagagtgtcagtatgagcagtgggtgtgagtgtggatctgaga

SEQ ID NO: 18561 - DNA, 12700 bp, Chlorella protothecoides
gcggccgcgctcgccgcggctaccgccgcggcgccggccgtgccgacgcccaccacgctgtgctgggagggcagggagccagaggtgcggcccaggcgggagatgcccatggccgaggcctccgacccagcgcggcaggcctgcggcccgccacgcgccgcgccgcgcgctgacaggctgccggaggcggtgccgctgctgccgcggccacgggagtaggcgtcgccctctgccagcaggcgcacctgcttagcgtgggcctgcagctcggcggtgatggcctcgaacttggcgcccacccccgggttgaacatgcgggaggcaaacttgcccaggccgccctggcgcccatacacgtccaccagcgcctcggcctggtccatcaggccctgcacgcggccggccagcgcgcagagcgcgcgctcgccgcgcgagtccagcgcgcccgcgtcggagcagacctcctccagcgcgcccaccgcttcgctgccggcagccagcgcggccatgcagcgctcgcggttggagcgcgcggccttggcgcgggcgcgcagctcgcgcagctcggcgcgacactcgctgacgaggcccgtcgcgcgggccagcactagcgcctcgctctcggtggccgagcgctgcccgatggactggttgcccccggagaggccgggggccaggggtgcgccggcatcagacgcgcctggaggggcgggggggtgggaccgtgaggggaggggagcggtgtcggggatgaaagggaggggggggagtggagcctggccagggtgagaggggaggggcgggagggtgcagggctcggtggaatgtcgacgtcgcattaggggcgcgttccacaagcgaacaaatccaaccgtgcgagtaacaggtctggaaaggaccaggcgtgggcgtggggggtggaccgacctgtgtcgctcatcgcgggccgggatgtatcaggagcagtgccaggcgcccgccacaatgagctccatcaagccagaaaatatcttattcgagaagtctcgatatctatgctcctctgatggctgccggcactcgcttggtggtgaaggggagaggccgcagggaattgccctcgtccccaacgaacgcgggcagcaaagggcacttgccggctcagggagcacagcaaatcccgtagacagaacagatgagccacccaaatcgtcgtcatgaattcttaccgagtttgctggatgatacagaacaccatcggcccacgacacagccgatctccgcccagtttctgggttgggtggaaagggagccaaaagccatatcgattgcggtactccgcgccctctggagggtgcatgcatgatatgtgcgaaaacatcgggacgaacatgtgatacaccttgatactcggtccgttcgtatatacttgctcatccgaaacatccggaaaccttgtcctccgtgctcacgtcggcgtttcaatggcgcagaagccccttaagaaacagggcaagtccgtgcaggcgaagcagtcttctgctgccaataagcatgggaagtcccagatgacgacgaagcgaggtgaatctgagggcgttgcgcctgggactccgatggggttgtggtatacccaccttcgcctgacgaatggcacacgcacacagcgttcaccatacctggccccttctcacaggcaaactgacagtcgctcccaaacgcgccgcgaccaagcggagtcacggcgataaccagaagctcaccaaagccatcaacgccgagaatgagagccatttcgcggccatggctgccaagggcgggggccacctggctttggtgggtagaaactactggcattgtgtgggaagggcaagctggagtctttagtgacttggatgtgaacctgatttccgttgggatgggcttcatggggagcaagatcgcctgcatctttattcaaccaccaacattcacctatcccctcggctttctcctcgcccacagcttcagccgccggcgacggcaacagcccaagacaagggcaagggtggcgtgcgccctgccaaaggccctggaaaggtctggggggctagcagcaagcagtgagagcatgctggcagaccttacctctaaaaacagtctggcgctttgctccaggctctcagcgctgcatcacaaaacctcctcatcactgatactgttttctcccctccctgtaccagtcatccctctttggccccctgctctgtgctcatactcttgttaaccctttgccaagctagagagggcagtggcagtccctggcgcggacgcaatttgtccgcaaggaatctgtctggtcccccgggctgcactggcagcctaccgatcaagtcaaagttgcaggttcttggcctcatggaacaggtgcgccacagcatcctctggcgtgccctgcacagcaatggtcggttaaccaaggtgcttatggattggtattccaccaccttgacatcaggacatccatcggactctgaatgcactttccccattctggctggccaggcagcaaacacagcacattcacactggcctgcactcctcatgacaatgaaggtgcactccgccacttccccacccacctgcatgatgccatgccccaggttcaggatgtggcggacccctgcgcgctgtgcctgctgcgccgtctcgcgtacgcgactggtgatggcctcgcggctgccaaacagcacgccggagtcgatgttgccctggtatgcgaagttggtgcccgcgcggcgcacgccctcctccagatccaccgagtggcagagagaaaggatgtcggggccgcaggcggccatgcgctccaccagcgcgccgctgccggagatgtagaggatgatgggcaggtccgggtgggcctgtgaaggtttgattggcgggagaggaccagggtgggggctgagggtgaggccaagaggtggagtgagggaagttagagcggaaggtcccaggaaactgctctaatgatactgagtctgtttgatgcggcaagcggatgcaagaaggctgcagcactccacacagctggcacggggtcctgcctcctccggtttgcggggccatgaattcaacactgcaggacacatcatataccagacacaagtccctcaataaaggtaacagtcgtccagaacaccagacaatggtcatacgccctataacaccacaacccttgagcttgcctccttggccttcttgatgatgtagtgcaagtatggaccagcaaacacatcgaagtcacgtgggctcaggttggcagcccacgagtcaaagatctgaaccgtctgagccccattgtcggcctggaaaggggttgattggtggtggagggttaagtggaaggttgcagggctgaacttgggctctgatttccttgcaggcctcctcatctggagagcaccggccaatgtgcgctgactctgagggtgtcccgtattgcttgccaggcagaaccaggaagcagcgctgacctggtcccaaccaacagagagatgaacacagccagcgatagcgccgcaccaacgatcagtcactcctacccccctggtagccaatgtaggtgacgacggcgtcggccaggcgctgcaagaggccgtgcagcaccgccggctcggaaaacatcagcttcttgatgtgcgtgtagttcttggacatgccacctgttttaaggggggaaggggagggtgtggggtgcagctcaggcttggcatcccagcgcaacccatgggtcgacccatcaacccccatcccccctccgccggccaccacgcatcccctaccttccacgatgtaggttgccagggtgaagggcgcgcccacgaagcccagcacggcggaggcactgcccacctcggcgcgcagcgtgcgcagcgcctcgcccacaaagggcaccgcctcctcgggcaccagctcccgcagcgcatccacttgctgcggaaggatgggggggcggggatgagggtggggctggactgggctgagatcctgtggacaggtccgggaagcggcacggcaacctatggaaggcatgactgccccgtgatcccaaacgggatgcaagcggccggacctcggcccacatcacagaggacgaccagggtacagcaaccccccctcccctccgttatgccatggtcgacccacctgctgcgtccggatggggtcggggatgatcggccccttccccgccgtgatgtcaaaggggatgcccatgccagagatgggggtgaggatatcggagaagaggatgacgccgtcgggctggaaagcgcgccacggctgcaggctgatctccaccgccaggtcggcgttctcggaccgctcccggaacgtggtgtgctgcttgcacaggtcctggtacaccttcatgtaccgccctgcctggcgcatgagccagacgggggggcgagagaccgactccccgcgtagggcgcgcagcaggagggggtcctccccatgagcctgggatggaaatggggagggtggcgggtcgagggggcgcacgggagcatgatccacatcgcatgctggtggtgacacatcggctttgctgtgagacaggaagattgacattgcactacggggctcgatgcctggggcccaccttctgtccgacggaggccggggcctcgacggcactcgcagcccgaggagtcgcacattgccttcgactatgaccgtgctgtggagggaaacagcgcagccagatgagagctgtgggtgctgcatgtagcaatactcaccaatgcatccaaactcaccctgtggggcgacgcccgcacgaaggacccgtacgcaaggctcgccatggcgtggcagcagcgagggtgcttccccgaggtatgcagttaccttcgatgatctggtagatacaggattcagatatactttaatcagccaacaattcgtgggatgggctgcaaattcctccctggggggccgaaatgcatgcacgatacatttatctttttggatcatgtgccacgtcggcaaacgcattctgctgctcagttgcgataggcatctgcccagatactctttccccggatacctcgacgaatccgatcttgtattccagaggagtctcccgcgttgcattgagagtgaagcaagcgcacgggtagtaggtatgacactttgcgctctgtgatcaaacttgtatacaaatttgcagtggagacaagagcatgatgcatgcttctggaccccaacacatcaagaagaagaaatgtatgatcttttcccaagtgagaagcatgtctctgtggtttgtggcctgcacgcggcagttcgttcattggcaagcttgccctgtcagtgtgacatgcaagggacttgccggaaggaccgctccgacaggtcacagcgacttcatctgtgcgatacgcaatgtcctacccccaaaaagtcaaaaagagaaatctggagccgaacgctctgccactgagctaaggagcccgtcagtttcctgacccctacgcggatcgaacgcgcgaccaatcggtatatcctccaaggcgaatgcctggcgatggtcccccagtaacggggacgtttcaggtgattcagatgaaagggtgcaatttattcagccctatgatccggaggtcagtcttcccagacttgttcagctgcgcgcaaaatcgtgttccttaatctttccggctctataccatttgatccctgcatgcggagactgccttgatcgctcgaaacattgacaaagaattggggggttgaccaatgaaatgcaggaggaatagcaatgtcgtcagctcgctacttgtaaaacaaatccttcaggctcgtcccgttcgccgctcaaatcaagccgccctactcctccccccgggggggaagcttgccggccgccaggtcctccagcacctgcgccgcggtgcgttctggctccccctcctgcgtcacggcctccaggatgacgttggaggcggcagggttggtcagcgcctcgatggccagggcagcaacctgggagcgcaggatagagccggtgggcttgatcctaggggcgcggccgtaggtgttggcagggcctgcgacaactccgcccttgggggcccgctgggagccctcgttggtgaggccgcctgtgtgtgaagggtgagtgggaccgcgttatccaccggaatggcaagctccagtcccgtgcacatttttgcaaagctgttccgagatgaatcctcccgacataccaggacggatgatggtgtagtccacgccagagctctggatggccttctcgccctgcctcttccagatcaggatgccccagaacactgtggaaagtaagaactggtcaatatgacgtgggcagtagagcatgggatgatgttgctgaggccttcaagcattgtgataccggcatgtaggaacaggtcggcgaccatgacggtgccccgctgcagcccaccatgcccctgcccaccccccggccactccccggcgatgagcacatcacatcccacgcacggttgaggaagaagaaccagtcttccgcgccaatggaggagaccatgacgatcttcttcagccctgcgttcgcggcggccttggcaacgttcacgttcccattgtagtccacgttgtagggtccaaaggggttcttcaggctgctcgggccggtggccacgatgaccgccccagcgccctgccaggcggatgagtcatggaagctccgtacggtggtacatgccaggagggctcgcggacagacagccctccagttctagtaacatactactctcacagataaaaaggcttgatatgcacccccaaggcctgtagtgtacctcttccacccccttcgtaccctctcacacgcagactcaacatccccatgtcacctgcaggaggctggtcaggctggcagagtcggtcacgtctcccagggagacctggactccctcccggctggggagcttgtccttggccctgctgacgtcacggacgacggcggtgacggggacgccctgctctgccagctgggtcaccaccgcggagcccacaccgcccccagcccccagcaccaccaccctgcccacggaggccaggggggtcttcgcagcggaccggccgggggcctccttggtgggacttgcgttcatacgagtcggcgaggttgaggctggggccatggagggacctacagcggtgaatggaacggtgtccgtggacctgctcgtggattctgggggccttcgactggctggaacatcacggatcatgatgaagaggtgtcttcccacagcgcaatcacatgcgcctccagtccagatccctgtaatgacctcgcgcaacgattgacctacctttgaatgggtctcggcgagtgggggcggcggggctggatcgggaggggtaggccctgagggacaggttcctcggtgatgcgaatcctgcagacaggcgttgacggcacagggacgggctgattgtgaggctcataccgtaatctgtgggtaatttgtatatcctaaagagactgcgcgttcccgagaggggctttgcgagttcttcaccacaaacctgtaccacacaacataagccgcacatggtggtgcgcgcagcgcgaatccaggcatgtgatcgaccgtactttgtttggagagaggaccaacctccctgtggacaacaataccagaacttcattcacaaggagggtttacttctcgcgatcttgagtgtaccactcgcgagcaggttgcggggatcacttcctaccaccagccagctaccatgcagcaggcgcttgtcgcatgccatgcatcgctgtacgctccatctgcgagaccatttgcaccttcagtacgccgggtcggccgatgcaagcccctgcgaccggcggcagggctgctggaaacggtgctgaagccaataaccagtggaggaaaggtgtggcgctgcgtcgcgattggaaggcacgatacgtttgcatctgctgcatcttttgcacttctatgagctgaatcaagaggtggcatgccggtctccgcccgcaggcgctgcccctcaaggacggcatcgccaagctctatgacgagtcctccggcctgtgggagtccatgtggggcgagcacctccaccacggctactatggcgccgaggaggggaccaagtccaacgcccaggctcagatcgacatggtggacaacgtcctggactgggcaggcgtgcagagtgtcaagaaggtgctcagggggtgctgttgctgttgcacttgtcgtggactggcagtagaggctgcctggatttgaggggggcacgtaggactcgaatgcatgagtgtagaagctaccaacgttgtggggaggctcctgtgcacctgccagcaggacctccctgtctgtgtgttcgagggtttgagttgtaatgcatgcagcctcctggagcttgtcccccctccgcaacccctggcaggtggtggatgtagggtgcggcctgggcggcagctcccgccacatcctggaccggtaccccgggtctgaggcgcgaggcatcacgctcagtcccgtccaggctgaccgggccaatgtgatgacgcgcgaggcgggcctgggggaccgcgccgaattccaggtggcggacgccctgagccagcccttcccggatggctcctttgacctggtgtggtcgctggagagcggggagcacatgcccgagaaggagacctttgtgagggagctggcgcgcgtggcgctgccgggggggcgcatcatcatcgtgacctggtgccacaggtgagctgcacaggagctgctggcgtggattcatcgacacagtcgagggttgcaacaaggagactcatggcgtccgcaatgtcgatgaggagtccagtgggaagcagacagggaaaggaatggcgctgcactctcccacttgcccgccacgccttcctgctcctgcaccaccacgaactctccctcccctcctcgaccacctgtccaggaacctggcacctggagaaactgcactgaccccggaggagcagacgctgttggacagactgtgcgaggcctactacctcccggcctggtgctctctggccgactacgagcgcctctttgctgcacacggaatcaggggtgggtggtgctgcgaaactggcctgcatgagggaggagcggctgcgacgacgagggagggcagcgaaccctgcagggcttggaggcaggatctcttctgtccgcccctcgtcgcccaccccacccaccctcgtgcagatgtgaagacggcggactggtccgtggaggtgcagcccttctggggccaggtgatcaagagcgcgctgaccacgcaaggcgtcaccggcctgttgaaagcggggtggaccacgatcaaggtgagggactggagtcgggggctgaggcttgcggttgccggggcagcagggcatattgtgcatcacaacaccagaagaacccccctcatgtcacctctcgcccatgaccagggggcactggtcatgccgctcatggcgaggggcctgtccatgggcctcatcaaattcgtgctgatcactggcgtcaaggccgagacctgaactggtgcggggacagtgtttcccacctgtcagtctgccctgattctggttgccattgcttttctacccaggtttgcaccccacgttctgcaaaaacttgtcgagtagcattcttgggctgtaagattgatccttgtactgcatgcaccgctggcatttcagtccaacaggtgcagctggatgcaagcagggcactcctctgcatgatgatgcaacccggcgcagtgcaactgggagggtaccagcggatgggagtaccttggtgtccaacacatgctgaaggagttctgtttccgatgacggtacccgaggctcgacagccagccggtttatgcagtgcagcctgcatgcctctgcacctactttatattcatgatcacagccatgcagcgtcatccgctgttgatgtacttgtccgtcctcgtctggtgtgcctccttccttgccagaagggatgacagcatataggcaatgctctccaccgtgaccatggggttcacgcctgaggcatggggggaggggaggaagctttcatctggggcactgcatgggcatcgggcatcgtccccattacgaccaacaggcttccgcaatctcgcttccctggaccactcaacccctactccattccagccccgagcacagacccctcttcccccccaccacctgtggccgtggggaaggtagaggcgtccatcacatacagtcctgccacgtcccagctctggccctcggcatccaccaccgagacggcagggtcggtgcccatccgggcagagcccatctggtgtgcggagaagagcggggtgcgccgcgtggcgatcccccccgcctcccgctccgccagccagcgccggaaggcggggtgccgcgcctgcgccgcgccggagtcggaggccggcgcggcgttgcccagcgccagcgccgcctcgtccgccggggtcagcagcgacgcgggcccctccggcgccagccgcgccggcagggagggcgtgccacccgtccccgccacgacctccccattcatgacgctcacgcccgaccctgccccctcgtccacaaacaggaagcggcagcgcgggtcggcgtccagggtcatcaccgtgtcggcccccgcggccgcggccacacgcgccgcaaaggccgaccctgaggccatggccccctcgtcctcggcagacaggctgtagttgaccaccggctggccgtcgccatccagggtgatggagcctggtggagggaatgtgcgtgattttcttggtttatggtatgcccgaacaaggaggtgtcgaggggtcgtcgcttcaagagcctggacagtgccagaccaggctgcgtatgcaaagttggcagcctagccgagaggaagcagcgggccaggcccgatgcaagcaaggctcttggtccagacaatgaccatgccacatcggccccgctcgatgcaaaacagcatacggaccttacccgccccaaaaactgcccgtcctgcaccggcctcaccctcctcccggtcgcggacgatggtgaggaacagagaggcgtccgggaggcgggccatgtactttttgaagtcagcctggcccagccagggcatgctggaaaggacggaaccgggcaggacctggggcgtgtagagcagtgagccgtagccgctgccctcccagtcgccgcgcgccgcgctgaaggtcgacatgcccgtcccgtcccacagctgcacgctgccgtggttggatgcggggcggcctcccctgtcctccaggtcgggcagcggggttgtggctgcgccggccagccccaccgctgcgtcgaggcggggcgggctgcgcaggaagcccaacgtcatgcacacagggtggaggtggaggtgcctgcctgcgcgcgggagcggcgtggtaggtgtgcagactggcgtggggggggtccatggagccggggcgtcgccacctcaaggcaatcaatcttgacccgcccgcccccgctacaggccccaagccccggccaaaccctcacacccatgctcccggtcacctactccggtctgtgcatagcagccctatctctctgggccctaccgccaaagcaatccctcgctgccagtaacctccgcacccaatgcccacctcgccccaggctcacccacattgccccgcccctgtatcccggagcggaggagcagggcgggcgtgtgcaggctgccgcccgcggccaccaccagccgcgccgcgacagcgatgcgcaggccgtggcccgatgtccccggcgagccgccacggagcgagaccccgaccactcgcgccggccggccggcagatccctgcgtctcggtcacgatgcgctcggcccaggcacctgccaagtttgcatggcggcacttgggcaaccttgtgcccccggatgttctgcctgcctgcctgattgacagtctgtggtctccgggggaggtggcatcctccccgcagaccatgcacatgagggggtgcaggcgccaaaccccctccgtgccaggcctggcccctgggcatgccacccgacggcacctgtgaggatgcgtgcgcccgcgtccacggcctccgtcagccacgcgcgcaccgagtcctgttttccacccagtttgcagcccagcgtgctgtcaaacgggtggaggggtgcacagcggggaggaggggcgagtcagggggggagcggggcagacggcgccgcgtggcatggacacaggctttgtctacgacagcctgcgacgcctcccatcgggctgcaacaaagggagcagatgcccctggcaggtgctgccctgctctcccaaagcccgcccacactagcacccaccagtaggagctgcagtcgtccacctggcagttccgtttcacctcgctcaccggctcgcccagctccctacagccctgggccagcgaccggcacatggcgctgtgccggtagcctgtgtcacatggaggaggagtggcgcagcggtcgggagcgcagaacctggcgtggccgaccccatctcctcgacagtctcttgcacgctggcaagaacctcctctcccaagcaggaacacacacacacgagcacccaggggcacaaaccacgccctttcccgtgcctccgcccccccc

SEQ ID NO: 18562 - DNA, 73 bp, Chlorella protothecoides
aggctacgacatgtatgaagccagcgtggatgcaggagctatcgagagtcagtacaagacgtaccaatcagaa

SEQ ID NO: 18563 - DNA, 61 bp, Chlorella protothecoides
ctcctccaggctggactcgtcatcgccggacaggatgggggcggactcggcgtgtccactg

SEQ ID NO: 18564 - DNA, 282 bp, Chlorella protothecoides
gtagggatctgtttgcctaagcagattccaagcattctctcgtagccgcgctttcttgtttttgccggcctcgcgatccagtgagcttcagactcccgctgaatgagaggtgggatgcggtctcgtcattaaccctccagattcttcgtggcagcagacactttgtatttcatagtaaaccttcaagtttcagaaccgcttagagcaatcaatcacagcgtctgagctttccttctcgcagatagtccctggccatggcgtcagtggcaatgagcctgtcca

SEQ ID NO: 18565 - DNA, 63 bp, Chlorella protothecoides
gtagcgacatatcttcgactcgctcgaagcttgcgcggataggggtggtgcgggagtgtcgga

SEQ ID NO: 18566 - DNA, 66 bp, Chlorella protothecoides
gattcttggagatcgtgaacgctgtctcccaggatcgctcgggatcgtgggagctttggtccatcg

SEQ ID NO: 18567 - DNA, 73 bp, Chlorella protothecoides
tgagggtaaaggcggtgctcttctcaccccacctccccacctcctcccagcccctgccaagatcgacatgcgg

SEQ ID NO: 18568 - DNA, 80 bp, Chlorella protothecoides
agggtcttgccatgaggaggagcaaggtctatgctctagattgcgatagactattgcacaccggactcaccccgagcatg

SEQ ID NO: 18569 - DNA, 65 bp, Chlorella protothecoides
ggcagcagctgatagtagccacctccagattgacagagtctgaatatcgaatgtgtggttctttt

SEQ ID NO: 18570 - DNA, 61 bp, Chlorella protothecoides
aatttatggcattatctttaagtgaaatatcagtattactagaacaaaaaatttcaaatac

SEQ ID NO: 18571 - DNA, 85 bp, Chlorella protothecoides
tgcccctgcgaggcatacccctgcattaaccccacacaccaatcaccactcacttgtgcagcttcttgacatagtccggggcctt

SEQ ID NO: 18572 - DNA, 61 bp, Chlorella protothecoides
ggcaccggagcctatgttgttcctgtccctgccccgcccgggggcgatgttgaatctatcc

SEQ ID NO: 18573 - DNA, 72 bp, Chlorella protothecoides
ttgcgcaccatcgcagaggatgtatcgatgtcattgtgcattgagcctcatgactctcctgcctccgcatca

SEQ ID NO: 18574 - DNA, 64 bp, Chlorella protothecoides
gagcctcatgactctcctgcctccgcatcaaggtgctgaggagtctgtgcacagtggacgaggt

SEQ ID NO: 18575 - DNA, 17302 bp, Chlorella protothecoides
tccccacccccgtccccacccctactcccacccccaccgtgtccggcgcctccgcccaggcccaggccgccgcccaggccaccagcagcggctccgaccttggcaacctgatctgcaccaacccttccgccgccgcctccgccctggcctcggccttcgcctccggcgccggctccgcccaggccagcgccgccgcccaggccgtggccttcgccggcaacaagtgctgctccaacctgagctccgccctggcctccgcctccgcctccgcccaggccagcggcagcggcaacgccaatgcctttgctcaggccgccgcctccgcccaggccagcggcggcatccccgcctgcgcccagggcgcgcttgcccaggccagcgcctctgcccaggcctccagcaacggcggcagcgccaacgccaacgcctctgccaacgcctccagcaatggcggcagcgccaacgccgccgcccaggccaacgcctccagcaacggcagcggcagcgcctctgcctcgtcccaggccaacgccttcgccggcggccgctgatgagtgagtggcgtgtgcgagcgttcaacacgacctccacccctttcctgccatgcgccaagagcatgaaactctccaggtctccccacatgagacccagcttgcagacagcaatgccccccagtactcgtgccaaatgtgctgcacctcttaattcctgattcatccgaggccccacaacctaccccttgatccccctacacacaattaaccctaccttgtgcggttgtaagaagggtccattaaagtatcgcactcaaagagggggggtgaagtgcgaggtgggatgcaccatgctctgaactgattgacatcctcgcaaagtaaagggcatgattcatccagctctgcagtgtttgcattccatctgcggtgatcagtcattctcgagaggtaataggatttcacaggtgtgttgttgccttccctaggattacagtgcacatatatatatgatctagggcacaggcttggcgtatccccagggagggtgtggagacctccgccctgctcctgaaccagaacggcgttttcaatcgcagagactcagcggctgacaactgcccgaagctaaccaggcccctttaggataggtggcaggggcttggctccaacaaaccacacgtaatggatccaggattgcgagcagcgagtggcccatgctgcctcctccgctctccgggaatcccctaggatcccgctcctcaggccctgcctcctccagcccccgccgccctgacaaggcgggagaagacgccacggcccctggccagcaggcccggctccccactttccaccaggtgcccgtccgacagcaccagcagacggtcgcagtccatgatagtgtggatgcggtgggcgatgaccaggacagtgcgcctggcgcggccatcgtcgcccgcaccggtcttgctgaaggtgcgcacggcctgtgggtggggttgagtgggaaggttgattgtgctgtgctgagaagggtgggggcgcccagtacctacactctgcaggcacccaacgttaagaaatcccagccaccgcttcagacactgcaaaccctgccacgctgccgggtccccctcaagaataaagcccatcacctcctgaatgaggacgtcggtcgcccggtccacattggcggtggcctcgtccagcgccaggatgctggctccctgcaataaagaatggaataggattggatgctgggcgtcctttgggggaagggattggatctattcttggtcggtccagcacattgtctctgccggggcctggagccgcacagccagcctactcccgagggtattagcactttaaggccccccacaatcctcctccttggcatcctggttccacaggctgtcacggctgacatcccacaccattgaagtagctcctccccttcgaaatcttgcacatgcatgccgacccaatcccgcgtctcacaaagtagggtcctccgcctactaagatacaatccactctcctccaaccctacacaacatccaacccccacacccacctgcagcagcgccctggccaggcagaagagctggcgctggccgacgctgaggttgtcccccgcctcctgcatgcgcccctccagcccacccagagcgcgcaccaccggccccagctgcaccgcgcccagcacctcccacagccggtggtcgtcgaaggcgttccaggggtccaggttgccgcgcaggctgccggagaagagcacagggtcctggggaatgatggcgatctggcggcgcagcgcgtccagcgccagccgcgcggtgtccaccccgcccaggcggatggagccgcgggtgaccgggatcaggcggaacagcgtgagcaggagcgaggacttgccggatccggtgcgccccaccacgccgcacgacagcccgccctgggagagtgagttgggtgggctgggggagggttgcaagcctgtgattgggactgggagccaatcaagcagcatgcggtccaggccccaggcaaccggcctgaggggcggccaggggtcgaggctgcaagagccaccaggatgccgtctcccatggtcacgctgctccccactgcaggctaccatggtgctcaggcgccgagaagcacacagcatgccctgccgaatgacaccaatccatggccatccccctccagaacccaccaacccaaccccaccaacccaaccccagtccctgcacaatcacccccaaaaccaccacacacctccagtgtaaagctgaggtcgtggaggaccgggggcaggccctcacggtacacggcagtgacgtcgtcatactgcagcatccctgcccccggccagcccttgggcgggtgggggccgccctgggccagggtgggcggttcctggggcagccgcgtgtatgccagcatgcgctccacgctggtcatgtggttttccacctcggaggcctgtcgcaccgcccactgcagcatgccgcccagctgcaggctctgggacaggcccaggcccaccagccgcgccgacagcgagtcgtgcacgcccatcatgagcagcggggccgccgtcatgagcagggccaccagcaggtccagtcggaagcccacccagcgcgcgcaggtgacgaagacaaaccaccaggcgccgttgtcagagaggtcgcgcaggaagcgggcgcggaagcgcggcgccgcggcgtacgcgcggatggacggcaggccctgttcgtttagttttttgggggggagggggggtgacttggggtggggttggtggtgtggtggactcggggctcagaaggcagcacggcggaactagcttcaggcctggtggggcagcacaggccgggtgcgcaggccagggatggaccctgcacccttgagattgagccatccctgcgtcgccctctcccaccaacatgtgcgcaccagacccctcctcccccaccttgaggagtgcggagaaggaggcgtagaccgggctgcgggaggtggcctcaaagcgcttgacctcacgtgaggtgcagacgtagcgccggtagaccagcacaaaggcgatgcccaaggggatgaagatggggatgataaagggcacgacgaccatgagctgcagcaggcgaggggtggttgggctcgggttgggggagggtgggtgggaatggggcatcttgggtgactctggggcgacacagagcacggcgaggcaaaacactgacagagcggcgacttccgtgcgtctgggcatggccagacatgcgcgcttggcgtgtgctcaaggcgacgcggtatcccttttgatccagctcgcagaatgacatggacaagagcccgtccaatcagcacccctgcccaccagcacaaagcagcccaggacgatcatggcggcctggatggcatcaaaggcaactgtcggcagctggtcatccacggccccctgatccttgctgcatgacgggaagaggaggagggcttggcgtggttgccatggaagcccaactgccgccaagaccaggcatgcaccaagcatggccacggggcccgagggtccaaccagcgcgcttgctcctggggaaggacccaactctctgggcccacgcacctgaagcgattcagcacacggccggtggggttggtgtggaagaaggagagaggagcacgcatcacctgcatggggggatgggatcatgatcagtcgcaggggtattgggaaggcccctcgcttgctttactggatgagtgagacacaggatggcgggacaggcacgctttccagcggtagtacccaaggccacagcagcatgacttgccatccgaaccaccccactcacccgctcgatcatggcgtggtgcatggccgaggacgccaccagggtgtaatggaaaaagagctgcgcacgaaccagggagatggccaggacgcagctcaccatgatggcgtagccccagatccagaaggcctgatgcggatttgagggtggggcgcaggtgggagagggcagcaggaagggggtggagggggggaagcatgctaccaaaacccacagagtcaacgcactcacaggcacgtgtccctttcatcccagcacacacctcctgctgctccgcctctgacttggaggaccagaccgcaatccagtagtcaccatagagatacacaccctggcccacaaacatggcggctgcgagcaaggaagagtggatggctggcttgtgagcgggcacagcagcgagggcttcgtgggaggggcccgcgggcttgtcgacatgtcccaactaacccaactcatcgtcgcacgtacaccattttgttcagtgcaacgatcccttcatcgattggttctcaagtaatgtgcagacctgcctgcaggacccagacccccatccaacctgcgatggtgatgacgatcgaccaggtcatgtagccacagtacgcgccatacacgtgccagtccacgctgccgatctcccgctcctccgccaggatcagggtgccttgggtggaaaggaaggagggtcgacgattgtacattgtgtagggcacaggtgctaggagaggctcactgacgaggccgctgatgcctgtcgtgtacagcccaatcactgcccggcccctgacctcgcgactgcgcaacaatgagagtgtctgtgctgtaccatcgccctggcaccacccctcaacaggacccttgtcttctccaaacaccccaccaagcaccccacctgcagccgccgtggatggcttggcagcctcagcaaaggagctgccctggtcgatcaagcgccggcgcgtgaccttggccagcaggcggctcactatggaggggtgcctgcccggcctcgcctcgccgcggtctcggttctctgccggcgtcctgtccggggctcgctccggtctggaggccggcgcagcgcccggctggcattcggcatcctgtgcggcgtcctgggtctcgtcgccaggcctggcgtgggccgccatcccctcgtcatccacctcccccacctcctcgtcctcggacccaagctggccgtcatacgtcgtgtcgtccagcgccgcctctgcgcagtgagaatcgatcatccgaggttgacagctggcagctggggtcatgcactgcgcggtgcccgcaacatgccggggatctgacgacacctcaggctccccccttcctgctgcccaccctcttcctcgccccgcacgaccctcaccttaccccgcccagcatccacggccgcccacccccctcccctcccaaacccaccgtgcatggccgcggcctcgggcaccccccgcgccgccagctgggccatggtcccgcgctccgcgatggccccgccgcgcatgaccagcacctcgtcgcaggcggccaggtgctgggtttggtgtgtggccagcatgcgcgtggcccccgccatgaccccgcccggcccgatgcaggcctcaaacagcgtgcgtcccacacgcgggtccaccgccgacagcgggtcgtccagcagctggacctctgcgcggctgtaggccgcgcgcgccaggctcagccgcgcgcgctggccgccggagaggttgacgccgcgctcgccaagctccgcggcgtcgccgccggggagcatggccaggtcgtcgcccagggcgcaggcctggatgacgcgcgcgtaggaatccgggtcctcctcgctcccaaacaggatgttctcctgtcacgcgtgggtgtgagggggtgggtgcccgcaggcgaactgtgcaggggggagcacagcgctgcgccagggcgtccagaggtgctccatccattcctgccggggctgggatggtgacctcatggccaagcatggacgccctcccccgcctgaacaagaaacaaccccaccccactgcaccaccaacaacaaccttgacggtgccggcgacggtccagggcacctgggagacatacgccacgcggccgccaacgtccacgccgccgccggccgtgggctgcagctccccgaggagcacggagaggagggaggatttgccagaccccacctcgccgatcaccccgatcaggcgccccggcgccgactccagccggatgccgcgcagcgtcagctcgccagggtcgcggctgggctgggcgtctaccctctccccctgccccccctgggcatcctccttctgtccggtcttctctccagcatcgcccggccccacccccccatacgcaccgctgccctgggcccagggcagcacctcccagtcaaagtcaagaccggggacgaggagggtgcccggcggcgcggtcgagacgtggtggtatggcggcgggggctcggccaggcacagaaacttcccgatcctggccatgctgacgcgcagctccgacagcgcctccaccgacttgacgaagaagtcggccatgtagagcttgggcagctggagcagggcgatggtgtagaagacgttggccacggtgagcacgtgcccggtgccgcgtgcggtggcaaaggtgatgagcgccgccacgggggagatggcaaaggccaggcccatgttgagggcgcggatgcgcgcctgggcgcgcacgaagccctgctcccgcccacgcacggcgtggatgcgggccagcagcccgtcctcccagcccagcatcttggccgccagcacgccagacagcgcctcgctggtcagcttcacgcgctcgtcggtctgcagcgcggtggcgtggcgcagcctgacgatgcgccgccccagcaggccctgtgggaatgtaagcatgttggtgagtgtttacaagaaggagggggggcgggggtcgctggagatggccctggtgatcaaggtcaaggagggggtcgcactggcaagggacagccgcagtgcaattcagatgctggccccgcatgccaatcgcgaacgatgctctgcaacacaacatacacatttacccctcgacctcacccctgtacaacacagcactccgccttgcctggatggggatgagtagaagagatgtggccacgcctgcgacggaggcagcaaaccccatcttgaggccgatgaggaccaggactatggccagctccacgggccctgcgatgaggaagacgccaaaggtgccggcctcgtcgaagcggcgcacgtcattggacaccaggttgacgatcttgccggcggtcacggccgccacgcccgcggcgttcaggcgcagcaccttggcctgcaccgcggcgatggcctgcaggcgcatggtgaagccgttgcgcatgcccttccagaacagctggtggtgcaccgcgcagtagaggtagcccatgagggccagcaggcccgaccacagccagccctgccaggtggggaaggccgccgcgtcgccgccgctgctctcccagccccagaaccaggtgatcagcttgcgcaggatgaggggggagccaaccctgagggtgtgggtgaggtggggtgttggggtgggaagtttggggaggggagtgtcccaatacgatgcggatggtgggaggagaagggcagcgtgaatagggtgagcttgggggggtgtttttgtgcctcagcaatcactgcggtctgctccaataatccaagcgtccggcacctgttcggccctccctgcgcagtgcacccccaaactctcacctgcagccgacctccgcaaaggcccacgacaagtgaaccagaatctttatgcggtatacttttaggtaggtcctccacatgatggcggcgggcgtaaggccgggctgggatgacacctgccaagggttgggggggcgggggatgtacgcccataacatacacaagagtcagaggtgccatgaaagcatgtcatgatgatgcaccgcacctgcgcaggcctgcatgaggtaatgtcctctttccctctggccacccacccattgccccacaccagcacgaacacacctgctggtagacggcatcaaaggtctccgacagcacctctgcgcggttattggcgggcaggagctcagggccgacgtcctcatcgatgccacccaccgctcccaggctcaggagggagcccacgaaggagtaggttagccgaccatataccccagcatccgcataggtcttcagccctgcccgcagccgcttgagcctctcctccctcccctcgctggatgtccagagcatgccacacgctcgaggggtgggtggtgccctgatcttatattgcagcggggtcctcacatccgatgcctagcatggaagtcgtgctgctgggccacacgaatcccgtctctcctggcattgcaggcgcacactggcgagaatggagttccaggtcgagttttggtaatgtaatgtctgtctgtgtaagccttgctagtcgctctgattagtccctcagcggcatcacgtttgggtgaatgtgagagtgacgtaaatgcggtccgtccggtggggacaatttctcaccaggggtgccgcgaattcctcgagccacctaccatcgcatggttttcctgtgaccgcatgagaccggggggtagttgcaccggtatccatctgaggctgtcggaaagatgcctgatgccgagagacctcctcgtgtcggtcccgttgccgaaggcgtccccaagccatacaccacccccaaagggttcgtgccgcccacgatgggagagcaatttcgatatgtgagcatgacatggattgatgggcaaggtcctgatctggaatctcgtgggcaacccattccacaggctcttgcaacttccctccctcctcaccaaccctccctccattcccacaggcatacttgaaccatcctcagtacagatacgggtatgcagcagtgttactggtgggaattattgctgtggtggcagcctacgcagatgacaagcctatgggagccctgaagcccaaggcaacaccctcatcaaaaaatagttgatgcgtatggagtgcaagtgcaagtgccgaggcaccaggaaaatgctgcagacctgcccctatggccagccgtttagggagattggccttgggtgtgagaggggcgtcgcctcagaatccaatgtgcgcgccgctctgcacttggagcactgattgcgtcctacatggccccgcctagtgctgggggggcatctgctagccagagctggaggtccaaggagggtctacccatggaacactctgaggagatacagacagctgtgcatgcttgatggaggcatgacgcctgtcccccgccatcagctcatctggaaccgccacaggtcgacctctatgtccttggactttagcctgcagtggtgggatccgatgttgtatgtatctgacttccacgtcctgatcaagaatgaagcagtgtcctccagccctctcaggctcccggttggctcgccctttcgccctgtaagtgcaatcccctgcccgaagaagaccctttggggccctgctggcccacctccagcccctggtctgcccacctgtgaaaggcgtaggtgggcggcaggtcgtagcgcagctgcgccacgacagtcgccgccccaggggccaggcccagggtcttgaccgcaaacttttggatgaagtcgcgcgtcgacgtcttgtgcagagagtacacgctggtgccggcgatgcccgccgctgccctgaggaagtccatgtcgacccctggcagcagtggatgagtggggtggctgccgattccggagggcttgagcagaaccagggccctcgcgcctgggcagtgcaggtcctgctcggcaagccgatgcgagatgcttggatggccctcctcgatccactgcccacaggtgggaggccatgtgtacactcacgctccgatggctctctcccagacccagaatgccgattccctctttcctaaagccacacctttctgtctggtgccaaagggcgggttcatgatcacggtgtccacatgcagcctgggctgctgctccgccagcagccgcacgtctgaccgcacaaactcaatctgggcggtggtgggaggagatgctgtgggctcgtgcagggtcagagggagatgtgagaggggttgggaagtacgccttggggaccagcgagggtggcctctgtgacccaccgcgaccctgcaaagacactggcaggggagtcatgcaagggcagacccatactgcctgcctcttgtgtcacctgtgccgccccgtcatcgtctgcctcgtcgtcgctgtcgccaaagatgccgcgcacgttctcctgagcggtctccagagcgtcctggtccaggtcaaaggccagcacctggccagcgcccagggctgcagcgcctatggccagcattccctgctttctcgaggaggagtgtgagggcaccacgctctgagaattcgaggcattgtgcatgcagccccccagcagcactcgcaggctcagggggggagtgtgggagaggggcaggatttccttgtccaccagcccttcccatacccaggcatgatgacaaaccatgtgtaaggcagtcatgcagtccctctgcaacccctgctcgcaccgttccacagccgaggtcagccaccaccttgccttcgaactcgccatagctgtttgccaccttgagttgaatttgttggatgacatggtgagcattgcccactctccagcaccatccgcgcatgagcacatttcagcgaatcaagagcctcaggtgactctcgggaaacaaagcagtgtcatactggagtccgcctcaccgtgtacaggaggcgggacgccagatgtgctccggttggatactgctccaattctaccttgggctgcaggaatggtgacacctcctgaagagcatggagaacaggggaaacggatctcgatctgagggggcgcccacattctaatagaccagcaactcttcatactccaataaatgtacctgcatgagggattcgagctccttgagcttcatagtatgggtcggtcacaagccaggagaccggtgtcaggacgtaaaacacatcgcaaccaggtattgagaggtcttacaggacgtgtttattcaaggagattgatgcagaagagtgcctcggtaatcgtgcatcgtgttgaaaccatgtcgatgttatttcccagggcgcctgacataggcagcgcgccctgccctgcgtcctgcgatccatggaagggcgccagaccttccacaaaacccggactgcaaactccagcccaaacaaatcatgcagaggacaacctgcacaaacggaatacgcagctattcattgagttgtaatctgtaggtcaagctgcacgatatccgtgagagagcaacggcacctttcggagtgaccaccctgacttgggcgtgcgagaaagagagcagggggccgccggcgtaactggaacccagtttgaggagtactagaggtcacgcgcatggttcaccgcgctctggtcctgttgggcgaagcggtgcagcgctcctcgcggctgaggccacgtcgggctgccctcgagctcacggactcagccgcgacccgcatcaagcagctgcttgagcaaagacacaaggtgggcacgcgaggatcggacgatgcagatatgatccggacggggtgtccttctcatgcgttgcgctgtggtggtgcaccagtcaaccgcacatgtgaggctgacgccagtatgtgaccgaccacaacccacaggagttcattaagctaggagtgaagacgcggggatgcaatgggatggcgtatactctgaactatgccggtacggaggctgtggcgtatggagcagagctcattgggttgctcttgtgagagtgttgcaacatccctgcttcagttcttccctttctcctgcctgcagactccaaagcaaaatttgacgagctggtggaggacccccgtggcgtcaaggtgctcattgacccagctgccctcctccacgtcctgggcacgaaaatggattatgtagaggaccgattacggtgagctggggcctggaagagaggggagtgggaaaggggcaaggattcccggcccgctgctggcttgaatgttgtggtccagctcgctgaccctggcctgtcccttcccgcaggtccgaatttgtgtttgtcaaccccaatgccaaggggacatgcgggtgtggcgaatcattcaccacagacgtcaagtctgccacgggctgatggcttcctgttctgtctgctgtggtgccatagcttgcccgctgccctggggcgtttgtaagatagaaagatcatggcggctctagagcgtggtgggactggcaacgatcgcacttgggttgggtacagtgtgtaagagaaatcttcatggacatgcccaggcagcgatgttgccgtgcactccacaaacccctgctcctgtgcaagctttgacaaggcgggcacctgctcacagatcgccgtcgtccgcgtcatccagctcgggggctcggcagcgctgctcggtcccgaggcagccggtgaacaaacggcggccacgtgtgactgcggtgccccgctggcagacgcagtcggcccggagctcctcgccgggtcccggagtcatcaccttgcgggggtagccggtgtcacaccacacctccgtccctgggcggcaggcgtgcggggggtggtcgctgcgattgttgctccagccttagtgtatcaatgcggtcgctgaaacgagcgctgcactcagcaaataggttatgtatgcaggtccaatttatctccctccactgcacgcaagcaccccagggcagtgtccaccaccctgggccggcgaaatcaggatctgagaggtaccccgaccctcttcctggggccgtacgctcctcgccgtccaaccctcgacccacctgccgcctggctccaccccgagttgcagggctgcaggtcctgggtcggatcctgcaccaccccccgcgggcccctgcccccatccagcgcctcgatgcggaggaggaggggggtgggcctgccgtccgcgtcgtaaaaggcgccgaccacgtggcccaccaggtggtacttctgcggtacaaagtgttgtaaggcatgtgtgtgtctacgcgtattgccctgggggccagagggacatgaggtcgtggagaggtgatccaaggccgccactcgtgcgccaaggcagcgcccaccacccaggaccggcatcgcatatgctgagggtggaaagcacccccgatgcagggcagggacggccgagaggagggaagctggcccctggccgcgtgcccacccaccgtgctcttgtggtaaaagtcgcgccacttgagcacggccttgatctggtcgtcgctgaagtcgtggatgtcgtcgtgcaggtcttccacaaagttacctgtttcccagggtgggcatttgggcaggcccacgggtgaggcgcagggcaaaagggggggaaggagccactgcacaatctggagtctgctccagaggctaccactcacccctgccccccaggggctggcaacggggaccctgaatcaaggaagcattgtcatcagccctcactctccccagcacagtgtcaccgtacccgttgccagagaccggctggcatccttgcctgccaggctgtggtacccgccccccagacctgggcacagaaaaaagggagtgggtgagcagagcctcactgccccagggtctgagacggccctcaacatattgaagaagccatcgttctcacccctgctcccccaccatgcaagcgccccgtatcccagcgcgcacaacaagcgcctgacccaccatagtgccgcttccctgcagaaacgtcgtagacctcccccatgaccgccatgaacaggcccaagccgtgctttccatcatacttgctcagctcctcgcggttcagcagcaggggtgccttgacggggaagtcaggggaccgagaaggatgggcattaggcggggcagaaggtgctccttagctctcctggccggccctcgaccacaatcaatgccccctccaaggcccccagcccacctgccccgcatctaaaccggcttttccccctctatgttccaaggaggccggtgccgggcgcctatgatagaagatgagcagccccgcagccagaagcaagccaacaagcagcagcatctcgctgcgcactggtgtcggggagaaagtgggaataccgtgcttggatgcgcagcatcatcacactcgctgattgatcactcaagcctgcaggcacacgatgtcacaggcacaggcacgtccaactcacgggacgttttgatggagctcgccctcccagaagtgggcctgcgtcttggcacaatgcctgcaatggggcccttggacgccgattagaaattgagggatcggtgttccccgcctcccttgattctacaccccttatccccctcccttccccctcgacacacacacacacttccaccctccccaccatgatcgacgccctccgcacgcagattcgtgggtggtgggccggggttctgcaggcccacctctgtgcagcgaaattggtgcgcggcagtgtcaggtgcatgcaagccaaggaggtgctctagggaattagccatgatgcatggcaggatgcccgacgtcaaatgctaccatgccgcacctgggttacgctggcgcacagtattcccagctgaagtgtaccagctcattcttgcaaatcgagatgcgaggtgtgagcgtgggcggggagactgtccgtgccgaggggattgctcgacaagctagcggaggcaccttcccattaaggacttttttcccggtgatccagacgcagatcagtcaaagaactcggattatctgccttgcatataatagctaggggtccaggagcgccaagatgcaaaaaagattttcggaaacaggtttcgatcctgtgacctcggggttatgggccccgcacgctacctctgcgccattccgaacgctgacagcagccagtgcccatctgattgggccgaacttccttgttgtataccgggaccaataaacgcgaccatgttgcggaagaacggtcattatcgcaaattcaaccagaatgctacgagaaatatctcggtcaacgagtagaatgaccctaccatacactttgatatcttggaatgaaaggggggctatcaggtccacggaaggaatcatgtcatctgtctgaccctgtagcaccatcatgcacattggcttctgcaaggagaagcacaacatggccgtccagcactagtacagcaaacatgttactaagaaggtctcctcgcattcaggtattgtcctagaacattcatgctgccaggaggtcccactccagcccagctttggagtattgatgggcgaggacctcgatataccggaaacccctcattctcacactcctccaatctagagggtggacttgatccaacagcttgtgggacacgccggggtgagccggcccaggagatcctaaagcggggaacaccgctgagaagatgagatgaagaggaaagcgcctctcgtttatgcgcgcaattcggacccaccgtgtccaagggctgcgcaccaaccagagtgcaagcagtgattcggtcttcaggacccgggagaaggctgcgtcgtgaaatgttgggtgtcgtcgttttctctgacccgtggcaatttcgtaactgtcaaggaggaggaaaggaaggatcgccatggggcatacgatctaggggggaccggccctctctccctgctatcaagctcgtgtgggaccagaagagcactcgatttccaattgcgcagcccagcgctcgagcctagcgtgttcatctgcacagtccaccgtcccgcccaaggtcgcactcaatgtcagacacgggcacctgagcatgccgatcctcaaggtcctgcagtgtcccgcgaaaagctgcaggctcctaccatggactctccttgcggcgctcgtcgtagctggacagcttccgggcggggcctgcctcccggcttcagcggtcctcgccacggacggggaggtcgtggatccctcggctcggcagatcaagccttccagccccctcccgaaccccgtcgcccctggtgtggtgctaaatgcctccacactgctggccgcgctggaaatgcttgagtctgcggacgacagtagccacgcggacggtgcccctacccaggtggtgttcctgccaaacggcagcatcagcatccccacccccggcgggaacagcaccaccgcaccccaggacgcgtcccccgtggtcgtgcaggacctcgaccaggccgcagggagcggcgacggcgacggtgactttgacgaccaggagctctccaggctgtcccccgagcatggcgccgacctgggcgcgacctcctcccagagccctggcttttttaatggggaggagggcacgcccgcaacacggccgtccgtccctgtcatgacgggcgcgtccctggtggtgcatgccccgccggcacccccgcttcccccagcgcgcgccctcccgccggcccctgcgccgggcgagccctccccagccccagaacccagccccgagagcgtggggagcgccacggagactgtgaccgcgctctcgcctgaaagaaactccagccgggaggggcccctgcccctgccctaccccaagtcctccgtcgacggcagcggcaagagccagaccatcgccatcgcggtgtcaggtgcatgtgcttggtgggtggctggcgcttctggcgcaccatgcctcccaggccatggtgcgcagccctgatgtcctacaagcccccaccccctgaacaaggcttcctgacaccaaacccccccccccccc

SEQ ID NO: 18576 - DNA, 68 bp, Chlorella protothecoides
agctctttcacgatgagtatctcctggacgatggcatgctctctgaggcagagtaaaccactcaattg

SEQ ID NO: 18577 - DNA, 198 bp, Chlorella protothecoides
tgtctatatagattattcctatataagatacacaacaaatttgattcattttaaattttaccagctagcttttacacatccttgtataaggccttgatttgctaaatcacgaaattttatacgagaaatcctacaaaatttatatactgaatgacctcggcctgtgacaatacatctattttttatacgcacacgtct

SEQ ID NO: 18578 - DNA, 84 bp, Chlorella protothecoides
tataaaaacaataaaattaattattaaaaaataaaaattaaatataattaaaaaagcaacataaataattagtaataaaaaaaa

SEQ ID NO: 18579 - DNA, 61 bp, Chlorella protothecoides
tccaaccccttcgtatcaacagcgcaggaaacccacctggacagtaggcatcctggggtca

SEQ ID NO: 18580 - DNA, 236 bp, Chlorella protothecoides
atgccgcatgacctttcccatcttggcttccttgctggtcagattggtcgtcttattaccatttcaactactccggttatcgctggcgactccttcgagatggacgccgttggcgctctccgtctttctccattgcgtcgtggccttgctattgactctactgtagacatttttactttttatgtccctcatcgtcacgtttatggtgaacagtggattaagttcatgaaggatgg

SEQ ID NO: 18581 - DNA, 162 bp, Chlorella protothecoides
caggtccaaaatggaggggtgctgctgtgtggaggtgcgacaagatgagctgcaagactgcccagggtcattgccatggttgatcagggttgctcaaactcgtcagaattgcaaatggtggatgcgggagacttcggataagagtggaatgggaatgggggg

SEQ ID NO: 18582 - DNA, 124 bp, Chlorella protothecoides
aatggctccaaggcggatcgaacgcctgaccttggcatcttcagtgccacgctctcccaactgagctatagagcctctcttcgtgatttctcggattttcccagcgcctattacccacacgttt

SEQ ID NO: 18583 - DNA, 62 bp, Chlorella protothecoides
ccaattccagtcatgcaacccccccgtccagcgcgccatactcactcatctactccttcctg

SEQ ID NO: 18584 - DNA, 137 bp, Chlorella protothecoides
aagaccgcgcatcccctgttttcttcacagcctttttgtaaaacaccgcgagaggggtgcagaccaaaatctccacctacaccatcacttcggacaagattggctgtcttgcattgatgactgttttatctgtgatg

SEQ ID NO: 18585 - DNA, 87 bp, Chlorella protothecoides
atttcattagcccacaaggcaaaattttgtctaaaaaaattactggcttaacctcaaaacaacagcgtactgtagcaacagctataa

SEQ ID NO: 18586 - DNA, 77 bp, Chlorella protothecoides
ttgccgctccctgcccagctgcggacggcaaccggtgaaaaatgaagaactaatcgtcacgatataactgcattggc

SEQ ID NO: 18587 - DNA, 222 bp, Chlorella protothecoides
agcaattcgaaacacaacaccacttattgaagtaaaagctcgacgggtagggggctcgacatatcaagttcctattgaagttcttcctgaacggggaactactttagctattcgttggatattaacagcttgtcgtaataatcacgggaaaccaatgtccgttatattaaccaatgagttaattgatgcttctaataaagcaggtaatgctgtgaaaaaaaa

SEQ ID NO: 18588 - DNA, 184 bp, Chlorella protothecoides
cagccacagatgcattggagagcaccggcacgcctggcagaagctcggcccaggtgattggagactcgatcatgagcaggaacctggtccgtaggagcgggagtcatggagcacctgtcccaacgttgcttaccatgttgcacatgtactgtactcatgtcaatgactcttcatttactgcagg

SEQ ID NO: 18589 - DNA, 78 bp, Chlorella protothecoides
cgccgctgctcaccaggcaaacaggttcctggtgctgggcctcacctttctgtgctacacctcgtaccatgcctcccg

SEQ ID NO: 18590 - DNA, 74 bp, Chlorella protothecoides
aatcccatcaaaggcacgacaagctgctgcgtgaatgggggaatgtgtcgggaggctgggagaatgggcattgg

SEQ ID NO: 18591 - DNA, 62 bp, Chlorella protothecoides
atatcgattacttggaaaataacaaatttaccattaatatatgcccgcaacagaatgataaa

SEQ ID NO: 18592 - DNA, 260 bp, Chlorella protothecoides
ggggagcaggggaggagcacaggctcgaacgtgcaggcccgcctgacgtggcttcgagcagcaggagccctgcgtaacacaatcaaaaaccagaacttactccaaattattgatgatgtcttgtcgacaggcgttgaaggcttctgtaatggcagcgtctgtcatttgagctcgtggctcaaaacgcgggctgaagaggctgcaacgttctttatccttcttacgagggcaatagcgcgtaatgcaatctaacaaggaat

SEQ ID NO: 18593 - DNA, 177 bp, Chlorella protothecoides
ggctgtacccccgacactgaatcactttttggctctctccaggtttggagactgcttttatcccaggcgccccgcggcgcctgccccatcctcccgcccaacccatctggggaggctctgcactgtgatccctcacatcaagagcgcgatcaaggtgtgtgtgatcctcaaaatgga

SEQ ID NO: 18594 - DNA, 61 bp, Chlorella protothecoides
atcgagggggaggtgaaagaggggtgcaggggtcgagcgcacaagatgtccatggcgctcc

SEQ ID NO: 18595 - DNA, 281 bp, Chlorella protothecoides
ctgccaccacttccccgccctccaggtctcgtagcaatgcatgttgacgtatatctggggacaagggggcggggcaaggggtgaaggtgcagggaggacctctcctcacgtccaggccctttgttccgaggaaacatgctcctgctggcaaggagacgaaagtgataccaacagcacacaacctattccgacatgccctgcatgcaccttggcaaccctctgcctgatcccagtccatcctcccctcccaccagatctgcactggccagcctgtccgcgcg

SEQ ID NO: 18596 - DNA, 61 bp, Chlorella protothecoides
gagcgatggaaagcacgcagcaagggaggaagaccccctgaccaggtcaaatcgcccaggc

SEQ ID NO: 18597 - DNA, 72 bp, Chlorella protothecoides
gcatgccatttgcaccccgccgatcgctcaccgatgttatcattcccgacgttgttggtgccaaagttgttc

SEQ ID NO: 18598 - DNA, 81 bp, Chlorella protothecoides
ggatatataccaacctcattgcacacctatccgtgcgtcaggacttgaaatgacccaccggatcggtctgcgcgacccaaa

SEQ ID NO: 18599 - DNA, 326 bp, Chlorella protothecoides
gttgaatgtaaaggctgactacatcagtgtgcacagcaatattagggcagacttctgagtacccacataccgttcatgaataatttccccggctctcttgcagttagcagcattgtctgtgatgacaacttgcacattctcgaccccaatctccttgatgacagcttccaattgctccacaaggtaatctgcagttttgcatttgccagcggtgtccacgctcttgatgaagcgccctcccttgcttgtaacagccaggaagttcaataagggcttcttggcttggtcctgccaaccatccatcacaagggcgatgccctgcacag

SEQ ID NO: 18600 - DNA, 190 bp, Chlorella protothecoides
atatcatattttgggtcactattgaaaatatgatatgttattttattccactctatttttttattatattctgctcgcttggtgaaattggtatacacgacagacttaaaatctgttccttttagggtatcggttcaagtccgatagtgagcaatttttaaattcaaagataagggcattcttattcaaa

SEQ ID NO: 18601 - DNA, 78 bp, Chlorella protothecoides
gttccgtgcaagagtgtgtgcacggcgcatctaaagcgtgctgagttaatgcgtggcaatgggtcaccgcagctgccc

SEQ ID NO: 18602 - DNA, 61 bp, Chlorella protothecoides
agggacacgatccatacaagtcgctattctcgagcttaccaaattggaatcctccaaagct

SEQ ID NO: 18603 - DNA, 100 bp, Chlorella protothecoides
ttgccttgccaaggcaaatgccgagggttcgaatccctttttccgctttttttgataaagtgaatataaccaattatagtcttgatctccgagctttttt

SEQ ID NO: 18604 - DNA, 909 bp, Chlorella protothecoides
  modified_base (375)..(384): a, c, t, g, unknown or other
ggtttgcggccggcggggcgctgggcggcgaggtcgccgccgcgccggccgcggacggccccaggtggaaggcgttggccgtggcgcccgtgttgtacgtgctgacgcgcacccagccctcgccgtcggcggtgaccagcagcgggcgcagcgcgtccagcatgaccgccgtcacgcgctgggagccggtgtccaccgcgtgcacgccctcctgcaggcaggcgcggtgcgggccggaggtttgcaggcccctgcatgcgttcagtcccgtctcgcgctgcgttggtgggggttggggaaggtatgggtggggtggggaaggtatgggtggggtgggagaggttgatgcgtgtgctggtgggtgtctgttggtgnnnnnnnnnncctcgcgctgcgttggtggggggtggggaaggtatgggtgcgtggggaaggtcgatgcgtgtgctggtgggtgtctgttggtggtgtcgggtgagaactctggtccgggggcccccgactgcgaggcctcgcagccaacgatctggtcaggggcagcggtctgcagccggctgccgggccgcgactcgacgtgggagcacggaggcgtcgcaccagggggccaccctggcccccaccctgccgcgcccgtccgcgccgcccatgcccgccacctcccagcacactcccgctggacccctcgaaccagcgacaacccccccatcgacctggtgcacgccggccttcaccagctccggcgagggatcgtgcagccaggtggcgtgcggcgggcccagctcctcgatggcctgcggcgccagcaggggccaggtgaaggcctcgcacgcggccgcgtagacgggcgagggccagcccgcgccggcgcccgcccccgccccggccgccagcgacgccgagcgctccggc

SEQ ID NO: 18605 - DNA, 6889 bp, Chlorella protothecoides
gccaccccccccaccaccgggaaccccaccccccccgccaccacagcacctgcctcccgctgccggtccaaacccctgggactgggccgctgccagccaggtcagtgcatacaaagacgtggcggacctcatgagggaccgtgctgcacggcccgggaggtgtgctttgatcctccggggcctgcccgggtcagggaagagtgccgtggcccgtttgatccgcgaggcggagaaggccgcggggaccgaccccccgcgcatactgtccctggatgactacttcctgacggtgggtctgggggctgacaaacccaggggacgcctcccatgggcaagggtggtggagacagggacagcggacgattgcatctctagcagcgcaggggcaaggcatgtgtgcggcaggttgacctcagagtgtgtattgcatggccgccgttgccgtctgccccagtcccaggccggtttgatcgaatttgtcctcgccaggaggtcgaggaggaggtggcgggcggcaaggggcgcaagaggcgcagggaggtgactggcatgcagtaccagtataaccccgacttggaaggtgagtcccagaggggtgaaaaagaaggcggtacaggggtgcccgggctagcctctcactcgcaacctccggggagcaagcagaccggctcgggagcaggacaggcacgatggaaacttggccatgactccgcaccgccacctcggtctttcatatcgatcaggcacgtaccagcgcagcctgaaccgatcgttctgcaaggctgcagtggaggcccgccacgcattcctcatcatggacgcgccaaacctgcggctggcagacttccgggaggcctggtcaggggcgcaggctgcggggtacgaggtgtgggtcgccagcctgccgcagcgcagtccacaggtgccgggggccggtgtcaggcagggcccggatgctggcatgccgcggggtgcgcaggctgcacccatcgtcatgctcaggcggtgcgcccatcgtgggacaaggcgacggctgtcctggcagcttcacagcccgtgcttccgtcaacctgtcgccccggaccccacccctgcatctcttgcacaggtgtgcgccaagcacagcacccatgggcgcagcctggaggagttggagcagctggcggcggggtgggaggagctgccgcccggcttccagcccatctcgctccagcgcttcatgtttggcggcggggaggtcgctgaggtggagatggagagcgacgaagggccagaccatgccgcggcccggggtgatgccggggcgggggctcgttggacgcgtggcggcggcgaggccggacagatgcgcgaatccgtggagggcgcggctgggggaacggtagcttcgcctgaggccggcgtaggtctggagccggcagcccaaaaggccgccccacctggcatcctgaaaaaggcaggggcgttgccgcggaggaatcgccatgtggtctgggcggatcatgcggcgtccctactggacgaggactctgggtttcagatgcccgggtcgagaccgcaggtgggggtgaagcggcggtggttgtccggaagttgcaggcggaactggggaggggagttctacgctgatggcttgccattgcacagggctgcatgccatccgaggaagttcttgctgcagatcacgctctgaatccccgtagcgcttcccctcaaatccccttgcatcgctccacattcatccagttggagcacgtaagggtcctggagggtctgggaccggcgcacgagggcgacgtccttggagcagggacgctgccgtttgccgaggctgcagcacgagagcacagcgtggagcgacgaggcttccgtgacatcctgctggggcatgggtccatggtcggctctgggtaggtgggggtaccctgcggatgttgcatcccggagtcgagccccgagtgaggtgaggagcagggtggcgcaggagggatgtcagtatttgttggctgacagatcttctgttgacagcgggcatgtgaagtttggcttccattgaatggaccctccatgccctgcgttgagcagcacgacagctgcaaacccattgtttactgggaatgtgacgaaagaatgcttggcgctgtggtgctggcttcccgtcggctggattttcgttggaattcagtcctggccataattgcacacaggtgccttgaccacaggatgtccgctactccttcgaatgttttgtaacccagttgtaaataagctcttgcaccgatacgcgcccctggagcgttgaatttcaaatgatcgggggtaccaaggatttgaaaagtatccaggtgggggctatggttggaggaaattattcgttttaagatccccatcgcccggaacctccggcaggcacgacgagcgccgttctgcgatgattttgccctacctgatagaaatgtgccacacttagcccggattctacatcatgcgtgcatctgctggcaccccgcacggtgagccccttccccctccaccaccggctgatttgatcccgcacccccccacgtcagcagctgccagtccttctaggccgcggtggactgcgagtccgaaaccagataaagtccctctccgcaccggaatctccacacattccttatgttcgcaacttcatagcctttgagagttattccgcgggcttagcccatgcgatagagagagttagttagttgagtgtgagagccgagcgttgtacgagagtcaaagttgaacaccacacctcccgtcccgacactgccccatcccctccaacacctgccaagacccaccgaaccactcacgagcatcatgtctgcctccgccgaagcccgtctgatcctcaaggtgcggagcggggccctgcggttggcgacctccgacacttgggacgctctgccgctcgcccgtttgcaccaccaattcaacttaattgttactatatccctcgcagtactttggcaccgtctcgaagacggtctccacggtcggccagcgtgccatgaccggtgccgcgtccggccacgcctcggccaacgcgtcccctgttgccaaggccgtgacaggcgcggcgcccgtcgccgaccgcgaggccctgctggccttcatgcgcgccaaccccgtcaccttctaccccgcccagatgcgcatggccatgtgaggtttcgtgcgaacttcgcgatgtctgatacttttgagagcttcttccaaggggaactgatcccccaaacgagcgtccatccatcacaaggcctttgccatacaccgagagataactccttctgaagatacatttttgagtgtgtgagaggcagcgggtacgctgtgcccgctgtagcacctcccttttgagcgccaaacatcaaccagatcctggtgtccatcccatgtccacctgctgtgtgccttgcgatgtaagccatttctggggaattctcaggataattgaggagcaggtttctgggtgtcaagcatctggtaaaagttggactgtagagggttgaatgaacacacaacatcccaaatgggatttggttcttggaggtcctctcgtcagttggcgcggctgcgcccctgcttggagctactccaaggtccctgccgggcctgccgcttgctggctggaggggcttcgcccctcccaccactgcatgccaggggctccagcagcatccaggcgtcctgtaaggggggaagcggggaggggcagccttctgtgctgctgacggggagggacaagggcggccagcttgtggtctcttcatcgccaggatcaagctgcccaaacacccgcctcgcacctggagctggggcgtgggcatgccccgcagccgctccgcccccaggacctggagtggtgcagacaggtccagcagcaggtccagccgctcgccggcggcggcctccgttgccacgggcgcagaagggcccccagggccgcagcgcacgcagcgcagccgcacgtatgcaaaacggtggctggcggcccggcagtccctggggcaggcgtcggtgtgcgcgccggggtcgagcacttcgaccactctttggtgacagggagatttggttgggggaatggccggtggaagcagtcgctggggcccattcagcaggcaccacttgcagggccctcgatcacagattatgcaggtgcagtgccagcaagaggttctgccccagaacaacccacatgagcgcacttgccggcgtgcagccctgcaggaacggtatggccccctgtcccctcggccagctcctgcacaaagtcctccagcagcacgaccgccacctagcaaggggtgcggaggatgaaggcttgtatcgggacttgggaaaatgcgacgatgcagcgtgagtcactgtccagtccaagaaacgctttgcggcgatgcaaggagtcctagatggtgggagattcacaggatggcaggcgagcgcgttccgggcttctcgaacgctgcccacccaccttgcggcccagcagcgcgccatcacatgcatgggcgctgatgcaggagtggcgcgccagctccgcaagcccccgctccagccacaggcgggggcggtgggtggcggggagcggggcatgggcctggggggcggtctgaggcgcgcaaggcgaggtggatggtggattgccagtgacctgcgcccagagacctgctgctgcaagggacgcagcagctctggcaggtggcgacccagctccagccgccgacactggtgggtctgctgtgcatttgacgctggcggggatgtcaccggaaccccccggtgtctggccaacagtctctgcgggcagccgcaccgtgatgcgctggagcggcagggggcagcagctacacgctcctgaactcaaggcggcgaggagtgcgggggtgggcgtgccaacccacggcagcgccgccacgacgcctgcgtccagggcgagcatgctggaggaaaggggggaagcggcatcaccttggcccttgcccggcatgaccagggccgatccgggcagccggtccaggatctcccggcgtgtcggtttgttgccttgggagatcccattgatgctcaggacctgcgaggccccaggtcacttcttaaatatagtttggcaaggaacatcatcctcccaccagcagaaaagacatgccctggccacctcccagccgcgacccacgcccaaatcctctccatatttctctacatgatacataatgccatccagctgccatgcaaacctgcttcaggtcctgcattctcagcatggactgctcgagggggttcaggatcttgactctcccagtgtcatgagtgaggagactgtagtgctccaggtacctctccagggacatggaagagcatgtggccggtttactgccgattcggctgttttcatgtccttgggaggcgggggtgggctggatgggcaatccgggggccgctcgagccggtgattcccatgctccattgttgggcgtaccgtccgcctgtggggtcagggcatcccagcagaaggacgattccatgatcatgacatgcttaacaatgtctctgttgtacccataataactcctgagtggcgctgatgtacgaaggccgtctgcaagctcagttcgaatttcctggcaagaagttgttacgctcggcgttcgcgcgcccaaaccatgggccccgtccgacgttgtgcgaccgagactaacagcggagggggtgccggggcaaagcctggtgcatcactggcctgcccacatggcccatcactgtctatgttgggtatggaggcgcactgactggcgtgtgcattgacatcgcagtcccgacattggtttcgagtcatggtcactctcagcgtccaggctcccgtcgccccccaagccaacggcgtcgcgcacgacggcctctaccgcctacaatgcaaggcgcagacatacgcttggggccttccgatggacgaaagcgaggtggggtccgaacgagggagtctctctgaagtccctgcgggacgagcagttgtcgtccgcctgcatcggatggcacccacaccaccgcaccggttccttgaccaagttcaacgggttgagggtggttcaatgtgattgggggactcatgcatgcttcggcaacacccctgcaggtggccagactgtgcctggcagatggtcaaatgctcgacccctccctgccctacgctgagctgtggtgcgtgggttggcgtggagggctcgattggttcacgggtcttgagcttggcactttgacagtcaattgctggaagtgtggtgggacgtagttaccatggcacgctgctagatggtcagtctgaagggtgcagccaccagccggcgtgcggccagccacgagctcaggaccccaccagctttgcctgacccatgccattgctgcccaggaccttccctcacccctccatctatcgtttctgcatcgtcctcaggatgggcacccaccccagcgccccctccaccctggccgccccctccggccagccgctgtctgacctgctgcagcgccatcccgagctgctcggcgcggcggcgcccgcctttggcatccgcggcctgcccttcctgttcaaggtcctgtccatcggctccgcgctgtccatccagtcccaccccgacaaggccctggcggcgcgtctgcacgccgagcgccccgatgtctacccagacgccaaccacaagccggagatggtgctggcgctgacgcggtgcgaggcgctgtgtggcttcgcgccggccgaggagctggcggggacgctggctgccgtccccgagctgcgcgcgatggtcggcgaggcgcgcgccgcggcatacgaggccgcgcgctcgcccgccgcgcgcgc

SEQ ID NO: 18606 - DNA, 246 bp, Chlorella protothecoides
aaaaagcataggttaaaataaatttcatttaaataaattcgatttactagtgcttgtagctcaattggatagagcgtcaaactacggatttgaaggttgagagttcgaccctttccaagcacgtattccagtttttaaactgcttttatttataaggttttaataaacttggttgtatgaaattacttcgttgtatgaaattacttcgtacaaccaagcctacttaactcaattggtagagtatcg

SEQ ID NO: 18607 - DNA, 65 bp, Chlorella protothecoides
ggcaccacttgcatggcgcatctgtgcaaacagcatagaccatggcgttgtaacaaacatgcccc

SEQ ID NO: 18608 - DNA, 61 bp, Chlorella protothecoides
acgtgaccaggagcgtgcacgggggaagtgttggcaagggaacgacggtgcaccttcttga

SEQ ID NO: 18609 - DNA, 97 bp, Chlorella protothecoides
aaatattcttcttttcctattaaccttcgagcagcattttcaaatgcaatacccgacagagataattttttatctaatactagtggttctcccttat

SEQ ID NO: 18610 - DNA, 10845 bp, Chlorella protothecoides
  modified_base (8316)..(8355): a, c, t, g, unknown or other
ctgctccacggcgctgcaccgcgcactggcggcgggcctgcacaccgcgccgagcctggagcaggccagcctggcgcacggctggaccagcgacgccgatgtcgcgccgctggccgcgctgcccgcgctgcgccggctggcgctgacggggacggggcgcggggcctcgctgagcgcgggcgggctgcgcgcgctggtcggcgggtcgcgctcgctggcccgcctcgtcgttgacgcggggtgggaccaggacgaggggctgagcgccgcgctggccgccgcgccgcgcgtgctgtgccaggtgtgcgagggcgaggtgcgcctggacgaggcgctgtccgccaccaacctcgggcgcctggagcccttcaacccctgccgccctgccgcggagtagggggccggcgggagcaggggcgccaggagcaccctgcgcctggacacagcctccttgcctgctgcaaccggtttcggaggccctgccccgtcaccccgagcggcacggcacccaaacaccctggcaccttccgctggggcgatcccgtgccaggccgcaagtcgcgcagcccccttcccctgcgttccctgtgcctcgcccacaagggcaccacccaacacaaccttttccacagcagcaagcacactctgcgacagaggtgctgtgagcgccccaagcctcccaagatgcccccacgttcaacctttcatcgtctgccactccgcccttgctctgccgtgtacctcatctccagtacttgcgtccgtccatcccgcctccatgcgagaagactgggcctcccgagatcatcccccgtctgcgatcccataagccctggcccattcagctggtgccccctcttccctccctctgttccttaccgtgtacgattcttgatcactctcactgtatgcacccttgtaataaccggaacactgcagtgtgtcttgggaggggtggaggggacgggagggagcacttgtgaacaggaagaatgaaggagggcactgattcccagaacctccccagaggcttcccgccctgtcaggctcctcctctccgtccagacaggagccgcagggccaaggcctcctggtcctcgagtgtcgccggcaccatgcccatgtgcgccacctcggcgccagcctgcatgcgtcagcaggggtgcgcggaatcggcacagcaggacatgttgggagccggcatgcaaaccagtcgtctccaagggaggagcttgccgcccttggattcacaaaggctctgacagcatatcccctcaacagccccaccccacccacctcctcccgcagctccgccccacgcccattcctgaagcgcccgccaaacttctcctcctcgctctcctcgccatccgaggcggcactggcagactcttcctccccttccatggcctcctccctctcacgtgcgaggcgcttggcctgcaagtgagcatcgggggaggatatggagagtcctgttcgtcgagacttctggttgcaagtgtcagaaccaggataggcagaaagatacccctgacgccagcaggcctgatgccctccctgtgcctggccccccttggctcaccctcttggactcccgctcttcctttctcctggcacgctgctccgccttgtccagagcgtcgcgctgcgccatctgtgtccgcacgtgctgtgcacgctgcgccgccgtctcgtgcccctcatcgctcctttgggttgcagagggaagggacgggtgatgacctgatcccaggtcgggactgtgtggagccatctgcactcggcaggtgctcaacagcccacaccacaccccaacccccaaaacaggcatgccagcccctgcaacccctaccttgccgctccctctggaacgagctgcgccagcgggtccaccgcctccccctcctcatcaaacaccattctgctgctgctgggtcggtcggggcggatgcgcaaccgctttttctttcctgttgactggctcgcggccagattcaagatgggttcctcggccacagcctcgctcactcccagggcgtcacgctgcttcaccaccaggaagtcatccttctcatctggagggggcccagatggccctgcctctctcgcatgtgccctgccctctgctgcttcctcctcctccccgctactatcactggccccgccctcgccttcgtcccgcctttcagcacccgggccctgagctgcgccgcgcttgaggaagcgtagcttgggggcggctgcaaggccgaggctggcagcgtactcgcccgccggcagggcagcggcgtcaaagacggacctgtttggctgcaggtgcaccgagcgtaggtaagaggtgcaggctctctggcccaggccctgtgaggaggcgtggatttgcatttgaattgagtaggacagtgcaggtgaagaaggtcccaagtattgtcgggccaggaatggtctgtgcaaagactcaaaggatccatggccgctgcgctcatgtggcgatggcatctagggatcatagacgctgcatgacgctctgcagcgcagcaccaacaccgcctgtcgccctcctcacacacacaccttgatctcggcgtccttcgacagcagggcctgcagcgccggggtcacagactggatcttttccgggttgtggcgcagctgcttgatgggtatcttggcctcacccagcgaggccagcatcccctcgctctcgctgggcagcagcaggagcaggctcttgccagccgccatgtatcgcgcggtacggcccaccctgtggatgtaggccgcactgtcctctggacagtcagcctggcatcgtggtggggagagaggatcggaaagagttcatgcggaacgcacagccggcggctgaggggcaaggcgctgcccgatgaagtggccttgcacagcagctgctccttgacgtttgggtattcgtgcaaaacactcacaagagccccaaatgcccaccttccctagaccctgaaccacctgaatgacccagtcgacggtggggaagtcgaggccgcgtgcagcaatgtctgtggcaaacagcaccatggccttggactcacaaaagtcgtagaagactatgaagtggggtgagggatgggcagggttgtaactttcgaactgaaaacagggactgcctgtttgaagcccctgggccgtgcagaaaggtgcctgcatacttggacgcgactgcacagacaggaaacctgtaggcacagattgccatactgtcaccaaaactcaccgcccatgcgcttgtactggttcagacgcccgtgcaaggcgcggagggggacccctggccggagcttgcggaatgcctcaaagtagaaccgagtttgtttgcaggtggacaggaagatgatgatctttgcctgggcgggtcagggaaggctggcttgaggctagaatggggaagtgaggccgcgcagggcgccggggcaggcagcagggtccctgctgcgacccttcttgaaggagcattgccccgccggccacaggcttccactagggcagtaggcgtatggtgcgttctggaatcccccccccacccactgcactgccctgcactgaccttgaggtgggagcggatgaatgaccacaggatgtccgtcttgtcctggagggggcagacaatgtacgcctgctgcagcttgatgggggtgggcacctcggcctcagcgtggacggccaggtactcggggctgcgcaggctcagccgggccaggtccttgaccgacttggtctgcgtggcagagaacagcagcgtctggcgctgagccggcaggttctccacgatggcattcagtgccgccgagaagccctggcgcatgggattacacaggggtggggggatgaggaaaagtgggaatgtgggtgaaagacgacgagattgatgtcgaggatgtgatcaggcacttcgcctcccttcaaacgcaggggcagtcattcaggccacgtcagggtagatggtaagagagagccctcatcagaaatttaagcagcacgaggagctgacctctagcgcacacactgccatgccattcactcaccaggtccaggatgcggtccgcctcatccagcaccaggatcttgaccccggagcagtcaaaccccgccgtctcgtccatgtgctgcagcaggcggcccggcgtcgccaccaggatgttcaaggaggagatgcgcgactgctcctcggcgacgtccttcccacccaccaggaggccggcgctgaattcatgcttggcgcccaccttcctcagctcattgaagatctggagcaggggggtggatgcgatgtacaagggccctgagaggattggacctgaagctgcctgggttccagtccagtactcatccagattggtttcacgagccgctcacaatccaaagaggcagagcgagctctagggtgcttctaggtaggctctagtcgcaagagaagacattgaaaagccctgcaacaggcaatcccaaatgcgaccaatagtacctgaagtgctagctcacgcgtgggagtgagaatgagggcacccagaccgtccaaggcgccccactgctgcctgtaaaggcactccagaacctggcaatcaaggggagacaggtgaaaggcatcatcattggtgagttcctgaatcctggggactgcggacccgattctggagccaatagggatctgatgggcttcacatctccccagtggctgtggtgcatggaagcagcggcaggccagccatccagtacctccatccgcaccactcaccgggatcaggaaggccagggtcttgccagatcctgtctttgcggcccccagcacatccctccccagcagagcatggggcaagaccgccctctgcactgcggtgggacgagtgaatttggcagcagccagcccctccttggtgtgccgggagagcggcaggccgtcaaaggtgcgagaggcaggccaggtggtcactccttcaggtgcggcaggcagggacagtgggtttgttccaggctctggcgcatttgaccgcaaagcagcctctatttgctttatttcctccgcatccacttccgaccgcttccgctggcgggcatggtgtccccgagcacgcttcgcgggcgccatgtggagcgtgtcaacaaaacatatgggttatattatatattgcattaattgcctcttggacctgatggcatggcttgctcacgctgagtatcgtcggggtcttcttctctgcgcgccggcgccccaggacggtcgcatgcacacccggcttcatgtcgaacagctccacacagacatgagcgcgaaattaacagcacattgccagcaaatgtcttgtaatttcatcggccggtgttgagagcgagatctcatcacgtcccctgtggccaacgaagcaaagggaatagcaggaagtacgtgggacgaggtcgcgacctcacgatgatcgtcaccgcgcaagatgaaatgcttgtgggtgctgggttgaccctcgctggagcagccacgatattttacaggcgaaagcagctgaatgccttcaagctggcctacttcctggcatggcccacgctgggttcggcagtgatagttgcctgcatgcccgagcgagccgcatttgaagaggtgggtgacggcttggaagcatggttatctctctgggagggacaatggagtatctgaagctgctatgcgcacttaaatcccttttcccgttccccccctgtcctgagtaggagcttcggaaggagcaccacctagactctgacagcaaaagggagagtcaggcccttgcccgtctgcaaatggagaagctaagagcgattgcagccggagaggacagcaccacgcgccaatgagtcctggccacaattgtgcgtcttggtgacttggaagtcggtccattgactgctggtgtcttcctctcctttggagtccctagtccaggtgcctatgtattctgaatcttcctctgtgtgcccctatttaacatcaagcaatgatacagtcctgcacgtcattacagtattacctctattcagaatctttttccttgagctgttgacaagcatcgtacaggagccgggcctcgtcaaagctgaaacccctcctctgcagccagccataaaatttggcaatatctgcagcggatgacctacctctcacgagctccagacgtgcttgacactttctaaaagcttctgcctcccgggcgccatcaccgtccacgtctgactgggcgcccagtccctcgtaacgccacagctcgagaaagtgccgcagctgaagcccctgctctccaaaatgggcactgagcgctgccttctggtgatcctggtcgatgcccagatgtttcatctcctgggcaggatgatcgaggaagggctgctcagtctaaaaacatgatgccctgcccattggccaggcagatgcagtgcagaagtacaagcatgcagcaggtacttcctgccccggcgagccaactaatcactctccccccatccactgcagctcacatactgcagcttcctgggagaccagagctgttgccgccacttactacgcacatagacctccgcgtactctgcatctcctgtcagaccctaagggaatgagggtagcattgggagcagcagcttgtgggagtgtctgcaggcacaacgacaagagtgcccactctgcactccccttggacatcaagtctgcatgcaggctggcacctcatcccaccactttctccagatcatgcagcgcctgctcgatgctgtccgggggatggcccttctccagcaacttctcggtgagcttcttggccgggtatcggcgaagattcaggaggcgcagtgcggcttccttggctgttgccctgcgaaagtgaaagttaaaggtgcattccaggccggcgtgtagagcaattggggcaatattgtgtgccacaggggtactagcttccctgccctactttggtgcagctggtgtcttccaatctgcactctggcatgtcgtgtgcaggcatgcccccagccatgaacgtcttgcgtgtcgccgacttttcatcatcatcggggaggtccactctatgctggatccatgtgataccatgcaggagggtggtgcaactggagcgtgctgaaacactcggaggatgactgagggcagcatgcgcattgcagtgcaaagaaggatcacagactaaaatttcagtgtgaatgtgatgtacataattgaatcagactcgcttgtcagagaagttcaaagaaaaatcgtgattgccgtggcggtgaagtagtcccgtgcaccctcccccacggaagcaacttaacccaggccggcttctgagagcgcgccgcggggtttcgcctggtctggaccgtactccggtcatcacgatctcctttacctcgcattttctgcatcttatcacccatcgcgaggcttcaggattcctgtcggcatgtattcccggtaccgcgtctgattcatcatggactccgactaccccatcttccaggctagcgcctcccgggacagatccctggactggaggcgcaggctgcaggtcatagcctatgcggcagccctgggtgtatgtgtgcagtgctacaaccggggcgtcacccgggtcctgaaggccatccggaggtgggtcttgctttgggatccttgcctgcaggcaatgggcgtgtgagggaggaggcaggaaggctggcaacccctgtgcccacaccaccctgcagggggatcactgccgcggtggcagcctatatcgaggaccgtggcggcatgaaactgttcaccctggaaggtgaggggggtcagggggcgttcgacatcctgtgacagcgggccgggcctgcatgcatcaacagcaaggctccctgccagcccacacacatgcaccggacgtaaaaccctcacccggtgcccagacgatctggacgacggccacccgcacgccctgcgcacgccgtttgcccgctacgccgcacgctacgcacgctctggcctcaaatccgggggtgcctccccccacggcgaggagcacagccccacctcccccctggccggccccgactcctccgactccggcaggtgggcgggtgggtggtgagcctgtgccaggcgtcaggatgcggccactttgggcatgatggaaggacctgtttgggacgcatccaccaagacctcaaccctcagctaaaccctctttgtcctcttgttacatctctttggcccctttgcagcccaaggccacaagccaacacccccccctctcccgccgcccccccccccccccccctgggggggggggnnnnnnnnnnnnnnnnnnnnnnnnnnnnnnnnnnnnnnnnggggtcatcgacgacctgcccaacttcttcgagagcaccaagttcttctcctgcctggaggcggaggacgtgcggggcctgtacgcgggcacggggcgcgtgaccctgggcccccacgagcccctcttcaacgccggcgaccccagcgagtccggcatcttcatcgtggtggaggggcggctgggcacctacctacccgcacccgagccgcgcggcggcggcgccgacccctccacggaccgcctgctggtcaacgtcctggtctacggcgagagcgtgggcgacctggacgtgctggacggcgcgccgcgcgccgcctcggccgctgcgctggccgaggggtgcacgctggtgcaggtgccgcgcgacctattcttgaacttcatcctggcgcgtcccgccaccctgctggtgtacctgcagaaggtgcggggttgttgtttgggagcagggcagtgggggctggcggaggggcagggctgagcgcgctgatcaggtccatgcccagccctgccagcaacgggcatgcaacctcaccgttgacccagccgtggacctaccctccctgccccggctcctcgggctgcgaccctaagtgtcatgcaccctgccctgccctccatttctctttagtaccaccatcttctcccccacttgaaggaaacacaaaaaccacactctccctccccacaaacacaccctacccaaggccatggcacgactgtggcgcgtgtcccacttcgtgctctccgacttcctgcagctgcccctggaagacttcaagggcctggagatggacggcgtgctccccggcctaccgcccctgcgcaccggccaggcggcggaggaaggcgggtcgggggcctcagcgccctccagcccggggtcggccaccgccagcggcgcggaggacgggtcctcggcgccggggtcccccgccgccgcgcctcgccgccagggcatcctcaaggacaagggggccgctgcgccgccggggaccgccgcggtggagtgcccgacctcgcgcagggtggtgaccatggggcggcggcgcgtcagcttccacagcgagcaggccagccccttccgggaggccatggcgggggccacggcggggctggcccgtgccgccgccgccgccgccgcgctgccgggggacacggcgtgcctgaaagagggctgggacgtcgtggcgccgcatgtgcgcgattttgaaggggggggtggaggggtgaatatctgggaatgtggtgtgaggcttgcgctctgtgtgctcatcgttgggtttcgcttggactgggaaaaataggatgcagtgccggatttcctgcatcatgaattgccctgcctgccgccccgggttcccccctgcgctcgccctgttatcccgctccgacctccccaccaaaccatacactctgcgcaggagacgggcatccgcgaggcgagctgggagcagctggcggctgggctgggcaggcgccgggtggtggctcccatggagcagttgcacgaccaggacgcgctcgtgcacgctttctacgtcgtgctggaggtgaggcgatgtagggtgaccctcgtgaagactgcacgaagggttagactctcttggagcatctcacaggactggggacgactcaggacacctgatgctgggaaagggctcttgccttgaaacatccgtctggctggacgcccgcggggcggcccggctcttgcgcgcctcgacccacagtcaggacaattttcatgcacgcatcacaccagcaacccccgccgtcctttcccctcagggcacgctggtggccactcgggtcagggagggacaggagcccaggaccgcctcggtgctgcccggcagcctggtcagctgcgccgccttcctctcctccactcgcaccaagtgcgagtttgcggccggcggggagccctgcctgctcgcgggattcggtgcccgggagctgaacagtctgctgtatgacgattcgggtgggcgagggagtggtctggtggaggggactggtgacaggctgcatcactgcacgcacagggtctgaggctcggtggatgccctgggtgcactgcctgggctccagggcgcacttcgacgccgcccaggcatgcacgcgcgcacatcccacgttcaccgggaactgtctttccttgattgcacactgcacatcacgtgcccccccccccttcccccacaccaccgacagattccctggccaacctggccagcccccagccgtcaggggtgtggagcccctgctttggcgcctcgccctccggccagtcgccggtcgacggcccctgcggcgtcgacccggccgcggccctcctccggtcccgcggcgcgcgcagcctggcgcgccagtcccacaccagcaacctggcccccctggagcgggccggcagcgccctggcagggacggcgggcgcggccgggatgccgggcaccgacgtggccgagggcccgaaagcgaggcc

SEQ ID NO: 18611 - DNA, 10935 bp, Chlorella protothecoides
  modified_base (5993)..(6044): a, c, t, g, unknown or other
cggcgcgcggcggcggccgcgacgacgcgccgccgaccgccgccatggaccagccccgccgccgactcggcggcgtcgagctgtttgaccccggcgcgcccactgccccggactgggcctccctgctgccgggggtactggaggggcggcagcagccgctcgcgcaggagaccgtggcggccgtggtcgcggccatgagcgcgtggaactgagtggcgcgatgcgtccgccgatccccgttcttttctgacaaagattatccctccctgttccacctcttcctgacgccccaacccccatcccttttggtacctccctccccaacccctccccccagccgcccatacgcgctgctcacacagactcataccatttcatgctgatcccaatgtgcatagcagtactgctgccatccccctagtacgcattcctttccgtctacccctgccatgcctgtcctccattctttgctcttaggttgactgccgatcctcttcccctgccaatcttccaccgctcacttcagttttgattacagagctgtattttacacatgacatagcgtcacacagcgggacgggggaggcatctaattgccagcgaggggttgctgaggccgcactgcagggtatgcccaaatataatggaggaagctcctttggtgagagggttctgggaggaggactaatcgagcctcggtatgagccagtcttcccgactctcatgagatgacactctaggacaacgagcgatattcagcgcatgttggccaggagacgaaggccacgtcgagggaagtaggagcgagcgcgcgcgatgtgctgggatgtgaattcagatcgtgggtgcgccttgtataaaattccttgacactctttggacgtacccatcgaggtgatatctccatcaacatgtcgtcctcatcaccgatacaggtgtcctcgccaaaccaggatcgggtgtctcggctggatcgcatcatcgcccagctgcaccgccagactttgtcgacgggcgccagggtgcggcgcgcgggggtgggaaactgatctgtgtaccacaggtcgaacaagagtgggatgttgtgatctgcccgcccctccgagcaggtttccaggccaggggaggatggccccctcatcagcgatctggaggcccagatacatgccctgcatgccgcggtgcaggagctacaggtatgtggggcgtctaaggtgtgggtgggatgcgagactgcaccgtcgtgatgatgcttaatccccggtccccttccttctcctccaggcgtcccaggccggcagccccgtcgcccggctccaggccgaggtgacgcgcctcgcccagcatgcccagcgcgaacgagaggtgggtctctgacgtgcacaaactgccggacgattggtggggtgcatccttgatcagcctgggcgacaggcgggcgcccatgcgccagcaccaagctccttcatctcgatcccatcccacccaccccaggaggccaccctggcggcgcaggagcgctggcagcgcatggagcaacgcctggcgtcccaggagctgagcctcgcgcggctgacgggcgcaatggaggagcaggcacggcgccacgccgaggagctggccgagctcgaaagcacgatgcaggcccgcctgtccacggtggtgggccgcatcgcggaccagtttgacgagctgggcgctggcctggacgcggcggtgtcagcgcggggggatgcggcggccgccgacgtcgccgccgcgaaccgcgccgccgcgctggccgaggcgctggggccgcgggtgcaggccctggaggccgcagtcgccgggctgggcgagcggttgcacgctgtggacgctggggtggaggcgtcggtggccacgctcgcctccgcgctccgcgccgagctggcggtggcgacgggggacctgcgctccgtggacgtgcgcgggcgcgaggaggtgggccgcctggcggacggcctggcggacctgcgcgacgcgctgcgcggtgtggaggaaagcgcggcgacccaggccgggcgcacctccgcgctggcccgagacctggccgacgccaaggccgcgcactgtgagggggggagagggtgcagcgtttttggttttgtggggggaaatgcatgatgcgggtttggtgtgaggggtgagcggcaaatctgaggggcagtgcacactccggctgggcagcctgctctgcagcctcacctgcgcccctgcaatgcttcacctagcccaccccacactcacacaccctagcacctctgctgttgacggcgtcgccggcacctgccccaccctcgacctgcgtccaaacttgcgcaattctatcaccccccgcagcactcgccatgtcgagcctgggcgctgagtgggctggcgggctggcggacgtccacgccgaagccgaggcgctgggcgccgagctgctgtgcgccccgccccgcgtccccgccgcctgaggagggatgcacggcgtcgggcgtcggcccatgggcgaaaccccggccctgcatctcgctggcaccgaccaagcatgtgcccaggtctggattggggttcaagaagagcgtgctggaaggcccccttctcttaaccgggccactgaacctcctgcaccagcgggtacaattggctcgccactggcgtgcgacgactgggccctggccgcacctgcctggccagccataacccgagcaggcaggtgcacgctggcccgctcttgggctccgcctgcatccaagcgcaggatcagcactcgaaatgcattcccgaccagccaccgccaggtgctccacctggatgcagtcggctgctgtggcgagggatcctttgtgcttgcgcggcaggagcggaggcgagactgcactctttcaggtgcaggagagcggctgcagtctgctcagcgtcagactctgtttttggatgtcagcagcgccactgaggccttctttccacctctctctacatgtctcctcctcgccatcactcctcctccatctgcttcccttcttcgcttccccagcgtctcaccttgctgtgcctacccctatgacccatgaatttacgaacatgaacccagcgctttgccataatgaaggccggacatcgttctcctcccgatgtcacttgtaccaaaaaggagcattgtcatgtgttcgacacggtcccacgctttcatagccatccacagcgggcaatcgcagagatcagctgctccctcatgcctcgcctgctcaatgcagaatctcagggaggaacaaggatgacactcgagcgcaactctgcagtcgagtctgatgccgctgtgtgccaaaagcgcgccgacagttttctttagagcgcatgacttggacgatcgcgcaactccaaatcaaggtcgccagcatccgaatctgacgatcaagagctcctagaggtagatgtgaggcattctggactacgcaagccctgggaacagatttcatggctatcatcgctgaccgatcaggtcccgagcgttatcgagcggagccgccacgtaccgcatgccggacacccaccaataatgcgctcaacctgcaatctgccggcctcaagtcccccgcatcaacctgactcgtttcctgccttggttcgatcgaacctgtgactatagctcttcagtcccatccgacatggtagccaaggcacttgccaagaatgctcattgtagcgagctgtccatgtaatctctgctgtttcttgtatacgctgttgggcaacgtccaacagggatgaaggttcgaagggttgtgcagctcgagttcttcatcgagcttagaatgccgaccgattacagacaggttttcgttctcacatttacaccaacattcggatatattgagctgacaaacctgtatcctggactgccagtcaagaaacttcgtgtgaagctgtggcccatgtgtcatgagcatgcgtgttccccgactgaagctacttgttgtctgcctaacatgttatagctcgtggttctgtggtccgtccctgtctcgaagacaccatatctccttttcgcactacctgtttaccgccctgcatctcgcagattctttaggattggcgggaaatgtttgccctcgcaggtggcccggcaattcgatacactctgcgcaactcagaccctcccgcttgaactgaaaagggaataattagaggaaatgcaggaaactcccttctgggaggcttgtgggactacaagcatcccatcgccgaggtaacatcccaccgcggtactgggcgctttccgccgagagactgcaatcgtacacccagctcctgttcgatcgacttgaataggcgcaattagattgactggcgccatgtatagagccgacaggggctcgtacgacgattctgggcggaaaggattccgtgggaccgaggagaacagcaagaccaggctgtgcaccaggtgcgcgccatgccctctccaggccagcacgcagcattgcccgcgcagtctgatgcacatgcgcctccgcagcctgctctgcgctgcccctcatacccatcggaacccaccccccggcactgcaagagcaggtggcaagaaggcaactgcaggtttggcaatcgctgcaactttgcacacggcgaggcggagcttcgagggctccccccacgctcccgtggcccatcaggggggccatactcccaggtggggcctggcgcgggaccaggcacatggcagggccaccagcaaacccatgggcctgggtcgaacagctcgtctgggaccccggccgcagaccatgctgccaaaccggagaagatgaccgacagggaggtgtgggtagcttccggctgtcctgtcgccggaccaaatgggtggacgcagtaccaggtgaacatcgtagtgggctggggatctgcgccggcgtgttgccttgtatcgttgccaatcgaggtcgccatgcagggtccatgactcctcctgtctggccagccaccgggcccacaagactttctgggcactgcatcgttaagtggcaaatgggctattacttgtttatttaccaggtgccccgccccgttcctccacaactaccgtagacgcccgacggcgagcactacttccaccaccgagaacggaacgagacgcagtgggatccgcccgccgggtggacaggcacgacatgaggtgccggtagcctgcccctcccttgtaggagatgtagtagaagatgtgaatggacctgttcgccttgaccagcatggatgttagtcactgtgccgtcgtgccacgtgaccctcgggacccagatgaggggcatttgtcgccctgacaacatcttcgagcgtttgaccgggcagggtgcaaggtgccctggggtttcatgccaatggatgttcggcagggcaatgaaaccattgcccggtgcacactggcgcatgcatttagggatacaaggtgacgtgagcgaggggcggtgggcagagcggtgtgcaaacagcatgcggcaattttccctcgcacagatggggaggtcgttccagctcaaaagcacagacctgccacagtggtacgctcagggcccgccccggctggtccctcccgcgcagcgccacgcccctgagctctgccgtgcggaccagcctcagagcttggcctgcgccaccggggtgtctgccggagggtctgccgcctcggcgccctccccggggcagacgtaggcaaccagcgcagtgatgtcatccatcttgccgccgaagaacctgcgacgggcgagggacggggtgcggtcaggatgagaagcgaggggtctggggattcacaccatccagggcaatggcagggcagggtcggggtcaacacagacccgccccccaaatccaagtccacgcacctgtacccgcgctgctgcgcgccgtaggcgaatggagacaggtgcgtttggtccccggcgcgctgccgcgcaaactgcgccagtgcggcggccgcccccccgggnnnnnnnnnnnnnnnnnnnnnnnnnnnnnnnnnnnnnnnnnnnnnnnnnnnngctgcgcggccaccagcgagaccgcctcgtcggggtacacgttgtcaaacacgccgtcggtggccagcaccagcacgtcgccctcgtacgtcttcagggagaagcgctgttgtgaagggaggggggtaggtcgggaggtaaggcatggtggcacgggggagcgattggagttggtgtgagctcatggccactgggccatcacgatccgcagcagctccctcaggcaggccggcgcctccaggatcctctgctcctctcatcatccccctccgtccacgacaaacctgtgcagcgctggggaagtcggacatcgagtcgggggacccgatctggaaggggaagttgaagtcgtgttgctgctgtggggacatgaaggccagctcgtccccccgcacgatcatgaaccctggcgggaggaaagggaggagaggagggatcgtgaggcgggctgacgagtggttgccacgcagaggtcccccctcgaggctcccctcccgtgcaaccaaagcactcggcaccaccacccttctcagcagctcgacccctcgcacccgagtcccccaggttggcggcatgcagctcattgccctcgatgaccagaatgcaggcggtgcaggacccacgggccgccgtggccgcatgcgccagggtcaaaatctccgcaggggcgctcgggcctgtgcgcggggggttgtgagtggaagtttggacaatcatcctggctgggggtgcagtgaggctgtagggtcaagtacaagcagacagcgttcatctggattgataatgctgcccatgggctgtgctgggcgcatgccgggagcgtggagtggcagggtgccgcacggcggagcgagactcagcatgcgcctgccgctggacccgcgctgccggtcacaagccattgtgttccatcgtccccgcaccacggagtctccatctgtcattgattgactgcaggaccccctccttctcgtcagactccgggcccctccctcacacacacacacacaacacacccaccggccttgacagagttgcaggccacttgcgcgtggcccatgagctcgcgcgagtagaggcccgggtccacgccgacctcggcccagccgcccacgccgtcggccacacccaccgccgtgccctggtcgccgatgaagtaggcgtcctcccctccccggtcctccttggcggggtgggggatcatcacggccgcggagcgcaggcgcaggcccgggagggcggcgccgcgggctgccgcgtcacctgcgctgctggagattggggaggactgggagccacgcagcgcgtcgcccgtgccggcgtgcgccagcgtggaccggcgcgcgttcagctgggactgcgcagtgttagtaggagggcgtgagttgacgtgggtctgtgggcacatggttgaagccagcaggcccgctggcgtgtgcagacagcatggtaacaccctccctccacctgggcaggcagttttgccagagagcctacccctcccatgagccctctccgtccaccccacctctacccctcacctgcgccatccacactcccgcggtgagggccgtggcccccgccacgaacgccgcgggcctctttgccagagcccgggctagtttatggagcgaggccgtgagcatcggaggccgggcgggcgagctccggactgtcatacactggacacactggccttggagcgtcgcaagccgggccagcatggacggccggggtgtggagaaccctgacctcaatctgatttcaggagcgtcagcgcttctgagtacaaggggatcgtggcgtctggccggaatcgggtgagcgtgggtcagggcctatctcacaccaggagtgtggcctctccagaggaagaagatgtgcccgatcgaggtagtatttcgatgtatttggtttcgaagtgatagtcagaacggatggagtgtgtgacaaccaagcaggatggtcgaaggtggatcgcttcccaaatgcatccagcgtggaatgagtttgcaagcttgggcactccacttggcgctcgcactctctacggcatcaggcgcttgagcgactttcgtcgatggctagcggttcctgaataatcctgctccacgtaaatgtaatgcatcggaactgatgtgcatcagcctgccgcgatgagtgacctgctggacgatcgagcgggggtggaggaggtgacagagaaggagcgacccgccggctctgaggatgaggacgaggacgaagatgaggactttgaggatggggacgagaccaaggaaggagcttcgggccaggacagcagcgaagaagaggaggtgcgccccctggttgcaggtggtctggtgtagcactgcccatggttgggcttcctgaggcctgcgacacccccgagacggtacgcgtgcctgccttccccctacagggtcccgatgactacgattacgacgataagttcctagtgcgagaggacgaggacgaggatggcgatggtgagcctcgaggtcaagtagcttgcccatgttaccttatgctgcggcgaggctcttgtcctgtgagacctggggataatcgtggtagaagtttcatgcattctgagaggggtgatcaggttggtatgggtcttcagcccccctcccggcccatgcccgccgctggcacaggcgcagcagagggcgaggcccagccccccgccggcgccgccaagcacgccaagaagaaacgacggcaccgggagctggtgctggaggacgacgactacgacctgctggaggagaacacggggatccggagagcccgccccgccgcccatcgccgcatcaagaaagcgcgggatgcggaccggggcctgggccgcgagggcggcgcccaggccctgcaggaggagctctttggcgccgagctggaaggtgagcctatgaaatggagggaaaatgggggggaggggattcgttgctggcggcttgaagtaagatggagagtgtctgagggaaagcaacttcaactgcatgcgaccatcctgcatgaaggagatggctggcaatgcccagggcaccgcagtaccgctgcggcactgcgtgggcatgcacaggatttaaagcactcgaactcaccgccgccccccctccgcagaccttgaggatgaggacgcggaggccgccccctccgcgcccactgcgcccccgggccgcgccgcacctgggcctggcgcccgcgccggggacgaattcgatgcggaggaggaggacgaggacgactggatcgtggacgacttcgagggcgccgaggacgagggcgccgcggccgcggccggcgcggagcggcggcggcgccgccgcgccatgcgcgagggcgtgcccgacattgaccccgacgccctggacgtgagcgctcagtgagggggagaggcgagttttgtctggatgtgaggacgcggcgagagggcgagggcaagttgacgtgctggcgcatgcggggtacagatttgacgatctgttctcgatctgggcggcaggagatctgcatctcgtccccgccctccgccagagtgccaccccacgccttgggggccggctttccgggggtgtgccccagggttctcgggtgctcaccagctgatgcccttgctcatgctcccccctctcccaaaacctgccgcaggaggccaacgacatcttcggggacgtgtcggacctgctggcgatgtacgaggaccgcaaggcggccggggcccgggaggccggggaggaggcgctggacgagggtgccgaggaggtggatgccgaggaattcagcgatgaggaggtcgccgaggccctgaggctgcagcgtgtgagacgcgcgggcagggcgggggttcgggggggagggcggtgcacgcacgagtgcgcaccgacaccgagcaaacaccccacacacaaacacgcaggaggagcggcggcgcgggtcggcggcgaggcgcatggagcgcgcggtcgacccctccctgctcgagcgccacttcctgacggcgcgcgacgacgccatccgcgacgcggacctgccggagcgcctgcagctggcggacgaccccacgccgcgcgactgggacctgggcgcctgcgcggcctgggtcacggcgcggctggcggaggacccgggcgtggcggggcagctggtgcgcgccggagtgcgcgaggtggagggcccgcccccggcctggcatggcggcgaggcctggcgcgccggcgagctggagggcggcctgcgctccaccgccgaccggcgcgggctgtatgcagggcacgaacgtggcgaggagggcgcggcgcgcggcctgccccccggcgcgctgcccgcgctgaacgatgcggtggcggcggcgctggaggaggtgtaccatcgccaccgcgaggtgcccaccattggcatgtacgccaaggagcgcgtggcggagctcctggtcctgcgccgcaccgacgagccctacttcactaaggagtgcgcgggttgtttctccttggtggtgggggaggcagttgatggggaggggggggagagcactcctctgccgagttccctacacgatgatcaccagcagggggcacgccaggcttgccgtcggccgacgagtaccaccccgctcaaccagcgccccgcgcatccctcctccactcctttcccccccctcgcagggacgaggccagccggacgtacccggccggcagcatccagccgcgcgaccgcgtcatccggcgctgggacgtgctgcacgccgtgcacgacctggcgcggcgctggcgcgcgctggcgcgcctgcgcgcagcacgcgcggccgcgtacgaggcggcgctggcgtccgcgagcgacgtggacgaggcggccggcatctcgcagtgcctggagcgcctgg

SEQ ID NO: 18612 - DNA, 78 bp, Chlorella protothecoides
ttttaggataccaaacaaatttaaattttctggttttatgcgagatagtattactccaaaagaagacagatttgtttt

SEQ ID NO: 18613 - DNA, 183 bp, Chlorella protothecoides
aaaaataggatataaggttttcggcgtatttgggattttactttcaaatttttttataattagtcaactctgtttacgttggcatttttcaggacatttccctttaagtggtctatatgaatcattgttgtttttagcttgggtattactttgtttatatgcttttttagaaatttcaacaaa

SEQ ID NO: 18614 - DNA, 78 bp, Chlorella protothecoides
cattttttcaacctgttcatgactagatcactcggtttcgggtcaaataaatgacacttgttaaaataaatgaaattt

SEQ ID NO: 18615 - DNA, 84 bp, Chlorella protothecoides
cacgggccttccgttggaggtgattcgaattgtacctgggttgcggggtgggccttccgatggaaggacgtttggaccatgcgg

SEQ ID NO: 18616 - DNA, 61 bp, Chlorella protothecoides
gggtcggcggtggcggcctggcggacgcggtcgcgcatgggctccgccgtcagcatcaggc

SEQ ID NO: 18617 - DNA, 75 bp, Chlorella protothecoides
tcggcactagtaggccggggctgggctgcggtcctgaggtaatggcccgatcacttccgcggggagtgacaagaa

SEQ ID NO: 18618 - DNA, 159 bp, Chlorella protothecoides
aggacacctctgcttggactggagacggtgattgatggtagtcgtcgagcacagactggttgacttccttgaggctgcgcatgttcagagtcccctcaacaccgaccgcctttttacactgtaggctgtctttctcgttgttgtacacacagtttgcgt

SEQ ID NO: 18619 - DNA, 150 bp, Chlorella protothecoides
aaagtttaaatataaaactcatattgagaattttttatcatcacactataatattgatttacaattatttcctttttatagtaaacaaaattggcaaagtgctggtttcgtagctgatgaaatagtctattttattgaacgacgagtttc

SEQ ID NO: 18620 - DNA, 73 bp, Chlorella protothecoides
gggggagggccgtgagggaagggttggttaggagatggataggtgatgcccgtggagtgggaagtccagagct

SEQ ID NO: 18621 - DNA, 2824 bp, Chlorella protothecoides
gcgcccgtcccggcgaccacgcccgcaccagcagccacgcccaccgccgcactcgcggcagcgtcctgggcccggcgctcggcctcctgggcccggcgctcggcctcctgcgcccgacgctcggccgccgccagccgccgctccaggtcggcacgctccgcttccaggtcgccaacccgggcgcggagggcctcggcctcgcgcttggcgcgctcaacctcctcgccccgccctggcgccagctcccggtcgaagtcgtcggccagggaggccaggcgattggtctctgccacagcccgccccacgcggtcctcaagagcgcgctccgccagctgctctgccagggcgtcgtgcgcctccttcagcttctgcgcctcctgcggagcggcggcgtggggaggtagtggtgggttgcggggtaattgcggggaggcaggggccagtctgggcgtttggggccccgggcacatcgccgccggctgatgggtctgcgcgaatcgggcgcttcccgcagcccacactggcgtccgcagtgctatgcacatgttcggcaagcagatgcacacacacagtcaaacgcccacgattgtagggaggtggttgcagccccactgcactcgctgctcatggctcagatgcgcaaccaccccagaggtggtcggccccacgcccccccagcagcccacaccctcccaccccaacacacacgcaccctgatggccgtttcggcataggagcgcagctccaggttctcagcccgcaggtccccgatgagggactgcacggtggcgaagtcgtcgtagcccagcgaagttttcagcccgtccagggcgtgcaccaggccctccagcgaggcggacaccacctccccgcccgcagcggtggctgatgtgggggtggacacgccaccggacacgctcggcatgtcgatctggggtacacggggcaggtcgccgtcgtggcctgagcggggctggcgaggcggagcagccagctcgagctccaaatgcagtgccaatcacctggtcgcgacgaggtaagccccgcgtgagcactccttgcacgagctctgatcaattcaagtatgtgagaatagggcgcgagggcaggagggaatgcattcactcccggagctggccagatcggtacacaggtggttgctaaaggtcgagcagcagtccggtatcctataccactgctgaatagctatttcttattccctgcacgcgtgtgtatccctgtcgtgcgtgactcgtcttgtcaacttggcacgacatccatgctcaactaccatccttccgaaccacctcaccggctgcgtaacggggtcacctgggcatccactcccttggatttgcaagggcgagatccggcctcctccaattgttgacactgccaacgtggcctaaggcttggacaactatgatgtacagacgagaatgaggttcggagggtggtgccacgtccaggtgtatagtataggtttcatgcagtgagatgttttttcaagctcccacaagatacctcctcctctacctttcttcagacaccatcttaacaatagggaggggaaaatgtgcacgagcttgaaagatgataatggatggggtcgatccatggggctccacggatgttattcgcagtcaggaagaagaggtggggccacgttcctcgcagaggattcagtagccgtgccggacgatagagcatcagggttaagggaccctcaaacagtcttctcacaacagccagactcccggcacgacggagcgcgccaaggaagcagatgcagttcatgctgaccacagggagggttatgactgcggcgttgagtgtggaggacgcagctgggcctgagattgtacatcattataagacttggagagttccatccgcaccagtgcagccacgaggcgcacaaaggtggggatgtcgttctggcagagctctgcgagcacctgtaggaggttgcgagagcatggcgatggtgagcttgttgatcgcggcgaggtgtgttccgtcgcaacaaggcctggacctgcttacagcgtatgactccagataaatctcactcttacagagagtttgcataagcacccacattcagccagccccggcccatccagagctcttcctgcacctcgtcccatgcacaggacctcacctttgggtgctcacgaaagcccacgaggcgtgcggccttgagcgctttcttgtccgcaaaaggatagatctcgtcccagacaagctgcgtgtgcacagggacacaaggtttgaggtagaactgactcctactcctccatgcgctggacgagaaccagtaggaagaaactcggagcaatccctccctcacaatcagcccacctgtgcttcgcggaagaagatgtcgacgccgccgtcccctatccctttgaacttcttcagcaacaggcgctcctgcagaaagtggggacacatgagctgcgtgatgtgtgcgcccttgagctccatgctgctgatacctgcgtcgctggggtcaagccgcccaaaacgcaaggcccaccccgcctacctgggcagggtcgcggccggccgcatctcgaagcttcccaaagtcacccttgtcgtgcgtgagcaggaggtgtgcatcatccaccagaaagccagcggtcttgtcatctgcatggttgggacagggagcacatcatgctgccgcacgacagcagacgacatggcttggggccaagcattgcatttaatgcctctattctgcaaccccattccctttccattccctctccaccccccccataccccttacccaccccccccataccccttaccc

SEQ ID NO: 18622 - DNA, 61 bp, Chlorella protothecoides
gtgacgacactcggggcccacggggttctcaccctctccgacgtccctttccagggaactt

SEQ ID NO: 18623 - DNA, 71 bp, Chlorella protothecoides
aatgggtcgtaaaaatacacctggcatagtcctgatacaaagacatgttgcatcacacctgatgggaccta

SEQ ID NO: 18624 - DNA, 77 bp, Chlorella protothecoides
agccctcttgatttgccaaagtggccaagcgcacatgtcagtccagactccctcacctccacggtgcatcaacaaca

SEQ ID NO: 18625 - DNA, 92 bp, Chlorella protothecoides
tttgccgccattaaacctacttctcgatacggaactagattaaaccacgctttagtcaaattttttaaatttttaatcgacccaccttctgg

SEQ ID NO: 18626 - DNA, 73 bp, Chlorella protothecoides
gctgcttgagctggggctgggagaatccacgggggcggggccgggagggcggataggtggggtgggagtgggt

SEQ ID NO: 18627 - DNA, 71 bp, Chlorella protothecoides
tcagccacgacaaaccagacggcgcgtgaagcgcgccgtgagtggcaatgcggaggaacgcccttccagcg

SEQ ID NO: 18628 - DNA, 64 bp, Chlorella protothecoides
cgtcacgagcgaccagatccgcagggagggcggatcggagtcctgcaaagtaggacgagtactc

SEQ ID NO: 18629 - DNA, 92 bp, Chlorella protothecoides
tcggagtcctgcaaagtaggacgagtactcgagggctgaagatcttgatggacaccccactgggcaacggaagacatagataccagctacta

SEQ ID NO: 18630 - DNA, 129 bp, Chlorella protothecoides
gtcatgccttcgcttacttatcactagtgggtgctcctccaatctggaggccatgcctcctcacccaccgaccacatgcaggaccacaagtttggaccctggacagtgcacgcaagcgagatcttcgcc

SEQ ID NO: 18631 - DNA, 67 bp, Chlorella protothecoides
tcctcgaatctctacagagctcatctgccctcccccatcaccatcctacctttgggcgagaccacga

SEQ ID NO: 18632 - DNA, 132 bp, Chlorella protothecoides
cgccctcgtccggcacgctcatgcactcctagaatcggaggggttggatcgggttttggggatgggttgagttgggtctgagctggggtttggggataaagcagggacagccccgcaccgatcatcggttcg

SEQ ID NO: 18633 - DNA, 61 bp, Chlorella protothecoides
gggaccggcaagcgacggggccgaagcgaggacttgcatccacaaaacccatctgtgatgc

SEQ ID NO: 18634 - DNA, 16139 bp, Chlorella protothecoides
gcgcggggctgggcgccgcttcccaggccgccgtcggcgaggccgggcccggcccgcacgccgcgctcaccgcctcgggcaacatgtacggcctggtggcgcgcagcgcggcctgcgagtctctgtgcgaggtggcggcgcgcctggcggcggcacgtggcccgctggcctcgctactctcccccggcgacagcgccgcgctggacgccttcttcggcgagggcctggcggctgcgggggacgcgctgcgccacgtcagcgacgccggggtccgcctgctcctttccctgggctggctggccgaggcggtggcgggaaccaactacgcgctggccgagccgcccacgcgccaccagccctgggtggaccagctgctgcgccagctgggcgtgtttgccgaccgtgtcgcacacgtgagtcacatggtgccaagtggttgccgtgtcgatgctttttatggggggcaaggtggggcgcgaggagctgtgtgtgggcttgcgagggctctctgcacgggcccacgcatctgctgccggctcacgagcgcaccgcatcttcatcgccgcccaccctcctccctgcaccccctgcgcccctccacaccctgccccctctcatcggcccctgccccccccttcacacacccacgcattcaaccaccacaaacaggcgagcggtctgtcccaggccggcgcggcgcgcgcctgggccggcgcggcggcgcacgtggaggcctgcgtgctggacagcgtggcgcgcgtgcgcagctgcagcctggagggccgggcggccatgaccctggatgtgcagggggtggcacacggcctgcggcgcctggcccccctgcccgtgggcgcccaggcggggttggcccgggccgacgcgtacgtcaaggccttctacatcccggtgggggagctgacgcagtgggcgctggcgcaccccgagtacacgcgggagcaggtgggtggaggacttagggtggtggtggaagggtctcgacagctgctctggcaaagggggggggcggtcaaatcatgcgagtggcgccgcgaaacccctggtgttgatgtgcacgcaggtcccctgcagagtgcttccctcagcctcctgtttgatcgccagaggcacgctcatagtccccccccccatctgctccggcagatcctggcgctgaccgcctgcatcgcggacagcagcgggctgcggcgcaaggagcgcgcagcgctgctcgcgcagatggaggctgcgctgcacgaccccggcaggcagggaccttgaggtacccagctccctaccttgttgcgcagtgcaggcgcaagcttccctgcttccttctacatacagacatggtggcaaggggagtgcagcctgagtgtcattgtcacaaagtgcccgaccatgtgatgggggcgcatcgccaagtgcaccccgcatcgctcgcagtgcaacacagagtacagacgcctagacggggcggacggcctggggcggcgctgagccgggggcctgctgggggaagccggtgactgtgccggtgccgcccggctggtagggcggggggtactgtggggggggctggtaggtcgcgttgccgtaggcataggccgagccgtactggggggctgcaccgtactgttgggcagggtactgcgcgttgccctggtacggtggggagctcccgtactgggcgcctgggcggtgggaaggggtgaggaggtgggaaggcgtgtggaaattgcagcagagggctccccccacatgcatgtgctcttgctgcaccagccccctggcccccagatccagcacagtaccctcgtgtgagctctgccacgcaccggcgggcccctcgatcttggagtggttgccaaagtccaggatgcaggccaccagctgcagggtgaagaggccaaaggcagcccaggccagggcccacacactcgtcctctcgctcttctgggagaggccggcactgtcggcgcgcttgccgtagactgttggaggtgtgggggtgggggtcacaggggtgcactcaatgtgctttgtggaaacacggcctggccacatggagcgtgcagccaagctgcgatgctaccccatcagcacgtcctccagggcctgcatgccagcgatcgccaccgagtgcatgcagtccatcaacctggggcaagagacggcccctcaccagtggtcacgacggcgtaggggaaccaccagatggtcccaaagcccagcaccaacacctcgatcttgttgtgcggcgaccactggggccgcagcttggagaactgcggggtcaggggaaccgagtgatgggcgtgctggtctgcagatgtgccgccgtggttggcggcgacgcaacccccccccagcccctggctgtcagatcctctgacacgagcatccctgcccatgagctcctggacgatccgtccacccatccagactcaacaccatgagcctagggcggcaggcttgcctgtgtgaagaagacgaagaaggagaggaagatgctgacggcacccaccacgtacccataggagcacaggttggcggaggaggtggagaggtagcagaatgagccggtgctgtaccaccagccaccccaccagcccccagtggtgaaccagaggctcgagcggatgatcgagatgaccgcgatggacacgccagcctgtagaagagtggggcgcaagggggatgcccctggcttcagaggcaagctcctcgaacctcgcgcaggcaaggacatgaagatgtaaataaactcacggaagctgcggccaagaggatgacgacgatcgggatcagtttccccatttcgaccagtgcgggcccggctactgggggttgcactcctctgctcgtcgccgttattcgtcaactggtgaccctcggaaatatcaaaatatgtttattgagcaagggctcacaatcgagtgaaagtgtcgggtgaggagcatgccacaacgcatccgctgtgagccgggcgaatccctggcgctattcttgggagctgtgaatgtggatccccctcaaaggctggggaacttcccccttccacagacactcaatcgtttgttaaagcttcacgtgttggcctgatctccatgcaattcaccttatggtcctcattgagcatgctgcatgatcatcagcctgtttgttatttggcttggacaccacacctctcactgaattggtcgtcgatggggatgatccaatgctcagggttagtccaggactacatcatgggtcccttgtgaaaacttcacgacctaagaggatgtggggggtgtcatcctgtgttgaacaccaatgtccgtcgcctcactctatttaatttaggcatccaagtttggagatctgtgggagagaatagagtcggacgctgcaatctcgagatgacggatggagtgatgtcttctacttcctgatatgcacaacggtatgcacatcttgtaacccacaaaacacgcgtctcatgacatacacggggtttcggctgagtctacaacacttggaatgggtttaacagcgagaatgtttctcacttttgaaggtaggcccccaggaccctcacgccactattgcgatgacggcgaggcaccagccaccggctctggtcgcgcaaactgcgtagaacgagtgccgacccacgccgacattcttaatcgctggatggagatgacaagctttttggtgcccctcaataggcgatcgtgcaccctccagtggctccagagcatttgcaagttccaattagggttggtcccggaggatacaaaagggtcacactgccctcccaggcttgtcagtgttcagcgaggcttcgacagggcattgaaaagtacatggatatcacaagatatgtctcgacactccatgcgattcaggagactagtttcggcgcaaacggttggtcccacatctagcaccgggatgtgcgtctgatataccctcgaagctgggagcagttaggccactgtcgggtgcggtccaaaaagggaccttgcacaagaatctaggctctagacgtatcctataatcgttaaaaatattccatcattgacattgactgcacatctgaggtgctgatagcatgtatacagtctcacaaggcctggccctgccacaacgagcaatggtaagattgccttccgagaactgcacacagctgtcgtcgcaatgcgcgctccatcctgatgaagtcagtgtaattgtctgcaggtacacctgtgtctcatcctggcgatactgccgtatgcgctctccaccacggtttcgtccgtcagccgcattgccggcgaggtcagcctcgaccccatagtcggcaccgagcgtcgtattctgaaccaggtggaagccgacgcatcgtcaccagcgttcgcctttgtcaaggtcgctgggaagcagttcagcgtcggcggcagggcctggtatccagccggcacaaacgctttctacgccgcccagaccgacatcatgagcagcgcggacgtgtacctcatgttcaaggtacgtgtacgatcgtgtgcagtatcggctcgggccacgactccgccttgcgagatccggggctccgtcgatggcgatccggaaccctaatttctccgcgccctgacatgcccctgcaggcgcatgcggcgcagggcgtcaaggtcatccgcgtgttcgcccacagcgatggctacggcttcccggataacatcaagactccgaaccccatccagccccgactgggcgtctacaacgagaacgccctcatgaggtgagaggtggaagccttggactgaggtcgtcatgagcccttcatcggccgccaatgcatgccagcctgcatcgccaacctccgctgacaaatatcgagcccattttggcaccccgtcacaggttggacttggtcattgctgccgccgccagcactggcatccgcctcgtcctcgtgttcaccaacttcgagcccttttacggcggcatccaggtgagtccccggaaccctccccagcgtgcgtgtcagacgtagctcccgcacgacctgcgccaactcgccaacagcagtccacgcactcctccatcccttctcatccacagtggtatgtgaacgaggccgtcggtcagggtcagtccaagaacctgttttacacccatccaaactgcaagttgtactacaagaagtatgtcaacatgctcatcaatcgtcgcaacaccgtcacgggtgagtcctcgggatggatgtcgcgatccttgtgtttgcaagttctgagatgctccgtaccatgagtgaatcccatgccctcaccacgtctccattctgtatttcccaggtgtcatctaccgtgacgaccccaccatctttgcctggaacctcatgaacgaggtgcgcaaggtggcggcacgacattgaatgcatagtcctagctaggtttctaccggtggattaccagctccttcacccctgtccctttgagcccatctacacgccgtcccctgaagctctcctcctcctctgcagccccacaccacggataactacgagatcaaccagggcaagaagcctgggcagatcgtggccgcctggatctctgagatggctgcctttgtgaagagcatcgacagcaaccacctactgaccacgggtaagacgcatgttttcggttggatgaggagggggctgcactctgtatcggcctgcctgagactcagctgcaggctccagccgcctggcatgcgggcgtagaagtgcgcatctgaaatagctactttgcccttcgatactccaatcaacggcccccttcccccccttgtcatttgtaggcgaggagggctaccgtgtgaggggcgacacctcctgctgcaccaacaactggctgaacggtggggtgaagggcgtggactttgacaccaacgtggccgaccgcaacatcgactttgctaccgtccacgcctaccccgacaactggggtattgcggccagcgactacaagtggtacggccccaacttcctggccgaccgtgcaagcatcgcgcatgccgccggcaagcccattgtcatggaggagtacggcagccgcgaaggtgacatgccggggtgctgaaggtggggatctgtgcatgcctattgacaagtgacactgccatctcttgggccgctcatagggtgacggcttacgagatgtctgatgaaccagccccaggatgagccaggagggctgcgcgggcactcttacatgccatcactcatatccttgtccccacctctaccaccacagggtacttgtcgtctcgtaatgagctgctctactacctccaggtcggttggcagggtacagtgggattggactagagcctgccaagtgtagaatcgccctgcgtcgcacaaagccgcatgcgactgcctcatcgcctcacccgcgcccccccaccccccctccctaccacaggaccaagccaacgccctggggtacgccgggtccatggtttggtccctgcgccacttggactctcagaccggtgggtacgtcttctcgtacagccaggacggcgccgccgctgtcaaggcccagctcgcgtatgccgcccgcatctcggtgggtgcagctggctggagggggctgggcatgctgcaagtgattccagaggagacccgagacaccacaagcagtggtcctagatcacctcacaagtgcatgacgtgcccacgcctgccaggcgtggcacaaatgtgccagcttccccgcatgcacagtgccgaccccatccttccctttccctgcttccacagggcgggacggcacccacccccacacccacccccactcctccctccggtggcgattgctcgtcctgccgggacaatgcaccggacaccacctacacctgtgcccagcaggcatcttggggcaagtgcagcgagtcgtggatgtcgggctactgcctgcgcagctgcggtaagtgctcctgcaccggtggagcgacgtgcagcgatgtggcgccctctgcggcctactcctgcgcccagcaggcggcctggggcaagtgcaacgagtcctggatggccggcaagtgcaacaagtcgtgcaggcgctgctgatagggaggagcggtggggaggttttcagtcccgatctctctgtgtccgtgcttctgtggacccctgctcacgctgccggcgcagcaatgcgcccagccccaacctctgggccctaactctacaccatttcattgtatctccttgaattgatttccatactatggttttctgcgcatccttgtgcctgcaccccagcccagatgtcatcgtcgattcccttgtaaactttctttcaaacggggactggaggtccccgggcgcgcaccacagacatacgcgctgatacctgcctctgatcacccatttcgacacacccatgcgtcacgtgagacagacagagggtttgtgcttgctacagagcgcccagtccgggacgggatccgcatggatcgctcggaggtggtgcggagggagtacaccttcggggacacctccctgtctatctactcgcgcaagtacgccgaggacaccaccaaggtatccatctcgatgcagctcaccgtggagcagatatgggtgagcgttggggattggccccggggcgacgcggcggagcggcgtgtggtggtgacagggcccccgcctgaaaaggccaatagcggggcatgagggtgcaagggcacagagaggatcaatgtcctgcgctatcccattaccctccacccacacttgactgtcctgtgacggactttatgcattgcgctcttcctccactatcgcaggactccttctggaactttggagacgggccttcccccccaccccccatcaagacgtgccaggggtcggagaaggaggtagccgtggggaaggagaccggcgctgctgcgccggccccagacctgctgggcctggacatctggcccggcgccctcgccctgtgcaactacttggccatgcacccgagcctggtggggtgccggcgggtgctggagctgggggcgggcatgggccttccggccctgctggccgccaagctgggctgctcctccgccctgctcacagactacgagcccctggtgaggcgcgcgttgggtggcggttgtgagctgatgttgcatggctgggtggcttgggctggagaggtgcgaggccactttttcctcacctccgtgcaggttcaggctgcagcagcagctgcaccctcgctcgctcataacatcgcattgattagtcttctctcctatacatctcccttttcacaatctcccctcccctcccccccaaccccttttccgtacatcaaggtcttggagctggcggccgaaaacatccgcctgaacggcgtgggcgacatcgcggccacgcatcgcctggactgggaggacccgcagggcaccctggcccccggccacccccactccttccacgtggtgctggcggccgatgtgctctacatctccgacatcgtgctgcccttcgtgggcatgctgcaaaccctgctgcaccccgaaggtgggagggagaggtcgtctggcgggcctggaacaggctcttgggaggcctgggcaggggcctcagatgatgagcggcacggtccaagcgctcgaatcacgcacccctcctctccaatccacccaggcatcgcgctggtggcgcaccagacgcggcgcccgctggtgctggaccccgagaccggcgtgccgggtctgtcgcggcgcgacgagccttacgaggccttccaggcggcggtgcgggcggcgggcctggtgccgcgccagctgggcgcgctggacgccgggggcagcgctgggccactctacctctcagccctggcctgggagcaggcctacatcgcgacgctggagccggtggcgcgactgcggcctctgaaaggctgacactggttgtttgctgccgcagatggactctggctgagtggcgctcgctgggccccctggcagccgtctggccgtcaccagcgtgcatggtgcacgccttttgccttgctttttccacgtcagcaagtgcggctgctcctgctgggctgcatgcccttgtcctcgggcaggcagaggcatcagccccggactgcggcgcaattgcccgtgaccttttcaggcaggcagaccgatcccagtgcatgtgatgcggcctcacatggaacaaatcctggttatttatgtaatggacctggcagacggcagagtcggagcaaggtggaggaaaattcctggggccagcctcgattaataatgtgtctgaccgcctccttccgtgccgcgcctccccatcgctatggcagcagcatcgtgtacctcgccttctccccccggctgagcaagaaggagtcggtctgccagccctcgccttccagagccgacaggaagggcgcgagggcgacgcgcgcctgctcggccgccgcggccacgtcacaatccccggcctcggcagccggccggaaggcgccgcgccggcggagcagggcggcctggaccactgcctgcagtgcatcccgggccgaggcgtcgctgcgcagagccacgtggattgaccccgggcccgccagacgcaggctcagccaggcggcgagaggggaggagggggcgccggcagcggggggccgcaccgacagccagtatcggctcctcctgcaggagttggagtgggttcagggttgagtggggcatgtgcatgggagtgcggggagcagccaacccgcggagttgcctcacaacaacgaccggaccccgctcatcaagcccaaggcctttgggccccatgccgcccacgcagggtaccctcgcacgctctcgatggcactcaccgcccctccttccccagcagggcctccagctcgctgctggagcgtatgcacgactccaggcccccaatctccagcggcaggggcccgcagtcgatggccggcgcaaacagcagccgctccgccctgctgacctgtgcgtttggaggatgagggaggtgcgctgtataattgtggctccagcggggcaagggacctcttgcaccatggacgccgagattgaagctggagaagtttgggggatgcattcagcctcaagccggcacgctccttgcacattctattctccccgccactggcacctgctggggggtcaggatcatggcatggtccagccagctggccgccaggatctcggctcgctccctgttcaggctgcggaggtggatggatcgcatctccctgcggatgggggagaagagggtgggtgatatcgctgcaaagggtttgcttcaactgagtggcagcagtgatcctcacattgacaagaccggggcccagagcctccctaccaacgagaccatttccctcttccagagcccctgccacccagcagcgctcgataacacacgcactggtagatggaagtcaagtccccgatgaccagcagggggaacatgaccagggggagcgcgctcctggccggctctgaggcgcgcaccgcgtgcgtcagcagcaccgccaccgccagcccgaggttgtctagcaccatctgctggccctggaaagatgtaggggagggacacgggacggggtttggacgctgaccaaaggggaaggattcctgcctagtgcctcgagacgtctgggcgtgtcgagacactggaaaggtgaggtcaagcacccagcatccccagacacccaggaccctccacgccagccgtcgccacacgatccccacctgactcttggccgagatgtcggccaggttctgtcctcgcgcaaagctcttgtggaatgcaggctgccattgtgggcgggcggcggagagccagtgagtcgagcagccccacagtttgctttctcgtgtgcgggcagatgcaccatcatcaaacctgtgggccgctgattgcaacaaacctcctcaaaatctcccacctgggtggccacataggtggccagtccgacgctcttccccacgttggcgagggaggccaagggcaggaaggcggagggggcgaggggggtggcgtactccagggccagcgccaggcagtacaggatggacgtcccaaaccggaatctctgaggcaagacgtggagagggtaggcgcgtttgaggtgtgagcgctctcttcacgctcgccgtgcatgttggagtgagactggaagttgagaggggatccacgattggctccaagccagggttgcggtggtacaggtatctccacgcctgcgaccctgcccacgccgacacttactccattaactatcccgtgcctgccccgcacaccttgaggtcagcatcaaaggaggcaccgtactgtgtggccacggagaggcggcccagccgtcccagcccgtccttgagaacccagttgatggtggccgccgccggcaggctgcgctgcgccccgatgccgacggcttggagcaaggactgaaggcgcggagagcgagtgaaggtcggtgaggatgcaggtggggcaggcctcggagcaggcgtgggcgtgccgtcccagcctcggcacctacagctgggcctgtggaacccagcaacagccactgtgcccctgcgtcagccactcacctgcgtcgcaaagaccgagttcatgctgctgaagaagcggtgcacagccctccactttgcataggtccagtagtctggacaagcgcggagccggagggagggagggaggggggtaatgggagggaaatgtcatactccagaaggccattgccccatcactcaagcaagcagccccagctgcttcacctgggtagacttcgtcacggtgtgggaagaaggcgtgtcgtatttcatgctttgcccactcaaaggggtgtcggagcaggacgtcgacgcggctgcgtggtgaggagtcccccttcccacccaccagcgcgtctgcgtccaccgtggacaggccggaggccgtccacacataccgcttccgccgccctcctgatgcagtggttgatagggaagtgatggatgggacatagcttcgtataaacacagcatgacgccgccgacacacactatccatcgtaccaatcgtcactgcaataggaaccggcgtgtactctggagtttccctgtgctgaatggctgccccagagatgctgccgaggagacaggtcttcagggacgcgggggtgtcggccagaacaaagtcgagctcaggtccagtgcatggcctacatctcatgataatatcgtatttaatcactctaggggcctcgtcgtggtgtgcatgtcacctggcgagtatcctccgtcgagagttgttgtgtaaagcaggtgacccctcgcgcctcagcgttaccgctcaactcgagggtcatttatatcaacaaagaagtgcatggcaactaggaaagtgcacgtgcaccatcgcccaaatgcatatacgtcgatgtgcatggcaccgggggagtcatcgcgcgccctggtgttctccggtatatttcccaagagctgacgtggttccgggggtctgagtctcgttgattttagaaagctgcgaggtgaaggatccaaccctgagtttcgtcatcgatcttctaattatggcgtgccccgaggccgccgtccaattcctaaagttcaactgcagccagaaggacggagcagagaacttgcaattcgacacccttgcgctccatggcatctacggattttctgctgacgatggcaccgcgacttgctacctcgacgttgtagacgaactacaaaatagatatggcaccctccatggtggctgcataggtaaggtatggttgagtgtcgtgccattggcttctctgttgattcaggcgacactttacaagagccagtccctgctcggagcacacctgtactcagtgccctactcgttgccctcacagcaacacttgtcgatgttgtgggctctgctgccctgctcaccaagatcgaaaagtcaggggtgagcctcaatatctctgtcaactacctgcggcccggcaaggggggcagcacagtcaagattgtgggtgaggtcgtgaagattggccgaactgtgtgttccatcgaggtggccatcacagagaaggatagcgggcgcctcattgcaaaggggactcatgtcaaggtgagactgccattgatattggactgtagtgtgtgcagttttgtggagcaaagcaggagaccgcttgatcagacccaaaccttgtgcttattggtaaggaaaatgaaggaggcgaatcctttgctctggaagggattgcggatctctgtgcaatttacatctgaaccccaaccacacgtgcagcacattttggaggccgaaccgcctttcccgaggttggactcagtagcagaggagctgacccatcgccggaacgcagtgcggaacaagacccaaaaatctaggctgtaaagctatattcatatttaatgtagaccttttggggatgctcggaggcgcacaattgagcaagcagcctgtccctcgctcgctcgctctggaggtgggctgatctggcgattgcaaatcgaggcgcgagggcataaggcagaatcacacgatacacataaaagtatttgttttatgaagacgtaaacatttcgttcgaccaatcatccaccctcgagttctaatctttgtcacagcctccactggcaccaccccggcagaatgtccggggtgcctgactatcaacgcttcgcagagcgcttccttgatctcagctccaaccagcgggacagtgatggggggccatccatgtttgacagtgcagcaatgccaggtctatacgacatccaagctgggcctgggcacatcaagtgctacatgaaagttggcaagacgcacgtcaattttatgggcaacctccacggcggttgcacaggtgatttgggccaggcatgggctgctgtaggttgttctgccaaggagatacgggctttggtcattgtttgaagtggcctgtgaatggcagagatgagtttggtcaccattttggcatgatgcggtgtggagcacccccttccccctagcattgccttcaatctcacagtagtgccatctatgtctcactgcaggctctcttgtagatttggtggggtcagcggccttggcaaccttggggaccacccctcatgtgagcatcagcatcactacaaactacctgcgaccggctccaatcggcaccatcatcaggatagaatccagcgtgagtgctgtggcagagcaggatcatgagttcttggacacccgcccagtctctgcatacaggcttgagccagagccgctgcatgacccaaaaactttgagtcactgcaggtgatcaagcctggggcatctgtcaacaccatgattgtccacatctacgatgacgccagtaacaagatggtggcccaaggcacacacatcaaggtatcggcaggggatgcctgggtatcctgtgatggtgtcaggcgcacacggtggaaggcctccatgttcttctgttctcatctcatctcccaagattccatttcatgccacacgtatttttcctgagcagatgatgatgcacaagcaacagatgcctggggagtatagcgctcccaaaaacgaggacactcagacgtcccggttgtgaggcaggcctctcggcaggttgctgaggcaacgacaccggcgtgacagctgcattttgtaccaatgccatgaatgatgacgcccggtgcgaaatactgatactgatgcagaatcgtgtctctccatgcttgcacaggaaggtattaggaatgatcccttgctggttaagtttctgcctgcctacacagggtaaaagttacccgttaacaccagccgggcatggatgccgcttctgttggcgagcatgaattggtcctcaaggactcctgcagactggaaacaaatgctggcaatcttctgatgctttgcctggcaccatgcagcatcggcgcagggaagctgacatgcaggctcgctttccggccctacccctgcctgacccgccgtttcttcagtcacctgatgtctggcggatcacaggttcgggcaccatgctccccgaatgcatctgatcacagcagctctgcatggaggcgccccctggcggctgacacatggaaacggctgcctcgagtcgattccacgccgcgcaccccaggctcggccagccccaggctcagactcatgccccgcctcagccatccttgcggccatgctcctctgcggcggccagcgtgctggcggggggaatgagtcgcaggagcggcaggggcgccagcgtgcacagcgtgacaaaggtcacgagctgtggcaggtggccgaagtcgtcggatgtcaccccgaagactgtggtgagggcggagcccagggcctggccggtgaagccccccgcattcagcacgctcatcagcgtggcgaagagcgtcgcctccacgccctgaggagggggaggaggaaagggagggacaggtggttgggtttgtggaagtctccgtgggaaaccatgcgacaaagggcgggggaggggaagggtctgggccaatagcaccccaaaacacattactaggatgaggttcactcatgatccccccactcccccctctttcctgtcccgctctgtgccacccagccccacctctgggcagaggcgggaggcgaggaccaggaccggcatgaacgacacctggcccagcaccgtgagcagggtcgtgtcggccagggcgaagacctcgttgctaatcccgaaccgcaggttggtgcctggtggagggtgtggtgcggtgctggggaagttggtggggcatggcacggcacgcaggggcatgacagagtgcatttccggcatgcgcagtcacagacacacacccacacaccagcgcacctgtgatgaggatgagctgggtgaagcccagcccggtgcccagcagggcggtccacaggaagatggtgcgcaggggcgtggccttgaggccgtagttgtagacccccacgccggccagggaggccagggccccgaccagccggatctgccccagatactcggtgctaaatcccagctgcttggtctggaaaaaggtcatcacggtctccaccgtgggcgtggcctgggagggggggggagggaaagggg

SEQ ID NO: 18635 - DNA, 113 bp, Chlorella protothecoides
cctgccgggggtgcgggatgccatccagcgttacaacgacattgacatcacattcgaaaacagccgggaggagggcctgctcaccgcgctggccgatgcgctggaggctcggg

SEQ ID NO: 18636 - DNA, 61 bp, Chlorella protothecoides
tgaatatgaatgaccatgcatgaagcatccgcgcatgaagcatccatgcatgaagcatcca

SEQ ID NO: 18637 - DNA, 354 bp, Chlorella protothecoides
cttcctcatccgggttcctcatctaatgctcggcgagatgtggtgggtggtccgaaggttatatctcagctggtctggtagcaggcttcagtcagaatggcgaaacgtccagacctgtcaaggttgcaattggatattgcttccctggagaaaggacattcttgcacaaatccaaccccttattgagggtttacgtgctccagccgggtcccgcagagacctgacgagcgcgacgagacagcacccgaacacagacaaggtccacaccctggattccgacgaatcatggctcacagtgggtctcgtgaagctttgccaagtgaacggtgcccatcgcctcgaacagggactttt

SEQ ID NO: 18638 - DNA, 61 bp, Chlorella protothecoides
tgatcggcaatgtgatggtgaggctgggggtgcacaattgtcaagcgtggggagtaccata

SEQ ID NO: 18639 - DNA, 97 bp, Chlorella protothecoides
cttggtaaaaattgtgcagccataatttatttgatttgtagatctattaaaaataaaacgatatttctattatattactattataccaatataataa

SEQ ID NO: 18640 - DNA, 172 bp, Chlorella protothecoides
taaaaagagctcaacatttgagtctctgctaccttctgcaggtaattccaataggggtaatgccaattggggaaataacaacgagggtaccggccaccattgcttcaacatgtctgggagccgcaagaatctgaagggttgcagcctgctcgagttccggaagtatgcatgg

SEQ ID NO: 18641 - DNA, 61 bp, Chlorella protothecoides
gaggcacaggtgagagggcgatgcgacttcaccccgccacggtgtgccctgtccttccgag

SEQ ID NO: 18642 - DNA, 79 bp, Chlorella protothecoides
gaatcgacaagatgcacatggcaggacctccggtgggctgcaaccgggtcttcgttcacagcagtgtccatcgctgaca

SEQ ID NO: 18643 - DNA, 61 bp, Chlorella protothecoides
cgatgcaggtgttcatgttgggaaatagattgaggactcactcaggattcttctcaacctg

SEQ ID NO: 18644 - DNA, 87 bp, Chlorella protothecoides
tttcacaggcgagcgactttggatcgatgcagacacgcccgggcacaacgccagggcgcggagcgggggtggctggcgcgctgaatg

SEQ ID NO: 18645 - DNA, 179 bp, Chlorella protothecoides
tgctgctcttctctatggtgggcaaggctagaggcaattcaagggggcgcccactgcagcgaaagtatgccccacagctccgatgtatggaaagggaaggaaagactaatattataatatttatgccaggagtaatgaagtgtatttttatcagcgtagaacgccgaattgccacgaca

SEQ ID NO: 18646 - DNA, 61 bp, Chlorella protothecoides
gcttggagaatggacccgaggctacagatgcggagattaaaaaggtcaggagagttcaaat

SEQ ID NO: 18647 - DNA, 83 bp, Chlorella protothecoides
ctggcgcgggaggcctacaagcagtactggctgcccgccccgggggaggacaagtcgcagctgggggagatcgtggtgaagag

SEQ ID NO: 18648 - DNA, 100 bp, Chlorella protothecoides
cagtgcaggagtgaactggcagtgggaaaggtgaaccagtggctgttgaggagctgggactgagatcaataatccaacaccaggtgtcgaaggctaggcg

SEQ ID NO: 18649 - DNA, 27898 bp, Chlorella protothecoides
caggccgagcggcggaaggcgctggacgccctgcccctggccatcaggggcgggcgggggctaagcgcgggggccgtggcggtggaggacggcgccgctgcacaggccggggccgggggaggggcggcggctgtcgtggatgcggcggcggcggggggcgcggcggcggcggccgggaaggctgcggctgctgcagccgggaacgcggctggcaacgcggcgatcggcacggcggccgccgaggatgcggcggccgcggacgggatggcggctgcaaataccaaggcggccgccggcacccaggcggctgcagggggtgacgcagtcggcaagagcgcagaggctgccaccagcgtcgcggttgctggcaatgaggcggccgctaccaaaggagcagccggagcagccgcatcggggagactgctcaacacacgccggcaatgaaggaatgcaatgtacatatgaaagactggagcctgtgcaatgaagggccagctcttagacaacctcatgagcaccccaggggctgattaccctcgcacagcatgtttgtgtgccagtcttgtgatcttgaagggaagtcctgctctgcatgtcacgctgttattcctggggcatatgccggtggaggccacccaggcattttccgcttgcccccgacagggcgccatagggcgcgcacatctcgaggacgatacagcttctcgtatgaaaatgctcgccagcagcaccttgcttttcatcgcaccagaattgcaataatatcatttctcataaaccggcctaatcaagttcccacaccaaaggaccaccgagtgactgcgccccatcctgcgccctctgtcgagcgcattcgcccgtgggcggggacacgcacggacatagacacatggataacctcacgaggttgttccgcattcgtaaaacatgcatggaactcctgcgggatcgagggtacctcatcactcaggtgggcagtgtgtgcacaagcaaggagtggcgcagtgccggcacccacttcagctacgcagccatcgccatctggcgcacctccgcgtgtccccctctgcaggaagaccaggacatgacaaaggaccagttccgggaaaagtatggggatgagccccgaaaagacgacctgaccatcctggcacccaaacaggtgcagcgggcgtatgagacctagatccagctccctcctcccaaacatgcttatcatgccaagccctctgtgacgctccaccgcaggacgacccaacaaaccagctgttcgtcttcttcccagaggaggccaaggtcggcgtcaagaccatcaaggtcctggccgagcgaatgagggcggagggggttcagcgggcgctgatggtggtggcgaccaacatgacaccatttgccaagcagtgtttgcaggagatgcagccaaaatacgtgatagaattggtgcgtaaggcataggaggggggggttgagggcatgagtcagagaagtggggtttcctgccggtgcctgcagtctgacccaggtctgccgctcattaggcatcttgccatcggaagaaaggagcggcctttctttatttgaatatattagcaccaacccagccatgttctcatctccaacagttcaaggaggaggagctcctggtcaacatcaccaagcatgtcctcgtgcccgagcatcgcatcctgagcgctgaagagaagaagacactactggcacgctacaaggtgggtgcagcgcccctgacctgggcgcctgagctcggctggcttggattgtccatgcccaacccctggatgtgcattctgacacccccagcccgtactccccccttcctggcaggtcaaggacacgcagctgccccgaattcagttcaatgaccccgtggccagatactatggcgtgcagcgcgggggcgtggtgcgcattgtgcggccctccgagacagcagggcggtacgtgacgtatcgcctctgtgtctgacatgatcggcgctcagtgggcctggtactcatgccaggggatcagccacaggggatcactcccctgttatctccttgtaaagctaaccttcatctgccgtttgagtcctaggatacaagttttgcatcttttgcgtgcgctccccgagcttctgtcggcgatgagttttgggaaggcgggtttgggtgctctgctcaaccgtccctaccttcccgcaggatagaaagggtgacgacccatggcccagatcccgcgatgccgacgcgatctgccagcgagccccgagcactgcatctggcatgccatgtgccccgattcaggcgcatgccattacagatacccacacggaatgggacaggcatatgagctgaagggagcccggggtctctgagtctctgaaaccctgcaccgagtggggttggattattaacaccgctcctccaagccctcacacctgatccaccatcgaggggtgtagagcactccagggtcgccagagtatcggggcgccctgcctgatgtccgaccggtcgaagccgtccagtccggagatactggctgtcgcgtgtgggaatgggcacgctattgccgtgctgggtgagtgggtacgcgagtgatgtttgtcagaggggagttgggtgtgtcctgatcccggttatcttgctaccggtggcccaaggaagggggaaggatggtcacccactccacagtgccaggtcgcagatcacgagccctgagcatgtgctgtgctctcggccccggaacttccctctttccatctcacccctacccctctctaccccctatcagactccgagatcggccgcatcgtggccacctggggctcgggcgatgatgggcagctggggcacggcgacacgcgcgagcgcgacgcgccccaggtcgtcctcgccctcatgggcaaggacgtggacctggtgtcctgcggcggcgaccactgcgtggcctcctccagctcgcgccgcgagacctacagctggggctggggcgactttgggcgcctgggccatgcccaggccgacgacgtgtggacgcccaaacccatccggggcctgtccgggttgaccctggcccaggtggcctgcggcgacatgcacaccctagcgctcaccgtggacggcgcggtgtatgcctttggccggaaccaggcagggcagcttggcatcccctcccagtacgacgcgctggagccgacacgcgtcgcggcgctggaaggcaagcacgtgcgccaggtgtcctgcggcggcgagcactccctggcggtggtggagggggggcagctctacgtctggggctggggcaagtacgggaacctaggtgaggggtggtgggggaaggaaggggacccggggggcgaggcccggaccattctacggcagcagtcgatccgtgggctgctgaggaagtggagtcccaatgtgagtttccccccccctcaccctccaccccttccaccttctctttaatcaatcaaggcctcggaaacgagttggaccaccggctgccggtgcacgtggaggttccgggtgcccccaccatcaccaccgcctgctgcggctggcggcacactgcggccgtggacgccgaggggcggctgtacacctggggctggaacaagtacggccagctgggcctgggcaaccacgagtgagcgcggcgtggggagggtggaggatgggagtggggcgtgggaggccaaggttgattgacgaggtgctgaaggggatcgggtcgagggccagggtgtggaagtctgatccccttgcaggagatccatccccggggcaatgagatggcatgctccctctccatttcccaccaccaagaacccctacctcccctcaacccaggaaccagagccggccgagcctggtgtcgtccctctccaccagcgccgtgcactccgtcagcggcggctggcggcacacgctggtcatcgccggcccccagcacgaggtcttcgcctggggctggaaccgcttcggccagctgggcctggacggcatccaggactgctcccggccctgccgcatcaggggcgagctggaggggtgcagcgtgcgcagtgtgcaggccggctggcggcactccatcgccgtgacgcgggagggcgaggtgtacgtctgggggcgcggcgcgtcgggggtgctgggcctgggcgggcgcgaggaggaccaactgatgcccacgcgcctggtgtcgctgagccggggaaccgcggagctgggggacctcatgacgcagcagaccgtgccggaggcggacgccgccagcaagtgcgttttgctgggttttgggtggggatgcgggaaagggggaactgtgcaggtggtggggcgagggaaagcactggctgtgtgcttgctgggcagggcttggcacctgttagttcaacgggaggagtggttgtggagctggagggtggcgcaaggctcagtggcggccccctgtgggaggcccctgcgcactagaggtcggaatgtgctccttcaagggcgtcccttgcctgttccggggacccggggagccctgccctccccccaaacccgtcctcctggagtctcagccaagccatctttcattctttccgcaggtacggcctggtcccggagcaggccggcgaggaggcgggcggcgtcgtccccgactacaacgtcgaggcgaagcggtcgcgtgtctgaggtgtccatcgactgcgggctgccctaccccagggtatacctatgggcagcaccatcttcccacatgccagaggcacacagacgaggggccctttcccccagcccccctccttgacgccactgcccacaggtatcactgatgtctgagaagctgcttcttttgtcgcccagggattattctaggtcccacctggtcatccctaagcaaacatgctgtcatctcgtcatggctattgattctccaagggtatggtctcattcttgattttccccatccctgactgcaaagcttggtcccactgctcacctgagaccgtcttgttgggagacggtaaagggtccccactccatgcctgctcatcggagtcctcccgctgtcaaatttgccgaggggttgaatgcaggctggaccactcagcacaccgagcatgggatgatcatgtgggctgagcacctgcctgagcagtcgtgcgccctccactctccaaggacaatcaccaggtgatggaccgcaactcttacagatagagtatgtgcaagtacttctcaatgggcctggccagctgcctgcattgggcacctgtccatccttaccacccttaaagtcgtgctcatgtgtggggtggaacaacagtatacccacgctgttgtccagctgtgcaggtcgtgccccatcattgcttggtacctcacagccaaaacagggaagagccaggaaaatgcgacctaagagtcaaccatccttccatgcgagtatcagaggtccgctcacgaagcccatccatcacgggaccctctcgaagtacaggaatgtcaggcccttcccagcagcggcgatcttttgaacggtggccacagagcaggagatcctactcatgcagccatgctcgatgatcccgacaggagcatggcagatgtagtcaggacttgtagatctgtaattttctagtgcgagacgtgcaggcgatgcgggcatcgcacagtgatcgcttagggggtggcgtctcccggcccctccaccggtctgcaagcagccggcgatgcagagcccgatccccggctctgcctcgggcatgcccgagcatggccgcaacacgactgatgcatgagctggaggacatcgacagcaccgaggtgctgagagttgggggttgggcggcgcgcgacaatgcttgaatccccgggaataatctatgcatttttatgctgcatgcagatgcaagcccacaccatgtgccccacaccggcgcccttcccacccctcctctccaactccaggacctgatgcacgtgctgacatccacccccctggcaacactgtgcgaggcggcggcgctgaagcgcgacgaggcccacggctgcgtcgtcaccttcagccccaaggtcttcctgcccctcacccgtctctgccgcgactcctgcgcctattgcacctttgccgcgccgccccggcctggcgcacgctgctacatgactccggaagaggtcgtcggcctggcgcgcgccggcgccgctgtcggctgcaccgaggccctcttcacgctgggcgacaggcccgaggcgcggtatcccgaggcggtatgcgagctggcggagctgggccacgcctccacgctgtcttatgtgaccgcggcggcgggggaggtgctgcgcgccacgcccctgcttccccacgtcaacgccggggtcgtggctgggcccgcgctgtcggccctgcgcgccgtatccgccagccaggggctgatgctggagggcacggccccagcgctggcggcgccgggcggcccccaccacgactgcccggacaaggaccccaccgcgcgcctgcgctgcatcgaggaggccggcgaacgcggtgtgcccttcaccacaggcctgctgctgggcatcggggaggggagggcggacacggtcgacgcgttgcgcgcgctgcgcgcgctgcaccgccggcacgggcacgtccaggagctgatcctgcagcccttcgtgcccaagcccggcacgggcatggcgcgcacgcctccgccggacagggcctacaccctctgggcggtcgcggcggcgcgcctcatgttcgaaccggggatgagcgtgcagtcgccgcccaacctggcggcggggggcgagggggagtgggaggcgctgctccgtgccggggtcaacgactggggcggggtcagcccgctcacgcgcgactgggtgaaccctgagaaggcgtggccgcacttggcctcgctggcgcgggccaccgccgccgaaggcaagctgctgctcccgcgcctccccgtctacccctcgcactccaccctggaccagcgcgggcggtggctggacgggcggcgcggcgcgggaagcccgctggcggccgtcctccgggcctcggacgcctcagggctgagccgggggagcagttggtggccaggccgagatgccaaggatcgggaggagtcaatggaaggggtggaagccgggcgcacggatgtggacgatgctgcgccctctgttcaacacagcaacagagcaacgcatgcgcatgtgcccagccctaccacaagaagcgccgcctggcgggtgtccctgtgccgggatggggcgctcgaagccatgccccggcctgagcgggccagtaatgcactgacagagctcgcagtggcgctggcaagtgggcaatacgccccggcagaggcggaggtgcggctcctgctgggcgcgcgtgggaccgacttcgaggcggtctgcgcggcggccgacaacgtgcgccggcggctgcatggcgacgaggtcacctacgtggtgaaccgcaacatcaactacaccaatctctgcgcgtatgcctgcggcttttgtgccttctccaagggaccgtccgatgcaaggggaagcccatacctcctgacgaaggctgaggttgggcggcgggttgccgaggcgtgggctcgaggagcctcggaggtctgcatgcaggtgggtgctgcaggctcagggttggccccaaaggggggatctttcaagggggggagagggaatccgtggtttctctgcggattatcggagcgtagggcaacgtgaagtggtggcgtggttgggcggatgccaggaggatatgtgcgatcctaaggcaagcctggccttggcttgattgctcccagttctgatcaggctctatctttttgcaaggctatagctttgcgtctgccagttgtgcatccagaatcaccctgtccacacccccacactcccccctcccccacatgaaaagggaggcatccaccatgactttgacgggaacacctacctcggcctgctggaggccgccaagagcgccgcgcccaatatccacgttcacgccttcaggtcgggagtggacaagggtgcaggggttggtctgggcctgtcgctgctctctatgttggcctcaatgcttcccagcgctgtcgtataccagcaccaacagtattgttggtcatgcatggccacgaagtgcgcagggtgtgcaatggtaagagtgaggctgcattctgccatagctcctcacccttgcctacccaagttcctgcacacttcccgcctttaacctctcccgcacctttcttcctttctaccctcttgccagcccgctggaggtctggcacggggcaagcacgctgggcatgtccctgccccgctacctgtccgcactcaagtcggcaggtctgggctccctgccgggcacggcggcagaggtgctggacgcgccggtgcgggcggccatctgccccgacaagctcagcacggaggagtggctggaggttgcggcggcagcgcacgacgcaggcctccccaccacctccaccatcatgtttgggtcggtggagggccccgagagctgggcccggcacctgctgcgcctgcgctcgctcgccgcgcgcagccgcctggtcacagagttcgtgcccctgccctttgtgcacatggaggcgccgctgtaccgccggggtcaagcgcggcggggccccaccctgcacgagtgcacgctcctgcacgctgtttcgcgcctcgtctttgcagacgggtgcatccccagcatccaggccaggtgtgggtggagtgtgggtgggtgttccatttctggaaatcataggtgcggtcttgcccttgagcagccccatacggattgggggggctgagaggatgagggtgttgcgaggttgaggaccgtttgcccactgaaacaattgagcaacttccgcagcatgcagccattgctgcattgcggctttgcctgtcaaggatgcctgctgacgaagctccgggggtgggatcggcattcttgtcacccttccccaaccttccctgatgcctagttgggtgaagatgggcccgtctgaggctgcgggcctgctgagggccggctgcaacgacatgggaggggtgctgatgaacgagtccatcagcagggcggccggcgcctcccatgggcaggagctgggcccacaagccatggatgatctcatccgcacagcaggtatgttgccggggggacggtggaggaaacataggcaaatagctggggaagcaggaaggcgaatgatttttgcatccttgtgtctgttttgtgtgcacacagcattgaaccggcagacaaggtagagttgcatgccatgtttgggaagattgcagggtggggcagcattgcatcttaggagtcgcggatctcactcgagtgcgccagtctgatgcttgccactccaacctacttcaaggtcgagtgccacggcagaggacaaccctctatggagtgcctccgcggtcccaagtcgagaaagcatacgctgcgacaccgctgatggcagtgtagaagtcgctgcttgacaaactcaggccctacgagaacgtgacgtactgcaaggtagcgaatccaccccaccccaacccttttccaacagatggtgtactcatgaccacactcatgtatcacagagcactggaaggcgctctaaactgactgctatagattcacaatccagcatctcagctctatcgttggtgtccagaaggttgctgtatgttcatgagattggacagattgacctttgctaagcagggatgctggccattgcgggaaagatcaaagggtggggaaacaatcccaaactgtaaagtgactaattggagaatgaggccgggcgaggcccaagctccctgaattaagcacacatggagtcacgtcacccaaatcggagcgatgcgggacagttagaatgaatccaggtaattcgtataggttttaccacgtatagctttcaggattaaccagtgcgagtcagaagccttgacaacctggtctcgaatccgtgaaacgtcccgccggcaggttactgcggcgggtctctcgctcatcggtgtccgcgatgcaccctcctctctacaagaacaagcatccttcttgcattgaggtgggaagatgacaagttcttgctgtggagcctcggtgggttcttcccgggcccggtgacgactgtccgacaccatgcactgctcgcagggtgtgagcaacatcggcagccttgatggcgcgacactctctgctggaaacatcttcaaggcaatctcatcttcacatcttttaggtcattgacgcgctcaaccgctgccacaaggagaggagcattgccaagttctggggcgtgtgcacagatcagaagcttgctctggacgcctgcttccgccaggagaagaaggacaacaggtcggtgtctgggtatgacgtatggcagactctttatgatgcagctccgccgtgggatgcagtcttcgtcgtgcgccatcgtcatgcacacttccttggcatacttggaccctacggtcactcattctgtcagcgcggcgtagtcaggaacgtaaatggccaagcactgtcggcgcttgagtactcatcctcaacctgcctgaagcagagcacgcaactttgagaaggccagggccgagcgcgagcgcctggaggtcaagatcgggactggggctgcgacgcccggctacggcgtgaggagccagcacgccgagacgtgaccatgcatcgttcctctgtgctggacgcctatgtggcggggtctggtgctgagaaaggggagaccgacgacgtcggcgctgccgccgcgaggcctgtggcaggcgcgacgccgccacaatgtccgtctgctgcgggaaacgagggattggaggatgcacaagctgacaaggacgagctttggaacgcaagtgctgggccaacacaggtgcaaagcatcccctcgcatgcccccgttgagcccgccgccgaagcgctgcccggaccaaacagaacgggagatcccacccctccgccggcgcgccggccccgggtgctgctggcagttaccggcagcgtggccgccatcaagaccgcgcagctggcgacatgtctgctggcctttgcggaggttaaagtggcggtgacgcgcggggccagggccttcctggagggcctggagctccccggcagttgcctgccgctcctggacgatgagggcgagtggcgggcctggcatggcgtgggcgacccggtcctccacatcgagctgcggcgctgggccgacgtactaatcatcgccccgctctccgccaacacgctggccaagctggccgccggcctctgcgacaacctcgtcacttgcgtcgcgcgggcctgggactttcgcaagccggtcctggtgcgtttgtgttgggtgttgggctggaatgggggccatccttgtgatgggagcccctgcacatcaacccaaggtgacctgtcctgttcttcgatcacctgatgaatgagtcgctcattcacaagcttggcaggcgagtccttgccacccacaagagaatgccaatgccctcaccccaccgccctatgaagctggcgccggccatgaacaccttgatgtgggacagccccttcaccgctcggcacatgcacgcctgtgccggcctgggcatgcacagcatcggccccatcgccaagcggctggcgtgcggggacgacggcacgggggccatggccgagccggccgacatcgcagaccgggggcgggcgctgctgggcgcgtgagcctggctacggcgctgaatgctttgcgcggggccatgtgctctgcttcattgccagccattgttgcgctcggttgctggtctgcctggcatatgcagggcgtcatgcctggcagaatgaatggtttgcactcgaggaatggtggtcgaggggttgagaggcgaggccgacaacaggaatgcgagcaaggggtccagcagggaacggggtgaaaaacctgctgtggaggcaagcacggcagcggtagcaggcagagggtgagtaacaagactcgcagcaagcgcaagaggggcggagcaagcagaggggtgccactcggatgaatgagaaactccttgcggaaaggtcatgggcgcccacccctcgagacgtcgtcaaaacctccgtcaatggagcgcaaaacaggtacaaaaccgcgctcaggcccggtcctgggcgccgcggtccaggactcggcgcgtgtcgcgcacgctgagctctcgcaccgcgccaaagggcacgcctgggtccaggcggtagccgccgatgcgcgtgcggcgcagcgtgcgcagcgtgagccccgccgccgcaaccaggttccgcacctcgcggttccggccctccgccaccacgatgcgcacgcggttgggcttggaggcgacgctgtcgtccagcgtgacggacacgggcgtgacccaggtgccgtcctccatggccgcccccgccgccagccgctgcaggtcgggcaggcggggccgcgactccagggtcacgcagtactccttggtgaggtttgatgaggggtgcatgaccctgtgcgggggcgcggggagggatgtggggggggtgcagccctggctggcagtgaaacagggaaggggggatgatctcgggagtgacgattcggttagtcagggccacaggccaaggcaaggcacggcgtgccaaggtcagggcagctgacgctcaaataaaagcagtgtgtgtgtgttcggtgcgtctcaggtttaaaaagctcgttttgaaagatccgcagggtggtgttacccactcagtggtttggttcaatgtcctcatcctcgacgaccgacacacacgcagcgcagggttgggaatggcccccagggctgagctactacatcgccaatgcacagaaagtcaacgtgggtggcattcgcctttacccccggcgcctcacccactctcacctctgcgcccactcgccgtcgttagtgacgaagatgaggcccacggactgtgcgtccaggcggccgacggtgaagaagcgagggggaagcacggcggcaggggcgcgcgcccgccactccctcaaccatgggtcgagcagcgaggtgacaaggcgctctggccgcgggtttggggcggttgccaggctgctgcagatgtaccccttgggcttgttgatggcaaagtagaagcgccgcgacgcgatctggggagtgagcgcctttcccttgacgatgacctgaggtggtgcgaggaggagggagcacgctcaggcacagctggatgcagcaaatccaacctttccatgcaccgttgtcggaatttatcacactcgcttgcggttcgtaacgaggcaggtgtgcagaaagctgggcagatccctcccattcacaatcttccccacggcgtgaaccctgtgctcccctccctccaaccgtttcaaaacacgaccaccccagtaccttgtccttgccgaggtccacccgagtccctggctcgtgcactgcaacgccattgatcttgacgtggccctcgaagatcagttcatcggccgctcgtcgggagcatactccggccgtggagatggcctgatagaatgtgaaagaccagattggttcggtgaaacgcgcatggggttcgcgatacagaacttgctcgtgatgctgagcaagagggatatactaacatggtcgccctcaccttgttcaggcgctggagaccgctaggagcatttggggcgtccttcccgatgcgccgccgatcgactggcggaggcttggattgcctcttatcactcacagggggagcttcaggtttcttttcagcccccgcaggtcgtctgcgggcttgaaaggccgacgcctgcacgcactgtaggcgagcaggccggggaacagccgtcacgccagtgggtgcttgactgaaggtggtccgatagaaaatcatccagcagcaaagtgattctccttcacatgtctgccaaccggcagcgaggaaagacgccatgttggtgtgccatgttgtactcaagttcccctggtgccggcgtggtgattagaaagagcgacgccaggttgtcgcgcacaatttcgacactgaaatcacagattcaaatatacaacctgggcaagcggcggtcgttgatcgatcccaccaccagaagcccttgcaaactcctcctcgagtctcgttcaaatctcctgccatggcgtccacgctcgtgcttggcagccgcgtcaccctccagtgtgtggcatagggagggaagaatatttacactcaggactgaatcaaactgggtccgatcactctgatgctatacattaaacattacattcaagcattgccaccgccaccgaatggtgcctgatcacccctctcatcccttccccccatgaaggaggacggccctggcgcgtcacacacttccccgccctatcccggcctctcgcaccaccgcgcgcgctttcaagacagaagacgtgtccaggagcgtggaggagtccaagcagcagggcgcgaagctcttggagtccgccaagctgcagaccgaggactttgcaggcaccttttccggcaaagcggaggaggccctggaggccgccaaggtgtgctggggagaatcgccttcacgaatccgagagcagggaacaccggaatctgcattgttcatgttcctgggcagcagatgctcgaggtgtgatggctgcctagctcgcttcagtcgcacagccatgacccagctgtcggcatcatgcccccccctggatccacagtcgccctcgatccgtcctgcagagcaagtgggaggccactagggacaagcccaccgtcatggccgcgggcgctgcctccctgctggccctgtacatcctgtctggcgtggtggagcggatcgatgcgctgcccggggtaagtcccccttgccctactgttccgggtatctgggtaccgagccatgcttggcaaccagcgagcttgcctgctgtggatcttgtaaagctgcatgcactacttagtgccgttgatgaatggcctcacaaagcacacctcgaaactcaggctgcctccctgcactcgcccgacagatcagcaccctcttccagctgatcggcttcctgaccaccgcctggtttgtggcgcgctacctcggctccgacgaagacaggtgtgggcatgtcgcagagccccagcttttgagaaatattcaaaagggctgcttccgcgtgtgccgacgcaagcgggctgcttctctgagagccccttgtttccagcccagccatgatgcatatgtgtcccaagccctcctctccttccccgccgctgcactgcaggtctcgagtccactcctccgtcaccgccttcctggagcgtcttggcttctagcctgccccagcttggggctctgaacaaatcttgcacgaacgcaccctgcccccctccccccttgatccagcagcggcgtagagaatgcccccgactcagcatccaacggaccctgcacccactgaaacagccctccacccagcgaatgcatcgtgcaccccttctctttgatcatggcaggactcgcaagggccatcgcctccctgagccctgaccaaatctccgcagcgcccctttcagcttggtgttagcaaaatcacacagatgaaggcatgttcatctatccagtgtgtactgtccacagtgcaccttaagaagttggtacgacatgcaaggcaggcccagggggaagggtctggcatcgcaacccaaagatcctccccaccaatctcaaaggggagtgtgttctgggagcggtctgatgagctggagtacatgccgcgccggtggcggaggcagtatccagctgaagggatggccatgacgctctgcagccgcgacgggagggcagtggacgtgcgagggcagggcggtgccagtcagggatcagcctcctgacttggcaagggcctggtcctcggatgcgagagggcccagcaatctcgccagccagccgcccgccttccatcctgcggatggcgctccagcctcgcccacagcagcacgccgcgctcctaggcgtaggccacgccggcgggcgcgccgaccaccctgtgcaccgccgccacgaccttctccggctgcacgatggtggccgcctccagctcgtaggcgtaggcggtgggcacgtcctgggaggagaggcgcaccacctcgtggtccaggtcgttgaacagcgactcgtggatgaccgcggagagggaggcgccgatgccgccggtcttcatgcactcctccacgatgatggcgcggcgcgtcttcttgaccgaccggctgatggtctgcatgtcgaagggcttgagggagatgaggtccaccacctccgggttgtacccctccttctccagctgcttcaccgcctgcatcaccacgtagcgcatgcgcgagtagcagaagatggacacgtcagtgccctcgcgaactatctcggcgcgctccaggcactgggtgtattcggggccctccacctcgcccttgacgttgtacagcagcacgtgctcgaagaagatgatggggttgtcggagcggatggcggccttgagcagggccttggcgttcttggcggtggacaccgccacgagctgcacccccgggatgctctggaagtagctctccaggcgctgggagtgctccgcgcccagctgccgccccacgcccccgggcccgcggatgaccatgggcaccttgaactggccgccgctggtgtagtgcagcatgccgcagttgttggagatctggttgaatgccaggagcaggaagcccatgttcatgccctccacgatggggcgcagccccgtcatcgccgcgcccacacccatgcccatgaacccgttctcgcagatgggggtgtccagcaggcgcatgtcgccgtacttcttgtgcaggccgtaggagaccttgtaggagccgccatagtggcccacgtcctcgcccatcaggcagaccgtggggtcgcgctccatctcctcgtccagcgcctcgcgcagggactcccacatcatcagctccttcttggcggccgccgtccgggtggaggcgcggttcaggggcccggggcctgcgcgggtgacagattgagggtcggggtgggtccagatcgggggcagggggtcgtaggaagctggtggcgcaccggcgcgcggtccacggagatccacgcaccccgacatcacctttgagaagtacatggcgagggatggggttgagggagcgggggatcgaagcaggccgcagggagcagggggaggagcagggcctcgacacctgcgaccccaccaaggctgacgccatcccggggtgtgcgggctggtgctggtatgcgcaacgatcccgctttccggtcgagcggcgaggttgggaatgctgggcagcctgtggtccggggctggggtctaggccccggcctgccagattgacatgggctcgctcgcggtgcaccaaccccgatggatggccggggcgcagcacgcgcagcaacctgcatccatatcgaccggagaatcgtgaacgagtggaggagggaatgatagcgttgcagcccacacgtgcagacctccggcacatcaagtttgcactgagtatcttgagtggcggttactcgtgcgtacgtgactgcgggagtgagtgagccacggaagacagggaccatgggcggcaccggtgccctgctcaccacagggcctgcatgccagcacctgagtggggcatgcagggcgaaggcagtataccgacccttggcacaggccttcagggtgagagcctgtatctggatggggaccagggcttcatgtaagctttgggcatgccgtgctgtgctgcagcatcatctcagcgactcacccaccggtcacgcagccatttgtatcggtgggacacacgagacgctcctgcgccccctctaagccatgggcggggggaccctgggcggcatgggccacgagaagcgtcgactccatcagcatgagatctgggcctgagacggcctcggtatcgccggatgtcacaccggaggacggcgtggatggggcagacgacgctgggcttgagcgggtgagaaggagttggtgtgaaaggtctggatggggcgtttggaagtggacgagcgcaataatgtagggctggcacatgagaggttttcttcagtgtgtgctaggtgtgcttgcctggggcacttgcaccagcttcgaatgatcagcgatcccccagccatctgctgccctctgctcacctcagctggagcgggagaatgaacgtgccaaggtggcggctcgggatgctgcatgggagcgggtggacctcatgcggaggacgggccgcctgcaggaggtcactatcgtgcagaccatcaagtctgggtgcctcatccgcattgaaggcctcagggtgggtgaatacccgctgtttgatgaaagagtggggcatgtggcatgtcatgcggttcttagagacctccggaggtggctgaatgcaccattgggcgtgtcactgcacaatgagcctgccgccagacctgtgctgtacggtctacttcaccatgtgtatccccccttctacgcggcagggattcgtgccctatgccctgctgggcaacgccatcgtgtcggagccagatctggatgctcgcgccaaccggggagagtttggcgaggagcccttcccctacctgatcaataagaccatcaccgtccgagtaatggaggtgagcggcgggtggaggcaggcatgtgcgcgcctgcgcatgcaagctcactcacaggaagctgctgatcgacacgcgggggggcgcacggcttggaaaagcgcgagcagagatgacccgctcagtgcaccgtcagggcaggctagctgatcttgattccccttctcagcaccttccgactccccacgcctccaggttgcaaagtctgagcggcgcgtggtctgctcctgtaccgcagccgagcgcgacattctgtcggatgtgctctacgttggccaggtgctggatggcctggtgcgatccatccaccgattcggcgcctttgtggaggtgcaggcgccgtcggggcagcagggccaggtgagggggctgttgtggaaagagggaatggaggtatcaatgtggctgccctgcctgtgcctggacaaggggacccttcccatcggtacccagaggaggagcaatccagaggttcctgtcaggccctcttccccctcctccccctcctaaataacaaataggtgtttgtgcccacctctgagatctcctgggactgggtatcagacgtgaacaagtacttgaccctgggccagcaggtcaaggtcatggtgcagatcgtggcgccaccccccaagaccaaggtgggacgtgggcgagggtgggagatggcttggagtggtctagagggtatgacggtgggggccgccgctccaccttgcaggctgccaggatgccacagcctctcatgtgtttctgaggtactggtgccatatcgttctgcttgtgcctgggccatttctgcatccaagcgccacctcgcatgttgctcagccatcttctccacacgcgctcccctgctcacctcgcgcagctggtggcgtcgctgcgggccctgcagcaggaccccctcaaggagaccctggaccatgtcatgcccctgaacagcagcgtgggtagactgtgtcatagaaacgggttggagggataacaaattgtcctgagtttgcatgcctgacagtgcacagtctggggctaacggtgcaagtggtgcacaaggacaaaaccccccctccccaaccacccaacaatggtgcagttcaacaactacgtgcggtttgggagcggggtggggatgtcgcagggcctgcagcccctgctggatgcgctgatggaggaggagggcgtggacaaggtggagctgggcagggaaacctccgagctccaaactgtgtcccaggtgggtaccagtgggcaggcaggggcgggcccctggcagggttgcctgggccttcctaggcaggttcatagggcctgagattgggaatccctccattgcttacctccccccccctattccccccacccccggggcaggacctggagctgtggatgacgcgccggcccgtgccgggcggcttcaacctcgtggcccgggcagggcgtgatgtgcaggagatccgcgtgaccacggggctgtcggtggacgccatgcgagccgccatccagcgggtcctggcccgcctgggatgaagggcgcgtggatgcggcctcctcccgtgtgttaccaggctgtgtagtgctggaccgatgtcccatttttcatgctgtacctcacacctctggcctctccctggctgaaatggccatgcagtggctggaggagggagggggggccttctcctggcaggaggcagggcaggaaggggtgtgcccggctcaaaaggactcctcacagcaagaggctgtcaagctcgagggcatgggatcagacacttgtcgtcgaggggggatttccatgaacttttcttgcatggatccggggccaggggcagtggttcaggcccggattgcctctttcacaggaaaaaataaaagatggagtaccaagtgcagtatctcgagggccgaggggtttcatacctcggttcagagggcaagaagggggttagggctgactgtcccacacccttgggcgctgtcagggcatgagcctgcccgggtcgtcggagtcggagctgagcctgccaaacgcatcgagctgacgcacaaaggacttggcgcgcagctcggcgagggaggcggagcgcggcatgccgcgggcagccttctggtggtcgccgcccttttccccgccgccatcacccgccagcccctccctcgccgcggcgaggtccacgtccacctcgaaccgggtctcggccatggtgccgtcgggctgcggcgtcagctccatgatggtgtgcagcgggatgttcaggctgggcacctccgccagcggcctgttcatgaagtatccgtacagcgcgcgcaggacggcctggtgcgccacgatgcacacgcactcccgctcccgctccacctcgctgatcaccgggtccaggcgctggatgacgtccatgtacgactcgccagaggggtagcggtagcgcagcttgtcgcgccggcgcagctcgtactcgccgggcagccgcgccgcgatctcgcggtacgtcatgccctcgcagatccccgcctggatctcgtccaacgccttccactgcaccttggggaagggcagccctgaggcggtgatgatggtgcgcgccagggtggaggtccacaccgccacaggcggcggcgccgaccccgccagcggcaccaccctgtccatcaggatctggggcagcaggcgcgcatacacctggcccctgtatgagtgcggcggggtggacgaaagggggtggttggaggggggtgaccgtggaatgtgtgtggaggggcgggtggccaggtcttttgggggggggtcgctccaagggatgtcatggcaatatacaatacccataagaaggccagtctgcggttggggtcggttccccgccccggatgtgtgttggacggaggcgggatgaaagatgcgggtgatcaaaacatgcacatgtgacaccgagacatgggcggttcttcttcatgagggagcccttgacccagaacattgaaagcactcaaggagtgacgccccagccacacagccggcttttgccctgctggaaaacacccagtacctttctttccccgtacctcaggctcaggccgctgtttcctccgatcttgcccatggtgttgtactccgactccccatgccgcgtgagccagatgcggcggcgctggcccaggcccttgcaaacctgggggtccgatgaatgaggagggtaggggattgggcgaggtggccactcaagaatgcccggcttcaagatcatcccctcatccgataccaccactgctgcaatggccaccccccacctgcatgaggaagaagaccatcttgcccggaatgtagccggagatacggttcacgtccatgtaccccttgcctgcatggtgggattgtggaggagcctgtgggagtgagcttctgggtgggcctgagtgcatggcgctggatctagcaactggcgttggatcgagcgtctgggagctcgggttggcggtggcacctatcgcaccaggcggcttgtccatgagaatggatacctgcgccccaagcctgccacatcgcactcctcccccgccgccgattccttcctcacctgtgaccatgtctatgagcttgatgtagtgcaggcggcggtctgtgatggtttcgtatatcgcctcgtacttcttgatccgagcagtgaagtcctgtgtgggtgcaagatggctggggcagtgggctgacgaggccggggacatgcatgctccaggcccaacatgttgcatcactgcggctccgagacctgagcaccagatctccatgccctgacatgctcggcatggtctccaagcccatccacccatctacacccactgcccacctcccaggcctcctttggatccatgttcttgtagtcagggctgtacagcatcttccacttgtagttctggtgcaggacctgtcaaagacggatggccaggatggtcggtggggggtggcatggggcagtgcttcaggtagtcgggctgggatcgatggacaaacttgaaggccagccatgcgctccgcaccgactaacactctgtcttagccaccaccaccgtcacagcatcagccaggcccacccacgccgcccctcaccacttcatcgttgcagatggactcgatgaacaggtactgccaagtgccatggaagcggcacttcagctcctcccgtcgctcctcggtcgtgttggtggcgtcgatgaccgccacctgcgcgctgtctgcgtggagtcacggggcccgggcaggggtcgagagctcagagggcgagtgaggagctcctagggagactgaatcgagtgcaggtcatcccattgcagcccaaagcacagcgcgtcagcagaactccggcactcagcgccggcctcactgggaaaattactccccgtggccaaacagcccctggctcgacgatcctaacaacgctcgaggcaaaatatgcccactccccccctccctcgccaagcacctgttgcgagccaggcctccatgtcgtccagggccgccagcagcgccctgtgccgcacctcctgccccttggcgttgccggggtcaaagaaggcggcgtcgtgcttctcctcctggtcggccgcgttgcggcggtacatgccgacgttgaagtggcgggttgggtggcccagcctgcggggcccagtgcggcatgagctgtggcgctgggcgagattgggagaaaggaggggacggaacaggccgaacacacacccgaaatctgacaccgcagtaaccaccccctcacagacccccactagcacgcaccagttcaggtagcacatgagcttgttgcacagaaaggtcttgccacgagcgggcagtccaaccaagatcacaatcagcttctggcggtccaccctcttcagtcgcggctggagcaggcagggagtgggtgcagaagttgggaggggagcatcctcggcaggtggtgcaagcatgagctatgggcggctgctgactggtgcacaggcacaaccctctgcagagtgcaacctgccaagagcgctccgcacaggccagtgagcgttcacgtgagaggtccagtcttacctttcccccagacgatcctgtgatcttgatcgagcctccaggtgagacatcctgatcctgggtgccttcctcttctggggacagaaatgacttgaaggggggtgagtgtgtctgcggttgatgtgccaagcagcaaggcatgcacgatccgagcaggggggtctgcatccctgcacccccgtgcttcacaagctttcggcctgctgatgccaaacaacgttcagcggcctgccacccatgactggcccctggactgcaaccatctgtcccccgcacacccaccagactcatagttgtgatcggccaggagcttcaggtccttgaagatgatgtgcgtgggcgactccgccgacgtctcttcgcctgcaggcccatctgcagccgtggcagtgaagggctgcatgcattgaatgacacatctcacatccagtgcgggtctttccacaggaagagcgcaccggatcatgccggggcctccctgcacccacccttgttcttggcagacagggtgggagtggaccccgtgcgattgcccagccgggcgccagccttctcgctcgccgccttctcgttcctgtggacaacattatggtcatgtcgcagggaattgggatgatgcagcaagggtccgaaagggagcaccctgtgccacagccaccccgactctcaccagaactcccacatggccgcgcgaataggacccctgggtcagggtgaagctcagtcccttgcgccttctctccgcggcacgatctaggaggcagtgaggctcgtccctgcagggcgtgttttccatccagggtttcgtctgtcacgggtttcgggccccgagatcctcaatgtccatgtaggacctcttcacacaggaggtcagtctcccagagccccctcactcccaatgccctccagtgtccttgcatttgttcacacgaacagtgaataaaaagtgtttggacgggcagtttcgtctctgagggcgcgacgctctaggttgaggcgcaggcggcagcagcagcagcaacgaagtcaaagcggggagcatgctcggtatggagcatgcacaagctgcaatacagcgaggacacgggtggggcaatggcatgtggggaacggggcccggggaggatgtcacatcctcagtttgcgcccagacaggccggagctgccgggcggcagcaccggccccgcgccgggggcgcgggagtctgtcaccacgcatcgctggcagctgagctggcagtaggtgccgtccaccagctcattggcatcgcaagagtagccggtcaggaaggcctgcgattggatggacagggcggcgcaggtgtgggtttggtttgggatgcccagggatcaggggtgtggctgtgggtgcaccaaacgaaggctgccgagggctcacttgcacacacatacattgcatgcatgcatcatcctccctcacccaggtcctcccctccatccttcacaaaaaatcatccaccactcagcgctcacgtcgcaggaggcgtagccgggcggcgcgacgtcgacgcagccggggctgatgacggcgcggttcagcgccgaggacaccaaggtgggggaccgcgccgagtctgtgaccaccgaatcgttgccggcggtgggggccatggggggcaggggcgaggggctgggggcgcagaagccgcaggtgatggagcagaggccggcgtccaggatggccggtgtcatgcatagcccctggaacttgacgtcctggcaggacaggcccgggggcggcgtgtcgctggcgcagccggtgccgcttgcctgcgacgcgttggcgggcggggaggcggcctccggcacctggctgttgatgatgacctgggtctgggtgaggggcggggagggcactaccacactgtcgatgctgaagccctcctcgacctccggctggtcctcggaggccggggcgccggctgcgccgccggcaggcgccggggagggccaggtgccggtcagcacggggggcatcgccaccacctccaaccctgtcacggcctcggccatgggccccaacggcttgtcctccatgaagaggtctgactcgtcgtcctcctcaaacccgccaaggacctcgtcggggacggctgccggagactgctcggtgagagtgatgggcgccacaggcggcaggaaggcatcagtgtcctcctcctccgcaggtggcagctggctgacaggagcaaggggtgctgacaaccgctggctgatgagctggggcggctcgtcctcgaagaagtcgacgctgtcctcctccagcgatggcggaggcccgaacgcgacgggcgacggtgctgcgaaggcagagggtgaaggcgactgctccgagaccgagcccgccaggatagagtttgcggcggcggagggactggctgtggggcaccggccgcaggttatctggcagtagttgccgctcgtcatgaatgactcactgggtgttaggggaggggtgtgagaggtgtgtgagaggaagcgggcacagtagggagagactcgcaccagcgccttgctcctgcggcagtccctgccaagggcaccacggcaccgctgccaccatgctcgggctcccgacccacctgcatttgccccagcccgcttgctgagcgcaggtgtactcagcggaagggggcacgtctgtgcacggctgcgtgcatcggccacaggtctgtgcgcagtagtccccatccagcagccaggcagcactgcagggagcagcgaggatgggtgcctgcctgagactgcaaatcccagtggcaaaaccacccaacaaagtagagaagcagggcagtgcagacaaacctctatccaagaaatttccgatcgtcacctgcatttgccccatcctgattgctgggcacaggtgtatccatcgggggtcgggttgtccgtacagggcgtcgtgcatcggccgcaagtcttggcgcagtagttcccatccagcatccatgtcgcgctgcgaggatgacgagagccggcccttgtcacaaggtggggttgctggtgacaggggcaccagacagggccaagccagcaaagacccaacaccccttcatcccattcgccaattcctcacctgcacttgccccatcctgattgctgggcgcagctgtacccatctggagtagggttatccgtgcagggtgacaaccgcgcagcagtggagggcgaggcgggggggctgggtgagggagaaggcgacggcgaggtggtgctgcagtatttgcatgacctggcacagtagttcccctcgatcatccaggtttggctgcgagcagggtgtggggaggggggcccaatgggcgagatggtatgtgcatcgatggtgcaaccagctgcagcttggacaggacatggaggcacgcaccatgatcctgcaggcagcctagccccaaccagcgtgcgccccgctcacaacttggcggactttgccacggcccatctctgccccaggttacctgcaatggccccagatgacgtgctgggcacagctgtacccgtctggtggtaccacgttgacacaggatgccgctgggctgggtgatgggctcggcgaaggactgggtgacgggacaggggaggggctgggcgaggtggtcggtggcgggctgggggacggggttggactgggagacgagcctgggcttggagatgggctggtggtgcagtatttgcacgacctggcgcagtagttcccctcaatcatccaggtttgactgggtgggaagaagggggggggagggggggaggggaccatatgtttagtgaggcagggtaatgacatgagataagaaggagttcctccagttcagtgtggaaggcttgccatgaatgccagtcgccgtaggcctgcacatacatcacggcggtcaccctcccctactcacttgcactggccccaaatgacgcgctgggcgcagctgtacccatctggcggtgccacattggtacatgagccgggggatggggtcgggctgggcgatgcggatgggctgggcgtagcgctgggtgaaggcgatgggctgggcgtagccgatgggctgggagaggggctggggctgggg

SEQ ID NO: 18650 - DNA, 307 bp, Chlorella protothecoides
aaaaaaaagaaactttatttgctaatgttttaggttatgtaaatcaaacagttgcaacatctcaaacagctgtggaaagttggaaagatagtaattcaaaacaattacttgaaaattctctttcaaaattcacaaatactttcaaaaaaactctaactttacagtctctatcacaatttcttgtattaagatatgcagcgccattaaaagtgtcttctactttttctgctaatgtattaccaaaagcaaaatctgcagttaaaacacttgaaactgtaaatatacataaactaggggacaaaaaaaa

SEQ ID NO: 18651 - DNA, 83 bp, Chlorella protothecoides
ttcgctgaatcaggttattaaagagattatttgtctccagccacttaagtgaggtgatttatgtttggtgctattgctggcgg

SEQ ID NO: 18652 - DNA, 400 bp, Chlorella protothecoides
atcgaattcgatagtagttcagcagtatttcaatataccaatggtatttgttctccaagtggtttttcagatgttactttagctcgagctgcgagttcatctagtttttctgcattaaatttcgctcttggggttgatggtatttcattattttttattattcttactacattattagttcccatttgcattttagtaagttggaataacatagaaatatacgtaaaagaatattgtattgcatttttagtgttagaaactttaatgctaactgtattctcagtattggatttgttattattttatatattttttgaaagtgtattaattcctatgtttattatcataggtgtttggggttctagagaaagaaaaattagagcagcatatcaattttttt

SEQ ID NO: 18653 - DNA, 220 bp, Chlorella protothecoides
gtaatgttgctggtgaattagcagtagctgcaacaattattgtatattcaagagcacctttttcttgtaatgtatttactacttgagcaatagaagaagctttttgaccaattgcaacataaacacaaacaacgttttttcctttttgattaagaatagtgtctacgccgatagctgttttaccagtttgtcggtccccaataattaattcacgttgtcc

SEQ ID NO: 18654 - DNA, 62 bp, Chlorella protothecoides
cttcgacttggcagcgggtttcttgggtgccatggcggcttaagctaatcgattactgaggt

SEQ ID NO: 18655 - DNA, 64 bp, Chlorella protothecoides
gcacgctttagaatccctccacggggcatacactcatccagcctccaagatccagcggtgtgca

SEQ ID NO: 18656 - DNA, 72 bp, Chlorella protothecoides
cgaaattgcgggttttgaggaaaacggcgcgaaattttcgggaaaatcacattttcgaaattcgactccgaa

SEQ ID NO: 18657 - DNA, 75 bp, Chlorella protothecoides
gcaagctactgacgatattggcatcatgtggtggccctgggcactccctctggtatagaaacacaccaagcgccc

SEQ ID NO: 18658 - DNA, 61 bp, Chlorella protothecoides
cctcaccagcttgaaggagatgggctggcctcgcttgtagctggagtcgaactccgtgccg

SEQ ID NO: 18659 - DNA, 187 bp, Chlorella protothecoides
cagcctgcttcaagatggggaaagacgcatccctgcatccatacttgcttgagtgggtgcgaactggcaaatggcaatacgtcctctctcttcaccttgtccggattacatgcggacacagcggactggggtgcgggtcgctcttgaggcaaaggccatgattcaacattcccgttgccgccaacat

SEQ ID NO: 18660 - DNA, 840 bp, Chlorella protothecoides
aggccattgtcgccgccacggcggctgcgctgcatgcgctgggggcgctgcagcgcgtcgcaccgttgctggcgccggaggccgccgcgcgcgtggccgccgcagccatcgccctcctgcccctgcgccagccgctgctgtcacgccacgccgcctctgtcgtcgtcgcgctgcacagctgccccccggagaggggccccggggtcgcggaagtcgccgcgcacctgcgcgccgtgctggcctgcgagctcagcgtggcggagcggcgggacgtggagggtgtggctgcccgcgcccagcttctcgccgtctgcacgaagcggtgagcgtgtccactgggtgggtgtcagggtgtcgtggagcttggaaggctgtcgtgagagtctctggggtgaggagtgcccaaggcaccacggaacatccatgcagcactccatccagccgcgcaacctcccaccctctcgcccccaggctgcaccggctggagaccatggccacacctggtacccccagcacggccgtgcagacctgggacctcctgccccgcgtcttccagtacctgctcccgctgctgggcgccgagctggacagcgtgcggagcgcggcggcagacacgctgggcggcctgctggaggcctgcgtggacgccgcggcgatccgggccgcggccgaggcacccgcggcggggcgcccgcgtggtctccatgccctggtctccgccttggagtcggcactgtcggcgcacagcgaggcgggctggccgggggcgctgggcctctgcgcgcgcctgttcgcggcgctggggcgcgagggcgcggaggccgcggcgccgctggtcgc

SEQ ID NO: 18661 - DNA, 62 bp, Chlorella protothecoides
ttttttgataaagccaagctacacaactaattggacaaaaagtatgataattgccagtttca

SEQ ID NO: 18662 - DNA, 88 bp, Chlorella protothecoides
caccatcaactcactacagggagagggtcaggaagggcagggggacgatgaagatggggggaccaatcacctttttgatgcctgtgca

SEQ ID NO: 18663 - DNA, 1720 bp, Chlorella protothecoides
cgctgcgaggcgcggcagcagctgcgcggcctcgcgcgcgccgtcggcggcgcgcagcgcgcccagcaggcccagcagccaacgctcgccggcgtggtcagcctccgtgcccattggcagggggcctgttgcgatggtgcggcctagccactcggcgacgcgccgcttctgccagggtctgggtgcggggggggaggggggggggaaggaggaggtttccgacggccggctgcaaagctgacgcaccttggaacaggaatgacaacatcagcgctcactttgagcgagcaaacaagactcgaccgcagtcgaggccagtaatccccgcatacccactgccatccccgcctccaactttgacttacctggcggacgccaggcgcgcaagagcagctgcccagtcacaaacgtgtgcactcttgccttccccaccccaagctggcacggccagccaggggagcagaccagcctgcagggcgtcaagctcggcttcctcagcgtccagctgatcctgctcctctgcggttcccatgaacgcgtccagctcgccagagctggcatgtaagggctccttcccctccccgctcccagcgccggccaggtgcgtccacagcgcgcgatagcgcgacgctagggttccgtctctgtcctctgcacgcaggagggcaggcgggagctccgccaggaacgcgcggtgcccgcccccctcctccaggcggcccgtggccagcagggcgtccaggtgagaggccggacagaagctgccgtggctgaccagcagcgccgcccagtccaccagggccggggcggggggtcccgcgcggcaggcgcctgccacccaggccgagacggctaccgtgaggcgggccgccgggagggccgccgctgcctcgcgcagcatgcctgccgcgcacagcatgcgcctcgcgcgcatgttgtgcgttgcgcgcctgatgcaggcggggtcgtctgcatgttcctgcccatcttcggtcttactcactccgagcccgtctcccagcgccgcccaggcctccgccacggggtcggccgtggcccagtcgcagacgaggcctgccaggcacgccagcccctccccctcctccgctacagggcccagcaggtccaccagcgcccgcaccgcgggccctgtcaccccgcagtccagagcggcgtccatgatgcgatgcgcgccatcttccgtccagcgcagcacgctgcagggcgtgttggaggtggaagggaggaagtgttggggggtggatcatgctttgtatgtggcgcactgaatgcaaccccagaggcaatctcgccattgaatgggtgccggcggtcggtgctctcattatcgagcagcggcgccttgcaccagaccccgccaccacctcggcacctgacttgcacgcccgcggtgaggccgcgccgctcctcctccagtgcgcgcagagcggaggccacgcgcgggccccccgccgtagccatggactcccgcgcccccggcgggcccccgtcccagggcaggaaggcggagcggtgggcggccagcaggaggcccgcctcgcgccagaacatgccggccagcatgggcccgccctccccttcccgcgcctccagctcggcggccgcggcgcacagcgtacccagcatggcgcgcagcgccgcgtgctgcgcaggccaggcgcgcagggcgcggcgcacgcagggcagcagcgccggcgcc

SEQ ID NO: 18664 - DNA, 61 bp, Chlorella protothecoides
aggcgccgctgctcgataatgagagcaccgaccgccggcacccattcaatggcgagattgc

SEQ ID NO: 18665 - DNA, 294 bp, Chlorella protothecoides
ttttttttattcatataaattatagttattatggtttttagcgtgtaaaaatttatatgtatattttatatttaaattctacgctttttaggcggtcgacaaccattatgtggaattggtgtaatatcacgaataacagtaatagttaatccagcatcacgtaatccccgtaaagctgcttctcgaccaaccccagcccctttaatcctaacaataagttctttcataccttgactaacgcaaatttgtgccacattttccgcagcttgctttgcagctaaaggagtttttttt

SEQ ID NO: 18666 - DNA, 30494 bp, Chlorella protothecoides
  modified_base (3192)..(3256): a, c, t, g, unknown or other
  modified_base (12180)..(12218): a, c, t, g, unknown or other
ggggggggtaatgcatgcggtgttggggactgggaaaagggggatgggttgttctttttgcactggggaacaaccccgtgtgtcccccagcctccctcaagtcaccccggaccccatcctgacactcacctccccgacagacgccacgcgcgggtaccactggctggcgcggcagccttggcgggggggcggcggcgcgctgctggtccagcgcacgcggtccactcccgccatcagcctgccggggcagggcctgcacatcgaggtcctgcacctggatgcaggtgggggctttgaggggggtgacgagtcgtatcgcggctactgcggcgcgccagccaccgttttgaccagcttgctgtggagagatcatgcccggcaaggcagctggggtgaaaggattattgtactcagaacggtggcctgatctagtggttgttgtcctgttgcagttttctgacctggttccttctccctaccaccttgccaatccaacacctctgccttcctgcaacaggacggctgacgacgcgcatgcactccagcctcaacgcgtccacgctggcaagcaccacagcctggggctggaggcgtggagcctatgcgcactggctggggccggacgtcgttgcctacgctgcgtgggcctgtgggctgcaggagccctgcacgggtgagctgccgatgcttgaaatgcggcgctggcggccagcgggcgggaccccaggcggcccgggtgcggcacaatcaaacacattccccatggccccccttttctctacaccatcgcagagatcagggctttgggcgatgagtcgcggcgcaccacgctgcagaggccgctggtcgacgtctccagggacgggacgttgggcctgtgcgtcagcctgacccggctggaggcggcggcgcccgggtttggcgtggcgcgcgccgagcctgggaccaggttcggcgccctggcggccgacgggctctggatccagcgcctggacggcgccgaggccgctccacccccgcgcctcctgctgtcctatgagcggctgctggctgccgctcaggagacacggcggcgagcagccgccccggcgcctgcgccggggatcgagccgggatccggatccggtcgggccaagcacagaggtgtgggcaactcgccgctgcccatgatttctgcctccagctgccaccacgccctggaccatgccttggtgctggatgggggccgcggctcggccttccaataccttgttacctcgtgcgacgacggtgcgccggcggggcatgtgttgatggggctgggcgggggggctggggtggtgaagggacactggggcagcaggtgtctgttttgattcagtgcaaggatggcacgcttgcatggatcccatcttcaaccaattgcgacgagccacaagggagtcgatcggaggcccgcacatgcaccctgcgtgctcctgcctctcttcacagggagcccggaccgggcgttcaccttcacggcaaatgccacgggcggggacctctgggccgtccccgggctgcccgaggacagggctgccgcgctcgcggagggtgagagcggcgtgctggccgcctgcttccacagctcggtgttcctaatccaggtcgaggtgcggtgcaggctccatccaggcctgcatgcccgcggttggtgcacaggggcgcggcgcatcgctctcccaagccatgcctcacaccccgcaccctggctcgatcgagcagaggccggtcctcagcaggagtgcagtgacaccactacacacacctgcaaaccccccaccctctccctgcagggacgcagcgcccggcccctggcactaccagctccgctggcggcggtggcgggcaacgttacccactgcgcctttgcgccgggccggggcgacacgctcgccgtggagctgagccgcagcggctgggctggcccggcgcgccacgtcgccgtctggaacctggcgaccggcgacgtcttcccaggtatggagcgcgcggctcggcacaaagctcaaggattcaggaacgctcagtgcactctcttgccgaggcgcaccgtacctgttgggtcccgcttgcaatgagcgtgctgccggtcgaaggcagggcgcctgctggcggcgaagggcggcaaagagcggcccagctcgctatctgacgtgctgccgcaccccaggggcgcaatgcccagtgctcctggcaagtcgtaccaggggtgcccattaccaatgcccttccatgactccaccatcacacgcagcggccaagtacgaggatgcctcctggcccgggccccaccacctgctcactgatctggtgccagcctggagccccgacgggcacaccctggctctctccaccagcggcctgtgggaccaggggtgccaggcagtcctccaggacgtctcgcctgcccaggcctgggctgggggcggcttgggggaggaagaaccctggccggggcgtgcgaggcagagcgctgccccaaccctcctgccgggcccgggggcccttgctcctgcgggggcggctgggccggccgaggcgctcccctcggagggaagggccgccggggccgcctcggaagccgcgctgcccgacgtccgagtgctgctggacgtcactggcggtcgtctgtcgggcctggcgcacctccgccgcgccggcgccgacctggccgcctggagcctgcatgctgtggtggtgctggaggagacagcggcggctgggaacgcgagatctgctggggacatgaagtcgactggggacgcagcgatggccggagatgcggcggcagccagcgtgggatcgtcgcaggccactgccgcgagtgcagcacccggcggcgcaccgccccacctgcgaatgcatttctggcaatcgagcacggcagggaccaccccgccccaggccggtcccgtgctcgcctctgcctcccttccggccatcaaggacgcgctgctggggagccaggccacgggcggcgcaggtggctggcgcggggccggctggcgcggcccctgggcggacctgcgcgcctgggtgggctggggcgcgtcggccgacgcggcgccctggcggccggagtgggccctgggggccggggccggggcggaggaggaccccgctgcggcggagctggcagccttcatctcgggacggcttgcggactgnnnnnnnnnnnnnnnnnnnnnnnnnnnnnnnnnnnnnnnnnnnnnnnnnnnnnnnnnnnnnnnnngggcagcgtcgtgctggccctggctctgcccgccaacctgcacgtgagaccggactggcacatgggattgcagggtgggggaaggggagtacagaggggcaatgtgaccctgcgctcggcatgtgcaagggtttggggagcgacccaggccgtcacgcttgtgtgtgcgtgcgggaggcatgtcccggacgcagcagatgtggtgtggggagcgggagcgacggagagggaccgggatcccccgcgctcccttcccgcggcgggtcgatgcatcgcagatggatgtagagcccatgccatgcttcccttatccccctgcctgcagtatgccgtgctgcagcgcttggcgctggacggcagcctgcacctgctggcgcggctgctggttgtatggcccgtggacgtgctgacgtggcaccaggcccaggcctgggagggggtgctgggcacggtgcacctgccctgggagtacctgagcccgggcgatgcgcccgcggcggagcgacagcggcgagggtgggatggcgcggcgcgggagtgacggcggagggtttggttatcgctacttgccgctgtagcagtccccagtggggcgtcgagcgtcgcggaagtgggttggagcgtccgctcttgctgtggcgcaccgacttgacctctgacaagctgccgcggggctgaaacagcctgacacagagggccaggtcaggatgagaccggaaagaatgccaggactggggtctgggatgtaaagggatcggggggaggatggaccatcagttggcaggggtatgccaggggaatccaagcagccaaccgcgtcaagtgtgtgtgatgcggataccccttgggggctgtcaaagtccatgcagaagcaataccatgaatggtgcgggcgtgtgccagcccatctttctctccgcctatctacaccgtgctccgagctgatgtgtggtgcaacctgtcgatttcttgcgagccccatggggtgatgttgccatactctgtctgatgtggaaatctccacatccattccatgtgcctgcctaggtgtgccgaggctggatgacgtgcccattccagcaggttctccccagatcccggtgcgcagttttcgaattcattcgaaaagaaacagatcatcgtgtacctcaacagagtaacgaagagaatcgcagcatggcgagggagggactcgtgatcttgcatgtaattttggtgacctgtgcgtctctgttgtaatgggtcaagctcagaccgagcctgtgtacaacagggactgtcttcctaccttggccgccaagaaggaggaatgtctgtcgctgaggatgaggctgtgatgctgattggtcgcgactcgcacgactgctgacagttgtcaaatcccgaccggaggctcaccggagcgggaaaggccgcgcaacctcttgacagtcaggattgattgagtggctagtacgatttcaggaatatttaggcagggcatgcattgcaacgaaacgaaaagtatcttcctaggccaaggaactgtctcgcttgtgtcctctgacaggacgcgacatattcaagatacgcttcccgtacttggcagccgttcctttgcgggatatagtaaagctttcaagcacgcaaggatgtctacacgaatcgcaattttagctatggttctgacactggtctcagcctcgctggctgcggtgagtcgtctggtgggctcgaccacatgtgcatgatagctaccctctaaagcaccgggccgccattgaggtccagtgagcagttccggtggacaagaattacaaacgcaattatgcatgcaggaggagtgcaactccgcattctttggcctacccaccgtaaggtatggggcttgcacagaatggggaagcactctgaatccgtgcagggtggacaacctgctgaattcccagaggatgatctcatctcacacttccacatccacgcagcctggatgatactctgtacttcatctcggcgaggagcgcgaacatcttctgcaggtgagacccagggttccgaggagggttcagaaccagcatccggcatgtgatctggagatctaggcattggacggtcacatcgcttagcacagctcatgtatctctgcaaccagcgtgccttttcaaatgcatacaatagatacaaggggttcgagaggggcgttggcaagttcatggcacggccccaagaggaactgcccactttgctccatgatatggacatccacatcttcgacatcttcgacatggccaaatgcgatggcagatgccccatgaccgttttcatcgagtgtgttccgcgagggcaggacagctgcagcgcggatagcaacctcaacatcggtgccaacaacaccggcatgaataacaggggcaacaacaaccaagggtggtgcaatctaggtccgtggttcgatgatgccgtcctgtacttccttctcctctgccatgtcttatgcctctgccctgcaccgaagagggtgtccgcagcgatagtgcctcagcatttccgagaatctagtctacttgcccacaccccccaccgatcagggctgctgcacacctcttccctctaccccatccccttccaggcaacaacaacattggagactataacaggggcagcaacaacaccggcaccaaggtgttctgcaacaatctacagcaggccagtgacagatgcactctggacaagctgaggactgcagaaaccctgtacctgtagacctagtcgctaatcatcgattggttgaggctgcacaactttcttctgcaacagtggagtccccccccagagtgcctgcgcctacccagtcttccctcgcgcctctcgcgccacggcctggtcccaggaggtagcgcttgattgcggcacagagcgaagcctatcctcctgcaggtttgcttggaatgcctgctatagtgagcaggactgctgctgatccaattcactatgtacttatgtgcgctccatgccaatggttgctcgcctattggccgagtggtccttgcccatgttggcttgcaatatgaagtatggacagagtggatgtagtgtgatgaccatctgggtgaaagctttagagcaagcggcaggatagcagccccacatccatgggccatggcaacaatgactctaagggaacacgcccccatccagcatcgcacctttccacgtgactgttttacgcatgctcgtggttagggaatgaatcagggggcaagccttgagcagaaccagagcaccatggcattttacaggaaagagaccatgccgactgcccaaccgcctgatttctgagggcaggaaatgccaaatccatctctgcgacaccgagaacgcactcaatcctctcgcccatcagggtgagtgaggtcacgaggttgtaacttgggattggtcatgcatggtctgttccacttccgtacaccatgccacgatgggctcgcagcccgggtcagacttccaacctcactcgcgaaattgcggacctagacacatacatctcatccaatcagtcggagccccttgagatttgggattatggagtatttgggttccatgaacatttccgatgtgtcgcatccactgcctcgtcccgagtctgacaggtgcacctcctgtgtgtgcagatacaaggatgcagggcagcgtcatgctcgcgaactcacaagcatggatgcatgtatgatggtgttggagaagattgcaatgcttggtgaacagttgatgctgaggattcaaccgtacttccggagttcgtcccggattgcttgcggcgctcccttcatcatgtaagatgacactccaggtaggagtaccgccagctgtccgggccacagccgccactagtgcacaccggaaccggaagacgcgaccctctcgtacgcgatgaattgctggcgagacctcagcactgtacagcaaaaaaatgctttgaatgcaaaaaaaggtcgtcgacgcctgagcagggcctgtttcaggtctaggccacggacagtgcacgaaacacattacgagaaggtagcagtatatccgcacctcatcaggatccaatcaggcttcaagcgcgcaaggatgtcttcaaaactcgctatgctagctttcgtactggcacttggctcagtctcgctggctgcggtaagtcgacgggcgtgcttgtcaagaatcgtaccggtgcgcccttgcccccccttgtgctcctatcgagaccagcaagaaccttgcgcgaaggagtcatccccatctgccaccacatcatgtagggggaatgcagttcctctttctttggcctacccaccgtcaggtgtgtagcactctgggtttggaggcataaccatcttgcatccttgacagccctgcaaagcgatggagcacttaggctagtacggtcccccaccacaatctcgcagcgttggcggccagctgtatttcatctcagacagaagcgcttccatcttctgtaggtgagtcgcagggcgtgaatgaggttgcaaggctaggattcggcttgtctgagacactatctggctgtttgaaggttggagttaccgagcacagaccgccttggtcgtccaccatgcttcccaaacccccccccaaatagatacaaaggatttgattggggagtcggtatgttcttggcgaatcccattgagcagctacctatcctcctgcccggattggacatccatgtttacgacttattcgactcggtcccctgcaatggcacgtgcggcatgacccagtttgtggagtgtgttccacacgaccagaccaactgcagaatcgatgaaacattcaacatcggcaacaataacgtcggcctgaataactggggcaacagcaaccaaggatcgtacaacataggtgcgcgcgagagcgtgccttactgagcatccagggtgcccgctgtgcatcctgcccctgctgtgcattccagtggtgcttgagttcaggtgcaccgcccttcctgagactccagcctgcttgcctgtgcccagcgtctagtcaggcttgctgcacccctcctgcctcaaccttacccattccaggcagcaacaacatggggaactctaacaggggcagcaacaacaccggcacggggcttttctgcaacaatctccagcagggtcagggctcctgcactttggacatgctgaggactgctgagaccgtgtacatgtaggccctgcgccaattctttgttctcatgaggctccaacgcccgtcccagtgccaatagagcctcctggcaagagtccagctccactgctgcccgcgcaaggaggggtgttccctgaggcctcctgcagaagtcttgatcacaagcgcccagaggtcagatgagtccatctgaggacagtttgacctcgcggcactctgtgtgggcaagctgtagaaagaatttactggtgcagctacaaggcccggtgtccatatctctcaaccgtgcttccattcaattattgagagattgatgtgagaaaatacacctaagaatacctcttcagcttcataaaaagtgattacaagcgcttatttgctgaagcaactcctcttgcttgcactgaagaccgcagttacggcaggtgtccggcactgaatagtctcggccacccacgggtctgaggaaggccctgctgcagcatccttgaaaccctatccaatccttgcgctggctcaagctcttgtcttttcgaatatggggatctgcggcaaagcgctatctgcgcgaaggcgggcattgaattgcagcacatgtagaagcctgcctgcccatggttgtcgaattgaatatccctcgggattttcccatcacccgacggacccccaggtgacaggtgtcccgccaaggggtttgggacacgcggactgaaggacgcgcagattctttgcgggctcagaaagctcttacatattaaatgcctgcggttgtacgggtaggatccctatactgagagcatccactattttggtgccaaccgataagtacaccactagcgcatctggcgcgtgacatatctccgcgccgaagcggtgcggtcaaagacacgggcacgcagtgcagatttactcaaccatgcgctcgaaaatcatagtcgcagctctgctgctagcgataggctcaacctcccaggctgcggtgagtcttcgtacctgccaaacacttgtccggatgtcgcgcgtttgtgctggctggcgacgccgggttggtctcgagcccctctatcggtcaacacaacacccatcgcatgaacgccgtgcaggaaatatgcaattctaaattcttcagccttcccactgttaggtgggcgatgtacatggcgtcgatcggaaagcaggggggtttctgtggctggcaggttgctcgtccacatttccgacccaatcctatcacatcttattgcagtgtggacaatgtactcctctttgtagcagagcaaagcgcgccaactttctgcaggtgattcctaggccgagaaaactcttgcagtgcgaatgccatgttcgtgaattcatgacgctgcacgaacgtgctgcaggaggacaccccaccctcgtcctgatacactttctcatacaatcatccattcccgcagttccaagggtttcggcactggactcgttgtcaccctctataactccagctatgagttgcaaactctgcttccggggatggacatccacattttcgacatcttaaagtggaacacctgcgattttgaatgcgacatgaccgtcttcgttgagtgtgtgccgcaaggtcaggagcgctgtccctttgatgataagatcaacctcgggaacaacaacgtcggggagaggaacggaggcaacaacaacacgggaaacatgaactttggtcagtagcgtgatgcagtctggtacagacatcctacctgctgggcgacctccatctaacgatgctatgagccatgctcctttcctcctgtgggagcctaccccaaaacatgcacatgagcatcgtgggccttgctgcaagtttcaccgcctcctccaaacccccctcccctttccctctaccccacccacaacccaggctccaacaaccttggaaattgcaaccaaggtgacaacaacactggcaggatgtttttctgccacaactcgcaccagggaagcaacaggtgcaccctcgacatgctcagaacggcagacacggtggatttgagcgcgctccccatcccaatcagcctgacagccgctgcagagacggtgaagacggttgccgtacccgccaactgctgatcatcacgaccacatttccagcccggcccgcggtcagctctgtgatcgcggagacgggtgccttgtgccctttctggctcataggccgccgcagggttccgacctgatgctgagacctgatgccaaccctgagtgggcaccatgccagtcatgcagccatactccggcgaggcctctccaggggcccttccctgtgacggcagtggccctgcatcgagaaacagggtcgaccgccaagtcctccattccggagacttcccccccccacacacacacctgtcctctgaccccgcacctgaaatcatgtgtgccatgtgcggcagggtgccccctgcaccacatgtgcaacccagagccacggtgcctatcacattgcccattctgccctgcataagtccagcccttcatttttctgatcccgtgacaaagtcttgtaaagcactggacaccctggcacacatgcaagcgtgggagggctctgatctgtgggctccagggaccagcacacccgccagcctcctcacgctcgggcttggttgaatgagaggcgagaggggggttccacagcagtgccgataccctgcggctgtccctcgtcggcaccctgccgcccctgagcggcctacgcggcggccacgcgcaaagctttgctcgccactgcggcatccagggcggcccggatgtcagcgtagacctccggcatggacctggcgccgtcgatctggggacgagggagtgcgggaagggggtgcagagcgatggaagtcaaggacagggccgagcgagtggcatccctccagtgctggtctggagcgcctgcgccgctgtgtccgcctgtttgcttcatcacccagatgtaggagcttgcggattatctgtccccccccccttcctccgcagggattccattgcgtcatgaacccccccacccctccacccccccaatcaaacgacaattccctgcgccctgcgccccacctgcacgatctggtctgggtagaaaccgagcacggcgtccaggttggcgtggtatgtggccagccgggtgcgcaccgcctcctccgtgtcgtcgctgcgttggacgaggcggggcgcgacctcggtcggcggcggtcggaaagtcaggtggtagatgtcgcccgtgaccgggtccagccgccgccccacgacgcgggccaccagggcgtcgtcgggtaccttggggccaggtgattgattggagggtgtgcgtcatgggggaagggacggctcatggactggggcagtcaatcatgctgtcagggaacgggacagagggggccggagcagctgctgaccacgtggccccagggacatccggcatcagcaggctcggtgttcaagcgggtggggtggggtggacttcctgcgcttgaggtcccaatgtcccacccctttcagccccggggcgggggaccagttcaagcagcaccgcctcacattgagcaggaggaagacgtcagggcggatgcccgcgcggtcgatggcctgggcctgctccggtgagcgggggtagccgtccagcagccagccccggcgcgccgcctcaccgctgctcagggctcccaccaccatgtctacgacgacctgaagggggggggggggggggggggggnnnnnnnnnnnnnnnnnnnnnnnnnnnnnnnnnnnnnnnggaatgttgagatgaaggggccgtgtgggagcccatgacagggagctgatcaggcggttgcgagtcgggacagaggccatggaagggagcgtgtcagcgccggctggcagaaccgcacttccgcctatgcgacgtcggaggaggaggggtccatgctgcaaactcccaccatcacagagcctcgctcaagccccacacctcgtttgggacaagcttgccggcggtcatgaattcggaggcgcgctttccagcaggtgttccggcagacacctcagcccgcagcagatcccccgcgctgatgtgggtcaggccaaactgagacagggttggatggtggtggtaagaaggccgtgcacaggtgtttttagggggcagagatgccattgccactctcgaagactcaggtaccgtgccaatgtcccctcccaagaatcccgttgccacctaagtctatactgcccgccctcccttccccctttccaaagtgccccccactcccattgaccaccccggcacccacatcttccacgatgctggcgcactgggtccctttgcctgcagccggtgctcctgaaatcatcacacgcagcggcgcatcccccatggctgcccgggtctgggcggggcatgggaagcgggaaatgggtcatgcagagcatgttgcaggcatcataaacggggcaactggctcctgggtcattgcatgcgcctaccatgaagctgtttcgtgctgagcggcgtggtgtcgcccggagtgtggtctggggccaggcacctggccttggatgggtgggataggtgacccacggcctcgcctttgggtaggctggaatcgcgaaagatacaacggagcacaggcaatgacataccattccgggtcacctttctgtaacgcagagcccctgcagcggggcaaagccagagtggggccggaagaatgcacagcacacgcaggtgccatgctgagatgagaccaggagggtcccgctgctggtcaggtgtaaccttcgttgctcctatatgcgagccaatgaagggaactcgcgtgtcatgcgcatggcctagtccagcttatctgcgggtttcgacataaagggtccttccccggcgcgcgcgcccgcacgctgccgaccccagtcgttcaccccgagagaaaggagctctgtgggataattctcaagcatagctcctttacacaaacgtcgcctgataatagtacatatggctgcccgaacaaggctcttcaaggcgagatggcacctggaaggggggtgtcccggaagtcgctggcctgggaacgtgaattcacaccccacgatccgctgcaggaactcaaggagatatccagaactagagacagcaatggtatcgagctgattccgaacgactcaaatgtcttcgtttggcaagccagaatagcggtatgaactggacccgcaaggaggggtggtccttggctcctggtgcactctggaggtttgtgcctcgcatacttgacatcgcagagcagcagcagaccttgatgtggccatactttcctcttcccaagtgcagggtcccactgaaaccccataccacggtggagtgtttgagctgagcattactgtaccggagcagtatcctttggtgcccccggtcgtaaagttcaagactcgcctcttccatcccaacgtccattttaaggccagtgaagctcatgtttatcatagggaggggtatttatagcattgcaagcacctggcccttctcccactcgctgcgtgatggttgacactgcctggaacctgacacccatctgcagaccggcgagatctgtctcgatatactgaagaatgcgtggagccctgcatggacgcttcaggtaacgtgaacgctatggggttagggtcacagttgtaagctaatgtcctgggaggtttcagccctgacaattggccattcaacaatgacttcacattgggtatgaatgaatggggcctgcactacctccagaatcatgtgcttccctgacaaccacaatggagcatactcctattctgacaatgtcacagtcggtctgccaggcgatagtggctttgctgtcagactcggccccggactctcccctgaactgcgacgccgggaatctgttgagaggaggcgatctgcgagggttcgcctccatggcccgcatgtacaccatcgagtatgccatgaagcgatgatgtctgtgaaaatgatgttcagaattcattatatactcatgtttttgtgtaaatgctgtgtcgacttaagttaccgagctggctgacagagacaatcttcaggtcaaatgttggcaccaatgatcgcgacgatcgttcaggggttatcaagtcagatctgaacgaaaaccagaaatcaaatttgccaaagcgcatgtttgtatgtcgagaattatcatgcgggtgactggctcgctaattctggcatggaaggatgccacatcgaattgatccggggagactaacacttgtcagaattgcaatgtgccatattccagatatcccagccggcccttctataaaccacctgcgggctcagatacctacgaagaggctcagataactcaaggacgtgcattcgaattatccctgccgcgcggaaacatcagaccaggtgcggatgctgagcgtcgagttgggtgcttgatagaccttcaccttgatctgaggttcccgtccccagagcactcgaatctccggcatcttacaggcaaaccgcaaacagtaaataatggcgagcaccatcaccatgtctgccatgcgaggcgcacctgtacgggtgaccggtccgaacaccagccggcccacctgccgccctgctcggggcggcacggtcaggccgtctgcggtcatggacgcccaacgctacgcaactcccttcgatggcttcaagtacggagatgtgggcatccaggattcgcatgtgctgcttcagccctcctcatgccactagcactcatttttcgactcccggattgccaggttcaagggcatcaaggagtcggagatcagccgcgccatgacctcccgctacttcgaggacctaaacgtcaatgccgaggtgcttttgcatatatttacagctaattatgatgggtgtggtgcgcgatatgcttgcaaggtctccggtgagctaatgatcggcacatcccttccgcgcatccgcaggtcgatgtcgtcattgttggggctgggtctgcgggcctctcgtgcgcctatgagctgagcaagcacccggatgtcaaggtatgggctgagcagggcacatcctcagatgatgttgctgtaattgcaattgaaacttgcggttgttcccagcacagcctcaatcaatcatgtgtgctgcgttggaaacgctatgataccccagccttcaacatggggcagggatatcgtttacacctgcttgaaccccccgcaacaggtggccatcatcgagcagggcgtcgcccctgggggtggagcgtggctggggggtcagctcttctcggctatgtgtgtgagtctaggcacggggacgggtggactgaagcaagggttgggcgcagggtgttgatatccatgtgttggacattctcgttgggaaaacaagatgtgtgtatttagtgctatctcggtggctgcattccagcagattgtaggtactttatgttgaagatccctaattcattgcaacagatccgcaagccagcccacaagctgctggatgagctgagcatcccctacgatgatgaggtaggaggctgtacgccctgctttccagggccccttgtactactatgcactctgccggttcccttgtattgcatgtgcctggccttgcactctcactcaacccccgactcaagggtcgccgccttcctcacattacaccccccctacctgccgcaacgacagggcaactttgtggtggtcaagcatgccgccctgatgacctccaccctcctgtccaaggtcctcgccgccccaaacatcaagctcttcaatgccactgcgggtgagactgggtggggcatcggggaacataggtggcctgcccttgcccagggtctgacatgtagatgggggtgcagcttgcagtactgcctgcagcacctcaaaccctgggttccctcgcaagatcctaccctcccgcaacgcctccaatcacacagccgaggacctgatcgtcaaagacattcccgcaaagggcggccgccacgtggcgggtgccgtgaccaactggaccctggtgtcgctcaaccacgacacccagatgtgcatggacccaaacacaatcctgtccaaggtcatggtttcttccaccggccacgacggccccatgggcgcctcaggtgaagtgcggtgcttctgttcatacttagacggataatgggagggcctggagctttgataatggtgcagagtgctcatggaggcagggcatcgcctagactctatcctgcatctgcagaggcagaagctccggagacccccacccacccttgatcccccggactcatcagtccctgctcattccctggtcaggcgtgaagcgtctggccaagctgggcatgatcgagaaagcgccggggatgggcgcgctggacatgaatactgctgaggacgccgtggtggaccgcacgcgcgagatcgtccccggcatggtcatctgcggcatggaagtggccgagctggacggctgcccacgcatgggtcccacctttggcgcaatgttcatctcggggctcaaggcagcccactgcgcgctggccagcctgaggaggtgaggagtgagggaggaattttgtcgtcggagaaagagggaaggaggacgcgggtgggggaaaaggtccgcatattgcctggcgggtgtagcagcttcggaggggcccatgccgtgcatggcctcccagcattatcaaggggcatgtcaggctggactggccagctgcagacgctgccagactatatgacctactttaccatgaccccatcgccaccctttccacccactgcaggcagcgcgaggaggctggcgaggtgcaggccgagaccccagagcagaagactctgcaggcgacgcactgaggtgcctgctggtccgtcggggtccggaccaaggaggaggctatgtgtgtcacttaagcggaatgcgattcccgggctgcacgggtgtaatgcgtgccatctcatctttctcactgctgtaccccctggaatttcctggggctgtcatgcgcatttggcagtcactctgcagcccagacagtgctcaacaagcctggggctgtacatgcatttgaatcgaggcacatgccacgacgagatgatgactcttgtacaactaataaacagcgtaaatacacgttcggaacacaactaggttcctggggggttgggagtttggcagcagggcgtctgccaacatcagcacacgttccttccgaggcgccgccctcagccaaacagaaacttgaggtcgtcctcggtcagcctggccagcgcagcattgtcctggcccacagtgccctcgaagatgagctgcttcttgtcctgcagcttcaggatgcgctcctccacgctgccggcaatgatgaagcgcaccgcccgcatcggcttgtactgcctgtggtggggggtgttgcggggcggcgatgcagcgcggatgcagtggaggatgttgaggtgtggaaagagatggatgctgcaaggtagcagtggccgccatgccgatcatgaaagaaggcaggacagcgcgggacgcagaaagtacaattacgaccaaccctgttcatacaccccatcttcctgaagcaacctctcaccccagcctgtggatcctgtcaagtgcttgccattcgctggctgggttccaccaggggtcctattgggagaggtgggaaccatggttttggtggaagcatgagtaaggacatgggagctggggctaactcccaaggatttgcacaaagaagatccaaaaatgtaccagtctccacccagcccatgccctgaggatactgtcgtcggcgcaggcctgccaggagcgcatgcatgcattccctccagtaggaaatcaaaggcaccatccccccagcgcaccatgaggaagcagtgggaggcggcggtgaggttgagagccacgccgccggccttgagggacatgaggaacacgcggacgtccggatcgttggagaaggcctcaatctgggtgttgcgctgctccatggactgcgagcccagcagctgcacgcaccgcactccgcactgctggagcctgcaagttgggggaggtttaaagtaagggaaaaacatgtgggagtgagggaattggcaatcaggggtaggagtttgctgaggaagtgggtgggaccctgaaaaatcaggcgacgggaatgcaagccatcatagagctttcagcgcatcaacaagtgtcttagcacaaagacggcatccctcgagccctgtgccaaaacacttaatctccacctgaaggagcagaggtccaggaaggatgtgaactgggaaaagacaatggccttggcgctggggtcccgctccagcatcctgcacagcgcgcgtggttatgggcagagacctgtcagcgtcagtcttgtaagggagggcgatgcaggcgacttgtgccccgtcccccgcccccttcagcccttccacctgtggatctcctccctcagcgcctcgatcttggtgctggactggaagtgggcggtgtcaaaccgggagaggatggagtttttgcggtactgactagttcgcacccccggcgtggccgctggcgaggccaggtccagggagaggggcttggagcaggcggggcaggtcacggtgtctgacagttggggggacaatggcgcagggtcagggtcgtgggaattggtgaggcgcatgtgccaggcctgttctgtgaatccgtcgacaggagcacccgcctttgatgggcatagtccttccctgcgccagccaacacatgtcactctggagacacagggcaccggtctccaacatacccgccgcggccgagttggtaaactcgctcacgcaggccctacagaaggcgtgcccgcacctggcgaccaccggttcctgcacagcacaatgttggagggagattggaggacaatcgcctgtgtagcagccacgtctgctgtgcatccgtttggctgcggcttgcgtcaccaacagctgtacattgtgtcttgggccaagcagtccacaacagtccctgcactcaacaccaggcattcatctccttcgcatgcccactacctccagcgggtcgtggcagatgctgcaaagcccctggaccaaagcgtggtcatgggtggcctcctccaccacggcagcggcgacgccgtcggccccggccccaaacccgcctgccaccacgcccgccgcatccgtggagttgtgaaccaccaggtagggatggttgaccgcctgtcgcagcctggaggggtgaatggggggcccagggatggttggcatgagcggcgggttggctgcaggggagacagctgcaaacagacatgcccggcatgtcgatgcagcggcggggtgcttgtgacgccccagcatgaccttgcggtgtacatcctcccctcgtgcatgcccccacctgaccaacagagagaagatgtggctataattctgcagagaaagggatgcaaaaggtgtgagaatcgtgaccatggagtagggcaatgtcatgtgacaaggcaatggagacatgttcgggggtctgctgcacgcacacggggagtgcaggaccatgtctggccctccacacatcacagctccccaccagccaagatggatccacgatacaagcaggccctccgcagccagtcagcccaggaccaacttcgcccccaaccctgcatgtgcattctccaagccgacggccctgccgcctcacattcaggagtgttcccatgtcgacgtaggagtcaaactgtgcctggctctgcgtgtacagggcctcatagaagtcggcctccgccgcgtccatggcgtcccgtcggaggacgaccaagctgccccggtggatgggtgggtgagtggggattgaagctgacaggaagctggagggagatgtctgcagcctggtgtgtgttgcgaccccagcgtggcgcacatccgcccccccccccctgggcaccgcctggagccagcagaggaaggccttgccacacaccgccaactcaccgaggaggcagcgccaggacatccgcctgctggaacttggtcctgcgcagcaggatacggggcagcacctgcggcggctcatgatgcatgggtgggcaaacaagtttgcaggggtactcagagggggcccggggagtgagggtgcccgtgccgcgtgggcccaacaatctgaacagcggcggtggccgtccgccttcccaggtgctgctgcccctcatccaccacgcctcacctccgtcttcagcacgagcatggcgtcgcgccctagaccctggtagccgtgccgcttgatggggttggccacatacttgttccaccagcagaagtggtgcagggggccgtgcttgcagctgtggcacgtgcgggaggcgttcttgaaggggtagtccaggtgcttgcactcgcaggcactgtgcacacagtggagagggtgtgtgtgtgtgtgtgtgttaacggtaaagatggagggctgcgactcgcagcggctgcatgaggtgcatccgctgcgagccgcagccccagccggggtcaaatttggtaccgctgaggtaggagacccgacgcggggggtggacgaagcaccgtggatgcgaggcgaacagcggtcgagcgagacaggcatcatgggccatgattgcaggttgacaggattcatctgccccagactccacctcctgtgcacccagccgatccccagccacactctcaggcaacctcacgcaccggcagtagtagtaggagtagggcgagatgcgcaggaagcgcaccagggagtacagctcgcccacgcgattctgaacgtgcacggtggatggttggggggaggcatgggggctcagcacagctctgtaacaacactcaaacagccctctggggatccaaacgcttaccccccgccagtacttgggcctttttgctgatgccagcctccccctgctcccttgcctcacctggaggggtgttcccgagagcgcccatcgatacctggaggtcagcgcaaacacggcgcgtgccgtcgagcagcgccggtccttgatgctgtgggcttcgtcgagcacgatgcgccgccagtggacctgtgggcgcgagggagtgggaaggaggtcgcaaagaccgtggcggggcaggctcttcgcggcgatgggcatggaggcaggtggcagcctgggtcgcgtcccagcccagctgcatgcgccgcccatccaggaccctcagggtttgcacatgcacccggcgccccaccctgacgggaggatggctgctgtgcaggagagaaccaagtgcatgtgctctgacgcccccgccctggtcctcgctccaccgcccagcacacctggtggatgaccgagctcggctcatctgtgtcctcctcatccaggacggcggcggcctggcgcgcgatcatctcgtcggcggccgccgccgcggcggactctggctcgatcctgccgccgaatcccgggccggcacgtaccgcgccatgcggccccccgctcgcaccagccgccagcagtgcacggagctcctcccgcgccacgttcgtcgggtgatcgctgtcagggtctgcatcggcttgtggctcctcccccagcttcttcctcttgccagcttttgttttctgcagggtggaatggtcaagagagatggtcaggacgggtgcaagactgcttcccgaggcgctggtgacgggggctcaaggccgcaagacacgggagggggggtagtaccatgggcgcgcgcatcgcaccccacccacctcctcatcaagacaggctccccacacctgtgcggcgtcatgcttccccgttgccccagcctgtgttttgccgtccttcctccctgttttccctttgggcatcagaggccctgcacaaagggcacgatgggtagagtgggtccggggacagcgagcatggtcgcagcgctcacgaccgcgctggaactcagtgtccagtctctggcctcacagggtcgctgcgatccctcactgcttccctcgctacaaggcctgcatgtacttttgggcagctccccaccttcacacccatgcgcacttgtggggcgggaccgttcctgcttcgcctgggcagcggtcctcttcgcgaacggcccgcaaaagtacttgagatgcagcttcaggcggtcgacggtgaactttttggagcagtagtcgcacgtcaccctctcggccgcaaaagcccgcctttgggaatgagtgggcgagggggggattgaatgcagccctgggtggcgacggcgtcgctgcaattgctcagagattgtgagagacaccgcacgcacccacacccagcatgagcgccgcaggcacgcgcacggcagcgtgccccagcggcccggcaggaccccttcccccgggctgggcacttccatcccaccacccatgctgcctcgggcacccgtcaaagcagcgcccagaaaccccggagcactgcaccctccgcgcccctttcctggaaacactcaggcacccacctgaactcgttctccagggtggagtaggtggtgagcaccacgtccgcccctgccagcacgtgcgggtcggcggtgcgcttgctgccgtggtaggtggcgacgcgcagcgcgcccggtgccacgtggcgctcgatctccgcccgccactggatgacagccaccagcgggcagatgaccagcgtcgcgccggaaggcaccagtcccgaagatgcggccccgtccccgtgccgcaccccgatgtgcgagtcgctgcgcggcgcgatggcagcggcggctgccgacggggtgtcgggcggcgacccgtgcgcgcatgcgccacactcggcgcccgccggcgaggggccgggggaggggtccagcaggccgtcgccgacggcggtggcgggcctcggcggcgaggacccaggcatcggcgccatggcctcgggcgcgacgccccgcaggcgcagcctgggcctcgccgggccggcctgggaggccgcagcctctggaccctccgcacccacgcgcctacactccgccccggtgctcagctcgccgtcccggcggtgcgccaggatgagggagatggcctggatggtcttgcccatgcccatttcgtccgccaggatgccaccgccgatggggcccatctcctgtgagggaggaggggggtgggctggctggcacactcgagccgtacggggattcaacaggcccacaaggtcatggaaatccaggtggccaaagtgacaggagcaggggcagagcatggtatcaggaacaggcaaccaaggaagggtggcatggagtggaaccccgccccggcagaacgccaagcaaccgatggccagggtgcccccagtcttcttcatcccatcacacctggcccaccgcccagctcagaaattccttttggtagggcaggagggggatgaggatctccgcagacggctccatctgctccaaaacctgaatgtcagagagggcgggttcatgctgagtggagggtactctcatgcgcagcacgacaggtgagcatgtgggactcgcaatggtcagggcctggctgcgcctgtacccaggcaggcaggggtgccgcatgctcgctgaggggcacctgccacccccagacccgccaagcatgtgcccagcccatctccagtctggcagatgaacacaaatcagccgccaaccttggcagggacgacgtcctccaggtcactacccgcatcctcatcttcacgcagcggcagcggctcgatctcgtgccagtctgaccgggtgggggccttcttgcggggcgcacgcggcttcttcgccctggttgcggtgggcactccaggctccccctccgcctccaggacctgcgccagggcctggagctctgcctccacgtcggagagcacctccgagtcgctgccatcgccgcccgcgagccctgcgtcgtcggcctcgagccccccttcggcatcgctcacctccgcggctgcacagacggaccacgaaagcatggagagcaggcaaagggaccagaggacgcgctgaaaaaggcggggcgctgcagggtgggtgtcaatcacgtctaaggatccccacttttcgccctcgtcctcctcaccagactcctcgacggacacactggcatcagactctgtggtgagggtgtcggcgctgtagaccgatccagaggcgctctccgacaccgcaaaatcgctgtcgaaggcttgcatggagatggccggcgcacttgggcctgcatggcgggagaccatgaggtggcatgatggtccaaggggggcatgaagcacgtactgggccaaaggtagagggcactgttgcacccaggccagcacattctcttgacaaacctgcggagggaccctgcgagtcggaattgacgcggcgagaacgcctggcagctgtcgcgccccgggccctcatccccatgagcggcctgtaggaacatgggcacggtggcttgctgccccgccacatacgagcagcctgatcagggatgcgggtgacaggcaatacatgccacctcaatatcaacccacctgcactcccagggctggtactgtttgaacaagctctgggcggtcgaagtgcagagcctcccgcctgtggaggtgacgacaaagactgggcaccttgcgcagcgcacggccccccagacttgtgtagagaaacttgattacagtcacacaaatggaatcgtattcagagacttgtgtgcaacagaaagactcgacccatgggcgtgctgtgcacgctgggccgttccaggggctcaaaatcccggaaagtcggaatgcaaacgatcgacggtaagcaccccacaatttctggatgccgccttgtccgtccactgtgaagcgtgcatgcagatcaagcgatttattgtcgcgactgagctcctcctgtccgtcctttggatgctcaaggggctgggaagtagggctcccatgggaatggcctcggtagattacgagatctttggcagggtaggaggggccatcaatccctggggcgtaatgatgcctggataggctcgcagggtgcattcgattgagatggagggtgtgtcatggtcatcagcctggcactcagaaatcggtgcatgagactcaccgcagcactacgatgcatcacaggttcaaggcgttttcttcagggcctgcacccaggagcaggctcgaaacctgggcgtcgtggggtgggtggcgaacacacgccacaacacagtcaagggagtcatccagggcgagtctgaggcattggaggagatgaaggtgcgcaggcgccatgggttccagcgtttcgggaatctgtgttgtgggtctggcaatcgcagagcagcatctccacaagccgttccctgcacctcagctggttatcgttacatttgcacaggaatggctgcgaaaaaaggggagccctcactcaagaattgagagggcagagttcacaaacgaacgcactcttgaggggttggaatttgatgccttcagcacagaacggctttagcactcggtagcagtgcggcatggcgcgggcaaggtcgcaaggggtgctgcgagggaagcctgtgtggcgatcatttgacgatgcaagtgcagtggttgaggggctgaatcgcggggtgctaggaatactcacggaggaggagagggtcacttgtatgtttccaaggcattggaatcattgagcgaagttccaggtcttctgtcttggccgcgagtctgtcagtcctcctgtctcagggcgagaagggtggtgatccacaccgcagagctcttgctatgctttgccttctcgagctgcattggaataggggcactgacgtcctcaaactccagtagcatgtcttgaggcccggagggaggcttggcttcaaccactgtgaaggaaaagggcggagactacgattacatgtcattgtgtctgaagagatcagaatgagctccatgcctgggcttgaggaggtgttggcctctcacccccactcagttctcacccgacttctccgaggcatccagacggaaaggaattggatcgcccaagtccagggacttcgatcttttagttttcgctggggcaccaggcggggagtcatcatctgcggagcggaatggggaggattgatcagcacggacaaaaatcatgcagaagaagctccgccaggtccacctcggaaggtaacaacatccctcgtcgacctcacccctccattctccatgcagggcaatgccatcaggtgtagatggactgattactgtatcactgcggccggaacgcgctgcccatcgctgtcgtctctgcatgatgggactctggaaggtaccacgagaagccatcctctctctctgcagtcttggcggctaaattgatagctgtgagtttgtaatgttgttctgagccttctttgttgctgtcgagtgtccttgctcgcattcatgaacgctcgagaagggcatgtccgagtactgcgacgcgtttttgaaggcgagtatttgaagaaaccacgacgggcacctctggtgactatctaaggacttccctcggtttgtacagggatctgccagtataatatcaagtctttgttcagatgatccatgttgcgaggtgagtcatgtttcgccctctgggtcctttgactctagactcagcacaaaatcccactcctccttcttcacgggctgcaccgacagcctcgattgcttgaagagggccatcccagagaggtcgccatctttgtactgcttgagctcctggaggccaatcacgcggctcaacctgcgtacctatagtgcaggaacgaactggtatctgggaggcatgacagaatgagatcagggatcaacaaccaaacactgagcaggaggccatggggatcaaggggatgagcaagaggcgctcattctaccaatcacccaggcgtcaacaccatcaggactcaccagcttgcagtcgaccatgaaccagcgcggttcctctggtgtgcttcttgggtcatagtacttccctcccacctcccaggcagagtggtcagggtatgcctcacgaaccacctgttgaatttcaacatgaagcaggatgtcatggcacaacctgattgtccttgcctgatcatgcatagggccagtccagcgttacgaggataagcatgccatgggctcacctccatgataccgatcacccccggctccttgcagttggactggtaaaagaatgcctgagcttgcagagtgaaataaaccgtgagcatgtggggcaccctgaaagtgatgggtccaggaaaggataatgtgcttcctgagggaaaatttcgtaatcgagtcctgcccctgggagtgaccctgtctcaccttgtcgcctgcacgcatgccttgcatgatcttcttggccaaatgattacgcacgcctgcaagaacaggggtgtgaagtattgccggctgaggcattcgaggtcgctgcggtggtgcataacaaagctccagatgttgctcctgcataaaatagcactgtcataccgcatcatgccacctgcagcgcatcatctacccaccgtcccagggctcggtctggttctttcgattctccaggtcgctgatagagaaggagtccggctcgctcttcatcaagtaatatgcaccgttgctgggctctgcctttattgccagaggtgaagctgagatcttgccattccccttcgctgtgtgtcctcttcgtgtctcggacttgccattctggacgacctctggcctcttcctcttgggctgagccccggaccgggtcgccgccatgaggaagcaggaggcacgcccaggcctagaccgtaggactgaggatatccacaccgagtggtgtttctttccaagcgatggggtgagaacgtgatcaaactggaattgtctgattcctgccaggctgaggtgaagctggtgatgcgaagctccagtcagggtccccccgtgtcagcgattcgaaaagtacacaggagttgcgcagcgccttccctccgatcaccaagtttccggacttgtcattcatattgctcggaactgcatcgcgattgggagtttgacaggactgcttccgaaacattccgccttggtcgcgcgagaatccaccaagagtgaacaaatgataaggggtccaggaaacaccttttcaaattcagatgtcgtcacaaaaggtactcaacgcccagtcagggtgctggatgcttttaaggttgtcagaattggccagcggcaacttccatactgatgtcaaacttctgatcgatgggctttgtacacagcgtcatcagctttcagcatcgcatggcgattgcgccgcagaggtccggcctgcctcgcatacttctcgcctgcaggatttgcaatgcttgatgctgcagagggtggcatcatccatgcgaggcggcagggctctgcccacgaaacccacatctgtgccgcccagtctctcccctaggacgctcttgagcaggtgcagccgccgcagagtcagtttctgttgacgatacagggtttgctggcgtgcaagccatgtggcggcaccctcccagaacagcccctcgtcccctcctggtgccgtcccactttctgcagcttcctgtgccacctacacgaattgtgaaaaggcaatgagttccagattaggcatttccctatggttgaccccctctgctgtggtcgactacactgtgtatccctggccaccttggaggctcttgcggcgtggaagcaggagtgccactgtgcgtccagcaaggggacatcccactcaaaacctagctcgtccagggcagcacggagttctgctggcacccagccgccacgattggccttgcggacgagacgcacccagtcggccaactccacagcatcgtgagcctgcacgcagacattccaggcaggcgtttgatgtgctgtcacggtgctgcagacactgcctagcctttaaagtggggacccgcaatcccaagcacagcactcacgttcctggggacgatgcatgtagaatagacggcatgccactcgcgcagctgatccagcatggtctgcgtggtctgcgcacttatcgcacggtccagccagcggggaggcttggcaagcttaggttccatacacgcagcgtccgtctcgcggggacggcatgctggccgcagcgatcttcgatactcatgaacagcaaagaggcatcgtgtggcccgcgcccgggctgggtggaaggcgcagggatggcaaacgttggcgttcagcagggctgacccgtgcaccgtgccccaggcttcgatcatgtccgggtcaggaacggtaagtgatgtactatgagtttggatggttcactctagaggattacatcatgctccatcaagaccatccacggcgcgtcggcaatgtgaactccggcctcgacatgcacatgcgcatgggggtcgggctggcccggtccggcctctgcctggcgactcctccgccaccctgcccagcacccgggcaggcaccgaatcgaccttacacacccatgccatcgcttgcgaccaggcaaaagattcatcatgccggtagcatgcacaccccttgcccatttagaggaggttctgggcgcgcagctccctcgcaaactcatcgcacagcgcctcgttggtcgccaagccccgcagcagcgcctgcaccgccgccctgtcggccaccgacacgtcccgtccccgcctgcattgcatgaggcgctcggtttgtgagatgtaaagctgcatcagcgggccagcgggcacaggcaggggcggtctgtgagccctcacccgggacccgtcttttaccccacccacctgggctggtcctcgacgcgggaggccagagaagggggccaggcgatggtggggctggggtcggccgccccggccgccaggggcgcgccgcgcaggagcagcgccggagtgagcagcggctccgtgggcgtggggccagccccccagccctgcgccggccgtgggggaccgagcttgggctcggggctgggcagcgtggcgggctcccgcgggggcgggggcgggggg

SEQ ID NO: 18667 - DNA, 24621 bp, Chlorella protothecoides
  modified_base (4663)..(4704): a, c, t, g, unknown or other
tggcagtgccggaggcggtggcggaggcggtggcggtggcggtggcctgttgaggaggggtgggagggatatttggtgagcggaagggtaagctggatccgagcgatatgggcagtgacccccatgtgtgaccgcatgcaccatcaggggttccatcctatactcccaggtcccacatgctgaggatctcacctgggcaacgccgccgaggaggcaggcgggggtgctggcggaggcagtggcctgggcgagggcggtggcaaaggccacgcccttgccagaggcctgggcggaggcggcggcggtggcgacggcctgggtggcagcggtgcagccggcgggggtggcagcggcggaggccagggcctgagcggtggcggtggcgaggccggcattgccggaggtgaaggcggtggcgatggcctgggcggtggcggtggcggtgggtgcggagaggatggaggaggccaggccctgggtccacgcctgggcggaagcctgagcagaggcggaggcggagccggagccggaggcgatggcctgggcggcggcgttggcagcggcctggccgctgccgctggagatcgcctgagctacggcctgggcagaggcctgtccgttgcctgtggtacgaaaggtgatggctcagggtgaggcatgaatgatacatggcgcagttgggcctgcagaccgtcactccccctcctcctctgatgccggaggcgtctcggatcccgaaggtggcaggggtacaactctcctccaaaccttctcaccactggcggtggcctgagctgcggcattggcgaatgcagcgccatttccgctggcaatcgcctgtgcgacggcatttgcactggcctgggccaacttgcggcctgcgggtgtcggtgagagaatgggatgtgccgccgggaatgacgcgtttcgcaatgggagacatgcagcacatgctacgccgcacatgcaattcaaaatgatgcatccgtacattataaagcatcacaatgcccatcgccagtctgaacgcaccagggacgcccttgagctcgcgagccggcacggtcgcggccgtgctgaggaggaccaggaagacaaaggccttgaagttcatggcgatcaggtgtcgaggaggatgaggaagttttattgctttatttgttattgtagatggtgaatgatgatggttgatggttctggaggttggaacggttctcttttatgtatctcagtccacgcggtggggccgtggcgagattgccgcgtttggacgcgtggcatccggtcagggtccaccatagatggacatggcaccttcatgtaggtgcccgggccgcatggcgcggggacagtgcttcatctcatgccagaactaacacggaacacgtccagcacgggaatgccatgcaccatggaggcctgttggcctcccatgacgccacactactgctgtcggtctgacctcattccgcccgatcgcgcctgggctgtctcgacatctccgtgctctcggagaattcctctgagaggggtgccttcgtgctctcaaactgcatccaagcatcgtgaatgtgtgctccggtaaactgtaggcccccttacgagactctgccgtctcttagtcgctcttgagcacggttgttgaggtcccgatcgccaggaacccatggggaccgtctcccgatatgtctagtactcctctttggcaacccttgaaagcaattagaaaaacattgtcgctcgtatgctgttcgaggaggcttgaacagctccccctgggggagcgcataaggaccgttccgtaggctgtgtcaatttcgaccaaagaacccggccccacccaaggggcgtacactttgtccaggaaataagactaattctaatttagaaaaagttgtacttgacaaaggcgcatgcaacgttgtagtcctgcgcatcctccctggtgcccatcctaaactcgcggcgccctttgagacaatcatcctaacgagcccactcacgtctgtgaaattcctcaaccacgccgcggcagaagcgatcacggcaacacacagctcgcgtatctctcgtagggtggcgcaatcaggctgttgcaaagtttggtggtgaccgggtcacgatttggaagaaggcacgcttgcattctgtcgcatggcgagacacccccgcgaggcaccccggtgaggcgccccgcggcccttctggcgccgctctgaacagctctgaagggctctttaaggagcacttccgccaatgaaatagcatgattatatgcttgagccgtgcaaaacgagcccgttttgcgcaatatgccccatgtcagccgaactaatcatgacgggagactccggctgctgctcatggagagcttgacatggggccacactcttggcactagaatcggacagtgacaagcacgctggagctcaggaggctcatgattggcatgccgcatcacgcacaaaccttctgttgacaaggcttttgaaatgcataccatgccgcatgcctgcccagtggaatctcctcctcacgccgacgccgagcaccccgcaaccctcaagcgcatgtcgctgaggatctgcagggttctaatcttgtctctggtagattctgctcaatgaatagcagcagtagcgtgcagaagtggttgacgttcatcaccactctatggacggactggtttgtatctcatatatgccagcccacatgtccagcgagacaccagcttcacaccagcttcagccactgtcttccacgcagctcaagcctttttctgagcccccgcagcgcccttctctttgaggaaggccgcaagccgcgtggagctgacgagtgcggccgcgcctagcgcgatccgcagcaccgtgcttatgccctgcgccaggcgtggatcagtcgcgtgagtgggcacgaggagttgtatgtgccagctgtcagggaggagagtcagggtgagattgtgcagaggggctggcagaggggcctcctggacgctcccaagcttcacctgagtgaccttgattgccgtggccgcctggagaccgggcagccggagggcagcgttccctggcccaaacacggatttgccactggcagccgcgctgtacacgtcccagatgcacaggaggaggaggaaagcggacaggtatcgcgctgctcgcagccctgcgagcctctccctgctccccagcgacaggaaggtggctgccccggccgagagagcgatggacgcgatggcagcaccgaacagcacaccacctggaagcgaggattgtgtcgtgagcttgcccatggagtattacaacaatggatttgttaacttctgcccgtaccagacttgctgttatcaggcactctccttaggttcagactagccaagcccctgatcagaacctatcctggtcccccttccttagcatgttggaatacctgacgagaactgctcggctgcaaaggcaaaggcaagaagtgtttgggcggtcacggctcctcgcagcgttttcctcagcaccgccagcttcttgtatcctgcgaccaggggtgcatgaggcgggctagtatgcgagcaaatgcttctgggccgcgaataggccaaagaaggcgcgcttactattctctatgaccatgcgaaagccatgatcgctcccgtccgtgcctccagcttgtgccgctgcaaagcgttgcatcgcggttgtgtgagaccctgtcaagccgtagcgatgccggactctgcgatgcttatcgagcagctgctgggcataagaccgagcatctgcgcaatacaacgcgagacatagcccaatgggttccctgtcggccccgagcaaagacagctccctgcaacaacgaaagcttgccgacgtggcagataagggcccactccaacccgttcgcagtctcaagagtggatcggatgcaaggtctttgtcgataatccaatcaagtttgagccctatattcaccaataatgcaggcctcggtgtgcgattcgcgcatggcgacgagggcgcaggtgccagctggccagagtgggtggcgatgctcccatggagccttcacgaccaaaagaccttcactgacacacgggcacatgcgccaaccagcctcgagaccctctgtgcaggtgggtgtccgcaggagataatggggcgcccccccccgatggcctcggctgttcccagcacttttgccacccatccctgcccccaggtggccacatctcgtggctttggcagcgcgcccaccatccgggccccaggaaaggcgcccagcaagtcccggcgcgcaaagaaggaggactccatgcaggtatcgatgagagggagggtcggcgcagggcatggtggtgaaggtggggtgctggctggagctcagcccgggcccacccctcctcctactgatatgatcatgccggtaaccaccctcgacgccggctctgcccatcttgagccatgacgtgcgtcttcactggcccatgcagctcaagtacacgcacaaggatctgccagacggccggaggcagctggaaatcatggtgccaaggcggcatgggcagctgtgctatgaggacaccatggcggagttcaggcagaaactgaaggttgaggggcacgccatcggcaaggtgcggggggggggggggggggggggggagggnnnnnnnnnnnnnnnnnnnnnnnnnnnnnnnnnnnnnnnnnngctgtgcgtttgcacagtgattggagtaggacgccccgacatgccacccagtggcatcacgaggatattgataggtgagcacgctcacaatgttctctggctcgaccttccccgcctctatatttgcgcttccaggctcccgactcagcgatcatcgagcagctggggggcgaagacgcggtgcagagcatggtgttgaatcagacggtgtcctgcgccatcgcagaggtgatggtggtaggggtggggagcggggcggcaatgggggcggggcatggcagcagtctgtggacgcacctggatggccagccgaactgcaactgggagcgcatcagatggagtggatgcctgctttccagcacacgtcctggactcgccaacctctctgcctccccaccgccaggccgccgagaagttcatgcctgacaggcatgcctggcagtttgaccctggatcggagctgctgggggtggactacaccgagtccggggacatgctggtcaacgtctccttcgagcctgcgcccaagccagtctggaccgtcccataccgggatctacaggtgcgactatggggtcagaggatgtttgaagggcgctttgtgactgcaagccactgcacaatcctgttggagatacatcaccagagctggtccgcctgcatttgcatccgtgcgtgcccctggaccctgcccccgccccctctctgtcacgagaatgccttgtcctcccggcaacacaggtcaaggtgcaaaaggtcaaacctgggccggaggcggtgcaggagcgtctggagagtctggccaaggagagggccatgcttggcattgtgatcggcaggggcctgcaggtgagaggtagagagaaggaatcgataaattggtgttacgaatgtcaggctggtgctagaaggagcatcccatccaagcacggaaaaaaagggcgcttggcttctgctttgtggaaatccagcttcgcatgcctactcctggacaccccctctcacacccttgtccctatttccttgcttgcagcgcggggacagcgccgtgatgtccctggccgccacgtttgaggacgatgaggcccccaccccgcccgactcggtctggagcgacctgcggctggagacgggcaacgaagcctttgacgcctactttcctggtgggcaggagtctgcatgagcaggatgatggtctggcctggaggaggtcctgcaaggaagggtgcgggtgcctccggcatgtgtcgctgcatgccgccgggaatgagctgaatgcctcactcacaccgctgaccctgattgctcatccggtcctccccctatgggccgccctgccctgaccaatagggctcatccaggctgttgagggcatgaagacgggggagcagcagacgtgcaccctcaccctccccaccagcacggacttcttccctgtggagtggcgggggaggaccgcctccctccagctgcacctcaaggagctctttgagcggcgacacgtcgaggtggggggtgacagggatccccagcagttgctggctccaggagggagggaaggcagggaccagcggcctatgctgagctggtattgaggtgcatgttccctttcctcaagcacggggggggtgggcaagggcacagggtgtcccacagcgccagactgtactcgtgtcaggctccgcctgcagatcccaaagggagcccttcttttggatgttgacaaactcccctcccgtcttccaaccctcacagctggacgacgcctgggcggccagcttggcgcccgggcaacccatggatctgaagacgctgcgctcctacctcagccaggcggtggagggggaggcagagctggccacacaccgtctggagctggagtcggtgaagaaagcgggtgagtggcggtgctggaggggcagtggctggagggcggcgcaggcttgctgtgcctggaacggccctggtagcccaagaggggccaaagatgggccaggttcatatcgtccgccggtacacaggcgatgtacggccattgccttctcccccctacatcaacccccctcacccaccctgccagtggcggcaaacatggagtgcggctgcccggagtacctggtgaggggcgtggccatgcgtctgctgcagtgccgtctgcgcgacctgcacgacgcgggcgtgctcagcgccgcccaggtgtcggccctcagctcccaggacaacgtgcggggaggaaaaggggggtacctcaggggctgatgccggtgctccgctcgctgacgacgggagcacggggtgcaggcatactggatgtgggaaagtctgcctgcaacaggctgcctgtctccaatgaagcgcggagggtctggtctctggcgagcatgttccaactgtactgctgggagcacccctgcacgcctcaactatggttcaacaacacccaaaataaacccctcatgtccctccctttcccaggctacggactttgccaagaataaccgggccgaggtggaggaggcgctgaggtctcaggtcggactggagcacatagcagagagcgaggagctgctgccgtctgagaaagacgtccaggtagagtggcgacgcaaagtgactgctgctacgaggtggcagatgcttgcgcttgcatgggcgggaggggggcaccgtcctcgggagaattgtgacttggggcgggcaggcctgtgacgaatcctcatcaccgcatcctcctcgctttcttccccctcaggcgcggtacgagcgggtggctggtgagctgggcgagcagagccagccgctgcaggaccccaatgtcagggagcacatcacagagttcctcatcgtacgtttgttacagcggggggcttgccatgaatccattttctacctggagttacagcaatgagttggaaggggaggacaatgtcatggcacaggtgcaatgcagatgacgatgcatgtacagactaggatccaccgtccagtccctgcagcatcccctgcagtttattcgcccagataatggcctgtgaccccctcccctgcccgtgcagactgacaatgtgctggagtggatgaaggagcggggcatcctgaccgtcgagtgaacctgccatgaccgcaccctgcctgatgttgggcgtctggtgcagtctgcataacaaattgccagcgcacatgacgcttggtcggctgagcaggagcccagtcaggcgtgcaggggctgtaaaggacagacacaggcaagatggactcctcacataaacgcaaggaggaaagcgtgtcccagcccctttccccgcagcctcgctcagcctcaggcctgctgcgcggccttgtgctgccgcagcgactcgctcgtgatcacgggggctgaggacgtgtactcctttgtccccggcacgggcatcagcttgcccaccagtcgccaccggttggtctcctgcttcttgaaggggtgctccagcacccacagctcctccacgtccacggggtcaggcccgcccgccacgaccgcgccggactttgagaaagcgcggaaccgctgcttggtgttgaagcgtatcgtgaactggacgaaaccggtgtttgggtcctgcgaggatcgggggtggggtgtcgggatgctagaatgttaggggaagtattgtgtgtttttttggggggggggggtggcctgtattgcctgacattcacacctcgccagctcctaggtgtcaatcagagcaagcgagggcctgcgacccgcttgagagccccttggtcccctcgtccagtgcagtgcattgcaagaatgggccaccttccatacccaaaccgaaactacataccttggggtctcccatagctgcacgcccctgtaccaccgacaggttctccgctgtcggccggttgacgagtgcccactccacgcgagtccagcccgcatcctccctggccttgatctgccgcttgaaggtcgtgttcacgttgggcgccgtcagctgcagaggtgggtgatgaagttgaagcaggtgtggcatcatgcatttgcttgaggaggatggtcgccgcacagggtcaccagcctggttgttgactcgggacagagcagcacccaggcacccagaccccaagcatgcagcccgggtcgggccagggactcacagcaatgagcgctcgtcggtcacccgcagccacatgcgtgttgatctcctcgtacagcctcagcgcctcctgcttgaagagcggcatcttgaagggcttcgcgtacttgtgggccatggccagcgcatacacgttctgcgccgagcccttggctcgtcgccacaggtacttcagacccttgggtgtcagcatggtggcggcgctgaggccactgggcaccccctgcgcgagggaagggtgtgtgctgacggggggcgggtatgggctggtgcatccctgcgcagaaacgaccatgctggcatggtagatcttaagcaatcgcagccctcatgaactcatccaggtaatagatacccacagcgaccacgcgctgggtcacctggtacggatcgaagacgtgatcagaggtgaccacggagggcctgaacccagcggggcgaccaagcgtctggctggcagcaaaggcgcccttgggaaatttgtttgccaggtattcctggccagcgtacccgcgggtgggttggtaggagccagacggacatgtggcgtgctgggcaagcctcaggagggaggtgaaagctgcgggtgcagagcagggtggcgcaccctgcacatattggagtggaggggagttggggggagtattgcgcgagaattgcagtattagtacatggaatgttcctggataacatcgcatacctgcagcgtatgtgtggcatggctgcaagcacgcagcgcgaggcgcggcagtgctgccattcctgtgtatcgcgccgagccgctcggggaatggacaccagtcaggggtaatctcaacacattctcgcttggctatgcatcgggttcgtcatcccgcctccccatcggagagaggattcaggaatggggtgtggtgcggatgctttcctgcctcgagggcgcgagaagggctcgtgacgaccaggagcttggatcacttccttcagggtgcacttctgctggacagggtaaaacgccccatgcactttactcaggccgacgttgatgtctatgccgcgttcttggaaggggaccagcatgtgcttggcggtgtcgaccgcgtctgcgtccttctcgtgtccgacagtgcgttgacagggaggagtcgcctatcccacagcccccacacatgcctgctcttcgcgtgtttgggcgtcgttggctcattgcaagcgacgacatcccgattcccgccggtttcctagccattttccgatttgtgagtaccatagcgttagtatggcatggtgtgtcggaggcacgactgccagcatgcctgtttgtagctggtcccaactctgtaagcgctgcctcccccacgcatagatctggtgtggactgctggtgggctggctgatcagcatccatggcccgaaggagtgcaccggcgcatggcagtacaatgtggcggcggggggcctgttgggcttcttccttgcctcctttgccctggagactgcaatgaccatcatcggtctccgcggttcgatctttgagaccagcaagcggaggaggctgcccctgctcatctacctcgacatcgtggccgtgacagggcagatcgccttcaacggtgagcagcaggagttcgagagggtcagtgcgaggtcagggtgtctgccagtcgagatgattggagatcgcgatgcagtgatctgcatgtatcctcctcggcggctcacctcatcccagtctcccgagcgctgcagcctactgcacgaggctgctgtacacggagccaccccagtgtgaggtggagccgggggagctctggcaacccgcccaggtcctcaaggtaggtgggtgatgggccggccgctcaggcgcagattggtctgcctgagtgtgttggtgggggtttctggctgctcgaggctagacgagtgccggccactgccaaccatggcacttggcgcccctcgctgcgcttcctgggtcagatccgaccttcacctttgccccacccgaccatgccaagctcctcccctgcgcagggcctggtgtggtcgacgtgggcggtgctggcgggctccctgctgctgctggccctgacctacaacctttaccccgactacaaggccgtggagtcctgggagaggcgctggtccgccatggcccactgctgcttctgctgcatcagcaaccacgagaaagggcggcgcgaggacctcgccgcccggctggggcgcatctttgcgctggtggggcggtggccgagggagggttgggtcctgacgtgagggacatggcgcaggggatcttgctccctcccacgtcggtattccttgatcaccgggccactccacactccacaaccccaggcaaccccatttctccccacctgacgcagatgtttgggcacatcgacatgaccgcctcagacatcgtggtctcctttgcgcttgccatgaccctgcagaagctcaggcggcggggcggttcccgggccgcccgggcagggtcgctgcagatgaccacggctgcattgcctggcgcagatccctaccgagccccaagcccctcgtcgtcgggggcgggggcgccgctgatggatggaacacggacgggggagggggggaatggaccccggtttcaaggggccagcgcgggtcccactggggtcggaggggggagccctggctctggtgccggcccctcgccctggtccgactcggaaggtgattggggggtggggtgtggatgactcgggcacgactcgtcgccaccaactgaagcggtcttggatgtgtgcagcaggggtcagattgactttgctctgaagcagtgcccacttgcagaggagctggtcctgtgtcatggcctgtgcagaccctgccaggcagcagaggatccatgcatcattcattgcgacttcatgcaggcagcgacgacgaggggctggctgctgcagatgaggaggccggtctgcaggggcagcgttcgcgcgtcgatgcggagacgctgcaggaggcctcccactacatgtcctatgcctttgctgcatacggctacctcctctacctgtggggcaagccagcgtgagtggggtggggcagaggagggcttgcatctggtgtggaccgacgctgaaatgtccacaggatgacgagggagctcgctgagctctgcatcctgggagccttcctccagctgtggcaggcgggttgaacagtgcatcagctgatagggattccctgcaatatctgccccttgccttccagaacgggcgtgctggagctgtgctgcgggcggagctgtgggctggcgatgaacatgctgcggccgtcgaggggggtcctgccagacctgcgcgtgatcaccaacctcaaccgcgaggcgacgctgcaggtctggagcggggatgtggaccaaggggggtgttgggtgcagctctctgggttgggtgatgtagatatagcgaatggagggagggcggactctgtgggggtaccgatgcactgcttgactggcttcaacgagctatgcagatgagtcggcctggatgaacacgccgaggcatcttcaccgtgcctgaatgtgcatcctcccacactcagcacaacattacgcgaagcaccatgaatcccctcttcatacaggccgccggcctctcgacggaggacctgctcttcgtgaggtatgaggcagagaagcccaatgtcctgccctacttcctggccctggaccacgcaacgcagacggtggtgctggccatccgcggctcgctgagcctggacgacgtggtgcgtgacctgctcatcgagcccgcctctctggacagctggatatcgtcgggcaaggagtggcacggggtgatccccgagatcgccatggccggtggggcaatgctttggggtttgtgttttaagtttgggtgattttgagggttggaccaactgaggcagtcgaccaggtagaggccatggcaagtgctgcctgtcccggtacacacctgggccggaccactgatgctgcgggtctttggccccgttctggagccctgccgcgttggacgaatggccactcgattccttgcccccccaccggtccccgtcgccgccacagaaagaaacaccgaggcctcggggcatgccggcatcctggaggccgctcgggcaacactcatggatctgcaggtttgccgacggggaccgagtggtgccctgtctgggaagtgtcctgctgctaggcttacgttgcctggcggcggtctctgcggggtctggtcatcgacaggcctgcccggttcagtctcccatgctgggcgcctgacagccagacagaccataccttctcgcttgccctcctttcccaggaatctgggtacctgtggagcacgctgctgggcccggaggctacgcaccggggctggcagctggtggtgacggggcactcgctgggcgccggctgcgccttcctggtcggcctctacctgagccagtccatctgcccggggctcaagtgaggcgccaaagaggggggccccaggagaggggacttgtccacggcaaggaggggactgggcggtgagctcttcagcctgcccaggaatgtcacacgcatcgctgtgcaatgcgcctgttttcccccgctgggcccctcccagtctatcatcccctctgctctcacctccacacgcccattcccgcgtggaagtaaccctccacccccaacacgccaccgcaggtgctgggccttctcgccccccgggggtttggccagcgcctcggtgggagccagcgccaaggcctggtgcaccaccgtggtgtgcggcaaggagtggatcccgcgcctcaccgcccagagcttcgaccgtctgagggatgagatggtgctggccgcgctgcgctgccgcctgcccaagctggcctttggctggggcgtgctccgccggcgagcctggaccgaggccgacctggtgctaccagaggtgccgccgcacgcgcggcccgtgctgaacgagtaccgcaagagcctggcgcggcggggggagctggaggacagcttctacgaccacgcctccagctttgcggcgccgggtgtgtatgtctgtgtgtgtggacgggggacctcgagggaatgaggaagggagctgagcctgttcccgcttgccattgccttgcggtggctagtgagagatcagggcctcagtgtggaccctccaaacctgcaaagctcagcaatatggccctcacatccgttgatagacgccccctcaaaaccatacccccaggccgggtgatgtggctgcagtcggtggggtcggcgccgcgcaagggctggcgccccggacgctcccacgagtaccgcgcggtgtggatcgatgccgaggatctcagcagcgagggcatcatcctctcgggccgcatgatggcaggtgcggagggaagaaagtaggaccgcgctgatctcccacgcaccccacgagatgtgtggatgaggtgtccgctggggggctggcggtgcgcaagcctctcatgactcggcctgctcgccttcgtgcatgcccacaccaagatgacgccttcgtttccctctctctcatgcccagatcacatgccagaccacctgctggccctgctgcgcaagatggcgcggcgcctgcagcacagccactctactgccgctgtggacgaccgggctggcgagagcgtgctgccgcatgcgggcgggagccacgacagggagcgtggggggtaacgcgacttggcagaaggaaaccccaggctatctgtctcggacggatgtatacctggagctgcgcatgcattgccgccacatcgtctgctttgctcatgatgacaaagcggcccatgagtggaccctttcatgatgtatctgacactcccacttacccctttccctgatgttctacacccttgaagcccttggcagcgctgataccgactgatgtaatatgaatttgcctgatggtctgcgtcaggccgtccggcttccatgcagaacctcgcccaatataggatcacactacaccaggaaacgactgtatgcatcaagctgtaggcccctctccagccacaatgggcatacagggtgtgctccggtcgaccggcacccggggctcctgggaatcgaggctgtgatgaccaccttggccatcggcccccacgtcgcgccagctcaggaccctgccctgcatctcagatgccagcgaggtgcacaggagcgcaaaagccaggctgtcctgctccactctgacccctctgcacagtctctgcagcatcgacacccaggctttcaggtctctctccatggagtcactgtgaggcatgcgagcatgagggtgagggtttgactcgagcatctatctgcacaagtcctggcatccttgaccaacacccatgcagcccaatcttccatctgtaccgcccgagctccagcgccaggctcaccagcgctcacagaaccgagcgattgcccgctcatgccggcgacgcatgtctgtcagcctcgcacctagcgcgttcctcgtcagcaggagggcctgcacctgggtccgcctctcagcgatttcagcacgcagcacacgcagtgcagcccccgtgccagcaccaccggggcctagatccaagcgagaggccgccgcttggagctcatgcaggcgtgcctctgccttgtctgtgaagagcttggctgcatcgtggcgcttggcggctctggtcaggacctccgcccgtgaggccaccgccgcctcctcctcctgggagtcgtggtgtggttgagggggaaatgtgggacgtcaggacaaggcagcaaagtgaggattgaagaggacagcaggtggaactggctggggcttggtggatgcgggaagaggaggcagatggtgggccggccaggggttgaatcaaagtgttgaactagccgaaggcaggccttatctgagacatgcatggcccagaccagcactgaaggctggcgtcccccgcggtgcctcccttatccccacctgaaccagcttccgtcgcctgacagccaccctgccgatctcctgctccaagaggacgcgagcagtggcgtgccgccgctcccccgcctctgcggcccttgccagagccagctcgcgctcggcgacgatggccgccatgcaggcctcacgctccacgcactgtgccaccgcagctgcgctgcggacgtcctgctgcgccaggccgtaggccagggccgcctcccgtgcgctgcgaggggatggggccagagcggtggtggtgatgcacggaggggatcctgatcgtccgaggcctcctctcatggaatccagatctcagctcgtcaggtttcgcttgtggagtggcgtcgtcctgtgttcaatcaatcccgccggccccgggagcactccctccatcctcctctgcccgacacgcctcaactcttcatcccacacctggcatggtgcgcagcagcgtgggagacggcggccatggcgtggcgagcccactgacccagtcggctctcctgggccgctgcttggtcttgcaggcaccgctcatgccgctgcctggcagactcgacctccagccggcactcctgaatggcagcactcatcccctgggagctgggagaagtgtgggctggactcagccggcgtggctctcttgccggtggtgatgaagcccttacggtgcaatgcactgggctgcaggaccggctgaccccaaccctctgcggatctgcgcctacctcaaaggccttgaggcgcagggctgtccgttcaccataccaccccagcattggaccgacgtgggacttgaggcgttcctcccggagctttgtcaggcggcctcgcccggtgtgctcgacctggggagccagctctgcaatcaaggacttctgacgagccagctggacagcaaggcggaagcgggtgccctcctctcgagcatccacctcctctggattgtccttctgttccattgcctccacccctcgtggctcctctgaccctccgccttgttcggcgtggctggtctttgctgacatgtcagtattatggcctgctgccacaactcagacgatgctgcatactgccgttcttcaagcgttgtcgtccctcatcgggaatatctggttgcattgtactgagtgatgatcatggctggctgcagtgcccacggcctgcacaccccgctgagcttgggcaccgccccggcagtcgaatgctaggtgcaattacttccagatggtttggggcgtagcaccacatactcctgaccgggcagtggagtttcgcgatgaaggatcacagtcgcgcgaatgcatcgcttatagtaccacttcagatcggcgaatagggacaggtcaaccactcccaaacgcgcgggaaggcgaacattaccaggtagaaagaatagaccccggccgcaaggcgactgaggtgcagggggtgtgagacgctggcagggcccctggcccacccctttcaagcttgagtgtccaccattcaggctcgacaatatggcggaggttgtcgaggagcgccgttccggccccaagtccgtgaaggatgtgcccgccgacgagttcatcaaggccttctccgcttacctgaagaagaccggcaaggtgggcgttgctagaaggctggatatgctcggcgattgactggggcctatcggcttagccgcagcgggctcctggcggtggccggggagtgctgtcgagccacctcccggagaccacatgcacgcactctggcgacgaagtctcgaatgccgagccatcgggatatgcatacccttgtgttgattctggaatgcctccccctcgcccctgcagatccagctgcccgccagcgttgacatcatgaagaccggatccttcaaggagctggccccctacgatgccgactggtactacgtccgcgcaggtgcgccaagccgttggatgcaatggctgcagggcctcggatggagtatggaggcctcccagaggctgcctgctgtggagtctgtctttctgctcgagcgatgttgggcactgggcggtgggcgctgggcgtgtgctaaatatctcattgctgttggaccgacgaggctcccccgagatcatcacttaactcaaagcctgttctcatccctaaccatgcagctgccatcgctcgccgcgtgtacatcaggcagggtctgggcgtgggtgccttccgcaggatctttggcggccgatccaacgccaagggcagcgtcgcccccggtatgtggagggtggaacgaggctggcgcgacggcagtcgctcctagttgttgtgcatgccgctgccgaggcgtttcatggggaaattatagcttggcagtgcccatgatggtgtgcatgttctcgctgacccctcccccccttcccaccaccacaaccctgcctgctgatcactggcccctccccacgattcacaccacagagcactttgccaaggccgccggcggcgtggttcgccacgcgctgcagcagctggaggccctgggcctggtagagaagaccaacaccgagaagggcggtcgcaagatcacgcccgagggccagcgacagatggacctggtggcggcctccgtcaagctcaccccctttgcgctgctgctggagtgaagcgcgcgccgcgtgccaggctgtttggggcagcggtgtaacaacccatgtgcttgcttcggacagagggggggggaaggggtgcggcaagggagggactggaggactcgaggcgtgcagggggcgcgggcggttgcccacaggtatgcaaggcacgcacacaaccaggcatgtcgcccctgggcgcatgggaggtcatctcggcagcagacagggcagccggcctgctgcagtctctggcggcaccactgctcccaagtgtggcaacgcaggtgggcgcggggatgcccgtgagaaggctgctgctgcttgccatggggcaaggggggtccaagcaccgccgcacaccctgcgcggcgtcaatcctgcaggaggatggccaggagggtggtcccctccaccgacacccgggcctcggagattcgtcccaggtgtcgcagaacagtgaggatggccttcccgctcttgtccagcttcagggcgttgcctgtcttcaggtcggactccaggacccagcgctggccacgcaggggctccttgatctgccgccgcgggtgtgagacacgagggatgtggtggtcagctagcagcgcagagggccacgagtccacagagcacctcatgcagtcgcagcaccccatgccaggcgaccagcagacatccccatgccctcatcgagggtgcggtcagccccctcggcgaccccggcagggccaccccctccttccctcaccgcgacagagtaggccagccacatgccgtgcctcttgtccgcgcccgccacccgcccccgcctcgcggccaggaccagcgcggcattgcgcgccgcgtgcgccgccagctcgtccagcgactggttcacgcggtccgccgtcaggcggccgcgcatgtaggacgacagcgactccagttcggcgctgctgatgtacctgcgatgtgcatgggtggagtgtgggagtggggcctggcacatgaggggccgccagctcgccgacccccgatgcgatccatgatatcaagggcgcatgcctgaggcgcccaagaccacctccgcgcccacgtgccaggcgatcggcaggctgtccctctcttcccagcgtgttcacctcggaacggcgttgggctcggcgcagttctcctggccaggggcgcgggggcgacgggcgggctcggcgttggccgtgtcaccccgaccgccgtgcaccgggggggtgggcgggagggaggggaggaaggtgggcaggcaggcctcgacatgctccagctgccgttgctgcagggtagccgcccggatcacggcctgggcggcggggagggcggcccggtccctggccagctgctcccttacaccccgcaccctgccctccagctcccgcactcgggactccagggccaccagatcatccttgtacagggcggcactggcatctgggcgggggggaattgaaagagacatatatgagtgtgttcaataaaaactccatgacgatcacacacgcagtgtcccgtcgtgagcaaggtaacgcaccatcggcgcgcagaagcgtggcttgctggagctccgatatctgggccgagaaggccagcaccacctgctcgaggacacccgtggccatgctaaggagccctgtgtgacttatggtaccaaagttcacaatagcgtgcaccgaattatcccggcatctgattgcctgcgactctgtgcgaatgcgtgagtttgaacggactagagagggcgcgaagacttgtgcagattgtttggggcggcaggcactgagttgtgcctccctcaaactccctttgcacaacctgtgcatctcgatgccccactcgaacatgccttggtcgaaccttggttgtgacaagcgcttgcatgggacaggcgatgggctgcagggcgtcctacagtcaggaatatcattctggagtgtctgattcatcatttccccatgtgcgaccccgacggccagtctttgagttcatttctcctcctctgtaaggcctccaggattgccaggtcttccccctggaatcattggcacccactcacaggtccagcttgagcagggccgcgccgctggacggcttggaggcgaagatgttgtccgacagggtctcctcggtcaggcggccctcggcgatcagcgggcgcacgtactcctccgtcagctgcaccggcaggcgaggtgcggctgtcagcaggtgcttcagcaggcggcgagatgatggcgagcagcaccgacgaggaatcggtaccccgcactgcgcgcatcaggccagctgcagctccatccgcagccgccgcctgccagcccttctccccggacccccccaaacacaacccttccacatcccctgcagcccctccatcgccagccaaatacctccccctgcatcttaccaccctcaggaaggcatccacatcctcgtccttcaccagggacacggtgcacccgccccacccggcccccgtcaggcgcgagcctatggcgccgttggccttggccagcgccactacctggtccagctccttgcatgagcactcgtacagatccctgtcgcacgcatcgtagatggagggtggagaggctgagtgtgttgcggggccgcgtcgagcaggggggtcttccagtgaaggagtgccaacctcgtcatcatcaaaacaccacaactcccctgcaagtggcatgtcctcgcttgtgtcatttcccaggagagccaccacacacccatgaaagccccaacccccattcaggctgccatttgttgctccgtgcctcaccctcagcccctctcccccctcctaacctctggaccccggcccctccctccctccaaaacctctccacaccaacctgcagctggcctggctgtcgtccatgagcttgcccagggccgcgatcttctcgtcggcgctgccatggcccaggcagacgtcgcggaaagcgggaacgcgagccgcctcgctgtacacgtgcgcggcgcggtcgtgcagcttgaagtcccggaaggcggccaggaccagggctgcggaggcgtcgccctcgaacagggaggccagcggcgcgcccaggatctcctccacctccgccgcgctgtatgtgcctgttggcggcgtgtatggaaaggggagaagtctgctcaaaccccgaacctgggcatgctgagcgacagctgggctgcctgcccgcgaaccgcgcctggagacccacacatggcgccctgcggcccagctggcgcgactcaggcctctcagccccacaccccaagcatccgccctgaggaagcaccccccacccacccctccgagaacccaccggggtgcagcagctcgtgcacggcggccaggggcgccccggcggtggagcccttgggccccgagtaccgcgccgccaccactggctccagctgcttgagggtgcgtacggcgcgcgcggcctcgcgcccctcgcccagcagcgccgccagcacggcggccgccaggcggcactccaccacgcgcaggttgtaccgccccgtcgccgactcggccttgttgctgacggccagggagttgcagatgacaaaggtcgcaccggcgggcaggggcacgtcgtgcgcgcgcacggggtcaaactccacgagcttggcgatgccgcgcgcgcccagcatggagatggcctggtccatgccgccggaggtgacgccgacgtagcgctccgcgcgcgccgtgaactccgacacctcctgcagcgcgcattggtgggggagtgagggggagagtagaaatgggtgtgtgttggagggggggtcttcttttgggggggcacatgatgggggctcgacaggcaggcaggaggtgaggagtgcaaatcaagcagggccacgcagagcctgcagcggctccacgtgacagatctccacgcgccgcctgctctgaagaggccacacccttccattgctttcccacgaagcaccagcacaacacgcccaggcttgcctccttggtgaagtcgaagccatagacgtgcatcagggccaccgatgcagcacacacgatggccgctgagctggacagcccgctgcctgggaaatggatttggggggaggatgggggtgagaccttgatacaccggtgctgaggagggccacgcgacgtgtcgctgcccactcgaatccactgcaggcccgagcctcaagcgccgcacacccgacgccgtccccgacacaccgagagacccacccgtggggacggtgccctgaatggtcacattcaggccggagatgtcggggcggggcaggcccttggcggccgccgtctcgaagacgcccttgtaggcggcgaggaagtagttgccccagttgtgcttgcccacgtccacggtctggtcggggtcggcgctgaaggtcaggtccccgtatttgtgggcctccacgtttgtgatggtgaggtccgccccgccacgggacacacccacaatggtgtcctgtttttttttgggggggggagggatggatgacggggggactggggttgaggggtgaggaacgaagtgcactgtgtccacagcccggtgactgtgcgtcgctgcggccgaccctgggctcacacaggcatcctgggcaccagcccagactcgcactgcaccgcagcacgcaccaggtggatcgccatggggagcacgccgtagccctcgtagtcgatgtgctcgccgatgagattcactcggcctgcaaaggttggggtggcgcctgccggtgaggaccccgggggcctggcctgcgacttcgggctcgcacccaatgcacgacacccagatccaggttgcacatcctgccccagatgagcacccaacgtaccgggcgcccgtgcgaagatctcaggcttggtcccgaaacgtgcgtggtgcgccttcgagagcgcgacgtagcgatcacggaccgcggcggcacctgaagggacgttgaagtacagtgatgtccatcacaatgcatacagcgcacgtcgaggggaatgcgccggagcagtgacgccccctaccttcgccgtacacggactccaagtcagagtgtgtgctgatgggggttccggccattctgtcaagttaagtctgtagatgaacgaaaccagttgcaatggcaatgcgtttggagcaacgaccaggttgccgcgggatcatggggtctggcaactctccgcgcaagggttcccactgttacgtgatgacatcacgtactacattctgagcagcatttccgagaggggggttcgcgggccatgcggtcctcaacatcgagcacctttcttgtttcaatccagaataacacgatatcagcatggagtacaggcaggagcagggggaggggccggtggagggaacaaagcccaccgtagtccgtctggaccacccctccgggagtcaggtgatcctggcggagggtatgtgggcacgcaacaactcgaagacgtgatacagttgagatgaacatgcgtatcgttatacctcgtgatcctcgccattgcaggtctatgtcgtcggaggtctgaccttctccccccaggtgcagcctgggattatagggtttgcaacctgtgactcccatcctcagtcagggttccttctcacgcaatacacagcccataacttctcgatgctgactaacaccccgcagtcgcaagtggacgcagtggagaccatcggcctcgttaagcccgtgacagtggtcctggacacggatgaggggacctaccacaaggtggatggcctgggcaggggctgggagggctcgcagcaggccccctcctcctaccccggcctgctccgcgtctacctctccggccagctgcccagcatggtgacaggcgtggtgctgcgcagtgcctttgccctgctgggctccgacccctcggcggaggtccgcgccgtgcgccgcgctgcgcaggaggtgggtgcccaggtgcagcctgcggggcgcagccccgcgctgtaccgcgcccggctggcggcgcacgccctccagatccagaaccaggagctgcggcggggccaggcggacatggcgcgcatgcgccgcctcatggacgacaggccgggggccgcgggggggctggatgccgaccgggacgtgggtgagcagggatgtctgtgtggtggtggcgggtggggggggggg

SEQ ID NO: 18668 - DNA, 79 bp, Chlorella protothecoides
aaccacgagctgcagtcgtgtacgtttgagatacgtcaggcacacaggcggtcgggaacatgcagaggtcttcaaggca

SEQ ID NO: 18669 - DNA, 493 bp, Chlorella protothecoides
tcgatgcatcactcccattccacgcttcatggatcttgatgatgtgatcgtgaaatgttagcgtcttttcctgctaccgccttctcattcgcaagggagggtatggaacctcgacataccaggaaggtgagcttgcgtccctgaaccgctccggaggtgtacagagctgcggacgctctcgacatctcgatttggactgtcgtcgctggtgatggtggtgaggtttcgcatgtgggctgtaccatgggaatcgccaacgagcatcgctcggtctactctgcttgtgcagggtgatcgaaactacgcatttccggagatcctatgaggtggtgatagcgtcaccctcaggggtgatgtgtactcattgatctacattgtgatggagacccccaccccataggatctccgtggatgcgcagtctgcatcaaccacgtacaagcagaagagacgtaataatatttgttggtggttcttctggaaatttcatgtgca

SEQ ID NO: 18670 - DNA, 278 bp, Chlorella protothecoides
acatgacacttgatccatcatatgagcgcagatcaattgagtaagatctaacataccttgattgcatttccactgtcgacgagctgagaatcgtcgccctcaggaatagcttcaaggtcggctgacagcagatccttcgtgacaaagctgaagtccagcaggccagcattcacaagcgtgccaaggagttcgccagtctgcagttgtgaaagggttacgttgatgcatcaatttaccctcgacattttatcagtgcaagccgctcacattacgcaagc

SEQ ID NO: 18671 - DNA, 61 bp, Chlorella protothecoides
atagaatataggtctcccagaagaaaggggggtgaatctggcccgatgcgcgcatgcctga

SEQ ID NO: 18672 - DNA, 90 bp, Chlorella protothecoides
cttaaacaaatacctttcttcagaagcctatatagttttttaaacaaacgttggtactttgataaagtatacaacgattacatatcaaaa

SEQ ID NO: 18673 - DNA, 130 bp, Chlorella protothecoides
gcaatggggaggaggagggaagggacaaaggggggaggagggagggatgatgggatccaaaccccgccaccatgcccccttgcccctccaagccatgtccgtctacactccacccccactcgccagcccc

SEQ ID NO: 18674 - DNA, 2869 bp, Chlorella protothecoides
acggcgtggcccggggccgggcccccccccgcgccgcccacgcccctgccgcccccgctcgccgccaggctggaggggctggaggtgacgctggggccggacctgcgggcggtggtgccggtggtgatgaatgtgggcgtggaggggcgtctggtgctggacgctggcgccggcggcgacccgcgcctgcgcgcgcgcggccgcctgagcctgcccggcggcgacctcaacctggtggccacccagctgagcctggatcgggagcacgccaacgcgctggtcttcgctggcgaccctgacccgagggtggacctcgtgctgctgggcggggacctgcgcgtcgccatccaggcgagccgggccagggcgattcttttgtttgggtgggggggggggatgcagggtctgtggtttggaggagggcagcgaggggactgcgccggggagtcggcgggggccgggcagggaagaccgctcggaccaggcgccggttacctcgccgcctggggacggtgggggtcacccgcggacgcccggcgagcgcggagtggggagggagtgcaggaggcgggccgtgcgacggcctgcgcctgctgaaaccccggaacctcccgcgcgacgcccgtccccgtgaacccacaccacctcacgatgcaccgcaccgccgcgtgctctctcgctcgcagggcccggcgcgcgagtggcaggagcacatgacgctgcagcacgtgagcggcgagggcgcgggcgccctggacgtggccgacgcggcgcgcatcttcgaggaccggctcaagtcggcgctgctggcggacgacgggcgcctggcgctgagccggctggcaggcagcacggtggcagggctcatgccccgtatcgagagctccggccaggtggggggggccacctggcgcctcgtgtcggcgccctccatcccaggcaggcggggaattagggacggcaaggggggggttggggagcgggacaagcgctggcatgctggggtggcggcatgctggggtggcggatcacctgggcaggcggacgtgctgggggcgggtcgagcagagaagaagccgtgcgcggcgtgtacggcaggggccgggggtggagagggtcgtgacatccaggagagggtggcgggcggcgctgcccacccggggcccgtcgctcccgggggctgagcgcctcggccagccttcccctcctgcaagaccgccgggaaagcaggcacaccagaccgtgcacacgctcgacaccgcctcccctcaggcctgctggagcccgggggcgggtcggcgcagccctcaggcctcctcagctccatcacggtcggcacggaggtggaggtccagtttgggcgcaagctgcaggcgagatcggcgggctttgcggggggtgaccttgtggatgggggtccggaaagggggtggcgggggccgatcatgtaaaggaggcagtggccatgtgctgggagggaaaggccccacccgccggccgctgctctcctgtctgccggcctttgacgagacagggtgggagcccgccgagccgagccgatgcgccccaccactcatcccgccccctccaaaaagaaaccacacctttgtaccactgcgccaggcggcgctggtgaggaagctgcgcgactcggacgtcgcgacgcagtggacgctgacctacgcgctcagccggcaggttcgcgtgcagttcaacataacatcggcggcgccctacgcgcggaccctctacctccagtactcgtccgagggcgcacccaacgcggagtgaggcgggccgggtgcacacctcgattgggagccccagcgcccagctccacagcctcggcgctggagccccgggtggcgcaggtggccccagccgccagccagcctcactcctgtcttgagccctgcctttttgcacacacagcgtattcccatcagctccgacccccctttccatgaggaatgcggacacttgcttggtatcagcccttctctacagttgaggaacaaggttcgcctccaacatgcccctcaggaggcaagacttggtcgtcaatgttcaagtgtggatagccagaaacaatgctttacacgggtttgaactattcgtggatgtgtggagctgggacactctgaccaggtgaacagcagacgggattgacaccacgtccaaggctgtgtatcatgaccctactctactcacagccacaactccaatctgtcaggatgctgtagtttcaaggatgtggtttgttgaaggttcctgtggagggtgtgtgcatttgaggggcaaatctctgtctatttcagcataacaagcgcaccatccaatgctcaaggggccatcttcagaggtgacttgtctgtggcgagcattgcgcagtgagtcctgcggtggtcgcgcttgcgaggtctgactgcaagctttccagtttcgccacccatgctgtgacctacctccaagcctgcgtgacctgttacatggcatgtactaccagcatcctcatgcgacacagtccaaggaccaatttgtttgcgatcaggacaaagtagtacctttccgatcaaggaccgctcaagcccatgcagtgctctgcacaccagcgtgcaacagtctgacaaattggtgctggggcggatcgcgacgcctcaccatctcaccattgcaaagtttcttgaagtgcgaccatcgagtagcattgtacaggcctcttccgtactggcaggcgattcgtcctctagcggtcaattcccctgagttcatcccaaacacatcaaaaaatcagctgatcaaaagcctcctgtttgcaagtcatgttggcctcgctagtctgggtctccattgcctgccactgtctcaa

SEQ ID NO: 18675 - DNA, 62 bp, Chlorella protothecoides
aggtggcacagtcagcacgcagccgcatgggagggctggacacgactcctccccacccccac

SEQ ID NO: 18676 - DNA, 72 bp, Chlorella protothecoides
aagcgagtgcgccaggcaggcggcgagggacgagggcgtgagcggctccagggcctccagtctgtcgctgag

SEQ ID NO: 18677 - DNA, 107 bp, Chlorella protothecoides
tttcagattattttgctaaaataaattacatttatttatagatgttacttgtatgtaaatatatagattgtcctatataatctacaaaacagttgtttatttaaaac

SEQ ID NO: 18678 - DNA, 194 bp, Chlorella protothecoides
aaaaaaagtaaaagtagtaagtatataatagactacctagagcatctattgtatgagatgtagataaaaacattcgccaatctataaaagataattgattgtagttggctagtaattcagtattttcaatattatatgatagtaatggaatcaaatcattatcgataagtatacaaatttcaaataaaaatagt

SEQ ID NO: 18679 - DNA, 143 bp, Chlorella protothecoides
cagtgaccctcttcagtttcgcaactgcaaccacaatggacactgacaccaacctacaattggtcgtcactctcaccaagttgccaacaccaccgacccctgccacccctgcgtgtgcggctggctacacgcccgtgaacagc

SEQ ID NO: 18680 - DNA, 66 bp, Chlorella protothecoides
cggcccatgtggcgaacacgttttggaacgcccgagtgccctgctccttcccagcttgcatagtca

SEQ ID NO: 18681 - DNA, 79 bp, Chlorella protothecoides
gctgttaccaagccagatgctggtgacaccggcccggagcgagtctcaatccaggagctccaggtgacctcacaagaat

SEQ ID NO: 18682 - DNA, 61 bp, Chlorella protothecoides
ccactgcagccccaggttgggccggatctgagcctcagaccctgggccccctctccaccag

SEQ ID NO: 18683 - DNA, 62 bp, Chlorella protothecoides
gcctcagaccctgggccccctctccaccagcctgcgcggcagtgccaggcccaggctgtgcc

SEQ ID NO: 18684 - DNA, 149 bp, Chlorella protothecoides
taaaagaattcttttaatattaatcttcatgctcttcaaaaggatctctcaattcttgcgaaggtgggccaaagcctatataaattgaataacctgtaatggttataagtaaacaccacaaaaaaatagtaataaaaatagctgaattt

SEQ ID NO: 18685 - DNA, 155 bp, Chlorella protothecoides
gggaccccgcgcctagcacggcttccgacttagaggcgttcagtcgttagcctacggatggtagccttgcgccatcgccggggcaggcgagcgcattaccaattatccgaaccgacggttcctctcgtactgagtcggattactatggcgggatc

SEQ ID NO: 18686 - DNA, 91 bp, Chlorella protothecoides
ccgctgtgctcgctgttttatgggtcgggcccctgtgggaagatggttttgagcaagaggtttggtacagttggagcgatgcgaggtgtcg

SEQ ID NO: 18687 - DNA, 83 bp, Chlorella protothecoides
cagggagcggggcgacactgtattgtttttgtctgtggggggcttgccgtggctctgcgggattcccagttgttttgaagccc

SEQ ID NO: 18688 - DNA, 61 bp, Chlorella protothecoides
cacctcggccgcatacatgcgcgccacgcactcgcccagccgcttgttgggcagcgtggag

SEQ ID NO: 18689 - DNA, 83 bp, Chlorella protothecoides
ccgtcatgcaacccactgtcccaatcgatgctgaatgtgagagcacattcaagtagtccagcaattgtggtagaagctgaggc

SEQ ID NO: 18690 - DNA, 194 bp, Chlorella protothecoides
atgtgtggaatctgtttgtataaacctgttctaccttgaataggattggcagagtcattccttccataaatcctggcgtccagaaaatgaagcacgacttttggacccccaaaagggcatgcacggcatgggcggcggcctggagccaaggccgccgtgctgatgccagccgtttctgtgtcaatcatagttcc

SEQ ID NO: 18691 - DNA, 8267 bp, Chlorella protothecoides
agcgggctggcgccggagtggccggccacgcccgaggcggacaggcgcggcgcgcgggcgctgcccttgatgccgccggcgcgcgggccgtggggttggcggcccttgcgcccggagtcccgccgccggcgcagccgcgtcaggaactccgaggggtcgggctgcggtgtgacgaggagggtgtttgcggggtgagaggtggcatgacggcggcagcacttgctccatcttgtggcaacatgtgaccaaaggcacttggagcagaggcgttgccgtgctgggcaaaccatcctgagcctccgagtgcagcgagacgaggtgggaccagagcccctggcggacctcacaccacggccttcctcgtccaaggcccccatggattacacatccgtgccctgatccagactgcacaacaccacgtgacgaagtgcctgcaccccatcagtgctgcacaacctcccactcaccagcttcccgaagcctgaaatgctcatggaagctaccggcagcccgctcagcgaaggctgtggcgcggatggagcgtcgcaccccctgctcggctgcgccttgggctgcgcgtgggagcagctgcccgtcgtcctcgccgtcgacggggccagaggcatgacacctcgcgccccgtggaacatggcgaaggcagactggaaggacatggcatcctccgggaagaggggggacgatggtccgcaatctacaacgggtttcagtgggtttatcgccaggcgcacggcaaactcctggccctgcgtggcagctactctgcggaggaaggggcaggctgccaccccttccctgaccgcggcgtcgcacatctttgggttgaaccttggaacttcaggtcgtgggtgatgcggtgaattagcgagtgactctttggtaggttccggctggaccagcgtatgtaaatgcaagtcgctggtcacctctccccaaaatatcgcctggaggtttgaccccggctgaccacccgtcgaatacaagcacacgtccgcacactccagggttgtttggtaggattggaaggtgtcgtgagaatgtaccacggcccgagcgtggatgaatcacatcatggtccttggcaatagggcaccagcacaggacccgaggccagactttgtactcagagattctcctatggaggcaccagaatctccagtttcaggtgctactcaagcttggtatggatttcgttttattgaaatgccgagcagcacttacctttgtttgatcccaagagaggaagagcagtggtcaacagtgacaggacacagactccagtgccggccgatcggtggtgtgacaccgtatgtccccatcaaaatctagacgaaagggcgtgcatacagtctgcgtattcgaatgatctcttgatgacacaaagctcacgctcagcatgtaagtgaacaagtctgcccattcttccttgatctgctgccgtgactgacgactcgagactctcgctggcaagagtctcgcgcaacactcacacccccaaagaaagatcagagacgaactcaatgaaatagcactgtgatagatgatggtctggaaaggtctactgccaccggcgtgggtggtcttcctgatcatcctgctcaaggagttgctggacgcctttctgcagtggtggctggtgcgaaggtcatcgaccctgtctattggacatcacctcgtcatctctaatggccccgattcgttgtcacatgtgcatgctcgccatgcaggtgcccgacaccgctcgccggcaacaggagttgaaggcatcccttccggtcctgcgtgccgagatcgcgcgcctgaatgccccccagacatttgtgcagtgcgccaaagcggagcgtaagctcttgatcatggagcgcgagctggagcgcctggctgaggtggaggtgcgctgaattcccttggcttggagaggcttgtcaagcccttcagccccctcagaaaggcattgttgcatcaccctcacaggcagcagcgacaaaacatccagccttgcgacttccaagcctcctcagcatcctgctcggcctatacatctcgtggaccctgttgagaggcttgcccctgaacggctcgctggagctccccgccatcggctggccagttcttcggactgcattgtcaaagccaggtggaccatggagagcagggcgatgtgtttgtgacatttaataaagagatgaaagctcacttcctcgtctttaagggctgcgcagtacgactacttcattgccccaacatgtgcccctcctcgaaaggcttccggagtttagcaacctgggtcctgctgagccagcgctcggtgcgcctggcagtcagaggctttgcagatgtggcaggagtcatgcggagactttcatgaggctgctacctataccaaagtatctccacaaagggatggtgcagcaggcgcagcctacacagcccggaggccatgcccatcctgatggaggagctgacaaggatatgggacctgcgtcacagacccctagtgacctactcgacccccccatcctgccactggtcagccaggatcaaaatgtctctcagtggcaggggtgctactgaatccaagttgtgctccagtatcatatgagcagccactctggttgctggaggccacctccggctgcaatacagtggtgggagatcttcaattaaatgctcaggccctccctcagtctctacctgccctttgcttgcaagggcaagcaaatcgtcaagaggggacttcagtggtggtcgggtgtggacaggcttgtgacgatgaatacagcagggctccctactagtacatgctgggttgtacagcttaaaaattcaagagctacaacgtagctcctttcatctggtgtttgatcaaaagggatcagcttgcctaatgcagagcgcattcaacgtgtggatgtacatccaaacagagcatatcgttgtgagacgcacagggaagattcaaaccggctcgtctgccactggcgcacattcaatgtctggaacactgggagctcgctgatattgcgatttttattcgcaagctggaatcctcgaggggcctgctattctgaggatcacgactcctggcgcatgctgcgcattgccgacctgctgcgcgactcggatcgttcgtagacctgccaataacgctcacctgcagcgcatgccgcaacatccctctgtggcaatgaagtgatcaacgttaggatcttgccttacattgattaatgcgtttgctgtgcttccgaacggcagccatgcgaccacccggtcccgaaagatgacgttggcccgggcaactcgtctgctgtgtctgaggctgagtcggacccttcgacgcacctccgagatggcaaattgggacgtgacaaagctggatgtcttcaagtacctgcgctgcctccggcacctgggcaaggccatgctgctcgtggtctttgccctggcctggctggaggtgcaggccgtgttctcatgcagcctggcaccggcctggaggcagggcggcctgatcatgcgcgcgctggtggggatcacgggcgctgtcttccttgcaatggtgagtttgccggcctggcagggcctctctggcgtgccagacgggtatcgggcatggccgcttcccagcctggatgcctttggggtcacagactgatttgggcagaccgtgcattttgtaccttgcatgaaaagcagagcctcacccctgcacagccatgaccacggccccgtggggcatctgccctctgcaggaggtggttggcaggcccacacatgcatgccaacatgcgagcaacctcaacccctgcaccccatgacctcacgcctatgcaggtggccctcctgctctgggcctacctggcaacctttgctgccaacccgggactggtgccccctggctggcagccttttgagctcgacgaggtgggttgtttgtttcgcgcggtggggattccagctggagaggggatttgatgtgtggcgatgtgaactactgcgcgaaggacatgcaaagaaatcgagtagctcaggactacgaggtcaatgtaagcgcgcgggccccagcaagccttggaggcaggggcgagggggtccgtgcgccgtggccagcctttgctccgcccctcggtggtggccctctgaatcaggccccctcactccctcccttcctcccggccgtcgagagcaggagcagcaggtcgggagcgcagacctgcaggccctggccgacgacttcaccgagctcatccgggactcggaggacccagtgcagtggcacctgctgcgcccccgcttctgcaagaagtgtgcggcctggaagccgccgcgggcccaccactgccgcatgacgcagcgctgcgtcctcaagatggaccactggtgagtgcgtgggtgtggactagactgctcttggcttgtttgttctcaagtgtgcggcaggtgcctgattgtgtgagcggtgcggggatgcccgcgtcatgcttgaaggccggatggccttgcatgaactctggcctggccctgtgccaatatatctgatgcactgcctgtggcccccctcaacctcaaccctattcccacggtccccttccccctccaacaaggtgcgtctgggtgctcaactgcgtgggtctcttcaactacaagttcttcgtcctcttccttgggtacaccgacgtcgcctgctggatcaggtgaggaggtaggggccatgtcgcccgtgggtgcagcccagcatgcggctgaggcacctctgactggaagcagggcactccagctccccgccccgctttcctttcgcagcgtgatcctgctgctcgggcccacgctgcgccagttcagaggcacggccggcccgctgagcacgctgctgctggccttcacagcctttgtcttcgcagcggcgttctcgctggccctcctcgcctttctcatcatgcacctgcgcctgatcgcccgcaaccagaccaccatcgaggcctttgagaaggcgccggtcaagtgagcctggtgggggaagaagggcttttgtggtagggggaccgagaggggaagggggatactgccgccattgcagcgtaggcttgcggtgcctgcagcaatagccacgaggttgtccagccagaaaaatcaaacacatcgatgtgctcctgggctgaaagcatctcccttccacctcaacatgttagtgctgatatgtccgcctcccttccttattactcctccctgtgttccatccattacagaccctggccgtacgaccagggctggcggcggaacttcctggaggtgtttgggcgccagaggcagtactggctgctcccgctgcaccccgccgcggatgccgaggccatgcgacgagcctacctcgagtggaccctgccttggcccatcgacagcgggcaactagatgatcacgccggtctcgagatgtcacaatcatactaggcgccctgaagtggcagcgtctcgcagtatgggtgacggaatcgtggcgtatctaatgctcctggctccttgaacccccagcccctctgcgcttgacgctctgctgtttatcgtcgacttggattcatgtacagaattgcacaggacattgccgtgtggtatgtgcagtctcagccgccccgactcaggaagcctgactgaagcgagtccttgtcatgcaagccgagctggcatgataggtgacggggtgagtgtcttcgccaggccgccaaggttcttggttggccatgtcacccagcaccgaaaactgcaacaaggggcagcacgggctttcaggcatcgctgccaccccacacctcgcgcttggggcgcttggcaaagtcatcggcgtgctcatactccatcaccctgcgataagaaaacataatggagtaagggtgggttccctgctggccagtgagccgggtgggttggtcgattggattcaatagcaatgcctccgatagaggtgcaacgagtgacacccagccctcgactcacgcccgcgcacactcacgtcacggagtatatggcatagggcactaggagaccgaaggtcaggacctgcgtcatggtcttcctgtcccacttgaactcctgctcgatgagctcacggcgcgtcgcccactcctccacgaacttgttcggcttcaccggcaggttgccggcaaaccggcgctgctgatactggagggcggtccgtgccacacccagaccctgtcgtaggatgttcgccatggccctgatccgggtcctcgctggcaggagttgggggtgggcaccaaacaccgccagacctggcggatagctggagtcgcgtggcagccgcagtcccgaaattttgatgaaagtatccttggttgggatattttgccgtgtgaagaaactaggagccggcctgtcacatcgttggctcccggcgaggatccgctgcagacgatggatgtgtgaggggcgccctagtcatttccagacggggcaggcacagcatgtgagccgtccccagggcaacatcggggggatctccaaggagccagttgaattcgagtctatacgacttgagatgctgaaaggttcaattctctttgcaaaggtgcggcctgtgcagtgcagcaagtcctgcccctcacagcggcacattcccgtgcttgcgccaggggcgcgtggcctgcttgtccttcagcacctccagctcggcgcacaggcgccggcgggtgtcctggggggcgatgacgtcgtcgatgaagccgtacttggctgcctgcataggattgctgaacttctcctcgtactctgcggtcttgacctcctgctcctcctgagacctccccctgcaggcgggcagcggtgttggagcgttggggatctgaggggtttgccttagcccttgcatgctacagggacaggagccttgacctgtggccacactcatcaattctgtgcagtacaacaggctgaagcatggcgctgtccgcaggcatgagacgggattccacaggcaccgatctggtttgccggggcagtgatcacgcccaaccacaccctcatgatgaccactggaaaggctcctcccacccaacccccccagctcccttgcacccacctgaagaggatctcgacggcacccttggcgcccatcactgccacctggcccgtaggccacgagaggttggtgtccccccggaggtgctgttggaatgagcaatgagggggccaagtgaggcacgggcggtcggggcgcggcagtgggacaaccgcctctgcatcgccccatcggcgtgatgcgtggcggatcgagccaggtacccactccaacacgtcccatgacagcccaagggctcaggctggtccttgagaatcacaatgcccgtccgcgaggatctcaccttggagctcatgacgtcgtaggcaccgccgtacgccttgcgggtgatcacagtcagcttgggcacggtggcctcggcataggcgtacagcagcttggccccgtgcctggacagagggcaccaggggagtctggggtttcaggattggaggccaagcaggcgaggcaggaagcagattccagggccagcaccaagcctggagcatagtgctgctcaggctgcatgagaaaccaatgccatgggcgccgccgcaaacctccccacccagcacacctgatgatgccaccgtactcctgggcggtgccgggcaggaagccgggcacgtccacaaaggtcaccagcgggatgttgaaggcgtcgcagaagcgcacgaaccgcgccgcctgcagggagcatgggggtagggccagtgcccagcgagcaatgtggtgcgggcctaggccggggacgacagactccagcatggcttgatgcgatcgacgacatccggttgcctcaacactgaaatctcccctttccagcaaccgatccccctctcaagcaccttgacggaggcgtcgatgtccaggcagccggccagcacggccggctggttggccaccacgcccacgctgcgcccgcccagccgcccgaagccgaccacgatgttcttggcgtggtcggccgcgatctcgaacagcgcaccgtcgtccaggacctgcgccagcacggcgtgcatgtcgtacgcctccgcatctgagtccgggaccaggtagttgagcgccgggcaggagcgggtgggggggtcgcgcgaggggactaggggcgcggcgtggcggttggaggggggcaggtacgacagcaggtcccgcatcgcgctcagcgcctggggggggg

SEQ ID NO: 18692 - DNA, 77 bp, Chlorella protothecoides
caccagtaccgcatggtaaggcgagagggcttggtcctgggaagccaacaacagagggcacaaggcgttattcagta

SEQ ID NO: 18693 - DNA, 91 bp, Chlorella protothecoides
aaatcaatctggtgttctaaaactaattcagaagcttgagcttcattttgtaatattaagttttgaaaaggttgagaccaatttaaccata

SEQ ID NO: 18694 - DNA, 67 bp, Chlorella protothecoides
gccctcctcagcaggacaggctccatgggccagcggagcacactgtcctgggcctgatcaaccacct

SEQ ID NO: 18695 - DNA, 3619 bp, Chlorella protothecoides
gccgcctcgtgcgccgcgcgcgcccgcgccaccgaccccgccagcagcgccgcgcggcgcaggagcgcggcctccatgcggcagcgcctggtcgccgcggagagcgcggccatgccgcgcggcgccagcaccgggtgcgccgccagcggcctaaccgcgcacacgtccaccgtggggctgggcaggggcccgtcccagggccagggctccgcgcccaacggcagggcggcgcccggcgccggggaggtcgtcgcatgcgctgcagcatctactccagaggcctggccgccttcctcgacgaattcttcaggggcctccgccgccgcattgccgctcgcaaagcagcaatcgacgtcggggcccgccgactccagcatgcggggctggtcgacgcggcgcaggtccacgctcatcagccacacgccgatggaaacgtcctcgctgggcaggagcttgaggaacctgatggggaggagagcgcaaggcatcggtcatgtgtgacctggcaggcggcgcgcggtgtgagacggcgcgcgacagtgatcgagcaggcagagggccagagggagtcccctcccgcagtctcgtccgtggagcaccgctgtggcgccatcatgcaggggactgcccttccgagccccatctcgcagcgggcaccgcgggagggctcaggttctgaccccatagccatgtgccaccaccattgcacacccgttcaaacaacagctcacccaggagcagcgctggcatgggtgttgacctccaggaccagctgcgccaggtcgcgggacaggacgtagcccccgcccagcatgtagggcatgtaggaagaaagggaggtgtgggcggcgtagacggcgtccaccctgccccgtcgccgcggtggctgccccgtcacatcaaccctctcctgcagggaggcggtgggacgctgctcccgccccaggtacagccgctcatgctcgcagccaggcgacctgtgcggaggtgggactggggtcaaacagcgcattgctgggcatgcgtgcaggtgtgggggccacggtggggcaggggttggtcacggggtagcagagggcaggcagagccagggacgagggtggtcacccccagccagctgcccaacgtctggccggtgttccttctgtagtgcacgcaaattcaaccaagcgcagtttcctcctggaacccttccatgtccggccccctcacatgcagagggagagcagttcctgcatgatcccaacagggtcgagccaggtcgagtcctccgccttcatgacaaatgtggcgcgatgtgccgtggtggcctcggccagcagtgcgtgtgtcctgaatgggggtgttctgcaggcagaggaggccggagcaggtgagtgtgcgggaccatgccgtgcatgcgtggctgtgcgtgagatgccctgggtgggccctgatgctgcggggactgtacatgatcaggccagagctacagatgcttgcagttggtgggcatggcatgccggcatccaccccccttggaatttgccaggtccaggcagtatcagaggagcccgtgtctgcgctgggatggagcccgggaacaatgcacgtggcgtgggagtcccaccaatccatccatggcatccccagacagccccagccaaccccatgcactcacccgtctgaggctggtgggactatcaccacgtcgccgtgggtgtcagcctcctgtgccaaggttgcatctgggccggggccggggattaaaaatcggaccatcagcccggggacatgcgccgatgccgagatccatgaccgtcgctgtgcagtgcggcggtgcctcgcctcagggttggagaagatgcctgcgggtttgtgatgggatcggagtgcggacgggcgcgatcgatatcatgtttgggtttccccaccgcatgcgtgatctttgatggggatcttcgtgcggtgactgggagtgcgacaggagtcaatgcaacgagatcaacccctggcccggagcagccaaccagcatcgcagacgcctgtagctccagccagccaggacctttccctagacaggggtttgagacacgaggacaagaatatcaatccaacgccggtgcccacctatgtagagaaatgttgatgaattgcaaccagcgcctgcagcaatttctggtgaagagaggagatcgactcgccgctcgtgcaaggctgtcaagtcatacttgagctctgccaaggtgtcgagtgtggcctgtgcggtgaggagtctgttctggggggtagggcagtggccctggctggacgtcggggcccagccccccagcccaatccaccagagactgctcgcagccagtagcaaggagcatgccattaggatggcacatgtgtaccgctcttccgccctccaacgaccgaagcggcggccgagggaggggagatcacttcgggtccttgaccgtcgcagtgggtacgtcatgccgctcactgtattcgtgacaacatctagttatagtttgtataaggagtgggaaaggagtggactatccgttggcgtccatggggcagctccactcgcctgctggttcggacacaacgccgacccagaaggggagcgcttgaatggcacgagggaatccttcccagcaggtgggccctcgccgtcaacgcagtcgaggttctcagttgggtagtggaagccggcggtgcattgcgggagggtgacattgcagcccctgccgatcagcagcgcgtgaagaaccccggggacggtctcctcgcgcgcggacagcacatactgtcgacagtgagcagaggcctgtcgctccatcgtgctgtttctgcgcaatcagaaccagcttattcgactccccacaaaatgtggcatttcctttgaaggcctcgccgcctccacctgcatggcggagtccctggccagcgggttgcggggcctgtccgtgacccaggaccggtcccgcaccccctcccaggcctcctcgagcccccgatgccaggccgtggagctggccggcatcgatgacgtgctagatgccctgcgtgaggtgactcgaggttgcctgacttgcagggttgcctgctacatgggcacgaaaaatgaggccgcctgcctgactgtgtgctagttctgcccaaggcaaccctggtctcacctcccaatatatacacaaaaccacacacgcgcacacatcccccctcctgacaggtggtggactggcccatccggtaccgggcagaggccgctcaccttggcgtgaccttccccacgggtgttctgctccatggcccgcccggcgtgggcaagacggccgcagtggcccaggtcgcgcgcgagacgggggccgccgtgcaccgcgtcgaccccggcgacgtcatcggctctttcctgggcgagtccgagcgccggctgcgcgacatcttcgctgccgcgcgggccgccgcggccgccgacccctctcgccccgtcatcgtgctgctggacgaggcagacgcgctgtgcgggcggcgctcgccgcagcggccccatgaggcgcgggtggtgggccagctgctcacccttatggacggcgccgagcggcacgacctgggtttgtttggggagtgggggggaaggggg

SEQ ID NO: 18696 - DNA, 61 bp, Chlorella protothecoides
gctgagctccttcgaagctttcggaatgccaccctgtgcttcataatatatcaagccactc

SEQ ID NO: 18697 - DNA, 655 bp, Chlorella protothecoides
  modified_base (383)..(392): a, c, t, g, unknown or other
  modified_base (464)..(473): a, c, t, g, unknown or other
acctccgacacggcagtgctggagctgctgcaggacatccctcccgagtggggcgcctggacggcaggtgcgcctctattgagatgggatcaggggccgcctgttggacccacacatgcccacttgcgctccccgatactagctgcgagagccgcctgctcgcagcacctttgcgagcctgtctgccccatttcccctccgcagccattggtcgcgactgccgtatggcctcacgccgggctcgcacaatcccaccctgccgcaggctgggatgcaggctgggtggagcctgggttcagcttcctggacgtgtcacagcccatgggtgattcccagaagatcgccagcggcaagtgagtcccaccggagtcagggcatgcggnnnnnnnnnntccgcagccattggtcgcgactcccgtatggcatcacgccaggctcgcacaatccccccctgccgcaggctnnnnnnnnnnggaaaggggggcccccgggtctgctgcatggcacggtgtgcaacttccctggccaccctgcactgcaccgtgcggcggcggctctgcagagacacaagccctccatgttctgagccacggctcgggtcgcaccctgtcgaccctgcccccgacccccaacccgcctctgaacctccattgat

SEQ ID NO: 18698 - DNA, 61 bp, Chlorella protothecoides
gtgctggcctggatcctcaccgtagacagagttgtgatgtgatggtgggcacggctgccag

SEQ ID NO: 18699 - DNA, 8650 bp, Chlorella protothecoides
gggtggattggagggggtggaggggaggggaaggggggaaatgagggaggagagagtgcagcatccatgtgtctgtgccttgccgtaatactgtcgagtgcagggcggaggtagagtttgaacatatgacaggccttaatgccaaccccaaccccacatttggccattctttccaatactaatcccacgacagggccacgacggtgtacctggtgcagcggcggatagacatgctgcccaagcccctgacggaggacatctgctccctgcgcagcggcgtggaccgcctcgccttctcggccatctgggaggtgactccagacgcacaggtgggggcgtgggtagggtgaaggtttagggtccactgcctatgtgagatggggccacgatagagcagggagtttggcacacgtgtgtgtgtgcgcatgccattgcgcagctgggccatctgaaaacgactgcgccggccgctcccaccggagtggctgctgagtgtctgaggaacaaccctccaacactgttgccagtccaggaggctgccacagggtatcctcggcaacaccccttctccctcaacctcacatcattcgctgcaatcctcccctccccctctccagatcctgagcacgcgcttcaccaagagcatcataaggtcgagggaggcgctgacctacgccgaggcccaggcccgcatcgacgacgagcggctgacggacgacgtgtcggtgagttgaattgcgagatgttgccctgggaccttggaacgggaggctcgtcggttacgccccctccctgctctgtggtgaaccaccacccacctgcacctccacacgctcaatctcgccccaccctacccccacagtgcaacctgcgggagatgaaccggctggccaagatcctgcgggcaaggcgctccgagaggggcgcgctgtccctcgcgtcgcccgaggtcaagttcgagatcgacaccgagacccacgacccgctggacgtgggcatgtaccagctccgcgacaccaaccagatggtggaggagatgatgctgctggccaactgcagcgtggcggaggctacgctgggcgccttcccggcctgctccctcctgcgccgccacccgacgcccgccccgcgccagtttgagccgctgctccgtgccgccgcggctgcgggcttcgccatcgacgcctccagcagcaaggtgaagtgcattgtgcagaggtgtgggggcacggtagaatattcacgcactgcgctttgcaacgtggtgcaatgccctgcgccgctcaaggcggccgcccctacaatagccacctgctctattcctcgccagtcctgggtatccccttgtcccttgtccgttggagaaccctgcccacgtcattctctgatacccacccaaatgcacaaactctgttagaccctggcggcgagcctggatggagcaatgcgcgcctccgacccctacttcaacaagctggtccgcatcatggcgacgcgctgcatgacgcaggccgtatacttcaactcgggcgagctgtcggtgccggagtaccaccactacggcctggctgcaccgctctacacccacttcacctcccccatccgacggtgtgtttgggggtgtgatgtgggagtccgcgagggaagctcggcttcggcaggcttccagctctcaggacgcccgttgcatgggagggtgctgtttgccccgtccccaaaatacccatgcaagatgcagtcatacacacggacccctcacacaaccccccacatgccctcatctcgagccattctcgcttccctgctcgcgcaggtacgccgacgtggtggtgcaccgggtgctgatggccgcgctgggcctggcccccttgccggggtccatgcgggaccggccccgcgtggccgacaccgtggacaacctgaacgtgcggcacaagaatgcgcagctggcggggcgggccagcgtggaactgcacaccctcatcttcttcagggggcggactgtggtggcggacgcgcgcgtcacgcgggtgatgagggtgtgggggggtggtgtttgggaggagcaggtgggtgttggcctgcggtgtgccctgcttgcacaagggcatctcagtggagccatggtccctggggggcggaggctggcgtgctgggtttgtgagtggccaggccgtctatgtgggctgcgcttccagtgcccagccccccaagtaccttccaacagtgtcccaaccctcactcacccataatccaaccctccccatatcccaggtccgcgccaacgggctgctcgtgttcgtgcccaagtacggcatcgagggccccgtccatctggacgacgccgaccgagctggaaaggagggcgtcagcagcagcgccccggccgccgtcgactcagcgccaggcgccgtaccccggtttgtgtatgatgaggagaagcagaccgtgtcgcgggaggacggcggggtggcctacaccatcttcgacacctgcgccgtcaccatcagcgtggaggagaccgccggcaaccgccgggtactggcgctcaggttgacagaccgagcgcagctgcccgatggcgagcgcatgggctgagcgatgcactgctgctctgtgtggaggagcggtggctgctgcttggaacagatggattcttcccctgctgccagctgccccaatcctgatctgttctactggctggcaaccaaactttcagagtgcctgatccagtagttcgtgtgcatcgtgtaaggtctgcattccagctatcagaaagcatgcaggcaagtggctgtgcgtgcaggtaccagatgcctctttgaaaaggagaagggcggattcttggcatcggaggtcgagaccagctctgtccagacagccagatcgacgctgggcgccgcatgcatgatcaggcgtagttcaagcggaagagatctgcgtccatggttgtgggatgaggggctgaggcgaaaggaagattgtgaggcaggtacaaatggacggctcctgtcttgcaacagcctcctattcgaaatttgaccacactcgcaatgccaaaccgcatggtgcagggaatgccctcccagaaggaaccatgccagcataccactcgtagcccctgctgtcgcaccaccacacgcaatggcactcaccgttggtcaccacaaagctgccattcaggggcgccaggtggaacgtctgactgaatttcagggggttgctctcgccctccgtctgttggaagaaggagaatgggtgcagtgggacaccttgctgcattgtgcggtggcatgtgtaatattcatcaatacaaccaagttcccctccccagctctgcaagcgtttccctggcaaggcaacaccccccccatcaacacagcaatgcaagatgcgtacaatgagctgtccggtcacaaacaccagcactcctcccgaaacggagggctgggcatccgtcgacgagatgcgatgttgacagttctggaatggcagggaggccagcttctggacgatctgcaggagaacatgcagggagggtgggtgggaaagtaccactatgaaccctcccgcagatccacactcccgcccagaggtcgacgtcccgcatctacacgtcgcgtgcatccatcccgacgccattggtacctgctgcgcgccctggaacttctgtccctcgaaggagaggagggactgatcctggtacaggcccagcaggttggcccggttggaatcaaaggtggcataatagtgatctgtgaaggcctgtttgaggaatgatgggagaggaaaatgagcgaatcccggtatcatttcagtgaagggtgtcctggttcaccagagggactccgagtactcaccttagccactgcctcggggtctgccatcggatctactcttcgattgatacaccaataccacgatgttcttgagacaatcaagctgcgatggacttggacacatgaggatggaggtgagcagctcagggcaccgactcgctttccaaaaaattgtgcaccgcgcgggggacccactgcatggcccggaaccggacgtatttcaatgctagaaaactacaatacaggcataggcttggattttataccttctgagtactttaatggctctcaacggtcaagatgagccgggattatagctgaccgggggaggagtttcagtgtctcttctgcccctcacgacaccatcgagttgtggaccccagttccgtccagttggcttctcatcattcttctgtaaaacttcagaagaatgagtcaacacaacaccggttatggaggcttgtacggccttcgccagcggccaggtcatgggacctctgcctctcgggaggatgccacacaccctgcagcacaggctgccatcgccgcgggatgccgtccccggtccctgagccgggcagagctaatgaagttcccatactccacgaacagctacctcgaagctaggtgcgattgcttgtagtgacagggagcaaggggacgccatgtgggtccagggcaccctgcctcaattctacctctggtgaatctgctgtgcagagcaggcacctccctctgttcccttgcaggaaccatgtgctcatgcagtggcatgcagatgcctcagccctcctcacagaggagcaatgcgtaggtgagagacagatgggggcccgtggaggagtgaaaaagatgagggtgatggcagcctgacggcagagtgtgcctatcccgtccatgctgtgtttgaagtccctaggcagttgtgtgcccagagtcttcaaagagtcttggacttgaggtgctggggtctgcaaccgcgagccactggcacccatgctgcagagggcaacagcagcatgacccgactcccccctcctcctatccctatgccagccaccgccccggagcacctgtccctcacacgggtgagagaggcctttcagttcctggaccgacagggcatcatcaactttgggctggtgcggagtctagaggacgacaaaccagccgcatgggtcgcgacggtggtggatgaagccgcggtgtccttcactctgcacgagcttctggcttcagccgatctacaggttggcttggatgtagaccttgagctgccactctcctgtcatgctgcatgggcctggaccatggaccacatcctgggctctggctcgcaggtgggcgggggcatgcacagcaagattttcaccttgccgtcctcccgccctttgcccgcagactgtcactgagaaatcgctgaggcagcagctggccgagaagctggagaccgacatgggtccctacaagaagttcatcagggccctggtgcgtgctctctcttgggccgcaggctggttgtctgttgcttgcactgcgtacggcgccagctgcatttctctcaggctcaaaccctcaatctgacacccgtgcatggcatccgaccaggggtgcaggcttgtcctcaagagaacgttgcacacattgcactgccctgccaatccacaggtgggcgattatctagaacgcggtggccccccgcccgagttcttggccaagcaggccgccctctccgccgcagccgcgggccaggcggcggaagcggcatccaagaagaaggtgatcgtcattggagcggggccggcggggctcactgctgcgtcccatctccaggtgattaatcttgcagatgaggctgggcaggtccccagtacacttggtatctggatgtgcatgggtgtgctcgctacagcaaggaaatcactgaagaatacactgatgtccttctcctgtgaggcctgagcgtttctgcggaccttgtgctggccaggaaggcgatttcccacagcttataccaatgacaccccctgattgaattcttgacgtcttttcagccactgcaatcccattccaaacaccctcccccactcagaggcacggcgtggaggtggtggtgctggaggcccgggaccgggtggggggcagggtgcactccttccagggtcacggcctgcgcgcccccgtggacctgggcgcctccatcgtgactggcacggcgccggacgtgaagtcgggcctgcgacccgacccctccaccctgctcctccgccagctgggccgggacctgcacaccttgtcccgagacctgcccctccacgacgggcccgaccccgtggatgcgcagctggacgcgcgcattgagcggtgggtgctctgagcggggattggggctgtgcgttgacggggggaggaggtgttgcagccctcacgcacggcatgtaaccagggccagatctcctcaagccagggctcaaccccacctttgcgcaggctgcagaaccgactgatggacgacgcggcggccgcgctggcagacatgccggaggcggccagcgcggggctgagctatggcgccctgctggagcgcgcgctgcgtcagcgtgaggcggaggggacgctgtttggcagcgacgacgaggaggaggaggatgcgacggggggtgccaagagtgtaggtggcgacgccagggaggcaggcgccagggatgtgccagaggccgagggcggcgcacctggaccttcaggagcaaccagacaccctgccgaggtcgacgccgaggccgcggtgcggacctgcatgcaggccatgctgcgggctgtggaaggggcggaggacggcgctgagcctggaagccagacccccaggcggcgggtcgggccccggcacaccctcctgcccgaggagcggcggctgctcgagtggcactgggccaacctggagtacggctgctccgcctccctgtcagaggtgatcgacaatggaggcagcagaggggagggcgaggaaggcatgtggaagagtccagcgtgagtgctgacgccccttccttctgaacacgatctgccatgcactctcactccctgacaccctctggacccccaccgtacgcagatatcggcgcggcactggaaccaggacgaggagtttgggggatttggaggcccacactgcatggtccccggcggctatgacgccgccttccgagtgctggccgctggcctgccggtgcgcctgggctgcgccgtggacgcagtggctgacgcggcggacggggcgcgcgtgtctgtgcgcgtggcaggcgcccaggaggaaagactggaggccgacgcggtgatcgtgactgtgccgctgggcgtgctcaaggccggcgccatcgccttcagccccgcgctggcggcctggaagacggcggccatccagcggctgggcttcggctgcctcaacaaggtgtgaaggatgtgtgttgttcggagatggggttttgaaagggccatgtcaagggtgctgtgttaggctcggtaccagaaagcactgtgcacgccagtaccagaccatttccccaccaccaccacccgcaggtggtcctccagttcccccgcatcttctgggacaacggcctggactattttggcggtgtggcgccggcgggggagcagcgccgcggccgctgcttcatgttctggaatctggcgcggcacaacggcggcgtgcccctcctctcctgcctggtctctggcgcggcggcgcgccgcctggaggccggcagcgacgaggaggcggtggccgtctcgctgcgcgcgctgcgccgcctattccccggcgaagggacggtgcccgacccggaggcgagcgtcgtcacgcgctggtccgccgacccacacgcccgtggcagctactcctacgtggccgttggggccagcggcaaggactacgacgccctggccgcgccggtacgatcaattttcagggagatgacggcccgaatcattcttgcttgcaggcccggggagtggggcgcagggatcgtgcaggtctccggggtcactccggggcccgcatacccactcttggcttggccctgcgaaccttggagtcggccgcccgcgggcctcctcgacaacctcccccccctcatcccaacaggtgcggcgccgcatcctgtttgccggggagcacactgcacgtgcccaccccgacacagtgggcggtgccatgctctcgggcctgcgggaggctgtgcgggcgctggcgctgttggacggcagcgagggcctggaggtgtgaggggccgagggggggggagtgggtcaggggatggcaggtcctcggccgaccccagcctcacaatgcgcctgctcgggacctgttggctgcgtcgccgccgccgcccaccatgcatgcccctgcctgcacgcaggactacctgagcatgcaggagccgtcgaccaagcgggcgcgcctggacagctcccagcaggcagagctggaggagcgccagctggagctggtgctggggcgagacgtggcccggcgcatggacgagcagcgcgcggtgagagccgggttgagggagggcaggggggcgccgctgctgccggccgacgtgcgtggagggggccgaggggcgtacgggttggcacatggccgcacagttgcggctgcgtcagtgagtcccatggatgtgaagcgcattgcatggcgcccacacccgacgcttcattctccgatgagtgtgtgcccccgagcatgtcgtccctcagtcgacggtgggtctgcatgtcgacgctcatgttccacccccccacccccc

SEQ ID NO: 18700 - DNA, 491 bp, Chlorella protothecoides
agttgtagggtactccttatactgattcttctgagcctgtacggggagcattaggtactgatgtagtaggagttgagcttcacaaattcaccaggtaagcccaaatttattttctgcttggacaggtccacctcacatgggtctgtctaatatattaaaagagggattttctttgctgtattgcagcccagtatatctgttacttacagtagtagtccattattgctggcctaggggcttttgctcctacacgaacaccactctgtaaaatttgaggtcgtccttagagtcaaaccattcatggagcgctctgtgcatctaccaactatcgctaagcattcacttggttggtttaagtggaggcaactccattatcttctagcatacccttcccaggctacatgtagaaagagatctgttgggccccactattttttcacccagggaagcctactttagttatagcttgccagagattttctgtgtcatgt

SEQ ID NO: 18701 - DNA, 61 bp, Chlorella protothecoides
cattccttggcatgtcgagtctgctcccaaccccctagacatcccagcccctccccaacaa

SEQ ID NO: 18702 - DNA, 139 bp, Chlorella protothecoides
ttgaaaagattgagaagtttgaatgctatatttcgatgaattaagaagagataaacggaattcccaaattcttttcatctcagcctcattttttgcaatcaaatatttttttaatgatattcgatttaatcttaagatt

SEQ ID NO: 18703 - DNA, 3895 bp, Chlorella protothecoides
gtccgggtcgcggtcggcccccggcagcggctgcagcagccagcggtcggaggcggcggcagcgtcggcctcaagctgggccccgggctcgcaggccagggccggcacgccccccgccggccaggcacagctcagcgcggcggggaggccctcccccggcgcgccggcggaggccgggcgcgcgctgcgcggcagcgacggcgccagctccatgacggtgccgtagacccccaccacgtccagcagcagctggctgcacaggacctgcggcggcggtgtgggttttagaattggcataggggtgggggtcgcgggtcgctggttggaggggtgacggggggaatacatgatggggatcaactggctacgggcgtgtccttgagctgtcaccaccccgaccaccagggaggcgagcgcgcgcgggcccgagagcacccacccagatgcgtccaaggagggacaggcaggtgaggcacagcggcacgaagaaggtgagtgccagctgggccgccagctggcgcgcggcgcgctgcagggcccccaggaggcgggggacgaggcgggcggccgcgaggaggcgctgcagcaccgacacggcggcctggtggctggggaggagcctctgctcgtgcctgcaccaggggcaggtgcatgtggatgtgtttgtatgtatgtaagtgaggggaggcttcagcgtgaactgctggcgtcgcatgcacacttcaagacagcacgatcatgctggaactgctgcgactgggacctgtgccgtatcactcacccgagcgacaggtgcatgctgatggtggggagcgcgtggcggctcgcgccggcctgcagggcgtcgtggagggcacgcagcgcggcgtccagctgcagggatgccaacgagcgcaggccccgcctgacctgcggggagggcatggtggactctgagaatgtgcatgatggccgtgtgacgattcggacaacatgaagcctggtggcgagtgtgactcacctcgcgcagctgctgaaagtatttggcgtgccggtgctggtgcttgttccggtacagcaggcggtccagcaccatcgtctccatgtcaagcatggggtgcacgaggggattctcctgttgggaatcgtacaggtcatgacctggattgtcttgctcgagagcatcgatggcacagcagcaacatctcggcactgtaccttcgtgcccgtcaggccgaggccccgagcggccggggcgtgccgcgcccaatcggacgtcactgtgcagtgtagccgctccagcaccaccattttgctttcgttttccacaagaaaccatggtgggatgatctgggtctcccccatgcgcttgcgaccgacaagtaccttgctaaccggcgcgcccgcgcccgctttcctcgcaaaataccgaatctccccttagctgtccaaacctgacgtcgcagggcacgccaagcaggctgctccaaggcagcccgatcagccgacttcactcctgcgcagcgaaacacgtgattgtaacagctcgggcatagccccgcgcggttagcaggtcccaggagcgtggcgaagcgcgcacctcgccagatagcggaaaggccccgtcccggacctccatggccatccatcgcccgccctgacttttggactggatccgggcctcgagtttatcccagctattcgatttctgcccgacgaccgtcgggatctgtcggtgcgtgcgtggtggattgcccctggaccctcactcaaggttgggtgacgtgccagccccatatcccgacccacgcgcaggccatgacatcgctgccgtccccgctgtcggcctgccccgaccccaaagtcgcagacctggtcctggcggtcagggcctgcccagagagcgccggggcgtggtgggccctcctggcctgcctggaggcccggcccctgcccggcctggacctgctgcaggtctacacgcaagccacccgtgccgtgccccgccaggggaaccaaggctccgacgcctacgttcgtctctggctgggctttgcccgccagcagtggtgcgtcggagtgagcgtgagagagggcatgtcgagcgacagagggcccacagcacccacggcgcctgcagtgcttttgagcgtcatgccggggtccaggaaccatgctctcccccacctcccaccaccacacccctctccccccctccctccgcgcctgtatcatccaggcaccgggatcgcgacgacgcgcgcgacacgctgaagacgctgcgccgtcaggcgatcgggagcagctcccccctgctcttcctggaatgggcggcgctggagtgggattccggcgcgcgggaccgggcctccgccgtcctggccaagggcctgagggacggcgccgagccgccggccgcgctggaggcggccctggccgacgtggcggccggggtctggaggccggtgcccctctggcagcagtccgcagcgccggcggggccgcacacggccgcgctgacctgccccgccagcacctacgaggccttcgtgaccccgggcgccgaggcggagagacccgcgcgggccagccacacacacacgctggtgagcgcggccttgctgggaccaggctttccctttcatgggtgtgggagaggatgagggctggtgtgacatgaggagggtgcggtgcacggcacctgcccgcaccccaagcataggcttgataacaacgattcagggcagcgggaggcgccccgatgcagggcgcgtgtggccctgccgcagcgccgcagcgccgtggcgctgggcctgctgagacatgtgcgcgccccgatacttcccacctcccccgcccctgacaccctcctgcatgctcacccccacacaggaggccctcgtgccctcaggactcccgccggactcgggagcccctggccggcccctccccggctccagcctggtggaccgtggggcagcatgcgcgggcgtcgaggcggcccggggtcccgcgctgcttgcccgcctctgcgccggcgcgcctggctcggcgaccggccctggcggtctcggccagggcgccggggcgccgggcaccgcgctgagccgcggcagcgcctcctcctcctcctccaggggctccgaggaggccacggtgtgcatgggcgggcggcagtccggccccggcctcagccgcctcggcggggcggccaacgaggacaccatcgtcgtgcggcgctgccttgcgcgccgcacgccgcagtccgccacgctgcccctgcagcggccgggattcctcacagaaggcccgcatgtggagcccgcagagcccgcagcggcggcgccatcggcagcggggatggcaggcgcgagtaggatgacgccagcaggggggcatgcagcagcgtcggcgaccccgaacgaagcacaagctcccggtcttgcacggggcagtcgcgccgcggcggtgccaggaggatcggcgcctcccttgccgcccgtcgcagagcgcaacctgctcaggccgcgacgcatgggtgagtggaatgggggtgctgggctgggaaggcgggtcgagggggagtgtggtgtcgtggagactctgccgagtgctcaaaagcggcacagactcaccctcccaccgcccgctccgtccgtgacatgcaggtgtgctggggagggcgctgcgcgtggctcctggttcagactcggcgaacgagcccgcggcgggggacgcagcggcggcagggaaggagactgggaccaaggtcggcgaggcacacacagacattcggtcggcaggcgaggcgacggacctgaagcgcaaggcggcggcgccaggcgcaggaggggaggcggcgtgcaagcgtgccacgggccccccgcccagccccggcgacgcgcctggcggcagc

SEQ ID NO: 18704 - DNA, 61 bp, Chlorella protothecoides
ggatttgctacaacaatatagattacatgtttcacagagttgtgtttaaaatattgatttg

SEQ ID NO: 18705 - DNA, 7004 bp, Chlorella protothecoides
  modified_base (960)..(973): a, c, t, g, unknown or other
  modified_base (1157)..(1166): a, c, t, g, unknown or other
  modified_base (1220)..(1229): a, c, t, g, unknown or other
  modified_base (1283)..(1292): a, c, t, g, unknown or other
  modified_base (6311)..(6320): a, c, t, g, unknown or other
aactgaatgggatagactgttccgagaggtggttgagtgacagctgggagctcgtcgcgaccccttgcggggggacacatcgaaccccggaggtcagggcgcggctgcggaacccctgtcgcaaagctcaggggtgaatgccaccaaggagtcgagtccctgtcatagccatagagcaaaacaacagaagctgaagtttccttttggcaatcgcgggattctcgcctgtctaaaaagtgccgttggacacctgcaagtcgcggcgactactccacgctgccgttcgaggagaccggactttgttttctgtctcaacaggtatttaggttgtacagtttctgcaccgaaatatacgctgcatcacagatggctcggcagttgcgccgttgaacatcgcttgcgcccaaatttgcggcctatatgggcacacagctccatacaggggtacagtggacgcctggggtcttgcactgggggcctgttatgtgttgtaggggttggctagaccccaaaacgtggaatgctgtatatgacccaaggtgggaatggtacagacaagaccccggatatggtgaggggcgagggattcaagcactgtgccaggcgtcgtagagacgtcgcaaggcatttctgcaggtggaaagtatagagggctccggagagggtgcccgcacaacaacctccccaagccaaagtgcaggctcatcctcggcctgaggtgccttgtaagccttgaagacgtcgagctgggtcaggtgaacgtggggctgccaagtggcctcgtcgtcagggtagccctgccacttcaccaggtactggaagccggtggacgcgcttgtgcctgaggatggccttgacgaggtaggtgggcgcggcgctgtcgtcgatgaagacaggggttgggcaacgatcggtgtcgccatgcttgggcttcaagtagctgaagttgaccgtggaatnnnnnnnnnnnnnngtggtgatggtgaaggggcccataaagggagctgtcagcttgcagtcattgggcgccacaaggttgaggtgcgcgctgctcagcaagacgcgatcgccagtcttgaagttgtgggcctggcgcgtccagttggcctgcatggccatgcgggcattgtacttggccatggtggcccgcatgcgcnnnnnnnnnnccatcttcatcgactggggaagcgccaacgtcgccgccccagtaccgcgcactnnnnnnnnnntcatctttgtcaactggggaagtgccaacgtcgccgccccagtaccgcgcactnnnnnnnnnnggccgtgaaagtgtgggcctggtgcattctgttggcctgcgaggccatgcgggcgttgtacttggccatggtggcccgcatgcgctcgagggtctgctgcagctgcgcggcgcgctccggtccgacaatgatgccgggggtcgccggctgatgggagatgagctgggccggggacggtgagtcaacgccgtatacggtctggacggggctggcgccagtggcggcgctgacggccgaattggcggcgaactccgcgatggccaggtgcttgtcccagtccgtctcgtaccggtcactcaggacgagtaaaatatgcctcagcgtccgttcggtacattcggtctggccatctatctcagggtggcaggcggtgctgaagcaaagctccatgcgcaacgccccgaagagctccttccaaaagtgagctgtgaagcgcgtgtcacgattgctgacgaagacggtgtgaggccgggcaggcggtagacgcggtccaggaagatatctgcaagcccactggcagacacttcattggtggtaggcgcgcagtgcaccacttttgagtggtggtcgacgaaggccatgatggggtcgcagccgcttggcatcagggaaagccagtgaggaggtcctaggtcatggcttctcaacggtggtccagaatagacaaggccacggcagaccaggcttaggggtcaggacagcatgttgcgctggcagacatgcaggtgtggacggcttcgtggatgtcctgctccatgctggacaaggttagtaattttcaaacacgcatcaggattctcttgacgacagtgcggtttaaactcaggcataatctgcgcaggatgaatgtattttgatgtagtacaggagacttgtgtgcacatgatgaaaggtaggtatctgcaacgtctggtgccgtgagcagggcagattggacccggctgacaattgagtctcatccgtctgcagattcatgcaccaaacagagagaatgctgtgctgacagaataagctccctgtgataaaatcatatgggagtcctatgaagaaaaatgaacatttgcagcacggttaggtcgccctgcctcggtacattcccatgcgtcatcaatcagaagcagagcaccaggagctcctgggaggtccagctatgagacacctatgttcttaccttgacttacgtatgccataatagtttataatccctcatcgcataagttccggctagcttgagacgccgtggatcgggaagaggccaggagatagcaacgagaatcaggtaaagaaggggctgggtatgggttagtcatcttcctatcggaaatgacgcctgccaacctcctcgcttaacaacatcacgatggtgacattttcgaccgaaactggcacagatcgacgtacattagctgatcaaacttccgcatcttcattgactggacaaagcaatgcagcaggccggatcaactggactcgccatggaaggtgagaccccactttcctttgttcggggatgccctaggggatgcactcgatccgctgatacataccagtctccttccaattgatcattggccatcctcattctctgacaggcgaaaggatctccgaggtggacgaggccatgctcgctgtcgccgattcgttgtgaggaaggggtgggtgacctgtggcacgctatgcagccctcctatcttacgattcgtggtactgaacgatgtgattttcatatgtctgtgtctcatgcccagccaccgccttccctctcgcaagggcaacttttgggtctagtgtcattggcgacagggccgtgaagatggtcactgatgttgcggaccaacagcgcatccctcgaatcgaccttacatcgatggtgagagttgtgggaaccttacgtgaaagagtgaccgccaattcttctcatgtaaatgagaaagctcagctggatcgagcctgctcagtcatcccataactctcttgccctccttgcgcctatagattggtctctaccatactgcggggccccaagtctttgataaagtgctgctgtgcagctttgacggaggattcactgtgggactgtctttgacaacgattttgacccaagttggagcaactcaggaagacatcgtccagaccatggcgaaaactttgcgcggcctcctgatggtgtacggtttgtcatgcgcgatgccgttctgcatcggcgagataaacagagtgcccatgggcgtcttaacgcttgatggcaccttggtcagctacaaagaatggtcccggtaaggggaggtgttccgggacccaaggggggtttagggcgggcatgggtctgtatttcaatcgagaagcaggttgcgtggcctgctggaacagtattgcagcggttctgatcagattgtttgcattttgaggttgggaagcctatacccctagttagtgcaccatacatcttcaagtcgggcccttacctcactcacgttgcaggactgctgagaaggacacactgaagcgcctggacgtcgcgctccagctgacccaaatggtgcatgaggtgcaccagcacagggtgagatgcttgtgctgtggggtgtgctgcaagaactggtggtatgtggtcactccctgaagcacatgctaaagacttggcgctcagtgccctacacccacccacccacccacaggttgtgcatctaaatcttagacttgagacagttcttgctcgtaaggatgttgagggcagactggtatatttaaccggacttgagtatggtgaggtcgggcacgaggtgttctgatttgtcctccacaaaccaacactactttgtgtttgcaacacagagcaatgtgtcgtgcgtattctggcatgcatcaatgtgaggtatcagtgtgatcacgccatatactgtagcgccctcgacaatctcttgggcgcccatgctcccctgccactggtaccccttgcctttgcagctgtacctgtcgacgagaatgggctccgtcttagagttggtgccctgcagccactgatgaggaagtgagtcgattcgcagggctgtttaaggggtcctctgcttcatttggtagatgaggggatgtcaattgtgcttcacccaaagaatgccctattgccggctttccttgtgcagcatcaatggcaagtatgccagccccgagctgctcgagggggacgagaaagtgactccaaagagtgacgtcttccagctcggcatcatgctgtacgagctgctaaacaagaagacgctgaagaactacttcagacatgcagatgccgcctgtaagttgggaagagcagaagattctggagcatgcttaggctgtgtgaaagatcctcatcaatcacacagtgtccaccactttgatattctgcctcaccatccttactccactgacacgctctgacacatgggtgccaatctagcagttcctcattcccctgcttaaaagctcttcaggttccaaaccctcctgcgttcttcctcgtgtgctccgcaggggtgaaatccatggtcgcggatactccatacctcaagggcaatcccgcttggctggagacactggagtcttccctcaatcctaatccagcagatcgccctgatgcttcagaactggtcaccatgatggagcgagccaaggcccaccattacgatacaatcaatcccaacaaatccagtacgagctaactccttggccccttctttcgtcgtatcgtctagacgaatgcctgaggccccatgtttattccccttgatcctttgagacccacatgccgccacccctgtgattcaaacttgtttcaatgcttcaagaattccttcgacactttggtctgggatcccattcacatctatgagtcgccctggccaccacatagcattcctatgtgccagcatctcttcccacgcatgaatccatcatctgcttcccgccctccaatatgttttctaaaggagagattaggcaaaaaataatccataaggtcgtctcagtaccaaatagacgcccttttctactctgcaagggcactcgtattacacttccttctcctagtcgatacaaatgcagcgcctcaccgctgaagatccgcgctgaataagcagccctggtgcagctgcaatacgtaagtgctctatgagctccatccacgcaccagccacatcaggagatgaggggtggcaagtctaggtgctgacatagacagtaatgcagccacgccagtcgtatctgaaaggggcagggtccccacgaaagctagaaagggctacccgagtgggtaaaggattcagcttggcgcgtgacacagggctgtgggcaagctgttgctggcgagggagtcgcggaaaacgctgttggtatagcggctgggggagctccttgatgcggcgaggggatcctgcgcgggtatcgttcggttatgagaacctaccatggagattgccgggacattcctgatgcaatatctatgagctctatgtcggggacgatacatttgggctctgcctgaagtctccacttgctagggcgccggcgcgcgcaatgcttttgtgatggcatgggtcatcagaatgagatacgccagggcagagtaagccgatcgtgcaagcatcagacagagtgcactccacgactgcgcagcggttccctatcttggccctcctgaaggcagacgaccatccctgtcggcagcggtccagcatgctgtaaatatacttatccaatggtgtcgagcacccaacttactagactagccctcttggctcaaagtggcagattgtggtgatatttttcattgaggcaagcgcactgatgatcaccctaggagtccctcgatgctcgagcccaccctgccacttctctaggctcaccatggagctcacaagctgactctgccgaaattcttggctgggacccttagtcccggcctgctccggtctcgtcaaactgccctcttgactgttgaacctggtcagatactagagtgctgaaagaagtactcaaagcgtnnnnnnnnnnttctgccgaaatttttggctgggacccttagtcccagcctgcaccggtctcgtcaaactgcactcttgactgttgaacctggtcagatgctagagtgctgaaagaagtactcaaagcgtcagtgctgtcgcagattgtttaaacggttggtcacaggcttgggcagtccaagaggacggcagggtaagaaacagggcagattacagggggatggtcgcgacgtttgatcagcatactccggagaaaccccctgataggaatgcaaagggcttggaatgcagatgtttgattccaatttatggaacgagtggcctgaaggtgcatattgcggtgcatgtctgcttaaccaaatgattaaccccacatgcagcgttcctcataacgacttagctgcattaagcagcgcggtagatgactagattgacggcacaatgtattgatcgaggcttcaaaggctcccgctccatccaaaacgcaccttttaggaggcagagtgcttgactgagctaagacgtcaggtcttctgatgctacagagcagacagcactgcacgcctcgtgttcttcttgcccaaccctgttcccatatgctgcgagcacataccatgcctgccaacaagcctgaacccaatgagatcaagcttcatactcgttgttgcagcctactggatctccagctccttga

SEQ ID NO: 18706 - DNA, 62 bp, Chlorella protothecoides
atcctgaaactcaaagtctttggttaacagatatggcacatcatcatcttgctattgctgtt

SEQ ID NO: 18707 - DNA, 93 bp, Chlorella protothecoides
gatgcatgcgtaaagcagtggaatcatgcaccaaaggcggccatgtctccttggtacaccacgaagctcccgggtgctcccctgtctgggaga

SEQ ID NO: 18708 - DNA, 61 bp, Chlorella protothecoides
gcaggacttgggcaagaagctgctgtacaagtgggagttggaacaacgccgcagggcaaca

SEQ ID NO: 18709 - DNA, 490 bp, Chlorella protothecoides
aggcggcccggcgctgcacgccggggtcggcgtggcccagcccccgcgcgcccaggaagcccgccacgacgtggggcagcgtgcccgcggccacacccggcgcggccagcacgcgcgcgtatcgcacgcaggcctccagcacgcccagggccacgaggcggtgtgcggcggcggggtggtcgctgcgcatgacgcccagcgccagctccgccagcgcgcccgtgcccgggcgcaggtcggcgtcggagggcgcctcgcccagctggtacagcagcgccaccgccagctccacgccctgccagggcgcgtcgggggcgaacagcacggccgacagcgcggagcgcacgaaggccagcgcggcggccgggtccagccgcgcggcgttgcggaacagggtgaacaggtcctggcgccgctcggccatggccgcctcctcctcctcggccgcggcgcgtgcggcagggccggccggcgcgcccgtgggcaccgc

SEQ ID NO: 18710 - DNA, 182 bp, Chlorella protothecoides
ccataagatcaggtgtggcggtgtgctcccccaagcacccagccccacccctcccccacatttcagctccctatgcaccccgttatcactctatttacttttacaatccataatcattcttggtcgatgtttgaagtcaggcttgcaataaggaggctgtcgtgtaaagccttgggtccaag

SEQ ID NO: 18711 - DNA, 77 bp, Chlorella protothecoides
agttgccccacatgcaacaaagtgtcaaaatcccactttttcagaaattccttgcgaagtgcatcgggtcacctcat

SEQ ID NO: 18712 - DNA, 101 bp, Chlorella protothecoides
aaaaaaatgcaaacttatttgtgctccatttcctataggccctgacggtacacgagcttggattgaaaaaatttcttctgtttttggtataattccacaag

SEQ ID NO: 18713 - DNA, 13912 bp, Chlorella protothecoides
  modified_base (180)..(189): a, c, t, g, unknown or other
  modified_base (391)..(400): a, c, t, g, unknown or other
  modified_base (701)..(710): a, c, t, g, unknown or other
  modified_base (1310)..(1319): a, c, t, g, unknown or other
  modified_base (1724)..(1733): a, c, t, g, unknown or other
  modified_base (2409)..(2418): a, c, t, g, unknown or other
  modified_base (2471)..(2480): a, c, t, g, unknown or other
  modified_base (2562)..(2762): a, c, t, g, unknown or other
  modified_base (3025)..(3256): a, c, t, g, unknown or other
  modified_base (3346)..(3355): a, c, t, g, unknown or other
  modified_base (4520)..(4529): a, c, t, g, unknown or other
  modified_base (6450)..(6459): a, c, t, g, unknown or other
  modified_base (7020)..(7029): a, c, t, g, unknown or other
  modified_base (7464)..(7473): a, c, t, g, unknown or other
  modified_base (8090)..(8099): a, c, t, g, unknown or other
  modified_base (8460)..(8469): a, c, t, g, unknown or other
  modified_base (9004)..(9013): a, c, t, g, unknown or other
  modified_base (9211)..(9220): a, c, t, g, unknown or other
  modified_base (9576)..(9585): a, c, t, g, unknown or other
  modified_base (10168)..(10177): a, c, t, g, unknown or other
  modified_base (10652)..(10661): a, c, t, g, unknown or other
  modified_base (11030)..(11039): a, c, t, g, unknown or other
  modified_base (11689)..(11698): a, c, t, g, unknown or other
  modified_base (13047)..(13056): a, c, t, g, unknown or other
  modified_base (13308)..(13317): a, c, t, g, unknown or other
atccccggcccctgtcgtgagtccaccgccgccctcccccaagccctccccgccgcctcccacaaagtctccgccgcctccctctccaaatccttcaccgccgcctcccacaaagtctccaccgcctccctctccaaaggtttcacccccgcctcccgccaagaagccgccaccaccctnnnnnnnnnnacctaggcgatcaccacctcccccaagcaggaagccaccacccccctctcacaagccgtcacctctgccgcctgtcaagaagccgccacccccctctcacaagccgtcacctccgccgcctgtgaagaagccgccacccccttctcacaaaccgtcacctccacctccgaccaagaagccgccacctccatctcgtaagtcnnnnnnnnnncccttctcacaagccgtcaccctcgcctccgaccaagaggttgcctccagcccataaattcccccccacaccctcaagaaagtagctgcctgtgccatctgcaaggagatccccgccacctccccaggcaggttcgtcgcctcctccagcaaggagatcgtcccccaattctatatgaggcacctttaatgctccagcagatgtattttgtatacttccactttgaggggcccttccccagcccatgggtcgaacaccaatagtagaatcacagtgttgcatcttcttgagtctgacagcnnnnnnnnnncgtaatgctccagcagatgtattttgtgtgcttccactgtgaggggccctttcccagcccatgggtcgaacactaatagtagaatcaacagtgttgcatcttcttgagtctgacagccgcttccgcacctgaaacctgtcacccgtggagtctcaccgtgctttgcacccaccattcgttcgaattttctaccttggcgctggacagggtggccccgtcacttgtgaggcttacccatcggcactactgtcattgcccaggaagaggaaggtgtgatttcccatgagcggcacacctccaaagcaggaacgaccatactggtcttcttcacgggactgatcccgatgctgtttgccatagccactccaatgatatgctccatcttgcagctggcacagattccagctcagatttgcatcgcttctaccgggctgctgggagccacctcgcttcacaagacctgctgactcgctccccttgcattcgttccgagtttgctttccctctatgcttttgtaaactgcgtaatgtgcagactgaaacaagcagtgcgtgggggtggaatgaggctctggagcatgcttgcaagccgctgtgctnnnnnnnnnnaattccagctcagatttgcatcccttccaccgggctgctgggagccctctcgcttcacaagacctgctgactcgctgcccttgcattcgttccgagtttgctttccctctatgcttgtgtaaactgcgtagtgtgcagactgaaacaagcaatgcgtgggggtgggatgagactctggagcatgcttgcaagccgctgtgctgccccgtacagtacggagtggttgccacatggcagggagagctccaccagccagaacaggttggtgcaacttccctgggaatgcccacggcttccctctgacatgcttttatcggtgagggcgtggccggtagggtcctggacaacggcatccccccctgaatcccgccagcctaagcaaggtgcagcgaccgggcgcacccnnnnnnnnnncatcggtgagggtgtggccagtagggtcctggacaacggcacccctccctcaaccccgccaggctaagcaaggtgcagcgaccgggcgcaccccatgctcaacgtgcgtgtcctgctgcggccccctgccctcccaccctgtgaggccgccgtccgactcctgcgtcgtccatggttgccgtgcgcggtggatgccgccagcgataagcccggtgcccctctggagcgagggccagcgccggcgccggctggaggtcgtgtcggctgccggactcgcgccagcggcacaaacctctgcacgccgccgccacgccacgcacgttgctcgctgactccgcaagcgatccccttgagggtagtccagcgcgggcggagggctgcaagaagcagctagcggcctgcgtcccagccgtctgcccctcgctcgtccagtacctggtacttcagcacctcattcccccaagacacccagccggggaacagctctcgcgcaaacatctgtgcgaatgcaaggaaaggagggggggggtgctcaggtcgggaccggctcgggctcagcagccaggcactcatggtccctccgaggcttcagccgccccccccaccctgcgccagcctccacgcccagggcccaggctcacctccaggcactcgcctcccccggccacaagctccnnnnnnnnnngggaggggggaagggggtttgaggggccagaggggtccgacgacacggccccnnnnnnnnnngagcgatccccttgaggttagtccagcgcgggcggagggctgcgaggagcggctagcggcctgcgtcccagccgtctgcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcttcagccgccccccccaccccgcgccagcctccatgcccagggcccaggctcacctcaaggcactcgcctcccccggccacaagctccctcagctggtgccccaggtggggtttcctggagtgttgccccggcaccgaggcaaagacgcggccatccaggtgcttcgtgccttcgcccgcgggggggggcaccgacatgccctgccctgccgcacggcagatgagcaggggctcgtaggggcggcgatggttggagcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctgcaagcacgggcagggaagggggggaggcgtgggtgtgggctcgtgggtcggcgcgggggtgggagtggggtcgcaggggtggagnnnnnnnnnnagggggggggccgccgacatgccctgccctgccgcgcggcagatgagcaaaggctcgtaggggcggcgatggttggagccctgcggcagcggcggagggggaaaaggggtttggggggccagaggggtccgacgacacggccccgccgaggtcagcgacgcgtgacccggggccccgccccctcaccatggcgctgatggggcagccccccggggtcagctttagccagtgccaggtggcaacgtggcgcaggccccaggcgggcagcagctccgtttccacgaagcggcgcagccgctcgcgattggtcacccacagcgccacgacggcgccgccctcctgcgagcacgggcagggaaggggggtaatcgtgggtgtgggcacgtgggttggcgtgggggtgggagtggggtcgcaggggtggagatgtgcgggggacgaggaccagggcaccccgccgcccagggggtctcaccgcctcgggccgcaggagtccctgcagcggcaggcccagcaggttccagccgggcagggtgtggtagtggcggccccgcttcacgctccggttctcccagggggggtccacgactatgcacctgaagcggggccctcctgcgcggaggcaaggggcgggtgatcggggctgtgcccctggccggacgcggcgtgcgaccatggttgggtccccagggggggcatgcaactgggacggcatgcaggtggcccccgggctggggtgtgccaccccaggtatcccgttcccttgacccaccctgtagcagggggcccagctccttgacgtcagacaggaggaaagaggcgcgcgcagggagcagcacggtgtgctcggcggcccgggccaccacgaccgcgtcgctggcgttaacgagaagggtgccaaacaggtcccgctccgcaggcagcccctgccccgcgccgctcgaggcggcgcaggagaatttggggcgcaggacgcggcggagccccgccatggccacccagtcgggcccggtgcccaggggggccaggaggggggcaggctggcacagcagcccgctggcctgggcgtccaacccgatccagagctggtggggcttgagcggcggggcaccctccagcaggggcgcgagggcagccaggaaccgctcgatggcgggcgcgacgnnnnnnnnnngacccgatccagagctggtggggctcgagcggcggggcatcctctagcaggggcgcgagggcggccaggaaccgctcgatggcgggcgcgacgagggtgtgccgcgcgttggcctccgcccagcgcggatccggctcgcggcgcctcttcgccggggtgggcgaggcgatgggcgcagggtgcggctcgtcatggcgtgtgggtgtcatgccatcgggaggggagcattggataggtaacgatcctccagtgcccgtgtcgcgacagaacaccgccgtgtagggaattcagaggacctgtcggggatcttgcgtacaatgccgcctcgacatgcatacgccactattttctcagagcagggatggtgctgcgccgcttgtgcggatccgctcgttcatcgtccaattcagttctgtccagttacaccaaggggccccctgacagcttgccacccatcgagatgggtaggctagtttcttgcgcgcgattgcaggcgcctggctgcactctgcaacatccttgcaccaaggctttgagagggtaacgcatggcaaacccaggcaggcagccctccttccttgcaagtgagacacggagcctacccaggaggccacgccagctggcgcccgccgatgacatgcaggtgcaggtggtacaccgactggcacccatccttcccgtcgttgaccaccacgcggaacccgccggggcactccttggtgccaacctgcccggcaacccagaacaggtgacccaggagggccttctggtcctcacgcgccttggagagctggctcaggccgtccaccaccttggggatcacctgaaggagtgggtaggaggcacagccagggggattactggctagagcgcttgggtctggctgagatcagcccggacgttgtgcagctggcagttcaagcatactcacgaggaaatgaatgggggcctgaggggagacatcccggaatgccagggcctgatcgtcctcatagataatcttggcagggatctccttggctacgatcttgtcaaagatggtgggttgggcactcgtcgcggcgctgcgaatcagagggagggaacagtcaagacctggggccagagagtccttaaccccatacgcaaccgcaacgtccagcgagcaaacctcaccccgaggctgcagcccgagctgctgcctccgtctctgacgacattgctcggatctgggtttgggtaggtcgacggatcgctggcgtgcagagggccggccggagcacggagccgcacaatgtgagcttggcaggaaggagagagagaagcctcatgtgcacttctgatatgccgtcgtacttggaagaccgtttccaagtcggtaggaatggcacgatctcgacctggtcatcgtgctcacgaagtccgggcgcgaagtgggtgccgttacgcacagcccatcacgcaggcccacaagagtattcgagccgggagacaatgcagtctttacatgcctggttcttgacccatgaaactgcaatgcagcgccctgcaaggtcgtgcgggtggcgcatggaggggtggcttgctcgccggtgagcagcggttcctgaccccagacaggccacccctgcgtcgtcctaccaggggccagaggcatgagagatcactgaaggccttgcagacccagcaactgggtcatggaggacccagcatttcccgcatcaccctgggtgagggggtcctggtaaaggatcctgggcatcagctcttcaggcctgtctcgcccatgtctttggcggttgggggcgtgctgcctgccggccaggaccccgagtatcagaacacgcccccgcagcgccctcacggactcctcactgctctgccatcatgccaccgttccctcactcccacaggcacgatgctgttcgggtcagatgtcagnnnnnnnnnnggccggccgggcccccgggtatcagaacacgcccccgcggcgccctcatgaacccctcactgacctgccatcatgctaccgttccttcactcccaaaggcacgatgctgttcgggtcagatgtcagccaggaggacgcgtttgcgcagctggacgccgcgcatgaggcgggcgtcacgtgcttcgactccgctgagatgtatgcggtgccccccagcgcggccacctgcggcgcctcggagcgcatcctgggcgcctggctggcgcagcgcccacaggcacggcagggcgcctgcgtagccaccaaagtcagcggcccgggggccatgccctggctgcggggcgggcccagcgccctagaccccgagaacatcaccctggccattgagggcagcctgcagcgcctgggggtggactgcatcaacctcctccagctgcactggccagacaggtgtgtgtgggggggtgggggtttggtatgggcaaggatggccaaatgaaagggagggggctgagggggttctggggggcaccatggagaagagggaggcacgatgcagcnnnnnnnnnntgtggggggggggggttaatatgggcaaggatggccaaatggtagggaggggcctgagggggttctgggggggaccatggagaagagggaggcacgatgcagcacggggtggtggacgcaggaaacaagcctcaagcacatggccgcaccagcgtggtacaggcagggctggcttctgtccacccctacaccactgttcaccggaaagatgcctggcattgagagaaaggcatggcgcctggcacaggtcgcgctgccacagtcactgtcagcgcaccgtatcgccctacatgcccttgcatcagatagaccccacttgtgctgccgttgccacgccaccactcacaggaatgtgcccatgttcggcaaggtgaggtttgacccgaccggggactacccctcttgcgccatcgaggaccagctggcggccctggnnnnnnnnnnagcaccgtatcgccctacatgccctcgcataaaacagaccccactcgtgctgccatcgccacgccaccactcgcaggaacgtgcccatgttcggcaaggtgaagtttgacccggccggggattacccctccagcgccatcgaggaccagctggcggccctgggcgaggcagttgcggcgggcaaggtgcgccatgtcgggctgtccaacgagacaccctggggcctcatgcgcttcctgggcgcggcagggacctcgctgcctcgcgtcgtctcgctgcagtcggcctacagcctgacctgccgctccttcgaccacgggctggcggagtgctgccaccgggagggcgtcggcttcatggcttacagccccctggcggccggcctgctgaccggcaagtacgaggatgacaagggcggaccgcccagcgcaaggtgggcttggatgtgcatggagggtttgggaggtgtggtgggtcgggcaggcctgggaggttcgaggctgggcacaatagtgtcctctgggcaggggtttcgtggagtttgagcagatcgcctggctgcgatgacagggatggtggcctgtactgggttgagaggtgcagggggaggcgctccnnnnnnnnnncaggtggacttggatgtgcatggagggtttgggagatgtggtgggtcgggcaggcctgggaggtgcgaggatgggcacaatagtgttctctgggcaggggattcgtggagttcgagcagatcgcctggctgcgatgacagtgatggtggcctgtagtgggttgagaggtgcagggggaggcgctcccatccctgggctgctatatcggctcgggtctgagtgctttatgatcacagctctgcgccagaatcgcacggaaaggctgccacagcgatggggccatggacgtctgcacaagtttcagccccacgaacctcccacactgatacctgcacccaccccaaggttgaatctccatcgnnnnnnnnnnagaaggctgccaaagcgatggggccatgacagtctgcaccagctccagccccacgaacctcccacaccaatacgtgcacccaccccaaggttgaatctccatcgggaacggtattcagaggacggcaagcggtatgcacgccgggaaccggtggtggcggccgtcaggcagtatgctgagctggcgcgggagtggggcctgacgccggccgaaatggccctggcctgggtcctgaataacagcctggtcaccaccgccgtgatcggagccaccagcctgctgcagctgcgggagctcatcgccgcggcagaggggcggcccctggaccccgggttgctggccgcctgcgacagggtgcacgcgctgagccccaaccccacgccctgactgcatgtgggcatgcacagacttattggttcatgcatttaccgcttggtgacccatccacagtcgcggtgctgaatggacgagtggaggtgcggggtgggagcatggcactgcatgtggaacctggcgcgcaggttcaaaatatgcnnnnnnnnnntggtgctgaacggacgagtagaggtgcgaggtgggagcatagaattccatatggaacctggcgcgcaggttcaaaatatgcatggccgagtcccctccaacaatgtgatcgccctcaagaagaccaccgactgctctcgaaacctccaccctagcattgatatttttaataggcattgtgcacactctccgcagcgannnnnnnnnngtcaaaaagaccaccgactgctctcgaaacctccactctagcattgatattttcaataggcattgtgcacactctccgcagcgagtccgggacctcccatcctcccctcgaccacgccccgacacggtacgcctttccaccggctccgcctggcacggaacgcattgagccatggggaacagtggatccgccccggaaccggacacggatgagttctcctccccggcgcccgcccaggaggtacgtgaacgcgctggatcgctgccatcgtgtctagggacgggcactcaccggctgtcaccgaatcacaccagctccttaccgccccccccacgccgcagcccgctggtctgacnnnnnnnnnncctctggggacgggcactctccggctgtcaccgaatcacaccagctccctaccgcccccccacgccgcagcccgctggtctgaccctgtacaagggggagaggaacagcaagggtgatttccagtggaaggaggcggcaggcggcatccacgccagcctgtatgacgccaatgaggacgcgacgggccgcaggcccgagtggcactttgagctggaggggggtcctgtcgacctgaacgccgtcatcgatgacgacttcgtcttcgacctggcctcccgccgcgtgctcttcaccgtggacaacaccatctgggccctgcacacgccggcagggggagttttcgaggccctgcatgcaaagtacgagcgcgccctcttcgagaacaagtggggcctggaggacaccctggagaacaggaataaggtgggggtgggtggaccagatggagggtgtgggaagggcagggcccagagtggcagagaaggtggggagtctccctgggcactgccaggtcgtcttgcttcccaagtcctcatccctggtgcatggaactcatcacttccctcacatccccgcccccgnnnnnnnnnnggggcagggtccctgggcactgccaggttgtcttgcttcccaagccctcatccctggtgcgtggagctcatcacttccctcacatccccgcccccgctccctgtccccttcgcagatcatgggcaccgacgggctgcagatgatcgggaaggaaaccgcggagtcgctgcgcgcctgggccgatgacatggatgtcgacgtgcgtggtctggagaagggaggaaggggggccgtcgtgacggcggcgggaggcctgcctggttctcctgctggacctgccgggattcggtgcagtgcggcccctcagcagacattgaaagcgctcattcccctgccgatgtgcggagcccagtgccgatgtgcagagcccagtcccgatgtgcggagccaagtgccgatgtgcagagcccagtcccgacctcccatcccccaacgtaacaaccaaaccccaggtgccgacggcagcggagctgannnnnnnnnnaattcggtgcagtgcggcccctcagcagtcattgaaagcgctcattcccctgccaatgtgcggagcccagtcccgatgtgcggagcccagtcccgacctcccatcccccaacataacaacccaaccccaggtgccgacggcagcggagctgagtacgccgcctagggagcggctggtgggccgccgcgatgcaatccacggcctggtcatgggggcgggggatcgtagctacctgatccgggacggcgagatcaacgtcatgcgcaatgtgctgggggggatggaggacgcaggtgtggaaagtgggggggagggaagggggttgggaggggatccgtgcactctcagccccttgcaactccccggggnnnnnnnnnncatggaggacgcaggtggaaagcggggagggaggggggtgggaggggatccgcgcactctcagccccttgcaactccccggggtgtgggtgccgagcacattgaaggcaatgtcttttgcgctcgcatgctcacccttcctccctcattccaccgccccagcggtgaagctgtcttttggaatgcccgagtcggggggcacccccgggacgggccggcgcagcactcggcgctcatccctgggccccgcagccgcctcgggcggcggctcgctcacgccctcgcgcgcgctgctcatggcagccgagtccaagatggccatgctgacgccgctgcgcaagtccaacctcatccaggccgacatcgagacggggcgcgtggtgagtgagtggtccttccagaaggatggtgtggacatccccatggacgacatcgtgggcgacaccaaagcctcgcaggtgagaggggaagggagggatcctggcggtagtgttttgggggtagagcagggggatggcaaggggtccccgggaagtggcacatggcatgtgggcgtgctgactggcactgtggaccgccaaccagcgctggcaaggcagacccctgcacgccaaacgccatgtgctcttgatgccctccaactcgaacccnnnnnnnnnngctggcacagtggactgccaaccagcgctggcaagtcagacccctgcacgccaaacgctgtgtgctcttgatgccctccaactcgaacccccacacgaacccggaaacccacccaatacaccccttccatcccgcagctagaggaccggcagaccttcctgggcctgggcaccaaccggctggtccgctgggacatgcgcgaccgggcgggggtggtgcaggagatggggtcgccgatcgtgcagtatgccggtggcaaggactatgcgcgcaacaccaacttcacctgcatggccaccagcggtgggtttctgggagagaggggagagtgtttctgctgtcagagagggagaaccatccaggacgccagtctcagagcctgggtgagctgtcgcccagctcatggggtcgccatggcatcgacaaaacaatatgccctgctgccttgtgcccttctttcctcaaacagggtaccctttccaacatccttcatcatgcccccccttcaggcgacgggtacgtggtggtgggctcccaggacgggcgggtgcggctgtacagcgagagcacactaacccaggcgcgcaccagcatcccctccctgggctaccccatcaccgacgtggacgtgacctacgacgggcgctgggtggtggccaccgccgcgcactacctcatggtggtcatgaccacctaccggccgccggggtcggaggccacgctctgcggcttcacctcgcgcatgggcgccaacagccccgcgccccgccttctgcgcctccgccttgaagacgcgttgcgcacggtgaacaaaggcttcatgagcaatttctgcgtgatagggcacgcaagcgtggcttggccctcaagggccatggcaggaaatgtgtgcgcagccagacgccgtcgcgcattctctcgcacacaatcagatgagagcctgtccacgacccaccgccccggcctcatcccctcgcagggcaacgcgccattgcagaaggggcggttcacctgggtcacggagcgcgggcgccaggagcggtgggtggtggcctcctgcggcagctacaccgtgcgctggaacctgcgggtggtcaagacggccaatgcgcagaccgtgagcgggggcggactgaccaccgtcgaccagtaccagctgctgtccaaggaggagcatgtggtggactccgccttcatgcacgacaactttgccaggagtgagtacctttttctatgtcggagcggaggagagggggagggaagggatgtgttgagagcccactgtgtgcaaggtgggcgtgtggtaaggggcagcacgtgaagggggggatctggattgcttagttggnnnnnnnnnntctgtgtgcgaggtgggcatgtcgtaaggggcagcacatgaagggggggatctggattgcttagttggtcagggcttggggaatgctgactcgaggctatctagatctaccccggtgcctaccatgaaagtaataagcgaggcatgccttcacccacaggtcatggagagtccatggtggtggttaccgacaaccatgtgtacaacgtcaacgatgacgatgacagctcttgagatgctcccgatgcctccnnnnnnnnnnatgcctaccatgaaattattaactgaggcatgccttcacccgcaggtcatggagagtccatggtggtggtcaccgacaaccatgtgtacaacatcaacgatgacgaggacagctcttgagatgctcccgatgcctccgtctctggccacgtatcatcgctactgtgcatcaaagacgtcactctcatggctcgcattcctgggtcgcattgtggctccccgccattgcaagatttgcctgtaaggaggccactccaagaatggaacaccccaggctggatcccttgcctgcacaaacgatcacaacacgatattgctagctggtcgatggtgctatgctcccaaccctttcaatggctgacaaacaggagtaggcttagctcaggagtgcagattggtgcttccacggcaagggtcttggcttgggaaattactttcatcacgcgagggaagtgactgcatgccagcaaagtccaggcatgtgccaggagcccgaggggatcatacagatgttctcatctatatatgtgtatctctggttgtcaactcacgttggggatgtttgagatcttgttttgtgactcgtcaagcatgtg

SEQ ID NO: 18714 - DNA, 402 bp, Chlorella protothecoides
ggtgtggcaaagcggcgggcgggtggtggccgggcaacttctcgaacggcccacggctgattcttcttcttccacccagcaatctgaggtgccatgcagccgccaaggactggagaagagatagtgacccgacacgcagtccgcagctgaggatcgacgccgcgcctgcagactactttgggcacctgagcgaggggtggagaggagccgtgatctggtggcagaacccgcgctagctcgagatcctgctcgggtatggacacaatcgagcggtgttcctggaccccacgcatggcaacaacgagaacagggtatgtagggggtgggagaaggggacaacgcaatctggtcagtccagagtcgggcttgaggcttggctcggctcaccccgtgcgctgtacc

SEQ ID NO: 18715 - DNA, 167 bp, Chlorella protothecoides
tgtgctctgggcagcgatcgtgacggacacagtgtgcgtcacgaattggtcttacaagaccatgaaggcgaagtgttaaatctgtggggtgagtgcaagaaggttcgttgagacatcctgcgtgagcatggcgctggtgcaatggccagcacttaatcatctaagcg

SEQ ID NO: 18716 - DNA, 71 bp, Chlorella protothecoides
accttcagtggctatcgtccttcgtcctcccaccacctttcagacactctgcctcttggatccctcccgca

SEQ ID NO: 18717 - DNA, 153 bp, Chlorella protothecoides
ctgcccagccctcactgtggtcgagtgcctcgccaatggcgtgccgagatgcgtacaggatgcgaatgggaacctgggcaacggcaacgtggggtatcacaacatcgggcacaacaatcgaggcaataacaacagaggtgagtgaaccagggg

SEQ ID NO: 18718 - DNA, 61 bp, Chlorella protothecoides
tttgcccgtgcatatgcaagtcgaagcctcaccctcctcatccactctgccccgcctgctg

SEQ ID NO: 18719 - DNA, 62 bp, Chlorella protothecoides
ggggcgactggggggtggagccagttgccttggtgaattgctcgagctgtgcgtggagcgtc

SEQ ID NO: 18720 - DNA, 100 bp, Chlorella protothecoides
ttatatatataagagcattgtaaggttttataaaaatgattagaaattctaaatttttagattaaaaaaagagataatccaaccgcaggttcccctacgg

SEQ ID NO: 18721 - DNA, 6206 bp, Chlorella protothecoides
gaggcggccccggcgccggctggggtcggcgagccagaggccgtggtgccgaggcgccggcgcgcgggccccggcgccgcctccggtgcgccggtctgccgagggtggcgggctccgggagacgatggccgtgggcttgggcatgaggcacgagctgcaaaggattgcgcgggatacaaaccgaaaccctctcgtgctggcccaccagtcgatgccaccatcaccgacgccatgcacccacaggcacggcgctgcgggtgggcgccaccgggcccgtggccaaggccaggcccaggaaggccacgatgctgtctggcgtggcgcgcgcggcggggctgcgggaggcggacctcgcgacggcgggctgggcgctggcaatcgcggcgctgctgctctccgccctgggcctgtggagccgctcggactgagcggggcgccgctggtggcctgtgcgggcggccagcgagggggaggggaggggggccctcctgctgtcagttctccaggtgtttggtggagtgcagggacccgcaggtgcctcgccagtcgtcctgctcaggatacctggggccaatctcagatccagactgtgtgtgcctttgctgcttgctcaccgccaatgtagatccaaccctcctggatgagggattggcagggcttcacgtgtggggatgcctggacataggcaaggccgtgtcgaccacgcgcgcgcgctgtcacggcacggacgacgatgtggatcgcaactgccccgagcattacatggcttcatgcccatcatcgtgctgccctttccgcgcactatcaatgcggtagtcacaccattgcgatccgccgatggcatgcagggtgtcgtcatggctccggccccaccacctgcacccccctcgcctcgcggtgctcggcaggtttctgcccgagcgagtccagcacgaggcgcatgcgcatgccagggtgactagaaggtttcacacatgcaggacggccagctcagcggctcagctggccaccgagcagcaggccactcccaatagccagccagaggtacgacacgaacctgggggtggggtgtccagatggatgcgcgaggagtgcatgccgtcttggagcacgtgcttctctgcacccttattcaattttggacgtcccgtcatcccatgctggcagaccgactacgaggctgtggtgggcatagagtgccatgtgcagctgaacacgcggaccaaggccttctgcgcctgccccaatcagtatggtggggagcccaacagccacatctgccccgtctgccttggacacccggtgcgtgtttacctggtgcctttgaattgacagcatatggaagaggaggaggtggaaggggggcatccacaagctccgcaacgagctggacactgctccacggatgtgccatccaactgctccaaacgctgtgccgctcgtctgcagcatcccaccgtgctcccacacagctcccgctatcatactactcctagaaaccacctcaatgcctccccctcacacacaaccagggcaccctccctgtgctcaacgcagccgtggtggacaaggcggtgctgacggggctggcgctgggctgcagcatcgcgcgccactccatcttcagccgcaagcagtacttctaccccgacctgcccaaggggtaccagatctcccagcacgacacccctctggcttataatggcagcctggagattgatgctggggacggcacccggcgccgcatcggcatcacgcgcgtgcacgtggaggaagacgctgggaagctggtctacgtcggtgcccaggcactgacgggggccgcctctgcgcaggcggactacaaccgggcgggcgtaccgctgctggaggtggtgtccgagcccgacatgcgcagcgggcaggaggcggcggcctacggcgccgagctgcgcaggctcctgcgctacatcggcgtcagcaacggcaacatggcggtgaggaacatcaaaggagggcgaaaggggaggggcgggggggggtgtccgaagatgaggcgggtgcgagagtggaagggagggatgctgtggcatggacgctgggatggtggagccttgaagtttcggccagcgcagtccgctgcccaccgaccaagcaccactcaaccccgtcccacaggagggatcgctacgctgcgatgtcaatgtgtcggtgcggccccggggcacgactgcactggggaccaaggtggaggtgaaaaacctcaactccttcaactccgtccagcgcgccatacagtttgagatcgagcggcaggtgggtgggtgaaggaggacgaggaggaggtgactgtcagagggagggctgcccggcttggatgggctgccaggatcaatggaaggctagtgttgtccatctggttggccatctcgtcagtccggcagggacccaaaaggcatcccctctcttccatcctccgaccgcccttcaggtcaccgcgctgtcctcaggcgctgagcacgaggtggtggtggagacacgggtctgggacgaggcggcggcgaggacgcgcacgatgaggaagaaagaggggcaggctgactaccgcttcttccccgagccagaccttcctcccttggaaatctctgaggagaccatcgcaaggatacaggtgaggcgttgtctatggggttagacacgagagcggtggtgcggcctgcaggctacttgatgtctccctttcaccccctcgccgcccaaccccgcccctcccgcaggcgagcatgccggagctaccgcaggagaaacgggcgcgcttcgagggactgggcctgtctccttacgacgctcatgtcctctgtgacgacctggcggtcgccggctactttgacgcgacgttggaggcgggggcaagccccaagccagcggctaactggatcatgggcgacatcatggcacactgcaaggtgggcacgggcatcaagggctggtgcatgggcgagatggtgctgcatcaacggcttctcagcagtctttcgcaaagtgtgaaacaagaagagcagttacagtgcacaggcacctatacttatccatatggatctgctccaggctgcaaaacagttgcactcctacccacccactcatgtcctccccgacgcctacacacccaggaggcccacctcggcatggacgatctcctcctgacacctacaaccctggccaagctcctgggcctgattgagaaggggactatcagcggcaagattgccaaggatctgctgccagatctcctgcaaggcaaaggtagaatgtgcaagaggtttacttggtggcttggctggctgagcattgggcaaccttcattgttgagtagctgggctgttgagttcagctcgttgtcttctatggttgaaatcatccatatcattcgcttgttttgggttgaataaacattggagtcaccacaccctggttcagggagcggagatctcctggcctacgtcgaggccaagggtctcatacagatcagcgatgaaggcgccctgctcgacatcatcaacaatgtcctggagtcgaactcaaagcagctcgagcagtacaagcaaggtagggggttttggaggggaatcggtaagggtacgcgtcgtacaatgctgggaagtcgtgcaacatgatagcgaactcaacccaggctcgtcacatatttggcctgggggattggagccactccctacatcgtgcacctcagttaaagggcgcggtaccttgatccaaactctaccctcaaacctgcagggaagacaaagctccagggtttctttgtggggcaggtaatgaaagagtccaggggccgagccaacccaggggaactccagcgtctgctcatgcagcgcctcgccgaggaggcaggccaatgaagccggagggaggcctggtctcatgttacccttgcatccaggtgtgtcccaagtccagtcagtaagtcggcagaacaaggaaatcatgtgcaatgatcggctcagaccttgtttggaggacctctctccgattacaggcgatgatgttgcgcccctggccagatcaccgccgagcacaggcacggacaccttcacggcttcaatgcagccggtgtgaatccaagccagcatcattcccttgcaagcaatctacaaagggattggggctccttctccccgtgtccgtgattcgacccacgatgcgaaagtgatcgcttccatgggtgacccagcacgggcccgcgcctggctggcggacatatggagccccgcggtcatggtggtggccagccccgagacggatgcggcatgcctggcgagcacgggcctcacggtggtggagctgctccgtccctttggcgtgataccccacctgaacggcactgtcgggggtgagcgggggaaccggctcatcccaagtccagggacgaattcgcaagggttgccttgggggaagaagaaggaatactggctgcttgatggatcgagtccctccctgcctggctggtagcccctcatgctccccccgctggccccctaaccctcagtccccatccggactgcggcggagcaccccgtcagactccactcctggcgcctgcgcttctacgccccccagcacatgttccagcccagcccggcggcagcagacgcgcacctgcgcggtgtgctcagcgctgccgccgcagcgggagtgatgagcccggtccccgacctggacactctgatccatgcaggtgagggccttgggcgggtcgtgcagcaattccggcatcgtgctgcgcttcactggggccagtggcaaggccgcagaccagacctcaagtctcggcgctcatctgagggcgctacacgtcggcaacccattgatcgtagtcaggcaacccccaaaccatgcaacgctgcagggagtgtgagcgaggcggcgccctggtttgaggtctaccgcaccgagttcttccgcatgatggcctttggcgagcacgagacgatggaccaccccgtggcctgtgagctgggaagggtggcgtgcaggactcagggatggcgtgggaaggaatggcacaggtgtcccacacagcagcaccacaggctggcatgctgcaccggcattgcagtggcttgggatggtgttgtctgctctgcaggccctcctgtttgcgcgctgaagctcctctcgaagcccaagcatgcggcaaacccatgctgcactcccctcgccctgatttgacttcttcttcatacgaccccacccccctgcccatcacccgcaggcttgctggtcgtgccttctacacacaggggcggcatgggggctgccttcgaggagctgtacgcccgcgcgcccctgccccccctcatgcgctccggcgccatggaatcctccctcctgcgcctccacctcgtcctgcatgacgcccgcgccagcagcgcagaggacctggagaggtaggcgacgtcggtggctgggaggaggggggaggggggtgagtcgtggccacttgaccaaggtgccgggccaagggaccccaagcccctgcctgtctgcttgtactgggcgctcttggcatcgtatcagtaaactatccgaggcagtcccctgtcaaaccccacccatcccccccgcctcacccgcagggctgagatggagctgagggccgtgagttcccagctgggcagcgcatgccaaatcctgacgatcaaccacgggtccgaggagacccccgtcatggacccgcgcttctggatctcctccatggaaggtgtgtgttttcatgatggggggtgcgcttgtcaaaaggatataaaaaaggggcgctctcatgacacccatccttgcgtgcgtcgtttatactggcattgcttgatgctggcagttatttggtcaaaaggaatgtcccccccacccccccacccccgttaacacctacagagacgctgcccggcgggggcgccggggagccgccctcccgcacgcccaccccggctgagggcctgggccggcggctggccccgcgcgacgtggaggcgctgggcgactacgttcgcgaggcggcggtgcgggtgctcatcccgcacctggaggcgcgcatccgcggcctgaacgcgcacgtgtcggacgcgcggcgcggcctgcggaaccagctcaagtcgctgctgtggcgcggcgccagcgcggggggaggggcggccgccgcgcccgcctcgccg

SEQ ID NO: 18722 - DNA, 73 bp, Chlorella protothecoides
acccagtctcgacacttgacctgcaaggtgagaccagcaagccttgcctgagaaaagcaagaccgtggtcgca

SEQ ID NO: 18723 - DNA, 61 bp, Chlorella protothecoides
tggccgcctcggtgtgctgggcgcctggtcttgcgtcgtctccttgtcctcagccagcccc

SEQ ID NO: 18724 - DNA, 80 bp, Chlorella protothecoides
gtccttgtcaccaccatttagtgtactcgatgtcatagcccttggcaggtagctcagtcaccgtcacactgactgcgcat

SEQ ID NO: 18725 - DNA, 61 bp, Chlorella protothecoides
caggcgaggacatcaacgaatggctggcggggaacacggtgtttttctacaacgcgctcaa

SEQ ID NO: 18726 - DNA, 61 bp, Chlorella protothecoides
ggagaacctgaagctggacatgcgcatgaacctcaagagcaagaaggtgatggggcacaga

SEQ ID NO: 18727 - DNA, 348 bp, Chlorella protothecoides
caaatttgtatttattacggagtaaatacagttaggcacagcaaatacaatacttatactttatctataaaaaaaccgttatatatttcattattattttttctaatttaaatagagaattacggatctttgaatcaaaagattctacttgtaaaaaattatttatatgttacaaccgaaaaacacaaaatttcgtaaatttcaaaaatcaagagttaaaggcgtacaatctaatacagatcaattaagatatggtaaattcggtatcaagactgtttcagctgctagaatacctgctagaacgattgaagcggttcgtcgagtgatcactagaaaatttaagagatt

SEQ ID NO: 18728 - DNA, 68 bp, Chlorella protothecoides
ccgcttgtcccacagatgaagccgcggtcgacccaccgtcccgctctgacaccaacaccccgcgcccc

SEQ ID NO: 18729 - DNA, 79 bp, Chlorella protothecoides
aggggtctgggcctgcagcgtctgcatgccgcaacctacgcctgggactttgaccggcccactcacgcatgctcaacct

SEQ ID NO: 18730 - DNA, 72 bp, Chlorella protothecoides
ttgaccggcccactcacgcatgctcaaccttgctgggacctcttcaaacgtgcagacgcggggcggcagcag

SEQ ID NO: 18731 - DNA, 79 bp, Chlorella protothecoides
aacgaattataaactaaatcagcaatttgattcgtaccctcataacctaaaaacggtctataacctaatgggaaatttt

SEQ ID NO: 18732 - DNA, 76 bp, Chlorella protothecoides
gcacgacgccgacctcctctcaaccccatgttccaggtacactgcatttgtggagatcatggtgcccatggtgcgc

SEQ ID NO: 18733 - DNA, 66 bp, Chlorella protothecoides
atcttgcctcacctcacccttcacatgagacccgctccctttcccgaccacctccccgacagcttt

SEQ ID NO: 18734 - DNA, 65 bp, Chlorella protothecoides
ccgtgtatgcatgtagtatacatatgagtgagtgagtgagtgtgttgtgttctctagcgcctaag

SEQ ID NO: 18735 - DNA, 5407 bp, Chlorella protothecoides
ccccccctccctcctcgccttgatgctctccgtcctcctcttcagctgcttgtagaaggccggcgcgatgccgcgctgcaccagcaggcgcgaggtggagctgcagatctgtccgttggtccagaacacgccaaacatggcccactccaccgcgcgcgccacgtcggcgtcgtcgaagacgatgagcgccgacttgccacccagctccatgactgccgggcgcaggttccgggcggctgccaggtacaccgcacgccccgtgcccgtggacccggtgaaggccaccttggcgacgcgcgggtcggcggacagcggcgcgccggcgtcagggcccaggcccgtgaccacgttgagcgcgccggggggcaggccggcgcccgcggcgatgcccgccagctccaggctggtcagcgaggcggcctcgctgggtttcagcaccgccgcgttgccggccgccagcgcgggggccaccttccacgtgctcatcagcagcgggtagttccagggcgtgatgagggccaccacgcccagcgggtcgcggcgcagcgcacactcaaacccctcggcgccgaggtccacaggctcgtactgccgcgcgtccagggccgccgccaggtcggcgtagtagtcgaagcaggtggccacgtcgtcctgccacaagggaggtggaggagagaatgggtgatcgtgcattgctctgagctaggaggtatacgcttttgttgaaggctcacagccccgcactttgccctactctgccgggcatgcgggcaccctgtatggtctcaggctaccctggcagccaccctcttaatctttgccccagcacaccagtgcagacagacacaggtcactggaaagcgtccatacaaccccatagcacaccaatgcacaccacccaacgcaccacatcccactccgcctcggccaagggtttgccattgtcgaggctctccagggtggccaggaaggtcttctgctcgcgtacctgccggccgagtgtttaatcttccagttttgacacgcagggtgcttgatgggtgtacattggggggggttcaggtttcaggcatacaggcacaaagccctgggcacagaaccaccaccctcctgtcccccaaaccccatccccaatcacacacaccttgtcggcgatggcatgcaggatcttggcgcggtatgcgcccgtggaccgggtccactcgccgctgtccacgcaggcctgggcagccgagacggcggcatcgacatccgccggggtggcagcggggatggtgccaatctcctcctcggtggaggggttgatgacgggcagacgaccacccttgacgggctcaacccatcgaccgccaatgaagagctggcgcttggggatcgcgacggacatccttgggctcgggctggcactagggttggagcgtaaggtggtgagcgctttccgatacgcaggtgcttcaatgcctgagctctctcacaggctgctgagcaggtgaataaatccttgacctttggaatatcgttcggtgtgctctttgaaacgcgacacaggctctttgcgcccttccattaccctagcaccgggtgccgagacggaccgaccggaagctcggccatttcacgcgtagcagcagcatgggggccctccccacgcacacaatgcttctcctttccagcgtcagaactgtggcgcgctgtatatccaagccagcgtatcgatcaacctatcaaagcagggcttccactgttcccagagtggttccttaagaacactgggctgacacagacaggatgctctgccccagggtgttgacgaggttcatccatcaccatattaaacacacctctccacctgtgatcaagccattcaataaatgaaagaagtccttgaaagcccgccacacctttcaccggagcgggcaagtgcagaaacctagaactagggaaagatgagggtaatgctgtgtctagagaaaggggcaacccaatgcaggtcgtcagttttgtgtgctattctcgacgtagctctcgtacagggccgccacagcatccggggtgagagcctgcgtggggagagcggtgaggagccgtctcaggggagcaatgcgctgctcggagactcagatggaagccagagactgtggccgtggtcttcagggtacccaggccacgcattgccagcgtaagcatgacacactgatgccaccacccctcgtacctctgggaagagggacaggtgcgcaaggaagccgttgaagacgttggcagtgtcgttgtcgatgctggagcagagctggatgggcttggagagccgggtggggtcgccgccaggcagctggccagagggattggagtgggtgggtctagtcatactctcgcactgatagcctcggggcacatggcaaaggcgccttggaggctacgtcaccagtgatgggcagcgtagcaggaccatgtcactcccccaaacgcgcacctgattgggtggcgtgttggggctggcccaggctgcgctcccagcaaaggccccatccaggtagaggctgtaccccctctcccccgtgccggcctctgtggtcagggtcaccatgtgccagcccccgtctttgcacgcgggaaggggtggtgtagaagattggcattgcgcatcgcgaacagccacaacgcaccccagcccagacttgtgagagcgggaggcacgcccttgaaggacaagtcacccacggccattctgcgggacatcagcgctccattgatgtgcaatcaaaggcacctgaacttctcatcgtacactgccccttgcttcctcccgcggtgcacccttgcacacgcatcccgggcccatgtcgccacctctttctgcctactgttccaccccaccacacacacacctaggaagtctgtcgtgaagatggcggtgccgttgtcgggcccagcaaaggtcgtgccatcggtctggaccgacacaaactcgtcggggttctccaccgcatccttgccgtcagagatgagtcccaccagcagtggcccatcggtcttgctgctgcgggccaggaagatgaggacctgcatgggtgcgcgttgggcggcctggcaacgatgacagagcaaggctgtgtactcctgggtggtggtggacggtccagctggtgctgcgcacgaccagtccatgcctctcgagtgcagcagcaaccgcggcgcggcctgggctgggaccacatcctttcgaccttttcctctctcctccttggcacagccttgcacctggtttgggaggccaatggccaccatgtctgagtctgtgtggctgaaaagccacttgaggcccatgagtgggatggagggctccaccgcaaaccacaggttcaccgcaaagaagccggtggtggcgtagggcacaggctccaacttgatcctgctcccaagctcctgtgagatttatgggtggggaagggtgatgactcactgggcaggcatgccgattagccggcaagactgggagctgctacatggtagactgtgccggcacgagcctggtgtggcggtgtcagagcatctgacaggggcatgggacgcatgggcatcagcatcagagggcctacagccagcgcacccgacttccccaccacctacaccacgcccaccttttcacacttgaccgtctggttgaagtcaaaatccaggtcaaactcaatgttcctggctgttcccgtgtagggtgggagcaggagggagttcaggccctgggcactcgtcagcgggtagaaggccaggggctggggggcgcctgcagtggggcggcgtgattgggtatcagcctgttcctgatctcggaatcgaatgctgtccttccacaggcatggacatgtgccacaactgtacaattgaaggtgtggtcttcatctcacagcacaccagcataaagctcagggaactgcaatcttccccagcaagatgcaaggggtcaatctgccaccagtcctcaaccgtcaaccagccacatttcgtcatgctggcccagggaaagatctcgcagaaaccacccttccctgagatgacgagacagctcaaccacacctcctttcccaatcccctgtctcatatcttacctgcagactgcagcacctcaaaagtgttgaacacgccacccaggggtgtctccgaacagaatcccaggttgttgaactcggcgtatccctgaggtacatgggatttatgtgttgggaggatttctccaacggtcttctcacccgtattgagacgcttacctggcaccagatctacctggacactgacgatcaaagcagcaggcatgggttccagtggacattccaggtacaaaaacccacaccactcaacacacgcaccccgcgaacaagtttcagatgtacttccacttacactcctcccttcccccccttaccgtgctcccctccagcggcaggcagggcagcccctcctggcagggccacccctcctcctccagtctggggtccagcacgcacatcatggtcagcccccccggctgtgtcctgttcaggaacgcgtcgccagcgtcaaagtcaaggagtggggtcgatgccagcgccgggctgcaggggctgagcgcgatggagctgttggtcagggtcccagccccaagtgccgcctccgtggggcagaagccatgcgccgacgagttgccccgcccgccgtccacgctgctcgtcaggcagtccatatagatggagcccctgggaacgtgggtttcgggagggagggcatcaggaaggtgagatgggaggcatgcaatcgggagcctgcctgggctgcggcccgcgccagctctgggctgggaatcagagcgctgctgctctgcatcggtggcacccaggggagcacgttctccaggggatcttgctccccttcctcccagttccccctccgcccatcaacacaaactctgagcccctcacccctgcacgaaagggagggcgcagggcgcgccgtcctcggtcgtcctgggggcgaacatgagcggggccagcgtcgccttgtccctggccgtcgtctgcggcgcgcaggcccgccgccctggcaggctggggcagacctcgtcgccccccgcggccacgcagtccgtcagaacattgcggtcgacgtccacgaacggcagcgggcacactgtgccgtcgcgcagcttgcggatgcgagtgggcaccaccgggatgttgccctggccgatgtcgcctgcgcccgaccgggcctgggtggcggggttgcacgccgtccacctcctggcctgcgtccagcattgcagggacacccccaccgacaggcagccgtactggggctccccattcaggatgaggggggtgacgcagggctggccgtccaccccgaccaggggcggcgggggggaggggttggt

SEQ ID NO: 18736 - DNA, 130 bp, Chlorella protothecoides
agaactcatatccggctgggagatattgcaacgtcatcgcctatgagagtgagtgcagtgctgcgcctgaatttctagggcagaagttgtgaatatttgggcacatgtgcaaaacagattcaagcatcag

SEQ ID NO: 18737 - DNA, 137 bp, Chlorella protothecoides
ctccctatttttttatgggatgggtctgatggcctatacatatatagaaatttagaagatatacccagaatttatttggtaactggagtgaagtcgtaacaaggtaaccgtaggggaacctgcggttggattatctc

SEQ ID NO: 18738 - DNA, 74 bp, Chlorella protothecoides
ttttttttaatattttgaaatttcaatagcctactatcggagttgaaccgataaccttcggtttacaaaaccga

SEQ ID NO: 18739 - DNA, 197 bp, Chlorella protothecoides
tttttaaaaataagtatatatataaattattaataaattctactaataagaaattattaaattttattaataataaaaaataatcttaaattaatcatattagtacttatacaagtaataaatagtaattacatacaaccagttttttatattatatcataaaaataaaaaagtgtaaaaatcgtaactttttacac

SEQ ID NO: 18740 - DNA, 67 bp, Chlorella protothecoides
cacaggccactccttttattttgtagtcgtggtgggagggggggggcaatacactgtaggatcgtcc

SEQ ID NO: 18741 - DNA, 63 bp, Chlorella protothecoides
ctgccaaggccgacgaggaaacccctgacccttgcagcatgtcgattccagccaagccggagg

SEQ ID NO: 18742 - DNA, 67 bp, Chlorella protothecoides
ccgccattgggtcctcagtccagatcgagtcactgcagaatggtggggatgcgggacaaattagagc

SEQ ID NO: 18743 - DNA, 77 bp, Chlorella protothecoides
gaggctcgcatcagcttgcatgcaaacttcggagatttaaaaataaattccagggtcccttccatgttttaagggac

SEQ ID NO: 18744 - DNA, 72 bp, Chlorella protothecoides
ccccctgtccctcatcgttcgacggtgtcccctatgtatgcccgcagatgaagcagcacctgagggaggtgg

SEQ ID NO: 18745 - DNA, 61 bp, Chlorella protothecoides
aaccttccagctcgacatcccccggtctggttccatgcggatcagtatcacatcgtagagc

SEQ ID NO: 18746 - DNA, 74 bp, Chlorella protothecoides
tccatgcggatcagtatcacatcgtagagcgcacccgggtcaaacacacggggatggcctcgcttcaaatacca

SEQ ID NO: 18747 - DNA, 2988 bp, Chlorella protothecoides
ggcgggtgggtgggcacggatctcggctatggtgatcccaactcagtcagggaggcaggcggtacgttgggtggcagcgaatcgcaaaggtcatggaaatcagcccctcaaggcgtgctgctggcgccttgcatcccaacctgtaccccagcaccctacctaggacccccaggacggtgtaggcagcggccaggccggtgggcacgctggcctgccagtcggcctgcggatcctggccatggatggcgaccaccgccgtcatacctcggtgttcgagtgtctcgccccgggtctagggcgggtcagaggccgtgccagcgggggggcctaatgccttgggggccctgtcccaaacccctgcacatccgttgaaatgccgacgagccttcgtccgacatattacatcagtgtgcttccttattatatgcaggaaaatggcctggtattcccctctgtctgggcatccgtggcacgatcgatctgattcaaggcaggtgcgcgcgtccactcggaatctcgggtatgaaattgctgttgggtgaagcagacaccgagtcgggcctccagacggccatctgcgctccactacacattgtaacgctccatactacatacctgccctatcagcctgtgtcccgggctgtcgtctccggggcttcccttcccttgtggtctggcgcgcgtggggtctgctgtccgacaagcataggcgagctgcacgcagggagtacacgcacttcattgcagtgatttggaatcgaaaatcaccggaactcgcccctggccaccccccgacccactcgcaccccctccctagccggtgcagataaactggcgtgggcgaggagcctggttccccgcggcccgaaccacccggccagccacgcactgctcccccggaatcccgaggaatggccacgggagggggagaggaccccccgctgcagccggacgtctcccatcagccctccagggggcctggcatgcggcgcccgacggggatggggggcgaggacgactcccacgcctccccatccccccgacactccgcctcggccacaggggcccacctcctgaacaagcccacgctgcgagagcagagcggggacatcatcctggaggaggccacggccctggacccgcccaacggccgccaaccgccgcccctgccgccggggctgccgcccagcacctcgccggggctggcccacgtcccggagcgtgcgcacgatcccacgctccaggcctacatctccaggaccaccaacacgtcggactgggtggcgcctgcagggccggcgagcagggcgccccagggctccgtggaggctcaaggcggcgcctcgcggtatgctctcggcccggggcgatgatgcacggatgtttttggaggagtatgtgcgtgctggggagccaatggattgccgatttcctgccaggcaggatcggtcaggccggcgccgcgacagattgcaagcctggggaatgcggatggcatacatacatgcacgatccttgcacgatcttgcccctcaccaccgcccacccacaccctcccttttccccggcccccaccttgtgcagcgctcgctactcctcagtaacacaagactcatcggacgcggggattccggccccgtcgttcaggagtctactcacgctcgagaatttggatgcacttgcacaattggagaaggccggcggcaggacagacgcagcaggtgtgggggctgtgtgattctgggggcacgccactcggcaggggtagcccacattacagtgtacgcccaaccaccctctgccgagacgctgggccatgcgaggacgggtcatgggtgcttgtagtcgctgccaaggtggcatgtctgggctgcatgctccccctgagccctggtgcccggacgtgcaggcttgcccagctcgccgcccacaaagaccatttcctccctcgcgcagatcggttgtcggagtggttgcaaagttccgggccacccttcgagaccagtccgtcaggtgtgcagcgtggtcgggaggggtgttggcgcagcgctgtggcggcctgctcatcatcaccgtgcattgcgacgctgcaccttcgtctgcctgcagaccttgcatgcatgcatgcgtctgccgcatcagtcgagcatggccactggattcgaccatccagggcttccgcaagccctccctcccaacgcctcctccatctgaattcctcctttcccctcccaacatcccaacagtcggtgtggcgcagcgacacgcagcaggcacacatgccctgactcacgccgaggggcccgggccgccgggcaagaccccggggcggacgcgagcctggtgctgctgcagctggctgtgtggagggtgacccggacccggcccccaccctccagagccgattgatcacccgccctcagcgcccagagtgcgcccagctcccctgcctttgctgcgggatggggcgccgggcatgacgcatgccaccccctcgacatgactcaagctatgcgacatgccacggataccccggactgcccgggccgaacccaggagtccatgctgggtgtcacatacaacaaggttgggtcaggagggggtgcgcagggtggcagcacgacagcaggggcaggggggcagtggtgaccccccctcatctcgcgaggggcaacggtgaggagtggcaggctggcgttgcaggcgcacgttccatagaatacagtacaaataatgggaagtatcaggaaaaaatggtgtccacgaaatcctccgtggggccctgggcatgaccatgggggaggggaggctgtcaacacgaatttcatgtcaccacatgacatacatctcccctggatcacaagagggagcttcctgtggctgtctggacacccaaatctgacgagcgaccccgtttgctttcacaatcacctcccagtcctgggcgccccttgccatccccgcctcactcttcaagccacctccccc

SEQ ID NO: 18748 - DNA, 79 bp, Chlorella protothecoides
gctggcggccttgtcctcgctgggcaagggatgcgcggcatcctcctctccggcgctcatacgcgcaccgccccccccc

SEQ ID NO: 18749 - DNA, 61 bp, Chlorella protothecoides
gccccagaagtagctttgcggcgtgcggggtcgacgcgggcgctcccccgcccaggaatat

SEQ ID NO: 18750 - DNA, 128 bp, Chlorella protothecoides
ttcctcggtcgggcaggaggcggggcctgggggtcgagcccaggggttttccctcccgcccaacccatgctgaccagggccctgcgtgggcagcgcccggctcgcgccggacaccagcaccagggccc

SEQ ID NO: 18751 - DNA, 333 bp, Chlorella protothecoides
cgaggcatgatacatccatgatggacgcagggagagccgtgtcccgcacaggacactcgctggtacaacaaatgcgcgtcgtggctttcgggggcgaacagccggagatcagggtttgtgtcggggctagtagggcaaggactgtctcacaagttcttacgtcagccagttccagttcatcacgatcaaaatctctgcagggagggatttgtttcgagccctggggagggccccgaagattacgtcactgtgtgagggccgggagttaggctataggagtcccagatcggccatcccgggacaatactaatcgcccagtcaggtgccactcga

SEQ ID NO: 18752 - DNA, 75 bp, Chlorella protothecoides
cgtttctatgatattaacaaatttgacaatgcctcttgcgatgcattcgcatccctactggccacgacggggtct

SEQ ID NO: 18753 - DNA, 79 bp, Chlorella protothecoides
ttacgaggcgcaccgagattcccccagacgggttgaaagctccaagtcaccggcagccccttcacacacttcgagtgcc

SEQ ID NO: 18754 - DNA, 123 bp, Chlorella protothecoides
ttgccgtacacatcgtagatgtcacgcttatcagggttgctcagcacctacgaaaatttgggggacaggtatgcattggggacaggttttgcgggcatcagaggaaaggcgtagtaacgacga

SEQ ID NO: 18755 - DNA, 61 bp, Chlorella protothecoides
cgatctcccgtgggacgactggcaaggtcggacaacgcttgcggcctggggaaccacagcg

SEQ ID NO: 18756 - DNA, 80 bp, Chlorella protothecoides
aagggggagggcacagctacagatagctggtggtgtatgctcaagcacgcccggctggacgcccgtaccatcccagctgc

SEQ ID NO: 18757 - DNA, 103 bp, Chlorella protothecoides
cggggggatccgccacgactgacatgtgcagactgctctcaatcacacttgcattcgatactataccgttcttatgctggttcaacccaacactcttcctcgt

SEQ ID NO: 18758 - DNA, 94 bp, Chlorella protothecoides
cccattcttggacggttcgaagacttgcaagaacttttgaaatgttggtcctccccgtgctcttatgtgtggaatctgtttgtataaacctgtt

SEQ ID NO: 18759 - DNA, 61 bp, Chlorella protothecoides
atggtggacgaggcgcatgaagagcatgcggacctcaggatgcagcagctgcggggacggg

SEQ ID NO: 18760 - DNA, 467 bp, Chlorella protothecoides
  modified_base (172)..(349): a, c, t, g, unknown or other
cttgctgtgtcgagggcagcgcgcgaggttcagactgtgttggctggctgcgaggtgaactgctcgtggtgtcgcgtcgcatgaagcaccgctctgcagcgcagccctcgtcggcgccgccatgaccaatcctatccctcttccctcccagatgggcctggcgtacgacgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggacagagggtgggcactgggggtgctgacaggggagttggaaatgacgtgaagcggtagggggctggcaaggggtagggagagacccagcatgtgcctgcctcctggattggtgac

SEQ ID NO: 18761 - DNA, 90 bp, Chlorella protothecoides
ttatattttgggtgatgccaagtttttaatgcaagtaaactttcaaaccgtaatgaaaaaataatgcgcgcaacaagaattaagccagca

SEQ ID NO: 18762 - DNA, 250 bp, Chlorella protothecoides
gacctgcctctgcccccattctgcgagctccggtccacaatcggccgggggacagatggagtttgtcctcgcgctttgtcgatcatccgagtgaagcacacccgtaacattgacacgatatcgtattgttcgataaactattagaaggccccgagtgcggcttgctctgttggatccgtcccgccgcaaacgcgcggccgcaaatgctaggcttgtgaaggttcttgcccctcggcgaccaatctgggac

SEQ ID NO: 18763 - DNA, 80 bp, Chlorella protothecoides
cgtggccaggggccgccaggcgtaggtgattttgcctgaatagggtctcgagggtgggtcttggtgcttgctgacatgga

SEQ ID NO: 18764 - DNA, 61 bp, Chlorella protothecoides
ggcaatgaaaggcaatcaccccagcggataccagcacgcgcaatccgctgagagccgcgga

SEQ ID NO: 18765 - DNA, 61 bp, Chlorella protothecoides
ccggtcttgcgctgccagaccagaggctggtggcaaggctgcacacagagggcaagatcca

SEQ ID NO: 18766 - DNA, 2951 bp, Chlorella protothecoides
ccggccggctggaccggcgcggcgcccgacggccctggcggtgcggctgcgggcctgagcgtgcagccgcccgcgccggcaggatcaaacgcctcggcgctggcacggggactggcgtgggcggtggcgagcgcgccgcccgcgccccgcctcgccgccgtgccgctgacgaccctgctctccaggaccctggccatgctcaccccgggcgtgcctgcccagcaggcactggagccgggcctcgccctccgactgtttgacgcggtgctgacgcgcgcggcgggactggtggggtcggcccgcgactccagcgccttccgccgacgctggccgccggcggaggtcgggacggggacacccctggacggctggtacaccgagcaggcccagaccaggatcctggctaccctggcggccctgaggctgcggcggggcgccctgctccaccgcccaggcgaggggccgtgccgggggcgtcgcgtgggggatgggaaaggagggttgccggggtggatgcctgcgagggcagcgccaggcttgtgctctgctcctgacggccggacgcacggcatgccagggcctggtcccaggcaggtgcctcgcttgccccacaatgccaaccgtgtgcgatgccgcccctcctccctcactccgtgcaggcggcggaggctgtcccaccctggtcacgctgcacatgctgctgagcgctgagggcgcagactgcagcgaggtgatggtcgttgccccgtcctcagagctggaccgcctgtccgggcaggccatggaggccgccccgccctgccgcccacgccacgtcgacgcgtggcagccgcccctcaccccgccgcctcttcgggctctggggtcgacgagccggaaacgcaagctgtcgccgcaggtgggggcagtggaggcgaggggggcccgaggtcggggtgggtgcatcgctggaatgcgaaagaggaacctttccgtgagccagcagacgatgccgatgtacagcaccttcctccttggcatatgctccaattttaaaggcagaacgagccatctcggcgctcaattcgatgggctcacccgccacctcatcgcctttccaggagaccatcaagcaggagagtctgatggacaaggtgcaagcgctccagctggacatccgtgcagagaagcagagttttgaggccttgagcatccagtcaagcaagccagccactgagatcccgtctggctgtgggggccgagcttccctggaaatgcctgacgcccccaccagaactctggacgcaccaggcggcagtggtttggatgtgtttgagcttgccagagaggcgtcagctgaactcagggcatggatggagcggtgaggggctgatccttgctgccaaggcttgaccatccgagttttgccccaagcggtcatccctgtaccagtatccattgcggcattctcagtgtcggggggggggggttcagtatcgaaaatcgacacgagatgcactaccaaatgccgcaagaacccatgctggacttctgtcagctgcatggtggcttctgcagatacctgcccatgctcagttaggtttgatcagccctaataactgactagtgggggaaaggggcccgggagggggtaaaaaggcgagggcggtggcaaaagaaaagttgcagggtgaggcgcacaagccagagcgagctcgagcagcatcaggatgtttttcgcccgttcacgtcccggttgacgatggaattacagcatggctctctagacgtggctgttgcatcccgttggcatcatggttcggtgtgaaacgccattggcttggtggcagttgctgagaggctgcgtcgagtcagccaccctggggtgccacctacacaaccctttgtactcaattccagcaaagggtttgtgacattccggagcccattagggcgaacctatgaagataaactgaaaatgactgagcccagtcgtattgtaaggaaggcagggatgttttgccccccggaaagggtccggatccggaatgagaaggaggcgaggtagctacaggatgagcggggcggtgctccggatttacaccctcgcctggatgtcactggttgttagagttatggcatgaatgaacaagagcggacagtaaacaaggacacatggagaattatgtgggtcggtgaaccttctcatcagcttagggactaagagaggattacacccggcccctgccggtccctgccggcggggggaagtacgctcaaacaccaccatatgggcaccactgggctctgctcgccaccaaagtccaagtattcaacacttaccgatgctctcgggttaccccgacaccatcgcacgaagcagtcttcagctcgaacttcttcaagagtcggacaaagggaactggagtcgacggggaaaatagcatacccctctgaggatggcaggcagtgcaggaccaaacatgggttcatcactgcttctcctactgggtttcgccatcctgctgcagacgacggtaagatctcggatgcgtcagttcagagtcgttgagagactccatgtgcagtcggcgtactacctcttccccctcacgtcgcagatggcttgtaagtcaacctttttcgctctgccaactgcaaggtgagtgagggttgccgtgagatagtatggcgtgcagacgttatccgatgccagcgtcaccatgcctgcgagctccaccgccctgtccggtcgggcatgactgccgggatatgtccccccctgcactttgccaagtacatccatcttctcgctatgcacagatccggacacaaagtcttcctactgacggatgacagcgccgacagcttttgcaagtagggtctagagcggatgtggatgattcccctgtagccgttcttgctgtgttcatgttgcgaccacaggcgtacgtcattttagtttctgattt

SEQ ID NO: 18767 - DNA, 76 bp, Chlorella protothecoides
tgcttgtctcaaagattaagccatgcatgtctgagtataacctgtttactactgtgaaactgcgaatggctcatta

SEQ ID NO: 18768 - DNA, 251 bp, Chlorella protothecoides
cagaaccacgtaataatactccagaaaaactccaatccatagcttgttcagcagaaacaaccccaacatcaacaagtctttgtttccaaattctgttagaagtcagcatttcttcgatttcatcaatacgtgatgcaaattgtttagaaaatttataaatatcttcacataaacctaaaggtaaatcaagagatacaccacccggtctaatataagcagcatgcatacgtgctccagaaactctctcataa

SEQ ID NO: 18769 - DNA, 64 bp, Chlorella protothecoides
gtattcggggtcttgttctgtaacattcctgctataggtcatatacagcagtccacgttgtggg

SEQ ID NO: 18770 - DNA, 83 bp, Chlorella protothecoides
gggagcggggacgccgcccaggccgcggtcgatgccgaaccccgactccacgtcccagggcagcatggaccactggccgctgg

SEQ ID NO: 18771 - DNA, 77 bp, Chlorella protothecoides
ggcgccagaactcggatgactcggtgttccagccggcatcccctccggccccacccctgctccccgcaatcccgccg

SEQ ID NO: 18772 - DNA, 61 bp, Chlorella protothecoides
tcacacggtcatgacgaagtttgcggcagtggcttaagcatattgtgcccctcgtggcgcc

SEQ ID NO: 18773 - DNA, 61 bp, Chlorella protothecoides
cggcttctcgagggaggctttctggcgggcaccaccgtgaagttcccctttctgcgccgtg

SEQ ID NO: 18774 - DNA, 74 bp, Chlorella protothecoides
tggtgagtagggatggcgcctgccttgcatgtgtggcgcaaaccgtaatcaacaaacaccagtctttggggtag

SEQ ID NO: 18775 - DNA, 129 bp, Chlorella protothecoides
ttggattgtgggagcatactgccgcgaggtcgtcacaacatttgcaagggaatacacacaaagggctcgtatgatgatacaatgattcctcaagatcacaaaggttggctatcgcaccagaggctgggg

SEQ ID NO: 18776 - DNA, 61 bp, Chlorella protothecoides
tgggaggggtatacaagacatcctttccaaatttggccctgccacttcctggtagaagaga

SEQ ID NO: 18777 - DNA, 61 bp, Chlorella protothecoides
cactccaagttttactatgtgggactcccaaagggatcgaagctcgtccagcacggctctg

SEQ ID NO: 18778 - DNA, 172 bp, Chlorella protothecoides
ttttttttctttttatcgcattatttcttttcaacaaggaattttttagagtattgttaaatttagtagaacgtaattcacgaaataatttcggtgaagaagacgctaaatttggtttattatcagacgttacatttaattttaaatgatggtcgcttttctgagaattttt

SEQ ID NO: 18779 - DNA, 3847 bp, Chlorella protothecoides
  modified_base (951)..(988): a, c, t, g, unknown or other
  modified_base (1450)..(1459): a, c, t, g, unknown or other
  modified_base (1679)..(1688): a, c, t, g, unknown or other
  modified_base (2297)..(2306): a, c, t, g, unknown or other
  modified_base (3144)..(3153): a, c, t, g, unknown or other
cccacccacccccacccaccccctgcaggctcggccatctcctccatagacccggtggccaccctggccgtgctgacggacaccgacgtcccccccatgctgtacaacctggtgtttggggagagtgtgctgaacgacgccgtggccatcgtcctcttccgctccctggccaagttctatgacacgcccatgggcctgagcagcctgctgggcgtgctggtcagcttcgtggccctggccctgggcagcctggccatcggtgtggcagtggccctggccgccgccttcctgctcaagcgtctggagcggccggcggcggggcgcagccacgtggatggtacgctgtacgagatcgccatcgtggtcatgggctcctacctcgcctacctcctggcggagctggctggcatgagcggcatcgtcgccctcttcttctcaggtctaggctgctatttaagttttgctttctgcgggggggagagggtggccggagggggggctggtgggtaccgctgccaggggccgagtctggagaatgaccccggtgttcccaggggtgtcattggcatcacatcccttggtccagcgactcgcatgagtaccccttgctcaacgatgctgccaccccacaacccccgagcacaacaccgtcccaccaagtgatgcgcaggcgtgtgccatgcacactactcctactacaacatcggccaggatgcccagatcacccttcgcaagctgtcggagttcctggcctttgcctgcgagatgtttgtcatggcctacctgggcctccaggtcgcaacgatgcatcacaagttcgacctgggcctcttcgtgacgggcgtccccctggcagtcttctcccgcgccgccaacgtctttccctgctccttcatcctcaaccagggtaagcaaagaggggaaaaggggggggggggggggggggggggnnnnnnnnnnnnnnnnnnnnnnnnnnnnnnnnnnnnnnggtttggtcctggtggctcatgtttaacaaagggtctctccccgtgcatagcatgcatgcatggccaccctggcgagtgctttctctggaccacacacgaacacccctcagggcccccctctcctcccacgcaggcctgcagcaccgcatgccccgcaacctgcagctcatgctctgggcggtgggcttgcggggcgccgtcgcttatggcctggtggtgaacctcccacgcagcgacgcgcccggggagacgggcgtccccgccatcgagaccgccacgctcttcatcgtggtcgtgtccaccctggtcatggggtctgccacaggtaggagcatgcagccaatttggtagtatcgggttggatggtgggtgtggagtctgcaccccacgctccgcgtgtgcgtccttccatgcactcatgcgtctgaccacttggcaatgtatggggcccctcaccggcnnnnnnnnnngatttggtagtatggggttgggtggtgggtgtggagtctggaccccacgctccgcgtgtgcatccttccatgcactcatgcgtctgacgacttggcaatgtatggggcccctcaccggcagcgcccagatgggttgtcgtataccgttcagtgtggcactcccctccagcctagagcgtcccacaacacctcctgacggcctctccccacttgccaggtnnnnnnnnnnctcagtgtagcactcccctccagcccagagcgccccacaacagctcctgacggcctctccccacttgccaggtccactgctgacggccctggacctcgtgaacaaggacgacgcccagctgcaccaaatgtccctggccgaggatgggctggccagtcccatgcatggcggcccggagctgggccggtttgaggtcaccatccgctcgtggacgcatgagaagttcaaggtgcatggtgacattgttgtgggaaggtgaatgctcggcccccaggtgctggctgtgggaatccggagcgtttgtgacgggcaggcaagcggcaccccggccccactgatcccctggtgcaggagctggatgagctcatcctgaagccgctgtttgggggaaacagtaaccgaacggaggactgggtccaggacgccaccatcaggtgggatgcagcgtgcggagtgcgatgggccgatcgttagatcatgtgtgcatggccggctggtgccgcggatcccatgctcggagtttcatcctcttagagcctcgccatgcatggttggagtgccatcacgtgccaggcgtgtcagctcccaattccatgggttctcagatcnnnnnnnnnnggagcctcgccgtgcatggttgaagtgccatcgcgtgccaggcgtctcagctcccaattccatgggttctcagatcgtctggcctaagctgggacggcggggatgattcaaggagacccagcctggattctctgcaccgcctgccccaccccttccagacaccagtcgccaccgaaatgtgtgtgatgctgtgggtggggggtgtctaagggcaggtctgttcagtctgcagtgtgttgcttgtgcatcctccgccaaagaatgctgattatgaacaggaagtctacattgttgccctgcttcacatgcctccctcatcttcaagcatgtgcaggggctctggtgccttgacacccccacagagattgactagcccagaacatgtcaggggcggcgatgatggcacagaggcagcagaggccgaggagcatggaggcctcgtggcggttgctgcagcacttgcaccgccacatgacagccagaaagccccctccacccccaatggccacacttgagacaggatgtgaatggtctcattttgtagttgcgtccctgggaaggaggggagcacgtggaatgcgttcctgcagtcgcacttgcagactttcccccacgactaatcaaggcagatgcgcagcggtggcctttggacgttgagcttgtcaacaacagcactcaccaatatagaagaatggatttcgacaggctcaccctttgagatgttcccaccggatcttttctcttctcccacacttgcatcatctagacgagagggcttactcatgcagcccttttgcatgttcctcctgaccggcatcccaagcttgaagatcatgcnnnnnnnnnnccttctcccacacttgcatcatccagacgagagggcttactcatgcagcccttctgcatgttccacttgaccggcatcccaagcttgaagatcatgcagcaccttgctgcctgggtgggactctgtgtgcctgctcgccccagcaatggagccttgatacatgtgtcgagcatcaacacagcagcaagcctacaagcgctctgcatagaaaaggcgggaaaagtagaacttggtggcagtcatctccttccgtgtcaccttgaaccctgctgatgccagagccgcttctatgtctgcctcagcgtgcaagtatgccctcgttgcctggtaggggagttgtgggtggagggcaattaaacatgggagacatggatcaaatctgacaatcagggaaaacacgagcattagacagtggacacatgctcatgcagggagtatgcaagctgttcccatcatatcaggcatcccaggaagacccagtcaccttggatggccccggaaagaggttgcccacacgctgcagccaggtgtagaaaaaggtcttgggggcaaatgagataatcaacctcttgtccgccaggcccgccaagtgcttaatcataccattcaccttgtcctacatgtgtggaatgttgagatacagcataacgcggtcgaccagtgcatactttcatccacactccatgcatacatt

SEQ ID NO: 18780 - DNA, 89 bp, Chlorella protothecoides
tacatccagtcaccccacctgtcattcttcatgaggttgggcatgggcctgacccagatgtggtccggctccatcatgagcacatactt

SEQ ID NO: 18781 - DNA, 76 bp, Chlorella protothecoides
atccttggtccctgggggccgggtcctcgtgagggactatgcgcggggcgacctggcacagtcgcggctgtcggag

SEQ ID NO: 18782 - DNA, 118 bp, Chlorella protothecoides
aagtccagggaagagtgtctcacaaagcatcccaaagaagatgaagggatgcaatgtctttgtttgttctgacatgcatgtgtaagtatggtcttgcatccctgctcatgatggaagc

SEQ ID NO: 18783 - DNA, 65 bp, Chlorella protothecoides
tgctgcggcccatctgcattgatggtgctgtgagtcccatacagctgccggtggtggcgactgct

SEQ ID NO: 18784 - DNA, 65 bp, Chlorella protothecoides
tggacgtgcatgaatggacgtgcatgaatggatgaacgtgcatgaatgaatggacgtgcatgaat

SEQ ID NO: 18785 - DNA, 4557 bp, Chlorella protothecoides
  modified_base (521)..(530): a, c, t, g, unknown or other
  modified_base (1702)..(1726): a, c, t, g, unknown or other
  modified_base (1792)..(1801): a, c, t, g, unknown or other
  modified_base (3891)..(3900): a, c, t, g, unknown or other
aggtgcgccgcgccgcgcgccggggtcgtggcgccgtcggccccggcgcccgcctcgccacccccggcattgcccttgcgccgcgccgcggcgcgcacccagcctacgtaggacagcaggaaagggagcacggcggccaccacctcctccccaccgccgcccagcgcgcggagcagcgcggggaacagtgcgtccagcagggcgcaggcgccgcgcgcactggcctccgcctcgcgccccgcctcgtcgtccacggccaggcccaccgccgccatcgacagcaccgcgttctcgatcttcttgaccgcctccaggatctcggtcgccaggcaggccagcaacctgtcattgtgtatcataatgagggggagaagagggaatggaggtgactgaatgtgtggcttacaagtgaggatcctggtgggggggggggcactgtgccaggctccacgagtaccccaacattttcgcagatgggtaaggcaactttgcttccgcagagagtccccaccttccctgcnnnnnnnnnngatgtgtggcatacaagtgaggatcctagtgggggggggagcactgtgccaggctccacgagcaccccaacattttcgcagatgggtgaggcgactgcgcttccgcagagagtccccaccttccctgcatgcgtcagtcctgctccgttttacctcacccgcactttcaaggtaccacccaccgcacccccccccttctcaagactcccccacccccttggtataacggtatcagccgccttgcctggcgtatttcgcggcgagctccgacccggcgtcgccgtcttcggcccccggcaggccttcagcccacttggcggcctccggcaccacgcccagctgctggatgagggccagcttgggctcggcctccatgcgcttgcccacgatctcgatcagcacgcccgctgcggcggcgcgtaggccctcgtcccgcgatcccagcacgccgaagagcagcgggacgaagcgatcgttggccaccaggccaatgtccacccagtgcacgtagcgggccagggcacggagcagcgcggcggcggcgggcgggtcggccgcgtggctggcggccagcagctgcgtggccgccgccgccacgtcgggcagcgccaggtcgcgcatggcgtccttgaaggccatgctggcgcgcgcctcggccgccgagcgcggcacctccagcgacaccacatcctcgtccaccgcgaccagcacccggcagaagaggtcggcggcgggggggccagcgggcagcgtcgcgatcaggtcctggaagaaggcgggccaggcggaggggaactcgcggcaggccacgcccaccagcacctgcgccagcttggcgcgcaggaagggggccaggccggggtcgcccagcgcggtacccaccagcgccgacttgagcgcgtcacgctggtcgggggccagctcgccgtaccgctcgcccaccaggccgtgcagcgtctgcaggcaccagaattttacctcagcgtgggccgaggagcgaaggtgggccaggcagagggcccaggcctggggacccgcgcgcgcggcctccagcgcggcgccggcccgggccgacacgtcggcgggggcagtgccgggctgggcaaaggcgtagaacaccgccttctcgaagtcatcggccatgctgggggggggggggggggggggggggnnnnnnnnnnnnnnnnnnnnnnnnngtgggaggagtttgcgacaaactgatcaggggagttaagggtgcagtgggacccaatgccgcgggnnnnnnnnnngggaagagtttgcgataaactgatcagcggaggtaagggtgcagtgggacccaatgccgcggggacaagccagggagtggcattgacagcctgggtaggcaaataaaggcaccccttggtgggcccctggccgacatgctaatctcgcgccgcacgacaacatagagggcgccgtcgacacaccttcgagacctgcttcagctcccgactcccctccaatgcagtctcttcagcccagcatcccgcggtggtcccgcgccggccagaggacggggcgagtgcaggtgggggtgtgcggcgatgattccagcggctgtatgccacgatcgggaggattaagcgatgtcaatcggttcgatggaacgggagggaggtgtctgtaatgcctcctagaggagcaagcggtgtcttgaccaggctgcttgggaaggcccgagactcgtttgcgcgcgcgagcggtcacggctggcacggcaagtgccctcgaggggacgatccgccatccaacacgtcatgcagacgagtaatgtcctggagtcagtcagcatgagcaaggctcaggcatcatttcaagcattgcatgagaacaagggtactggaaatccattggatcagttgtcagggaaaatgagcctgcactgctactcactcatgtcatactcatctatgcgtgaaagagcactgggcaggtcaggggcttgtgccaggcattgtgctgcgaatgcagcatgctcagagtcaatgcgaagccaaagcctccgggcatgcctgcatgctgctctggccgactgcagcgccgagcccaccacctcgtcgactcggtcgcaccccacctgctccaccagttgggttccatggaacctgccatgctcctgcctgccgtcccaccacgttgcccggccgagcccaaagggccgcccatcaaaggagccggcaaaatccctgcgccaggcctggctgggaccccctcctcccgcgggtgggggcgagaagacgtgcaggcccctcccccagacagccccgtcccgccagcttccagcgtaccagtcccctgcgccggtcagcatgacgcccaggcccgtggccaggccgccgctgccctgcccgatgtagatggaccaggctgctccagactggggtggcgaggccagggggatggaggggtgagcatgaacagagcaggcccctgcagcataccagcagccaaggacagtacaggcaggatgagcctcccttggcccctgctcaggtgcgcaccagggatctgaagaccacgctgctgtcgacgccgtgtccatcactggccggcccggggctcctcagcaccagcactgcccgtccaccttctgttgagtgctcaaccgccgatgcagcgacaggccaagatcctttctcaaggctgatttcgggacccgcttcgatctgctgtcggagcttgcgtcgcagggcagacagggagttgactcccagggattccaggaaggctggcaggggtgattgtagagaggcgtgagcgatgtccccatctctgctctacgttgggcttgattgcaatcggaggcgtatgcttatggtgcattgatggtgcattgcggcaccggtcgggccagagcatcacctgcgagatttgcacgcctaggcagaggagtgtgtgtgtccgttcccgggaaacagtaacccgcgtccacagcggcgcactgcgcgtcttctaatgtgaaggaaggtgctagcaacatgtcaagactcgatgtgaggtgtgggtgcttcaatcagccggacgcttactcatgcagtcaacgatcgagtataactagtctccccggcggaatgatgggtgacgtggagcaggatgtcctgtcggcttttttagcatttcaactatatagcattctgttctcaatcatacacttgagaaacgtataggagatagagcaaaatatctttattaaagccgaaccgcgataaggtcataccccggtgttggcccaggctgcacgtccggtgctcaagctcgcttattgttacgctttcggcagcagctgagtctgcctgagagcatgccttacaattgttgagacaccgtaccgcannnnnnnnnnccttattgttacgctttccggcagcagctaagtctgcctgagagcacgccttacaattgttgagacaccgtaccgcaggcacacccagagccccttgtgtcgtttttttctgccaacatggcgggccgtgtgcaggcccagtgcagtttgaagggcgagcccatcttcaatttggatctggaagctagcgaaggtgaccgggggggggcggatttttctctcctgtatgcatctttgaaattggactcagcgccaccaagtgataatagcccggtgcatccacttcatcacatgttacctttctcatgctcctgacttccagtgcccatctccaaacaagtggacatcctcaagtccaagttgatgtccttcttcacgagttacatgaagtctgagaacatccctgtgacagaggacagtgagtccctggcgttgacctgcccatgactagaagagccaggaatacccaaagtttgcatgcctggtgttgagctctggtcgatgtctgccagcatcttgctcaaacaccattcccttttcatgcacagtcaacctcatggaggaggtggacatggggcaggaccctgactcacagccgcagaagccagcaggaaggaatgctgggaagaagcgcaaaggccctagggtgccctgaaa
